United States Patent 7,572,902 (NUCLEIC ACID MOLECULES SEQ ID NO. 16372 AND OTHER MOLECULES ASSOCIATED WITH PLANTS) - sequence listing, part 3

SEQ ID NO: 10890 - DNA, 626 bp, Zea mays
  Clone ID: LIB3279-183-Q1-N6-C4
caccgaaggtttctaatttatttctcagatctcaataaatgtacaaaatgtgtagggatgatgtacattgtatgctcagttcctgcattgcgtgtttcgctttacagaatatataaactacagacttggctacagcctacagccctactcctcggcaggaggatccacccatcggccatggtccttgatcagctggatcaaggcgtcagttgcaccttccatggcgatggcgcgctgcacaacggtcttgccaacataaaggtcgatctttccgggagcgcctccaacgtatccgaaatcggcatcagccatctctcctggtccattgacaatacaacccatgatagcgatcgaaacacctggcagatgagaggtcttttctctaatctcagcgctgatttcctgaaggtcaaagagtgttcggccgcaggaaggacaagacacatattcagtttttgtgttgcgcatcctgcaaccttggagcaagttgaaagatgtgtccctcaggaactcaaattcctggtcagcagcttcaaggaatacaccatcaccaagaccatcgactaagagagcaccaacgttggccccagcaccaatgacaagaccatctctgtcaatggtttcag

SEQ ID NO: 10891 - DNA, 607 bp, Zea mays
  Clone ID: LIB3279-183-Q1-N6-C6
attagaaacttcaacaggggtaactgattcattcagcaattataacaaattctacattgttgcagaagcaacctagcacaggcctaaatatgagaattaaacaggatcgtagcaacgtgcggcggcaccctaagaggatggaaacttggtaaccgccttggtcccttcggatacggcgtgcttggcgagctcgccggggaggacgaggcgcaccgaggtctggatctcccgggaggtgatggtgggcttcttgttgtagcgggcgagcttggcggcctcggcggcgagcttctcgaagatgtcgttgatgaaggagttcatgatggacatggccttggacgagatgccaatgtccgggtgcacctgcttgagcaccttgaagatgtagatcttgtacgtctcgacgctcttcttcgccttcttctttcccttcttctcgccgccctccttgctcggcacgcgcttctccgcccttggcttcttctcggccttctcctccgccggcttcttctccgcgggcttcttctcggccttgggcgccatcaggaatcgatcaaatgggtcgcggaaagagatggggaaggggcggctcgggaatttgctggtg

SEQ ID NO: 10892 - DNA, 434 bp, Zea mays
  unsure (1)..(434): unsure at all n locations; Clone ID: LIB3279-183-Q1-N6-C7
gggggggggggtttttttttttttttttttttttttacacaaacaagaccgatttttattaaaaacaaatcaatagagccagagacgcgggtgctcgttttgcgcatccggttcttaaaaaaaaagaacaagaaatggggctcggggggggggggggtttttttttttttttacggnnngcacgggcgaagacgggccggggaaagaggggcggcccccccacccccaagcngnngcngcngcnncccccccacnnccggcagcagagcccccaacaagccccaaaccaccccggcggccgccaacgggggccccacaaaaaacnccgnccacagcccgcgcccggacaggcgggagcggaggccccngggccngacgnccaagcccnngaggggcccgagcgccccgaacaaggagnagaggggggacgccgg

SEQ ID NO: 10893 - DNA, 593 bp, Zea mays
  Clone ID: LIB3279-183-Q1-N6-C8
aagcatgtaacgagataacaggggttccagttgggtgatgatcatttacatcatggcgggcgaacaaaacaggagcagctacactactgctgggaagtaccgacgaacattacattacaaaatactggtaacaacataaaacggccctaggcatttaccagtctccacctgctacattcttaccttaactactctggaccaacatgcgccagtttactggcttaacactggccgtactccttcgcggtcagataatttacatagtttcagctctctcaggtactgctgagcccctcctctcccagatggtgcagcaatatcaccttcacctgcaaccggccctgcacatggggtaccaagaccaaaaactagaccatggcagccgcctgccctcctagctcccgatatgcccaaagttgacaccgttctgccgtctaatgtgctccggtacaagcctgttgatgaggtccggggaggcatttgctagctcatgtttgaagttaaagagcggaacgaatggacggccgtttggtagacgtgcattcggcgcccgcagtttatcaaagaagggagagccgctgcatcaagagcag

SEQ ID NO: 10894 - DNA, 510 bp, Zea mays
  unsure (1)..(510): unsure at all n locations; Clone ID: LIB3279-183-Q1-N6-C9
taaaataaaacccctggggtgaaaaggggggatccgggtccagtncagagttcctacactccgggtgtgtaaaactctcctcatgacatgtgcagtgttcaccgaagagcgaagttcccctctcactcaaacgtgggttgctgggggacttttttttggaactnancacaaacacacagattggggcactcatcaccacagatcgatcgatcgccaccaactttattctaacaacacggcagcagctgctgtccacaggtggctatgccttcaaagctccagatcatggtgatgaccagtgcagccgcagaacagcacatttaccaggggacgatctttcagcgctgggtggcgccctcgcgccacttccagagcacgatgttggtgccgtctcgcacgccgccgtggtccttgtcggcggggaaggcgttgaagttgcggtagatgttcgtgaccatgcgggcgcagcggcagccgtggtcgacgtcgctgctctccgttccgtcgctg

SEQ ID NO: 10895 - DNA, 483 bp, Zea mays
  Clone ID: LIB3279-183-Q1-N6-D1
taacggcgcctgtttttttttttgtttttttttttttttttttttttttttttgcagaaacaaataccgaaagaagaattaccgtatcacttaagggttgccagtagccgcgataacatggaaccgaccgactatcacgagggccaaaaaaaataaccaccacaaaggggcgcggcccaccacaaataaaggttaagggggcacaccggaccgaccgacgacgataactcgggggagggactgggccagccagcaactgcagcacgctcaagactgacaacaaaccggttagtccacctcctcaatcttggggccagggccgccgttgccagcgggggcgtccttgtccatgccggcagggccgcccatgttttaacccgggccctggtacattttggcaatgatggggttgcagaggctttccagctccttaattttgtccttaaactcgtccgccttggggagctggttggcgttcaacca

SEQ ID NO: 10896 - DNA, 552 bp, Zea mays
  Clone ID: LIB3279-183-Q1-N6-D2
gaagaaaagtacttcccggaagataaatgttaaagggacacaaaccatatttcagagataaaatctgcagaactattctacagtttataacttattgctctccagtaattccataatgtgaacagtataatctcccccaacaagatccacaacattgagagataaaaaccggtacaaaaagatcggatgaattctattgaatgctcaaagatacaaaaattggatatcaacaatagaactccaactgcaataagactacttatgggcatatagataagatcataactcttcaagtgaccttacaaagttaagctctcaggatcctcaataatctttgcaaaagtttgtagaaatgctgccaaatcagcaccgtatacaatcctgtgatcagcagtgacattgaccagcattttgctcatgacgctaaagaaaccatctttatcagccacaactgtaggtttcgaggctccaacagccataatagctccctggccaggtggaaggattgcatcaaaccgatctacaccaaacatacccaagttggacagtgta

SEQ ID NO: 10897 - DNA, 489 bp, Zea mays
  Clone ID: LIB3279-183-Q1-N6-D3
atgaagagcgtttattgagaagtgtagtgcatccatgatccatggattcgaggtcgagagaccgtcaaattttctatctcatattacagtttccacaacgacaatctggacgaggggggggggcataatttttttttttattacttgcaaattcgctggaaacgacaacacgcgtacaggacggacattcacgaactcaaatccaacgcaactcgaccaaccggcccgccgaccggtataaatcacgcggggacggcgagcagcgcggggaaacggttggccaggctgcggacggggctgggggacaccgcggagtcgccgccgaggtaccaggtctggatcatcccggcgacgttcccgttctccaccgcgatcctggcggggcccttgccctccgtcgggaaggggatctccgccccgggtcccggggaggcggaggccggtgcccggaagtggaaggggacgacggagcccgggttgagatacttg

SEQ ID NO: 10898 - DNA, 422 bp, Zea mays
  unsure (1)..(422): unsure at all n locations; Clone ID: LIB3279-183-Q1-N6-D4
gagacgaaacagtatctctcccccagagggcaaacttgtcgcccaacataagaggttccaagtcaaattaaaacatcgcagtcgcagcaacatattgatgcctacctaggctgctctgacctgtcaaagctggcgggcattttctttcctatcataacacttattaacaccttttcctttcctaacagaaattaacacgaattgacccaacgaactactcgatggctactgcnaaaagagaaccttctgcgcgcacgaccctctcttcctgccagtcggcagtcataccgcgccaagctctgaaaggttggaaccggcctgctactctgccttggatcctttgccgaccaggcttgcgaaccctttcctggcttctctgtgcttcttgtgaagtactctgaagctctggtcttgcttttccc

SEQ ID NO: 10899 - DNA, 504 bp, Zea mays
  unsure (1)..(504): unsure at all n locations; Clone ID: LIB3279-183-Q1-N6-D5
ggccgcccttggggggggtggtgtgcagtaaaagaacaccagggtaagaatgacggtatatgtacaaagcacaataaactaataaaaacaaatacagtaagcaccacacataaatcttaatccctttgcttctctctctagcttcacgtgattatggtctgggggtgacgggcaaatttttttttacctacaaagacaaatggncctacctagaaaagtggtcgaggaagttgaaatctaaaagatagatactatacgctagtgctagcaatttattcctttgttgtatataaaatgcaaccgatttgaccttagctaaaatccttaagccttctcttcaagacgtccatagatttcttacgggcgctctgctggggggtgttccgggtcgaaaggcttccggacagactgtgtgcgagagccttgtgcttttcacaaatgatggagggggttttgtgggatcatggactctgggagggtcttgctggatccccgggttcatgt

SEQ ID NO: 10900 - DNA, 593 bp, Zea mays
  Clone ID: LIB3279-183-Q1-N6-D6
agtacagcagtactcgaacacagaagatcgccacgagtaatcttaattttaaacttgtttcaagacaaaatcttagggccagatgaaaacacgtagccaagacaactcaataagttcacgtcataagcaacctcatgggggggcgggcctagattcagaagtagcaaacaaactactcggcagcagcaacctcctgcccagcctcatctccctcgacaggcctctcaagcttcacaccaacatcctctttgtagtcgccatgaacctccatgagtttcccaagatcgaacttgggggccttgagtatcttcaccttgcggatgaagacgttttgaagtgggaagatgctggaggtagacttctcaatctctttaccaataacttctggaatgaacttcgaaacaagttctttcaggtcacatgtagaagcctggttgatcataatctcaaccatcttacggcggatctgacggatctgggatgcctgagcatagcaggttctcttgacttggtttgggcgcctcttggtgaagccgatgcagaacaaacgcaacatgtagtttgtcggttgtcttgacatcaacatgggcttc

SEQ ID NO: 10901 - DNA, 477 bp, Zea mays
  Clone ID: LIB3279-183-Q1-N6-D7
gtggggggttttgtttttttttttttttttttttttttttttttttttttttttttttttttttttttttaaacggggacttcaaaacatgattcagcggaatctcaaataatttaaaacattggttctggccacactaaaacactagagcggggggggggggtgaaaccttgaattacatccatcccccaaaaccgacgaataatgggcaaaagagatgataaatcaccggagacccttatctgattctaagcttcaaagggggcttcttggcttttaaggggcccttcggaatctttgataggcatttttcggagaaaagggggtaataccttttaaggtcgaccatgggcttttaaccaaaagcatcaaccttatccttatggttttaatacaggaccgggacaggggtcagtaccataaaaacttgtaaaacaaggggaggaaattggaggagctcccaaaaacagaagggtc

SEQ ID NO: 10902 - DNA, 576 bp, Zea mays
  unsure (1)..(576): unsure at all n locations; Clone ID: LIB3279-183-Q1-N6-D8
gcatcaaagagtaacaaattgcattacaagttcgatttccaacatccgatgcacacataatttcatcactgcttcatgattcaggtaagcctgctagcctcgcgattcagataaacctactagnntctcacgattgcagatggggccggccacagtttgtgatgaactaacaagagttcctgaaactttcttgaccgcaagacttgtgggcacggccagaaaacgtcgcatctgcagaaggggagaacatcgcgaggagcccatcagcctagccgccgaagccgtagagggtgcggccctggcgcttgagcgcgtagacgacgtccatggcggtgacggtcttgcggcgggcgtgctcagtgtaggtgacggcgtcgcggatgacgttctcgaggaagatcttgagcacgccgcgggtctcctcgtagatgagccccgagatgcgcttgacgccgcccctcctcgccagccgccggatcgccggcttggtgatgccctggatgttgtcgcgcagcaccttccggtgacgcttcgcgccgcccttgccgagccccttgccacccttaccgcgccccg

SEQ ID NO: 10903 - DNA, 337 bp, Zea mays
  unsure (1)..(337): unsure at all n locations; Clone ID: LIB3279-183-Q1-N6-D9
gggggtggtgttttaaacataacaacatgaactgaattaaccagtgcnacacgactagaaaaaaacaaacatcatttgacatcgagtttctaattaaatcatggctgcaactgggcagcgttattataatagtgaaggtggacgtgctggtgggggggggggtcccaatttttttcaaataccttcatcgaagaagaaagatgtactaggcatgatccggagtgtagccaccaattcttggagaggaacgacgatgatgggcgacggtatgccctcatctcccctctcttctcttcttttttcttcctctcttctcttggggcaaggcacaaaaggg

SEQ ID NO: 10904 - DNA, 456 bp, Zea mays
  Clone ID: LIB3279-183-Q1-N6-E1
gatgcaccatttcattattaacttgtagtaacaagtttcataagtgcgtcttcttttttttacattacactgcaatgcgaatcctctataaaaagaacaatcacaaggaagtagaagggaaaaaaaggtctatgctcagcccgtctattggcagagcagcaccaagattagtttttttgtccaccaccctccctcctaaacatcattacaaaatttggcttggttcccggcactccacgtgaccggtccccaccaccatctacagctcgtcgtggtcgtcgtcgacgccgccgtcggcatcgccaccgggggcgccgcccgaccgctggtacacggccgacacgatggggttgcacacggcctccacctccttgagcttctcctcgtagtcctccttctcggcggactggttgtcgtccagccactcgagcgcctccttgagggccttctccacct

SEQ ID NO: 10905 - DNA, 503 bp, Zea mays
  Clone ID: LIB3279-183-Q1-N6-E2
aaacacagcataagaataaggaactaggtaaattcagaaggtacagcggtagtaactagtaagactccataggactgttggtacgacacacacagttatggcttttggaagcaattatacccgacgggatttaagggggggggaggcccttattttttatattgaatagcaaggggtttcagctcctctccggcggtatccttacttccaaacaagccgtttaagtttctaattggcgcttcttattgctcaagttgcatccttctgccaagtttttccacaggatgtactgagtggagccagtgaacttcaatgcatggctctagtggtgttaacctcgaaaaacagcccgttatcctggaggcgctgctgtagatcagttgggccaaagacggtgccaggcgtgtataccccgcccttgggcaggttggcacgctggctcagcaggacgagggcgcactgcaccagcacgatcggagttgtgacctaaccgacctcgggtc

SEQ ID NO: 10906 - DNA, 593 bp, Zea mays
  unsure (1)..(593): unsure at all n locations; Clone ID: LIB3279-183-Q1-N6-E3
aaatctgaaagaccgcgtacgagagcacgaacctcatcaaactataatggacattgtttttgtacaatgtagtatgagaagggtactcaacaacctcctcaaacaaagaaagtgccacattacagatattaaaaaaacacgcacacagttacatttttaagtgctcctcgtctgtctgttacagaaaaagcgacgcaacgtctttcaatcatctttctcatgtctagcgccaggtagactacttccagtcagtgctgcatggtacacgcgcttctctgccagcccaatattagaaagaactaaattgccccttcgtccccatacttggcaatattttttccgacagcagagccatccatagggattagaatcgagccttctcgagctcttggggcctttacaggtgggaggccaatcatactctccaaccctcggtggatacatatattacgaagaggttgtttgatctttgcatggttgtttgactcagttttgggtttagcctacctccattgctattagttttctgacattatttgcgtagagcttcggatcttccttntctagttgagaaggatagtatacaggcaacc

SEQ ID NO: 10907 - DNA, 512 bp, Zea mays
  Clone ID: LIB3279-183-Q1-N6-E4
gagattaaattgccctcgttagttccatgcttatttagagtaaaacttcaatacacacagcttgtatagattctgaaaaaggagcacaattcatctgtagaaaaatgaaccatactaagacagggttaagaaacgatcgttctttttaagaggatgatcatcaaaggtaatattttgcccgcaagcatagtacaaagtacactacagaacattgtggaacaaatgtgtgtgcacataaactcctcaactcagcttctgcagcggtagacggcagtatcttcccaatttagtgatggtgaacttgaacataacggagaccacagtacttgcacacattaggtgcctccagatcaaggcagatgtactcaattgggtggccaagtccaacaccttcagaagccccttcacagacgggaatgcgaccatcaaccttgatcggaggtacctcgttgatcagttccattggcgacttcttgctcgtgtcctgcattcacttagcggtgtgggtgccg

SEQ ID NO: 10908 - DNA, 562 bp, Zea mays
  Clone ID: LIB3279-183-Q1-N6-E5
ttggggggtgtttttttttttttttttttttttttttggcacaacaatcaactattattgccaaagctaatcccagcagcaataccacctgctgcacaacaataaattgcatgcccgtgttggagtaattgtttcagggaagtgtctataaaagagggggggggggatacttttttttattgtttcagggaagtatctataaaacacaaaggctgggtcggtgaatggcaatctgttgctctgtacaaccttccacagaagagtagaagacagaaccccaccggtctactgggcagtagcacccacaagcaccctctcatttccaatgatccacctcgtcagctggctcgggtcctctgcgagtgctccgcacgaagggatgatggttaggtccgaccctatgacctggtaggcatccagcgcgggctggatttcgggcttcacccgtgcattgtcgagtaccacgctaagggcctccgggtagtggcgttatttttcaggggcatgcttaaagggatccagaaagcttccttgcgagcttaaaaagtgcctgttagccccg

SEQ ID NO: 10909 - DNA, 616 bp, Zea mays
  Clone ID: LIB3279-183-Q1-N6-E6
aattcaacagcatagaccagcaggtcttcttgataacgaagagtaccattcatccagtgaaggatatttaagaaaatacagagtcgaagccaaggtaaaacggcagttgcagttatagagacgaacatcatgtcttcttaggggggctaaggcttttatcagagctagccatgatcactcatcaccgatatactggaccaccagaaaaggaatagagtgacgaaaccggcgcaccggagccaccaaaccttgctgagataggcctaacgcttgtttcagcataagcagggttattctcataagcagttgtaaggtaggctgaatgaggggggtccacagcacggttagcaagtcgatcataacggtagagttcctccatacgatctgctctagtggcaatccccgcacgatcagcaatttcccgtggacggtacagctcctccacatgagcaccacgaatccggtagagatcatccaagcggtctggtcgagcagaggcctccactggaagtgctgtgtgatcactaatgattggatctctagcggttatgtttgacacagttctgtctggatacccctcaggcaccagattatcaacaggccgatagtatgagtc

SEQ ID NO: 10910 - DNA, 153 bp, Zea mays
  unsure (1)..(153): unsure at all n locations; Clone ID: LIB3279-183-Q1-N6-E7
cctntaanacgaccgccccctttgtgggttttttttttttaatatttttttgtgttttttttttttttttttttttttttttttttttttttttttttttttttttttttttttggtgggtgggggttggggttgtgtggggttttttttttt

SEQ ID NO: 10911 - DNA, 169 bp, Zea mays
  Clone ID: LIB3279-183-Q1-N6-E8
ggggggggtgtgtgttttttttttttttttttttttgtttttttttttttttttttttttttttttttttatcgaatatttggcgcccgctaactcatttttaaaacaagaacggggaggggactatgggtctgggttagctagaacatttagggggggggggggtgtc

SEQ ID NO: 10912 - DNA, 542 bp, Zea mays
  Clone ID: LIB3279-183-Q1-N6-E9
ggggggggggggttttttttttttttttttttttgttttttaggggttccacaaaaccattaaattcaacaatttgacgaattgcagaatcagaacgagaaacagaacatggggaacattagtacacaacgagctctgattgctgaagatggggttgctggggactatttttctttaagacacaagggcgaaacttgggcaggacacatcccatccacagatctagacacgagcatgctacagcacacagtgcaaatgaagtccctactttctaagccttcttgggggacttggcgcccttcttgggggacttgggctccttgctgccggcgctggccgcctttttcgccgcctttttgggcaggagcaccgagtggatgttggggaggacccccccgtgcgcgatggtgacgcctgccagcagcttcccgagctccttgtcgttgcggatcgccaggagcacgtggcgcgggatgatgcccgtcttcttgttgtctttcgccgggtccctgccaaattcagaacctggggggggaggtact

SEQ ID NO: 10913 - DNA, 296 bp, Zea mays
  Clone ID: LIB3279-183-Q1-N6-F1
aggaaaaccatgttcattgatgaccaagtcttatgggcttagtattccattagtcttatagagacacattgataaccaaattacatgaactcaatgctctaaaatcctaatagggggtggagttgtcatagatgttcaagccttatggacttgggagtctaaggaccacatagggactttatgatagatgggcaagccttatggactttgcactttagtgccttcgtaagggcttttagtaatgaccgagcctcatgggtcagcttttcaatagaaaactaagccttatgggcttg

SEQ ID NO: 10914 - DNA, 486 bp, Zea mays
  unsure (1)..(486): unsure at all n locations; Clone ID: LIB3279-183-Q1-N6-F2
aaaaactaaatatgcttttattttagggcggggggggtacattgcacccctgagattaccccctactggctaacaactgggggggggggccccagcccttttttccccacacatacaagggggatgccaaaagccaaggtgcctacacctaaaactgggtacaggccaagccttccaacggcttttcacaatcagtagcaaatcggtttgaaaactggatatcggggcatttgttgggcttaatatcaagaggcggccaaaactcgagatgctcagtaaatgccaggaatgactctgtatgggactttgttggagaaaatcttccagtacttcccgtcctttgatgagcaccgggcattatccctttttgctggggcaaacaataattttttcagaaaaatcaccgtaaaatttttggnggaagggattgaaaaaagctggaacattccaaaaaaatggaaaagtttttttgggggcccctgggtc

SEQ ID NO: 10915 - DNA, 639 bp, Zea mays
  unsure (1)..(639): unsure at all n locations; Clone ID: LIB3279-183-Q1-N6-F3
tcgcgatctagaacatctctgactgcttccctgaggttcgatggtgccctcaatgtggatgtgaacgagttccagaccaacctggttccttacccgaggatccacttcatgctctcctcctacgcaccggtgatctcttctgcgaaggccttccacgagcagctgtctgtggcggagatcaccagcagcgcgttcgagccggcttccatgatggtcaagtgcgacccacggcacggcaagtacatggcttgctgcctgatgtaccgcggcgacgtggtgcccaaggacgtgaacgccgcggtggccaccatcaagacgaagcgcaccatccagttcgtggactggtgcccgacggggttcaagtgcggcatcaactaccaggcgccaacagtggtgccgggtgccgacctcgccaaggtgcagcgtgccgtgtgcatgatctccaactccaccagcgtcgtcgaggtgttctcccgcatcaacagcaagttcgacctcatgtacgccaagcgcgcgttcgtgcactggtacgtcggcgagggcatggaggagggggagttctccgaggcacgcgaggacctggcccgcctggagaaggactacnagnaggtcgccgcanaggcggcagtgatgacggcg

SEQ ID NO: 10916 - DNA, 579 bp, Zea mays
  unsure (1)..(579): unsure at all n locations; Clone ID: LIB3279-183-Q1-N6-F4
ggttaactcaaatacttccaacaaaacagcataaatgtgcaatgcttagctttgaattcttgagctggaatggaacaaaacaaaatgtcttgggcatttaacttgttcaaaacaagtagaaaagctgaatggacattgccaacggactcttgggagactacagagacgggtaacagctcatttcagaggaataaaccgcgaggagtgggtggcaccgataccgggcctgccatgcttgaccggcttataggagatggagaactcagcaaggtagtggccgatcatctcaggcttgatctcaacctggttgaacgtcttgccgttgtagaccccaacaatgcttccaatcatctcagggacaatgatcatgttacggagatgtgtcttgactggctctggcttctcaccagcaggagcatcctttttcgccttgcgcagcttcttgatgagtgccatgggcttcctcttcagacccctctggaaccttctcctggcgcgcgcgnggaagagctggacgaggtcgtccgtggacatgtcgagaagcgcatctaggtcgacgccgcggtagctgtacttgcg

SEQ ID NO: 10917 - DNA, 417 bp, Zea mays
  unsure (1)..(417): unsure at all n locations; Clone ID: LIB3279-183-Q1-N6-F5
cgggggggggggggggttttttttttttttttggggggttttttttttttttttttttttttttttttttttttttttttttttttttttttttttttgaacggggggggccccccttttccaaaaatgggaaaaatccttcctcccccgggggggggggggaaaaatatcttttctncttgtcaaactggccccattaacggggggggggggggaacccccccccaggcccgcccggctgggcggcaccggcccccccccccctccccctgggcccttgggctctgagaaccatccggggcctcccccccgtctcccgtggggtcgccggcccgggccggggaacccccgggcccacccccccctcgcctcaaatgtcgacggggttgttgctccccggccccccggggccccccc

SEQ ID NO: 10918 - DNA, 590 bp, Zea mays
  Clone ID: LIB3279-183-Q1-N6-F6
agttaaagagctgtggattcgtcaacgtcacagttaacacaagcacaagttcattggatcaccagttcaccgctggctgtgcaaggagcaaagcaaacaagcacacatagctgcacgcgagacaccaaaccaatcacacgaggctgttgtagtctagacaccacgccgtcaatcaggacaccctgaggcactgctgcttgaacatcttgctcgtctgctgcccgctcgccgagtcctccacggtgaggccctgcgcgccaaagcagatgttgatgagcctcccgttgccgcacccgtgcttccgggccgcgctctctgccgtcccggcgccacagccgtcgtccatggacgagttgttggagcacgaggggtcctccatggcgtcgtcactatccttcagcctgccggcgggcggcgtcaccatggagatctcgtcgtcgaggcagatgtccttcagcttcgccagcggctgcggcgtggacgataccgaggacctcaggaaagtgtccgtcggggacgcggaccgcgccgtagatggcgccagctgtggcatggcctccatgatgccgtggatgagcttcgtgttgagc

SEQ ID NO: 10919 - DNA, 439 bp, Zea mays
  unsure (1)..(439): unsure at all n locations; Clone ID: LIB3279-183-Q1-N6-F8
ggggggggggggggttttttttatttttttttgtgtggtttttttttttttttttttttttttttttgggggaacctaacccaaagtttattttcaaggaagagcccaggaatgctcatttccgaacaattcaatgtctttttacaagcaagggggggggggcgggggctctttttttttttcnttnaagacacatcactgaacaaggaaacaacccaaaacagactgggctttttccattcaccggttggcagggcaaccgtttcaagcagatgggttttttgggggagcgaccttttggacaaacgggctttccattggaccaggccaccaggccttcacatgcggttgggggtcgagcacaaatgccgtaggcgtttcgaacatgccgtgagtgtcatacacatggtttaggtgggtgaggcctggggaagtttcc

SEQ ID NO: 10920 - DNA, 255 bp, Zea mays
  unsure (1)..(255): unsure at all n locations; Clone ID: LIB3279-183-Q1-N6-F9
gaaaaaaccgcgtggaattttttttaagtgtttggccccccggtttcgtgtcaggtttttttnttttcatttgaggttttgcctggggtctttttttttttcccaaanntccctcgcccaaatgggcttttttcgtggcgtcttctgcccttcaacaaatggggcctcccatttttggaacctgaaacaactgtgttttcctgggttattatacccttcacctgacgggtcccccctaatttctcttcttgtctt

SEQ ID NO: 10921 - DNA, 558 bp, Zea mays
  Clone ID: LIB3279-183-Q1-N6-G1
gtgcttaaggccttcgaatatgtgtatatataccgtttatcaatgaaacgttcacgcaaaaaaaaacatatgcagcagcccacgggtttaagtcgttccaaatatttcatcataagcaacatgacagaacctgcgcttggccaatatcaccggaacccgagcctcttttcttcgaaggaacatcgatcctttcaacattgggctagctaacaatctaataacaatgaataaataaaaaaatcgagatcccgacattgagcagttacacaggtataatatgtacccactctgtttccagcgctacgtcgtttggattaaacagaagcaacagaacagaattgcacgcgccaaacagaagagcatgtctcttttcttccagctgatctggtgcaaactggccgtgctaaacagtagccatgcatccagcaaaagagtgcctgcagatactcgaggaaccggcatctttatccttgctcctaactttcgacgttgttctcggtgttcaactcctcaagagtggataccatcatgccagccactcccaagcagtcagtgttc

SEQ ID NO: 10922 - DNA, 563 bp, Zea mays
  unsure (1)..(563): unsure at all n locations; Clone ID: LIB3279-183-Q1-N6-G2
aaaccgaatagcagtagtcacataactaaataagcatccaggtttgcacccctgaagttaacaactcaacacaaacacaataaccaaataactgatgaagcagtaccaggcaagcgttacacagaggagctccaacctggcaggtcaactaaaacctacaggatgacaaggactcgccgaggagcgcacagaagtctagtttaaactaaagatgcacatcccctagtcttcactccttggaggacttgttgatcagggacttgtgaatgtgcgggatgacacctccgcctgcgatggtgcccttgatgagggtgtccagctcctcgtctccacgaatggctagctgcaaatggcgaggggtgatacgcttcaccttcagatccttgctagcattcccagccagctccagaacctcggcagtcaagtactccaggatggcagcggagtagacggctgcggtggcaccaacgcgaccatttgcctgagtcctttgcttcagctgacggggggtacgcccaacagggaactgggangccggcgcgggaggagcgtgagattggggc

SEQ ID NO: 10923 - DNA, 468 bp, Zea mays
  Clone ID: LIB3279-183-Q1-N6-G3
gggcccaaaaaacaataaattacaattattcattttctcaagtacaactattttattagtactaggagctggatcgatctttggtccgatccagtccgtaatccaccagagaaaagggaaacgtctaggcgggtgctagattagcagcctcagcatagcgcgcgcaaaagccttctccttccttcaatatacccggagagaggcctcggcttcatcttcggcttcatcctccttttcggcggcggcgcgcaaaaaaaaaacaagggaaaaaaaccaaatcgacagtaccgtaattaattatccaatagctagccgcgcgcgcgctagctgttcatcctcaaaactggccgccctcaaaggtctggctgaactgccagccagcggggacggcgcccttgctggtgacggtgcggccctcgctggcggtgacctggaacgagagcgcctgcctgtccaagtaccagttgc

SEQ ID NO: 10924 - DNA, 511 bp, Zea mays
  Clone ID: LIB3279-183-Q1-N6-G4
ggggttgggttttttttttttttttttttttttttttttttttttttttttttttttttttttttttttttttttttttttttttttttttttttttttttttttttttttttttttatttgggggggggtttaaaataaaaaaggggggggggggggggggggatttccttttaaaaaaaagggaaaaccttaaaagattgggggaaagccaaaggaaaaaattggtgggtaaaactttagaggggaaaaaagcctttttttttggggggggggggggccccgggaaattggggccgggtcctggggggggaccaggtttccctataggggggggaattaaaattgggggaaaaaaagggaaaaaatggttcttggggaaaaaggttatggggtaaaaaatacaaaaaaaaaaagaagggggagaaaaaaaggaaaaacctggggggcctaaggggggggataaataaaaaaaatgggggtggggaaaaggggccgttttcaaggggaaa

SEQ ID NO: 10925 - DNA, 361 bp, Zea mays
  unsure (1)..(361): unsure at all n locations; Clone ID: LIB3279-183-Q1-N6-G5
ggcggggggggggggggggggacaagaaaactaaggtgggtggtacaacggaactcagcagcggttacttacaagatctagcatatacagcgtgaaaactttttgttccatttcctctcctgctcctatatttntcccccttantttcatgggttgggggggggggggggggtttttttttttttacccacctccancgtggaggcgtgcgggatggagacggtgtagttgggaccccggctgttcctccgcaggaagtcgttgcttaagttgatcacgaaccggcggaggaagctggacccggtcttcgccttnacgtgggagtagtcggggatgaacgccatgctggactgccttgcgt

SEQ ID NO: 10926 - DNA, 462 bp, Zea mays
  Clone ID: LIB3279-183-Q1-N6-G6
ggtctcctgtgtatcagtaacttttacttcagttgccacagctgctgtgatgccaggaggcgtatcttctgcagacaggtttgactcttgaacctgaccagaaatatcagaagataaattttctgactttggatctaggggtggttcatgcaaattcttagcttcatcagaagcactccccatgattatagtagatccagaattcaactccttttcagacattttatttttttctgctgcagtgtccacttcgtgagatttaaaaccctcgttcccatctgatgattctaccagtcttggttttagaagaatgcaagaggctattgaagtagatcagaaattttctgtccatggtatgcaggtgggtcaacaacctagtcagtcaattatgaattttagaaatatgggtggtgtagctttattgcaaaatcctgtgactgcactgccggtgccccctgaaac

SEQ ID NO: 10927 - DNA, 574 bp, Zea mays
  Clone ID: LIB3279-183-Q1-N6-G7
gctcagtcgatatcattttacagctagaacatgcgcctgttagtttctggggaaataaacatatatgttgggaaacaaaataaagtgatagcataacatcaatacaagtttcctacaaaagcttttagtacaagtcgtgcaatttttcttcgagcgttctcaaaactgtattcacattcaatcaagttgcttcgtccaatcgaagggctcccaatctttcatgaagctagcaacagcctgcctctggttatccatggactcgtgccttcgtcgacggtgcatgtcctcctttggcaactggagcatccctctaatgacattcaatccaaatccagcactgaacttgctctcgtcatctattacatgaacaaagccacggtccagcccgaactccacatggaagtgggcaaagttctccgggatgacttgcctcaagaggcggcttgcacttgtcgggataaccttcttcatctcatgttggggccattcttcttcagcttcatcaatagcctttttgaagtcattggggcattgcttgacacttcacaagggacagggatgcactcaatcatgc

SEQ ID NO: 10928 - DNA, 338 bp, Zea mays
  unsure (1)..(338): unsure at all n locations; Clone ID: LIB3279-183-Q1-N6-G8
gtggggggggggggggtgtgttttttatttttttttgggtgtttttttttttttttttttttttttttttgcttnacacacaacgggggttccttgttttggttttgatttgatcatacttgggttcagtttttacaaccttttnntaaaacaccgggggcgttggggggtccttttttctaagaaaatcatttttaaacatttttttttttcncttgcnttttaccatttactgcccggggttagtaatcattttggaatataaaaagaaagtgtcttggggaccctaaaccattttttggatccccaccttcataagcctttggggggggatgctc

SEQ ID NO: 10929 - DNA, 567 bp, Zea mays
  Clone ID: LIB3279-183-Q1-N6-G9
gcgcgggggggggggggtgtttttttgatgatcaaacaccaaaacacttgcaatgtcgctgcagttctgaagcgtagaacaatccacagaagaccagaacatgctcccaaatcatcctgctaagaaacttggtacagcaaggtaacaaacaaaaggggaggggggggggattttgacaaatgggacttgtcgctgcaccgcagcaccttacgccttgagcttaccaaagaacctctgcttctcatcggtagtctggaagcgaccatgcccaaatttggacgatgtgtcgatgaacttgagcttgatctcctccagcgccagccgggaagtctgcttcaggagggactggcggagggtcaccaccctcttctttggacccacacagcatcccttgatcatcaggtagtcacccttcacgataccatagtgggggaagccacccatgggagtgatgtccttctcggtcctgtcaaactctgcggaggcatcgtgggtctcttgtccagccttgccgatcttgtaaactttcttgttcatctcggggcgggggtgggacccgttctgacc

SEQ ID NO: 10930 - DNA, 490 bp, Zea mays
  Clone ID: LIB3279-183-Q1-N6-H1
ctgaacaagatcgaccaaacagttcattcaccagctagaaaatgtgttcaaataggagtggcagaaaaataacacggtttaccagattatactgtcacaaactgttaccgaacacttaaaacaaagactagatgttccccaaaactgatgacaaagcacagctcctcagtacttgataggggcaagaatctccaactgagaccccaacttctcctcggctgccttctcggccttgacacgcagcttggccaattgcttcttcctctcgtaggcaaccttggccttctccttcctcttctcctcaagttccctgatggtgtcatggtagttccacccgacctccttagagagctcgccgaggaggcagtacttgtgtccaggctgtagcctcagaaccttaagagcgtcagggatgaccatacgcttggtcttgtcgtacggcggggggacgccctcttacgttttgagccttaccagagccgcctccccc

SEQ ID NO: 10931 - DNA, 429 bp, Zea mays
  Clone ID: LIB3279-183-Q1-N6-H2
aggaaaggtggttttcactggaaccgaatccaaaataacgaatacagaacaacgacgctaatacagcctatttgtttgggaactagacattcatcaaatccccggagatgatgggtacccgcgctcgccacggatgcggggggcgagctggatgtccttgggcatgatggggacccgcttaacgtggatggcgcaaaggttggtgtcctccaaaaaaccgacgaggtaggcctcggggggctcctggagcgccagcacggggtggctttggaatcggaggtctgtcttgagaatcctgcgcgatctcgcgcaccaagcgctggaagggcagcttgcggatcaacaactccctgctcttctgggacttgcggatctcgcgcagcgccacggttccgggcctgtacctgtgggggttcttcacgccggcgg

SEQ ID NO: 10932 - DNA, 599 bp, Zea mays
  Clone ID: LIB3279-183-Q1-N6-H3
gaaccaatctcatctagtagtaaccatgagataaaaattgttcgcttgaacttgtacacgaggcaatatagactatggacatcagaattctcaaaagtcaggttcggtcgcaaatatcctgggattaagtgctcgaagcatcactgttaactgtgaattgccattctaaaggctctggaacattgcaagattgacttttgaattttctacagggcatcccaaggatatcaacaaatgcagtgcaaatgagatgtgatggttgcaaagaggattctattgcgtcctcctgatctttgaaaatgtgccggtctcggaaaagtaagtactttgagttccgcctccgagaaggtttccttggacctgtggatttgacaactctattccctgaactggtgtaaatgccaaactggatgtcaatcctgatgttgcaccactgctaccatagctcttctccttgaactttttcgccactttagcagcaagtttgctttgtccagctgagacacgtagcttgccactccctgcttgtccaagcatgccataaccttcccccaagccatcacctagtgagctctcctccgggatcccaaactgcattc

SEQ ID NO: 10933 - DNA, 524 bp, Zea mays
  Clone ID: LIB3279-183-Q1-N6-H4
aattagtgaaaagttcgattatgcatagccaataaactaattccctggcgtcgccagctgtttagttttatagagtatcaaacactacaacgaccaattgggacacaactaacctggaaaaaactatcatcggagttcagttcttttactagtgtacactgcaaataacagaagttaaaaacaaacaattgtacacgttttatgtagctaaactctctaacaaaagccctggatgcgttgctgtaacttttatcttccgataaccatctaaaactttgctccaggagaagtggaagacggatgagatttactgacgtgattcaacaatgcttcagagctcaattttgcttttgctggatttggcaggcttctttgcccctttccaccatttctttaccataccggacaccttgtttacatgccctttcaacttcttgctggtatccttgaactgctggacgacttgctgtttcaaatctttcttttgagagcccttgtttttcagagctttccccaagttcttt

SEQ ID NO: 10934 - DNA, 537 bp, Zea mays
  Clone ID: LIB3279-183-Q1-N6-H5
atataaaacaaaatgcatgtaatcataccctataaaaagggaaacttggatactagtaaagacaaaaaaaaatttgggtcaactgtcgataatcactatgcctaggtattcttgttgggtgattcaaaagctcgacctttcgatagtgtgttgaagatgaatagtttcaacaactaccaccatctgagccatgtgccacattcttccatgatgtgccaccatgagctccttttccacgacgtctggtacatccatgaccatagtcgccttgaccttagtcacaacattatgctgaagtcttggtcatcttgtttttatgccgcttaacttccatgactgagcatacattgacttcggtcattaagcatgccatgcggtttagcacggagctcgagatgcctcaataccatagaagttgcaatgatcgtggtcccggggatcaagaagtgtcgggtcacgaatcccgagaagacagcaaaatcgacgacgtcgtcgcctccagaaaacagcgtcctcatgtcacctgtgtcaaacaag

SEQ ID NO: 10935 - DNA, 551 bp, Zea mays
  Clone ID: LIB3279-183-Q1-N6-H6
gggcaggaaaaactgctgaattattgacagcaagtaatttgacagtttctggatcagtaagaaaaggccaccatccttagcttcccccaaccattcaatgtgcaacagagtaagcattagcaacagaacgatttttttacataataagcatttttttgattcctgacctcaatgcaaaggatagcctagcacactgtccacataagagatgacacaagttcagcgaccatgttgctcttccattcccacatgcacatggggctacgaaacggtaagagcatcgatcggcctcagcatctctgggtttgcgattacctcctcgcgatagatcttcgctgtcacctcatctttttttagatccaccttcgtgtttgccctgtcgatgtcgcatgcgcaaagagttggaacggcactgcaatgctcgaaccggaagcaactgactaggtgatcatttgttagccccgcagcctgcatgaaggaatatatgaccgtggggcccacacctcggaacccccttctcacatgggtttgctgattatatctgccttggg

SEQ ID NO: 10936 - DNA, 627 bp, Zea mays
  Clone ID: LIB3279-183-Q1-N6-H7
gggtggttttttttttttttttagaatgaaaccgttccattcctctccgctcctcaaccaaacacaccataagttatgaaatcaactccaacgaaagtggataacctttgaaatgactctgaaacagtcgcacgcacaatcattagcctggggggcgggcgagataccttcagaatgcaaccactccaccgaacaggggggaaccataatttgccacaaccagaagccataactttggcgttctgatggattcgcgttacacaggccacaagtttcttcagtcatgtagtttgggtgcagccgaaaccaacgtcactgcagttgcttatttgggtgtaaggtggaggaagcaaagaagggtaaaacaaacatctctcagcaggagatggactctccagctcgtcatgcctaactgggaaaagcataaataaacgcttaaaatccaaaaatggaacttgtacagggttgaacaagcaagaagcctccttatgaagcagactccttggcaattttctcagccttagcaatgacttcctcaatgccaccaaccatgtagaatgactgctcagggagggcattatacttcccattcaaacaccctggaaacttttacgctttccttcagct

SEQ ID NO: 10937 - DNA, 398 bp, Zea mays
  unsure (1)..(398): unsure at all n locations; Clone ID: LIB3279-183-Q1-N6-H9
aacttgtctcaaaatcatatcatgcataaaataacaggctgagggttgtggttgaaaaacataggtaatttatgcatcaaagggatccagtgagtttgtcgtgcttattcggcgaagggggaaggggagctcgcggaactggcttctggctccaccgcctagcgtagacttgcggatctggcctccacgagacgacacgaacgctccgataacaggagggtggactggaggcgaagcgacactatgcgtgtagccggcagagcggagtaactgagtgggtggggtgtttgcatttggctgagggtgttgagtgtgtgtggagagggagagggtanctaggtgtatttatagctgggtgtatgtggtgtagcacagtgaagttcactgttggtgagaat

SEQ ID NO: 10938 - DNA, 598 bp, Zea mays
  Clone ID: LIB3279-184-Q1-K6-A1
cgccaccagccttctcccatcctcgaagcacggaaggctcccagaaggagctctcacctcgcagccatctctggcacgtccgtccttcttctccctcggtccctccccttctccacagctatcggattggcgttggagtggagatcgacccgggctcggaattcccttcgttggtaaggaaccctaatttggtcagatgggatttccaacttcgacaaagcccgcgaggtcgatcgatctcagttgacgcgagggattggaaaactaagttgcgggtgtagttaattttctaggaagattggggtttcagctcaaactcccatgctcgacgctgaggacgaccctggcgggagatgacgaggatcttcgtgcagcgcgggaccgccggctcctcgtccagctccggccgctcgggcacgcagccagtgcagccggcagcagctgcccgggaggaggagttgccgctgcaacctcaaccacagctgccggagctattggccatagatgatacaactgataatttaaatgagggcagcgagaatatcagcaataagcctttgaggacggatgacaccatttcagagagctcaagctccgc

SEQ ID NO: 10939 - DNA, 575 bp, Zea mays
  Clone ID: LIB3279-184-Q1-K6-A10
gtgggttggcttctcctccccctccgggtgcggggtcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggggaggtgctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctaccgcggtggcgggcgccgtgatggcggcggcggctaccgcggtggcggcggctaccgtggtggcggcggcggctaccgtggtggtggcggcggctaccgcggtggcaaccgtggcggcggctacggcaactccgacgggaactggaggaactgagcggtggggcccgcg

SEQ ID NO: 10940 - DNA, 587 bp, Zea mays
  Clone ID: LIB3279-184-Q1-K6-A11
gtttccccaggccccactaccggggggggggggggggctatccaaaacgcaagatccaaaccgtcgccttcctatccatcccttcctcgccacgggggtcgcctgagacacataaacaatggtgaaggctgttgctgtgcttggtagcagcgatggtgtcaagggcaccagggtgtggggcgcaagtgggagatggccctaccactgtcaccggaagtgtctctggcctcaagcctggcctccatgggtttcatgtgcatgcgcttggtgacaccaccaatggctgcatgtcaactggaccacactacaatcctgcgagcaaggaacatggagcaccagaagatgagaaccgccatgccggtgatcttggaaatgtgacagctggagcagatggtgttgcaaacattaatgttaccgacagccagatcccactgactgggccaaactcaatcattggcagagctgttgttgttcacgctgaccccgatgatcttggaaagggtggacacgagctcagcaagagcacccggaacgctggcgggccgtgttgcttgtgggatcatcggactccagggctgaactgaaac

SEQ ID NO: 10941 - DNA, 616 bp, Zea mays
  unsure (1)..(616): unsure at all n locations; Clone ID: LIB3279-184-Q1-K6-A12
cttcgcgtgggcggacgcgtgggcggggggggggggggggggcggccgtccgcttccctttccttggataaccacggcacccgcccgcccgcccgccggcaagcgaaagcgaagcgagcaaacccagccatggagaaggcgatcgatcggcatctggtcctcctggcgcacctgggtgggctgccggggggccgcctcctcgcancctcagcttgcggcgtcngcgtgcgcggccggggacagcgccgcctaccagaggtcctcctccttcggggacgatgtcntcgtcgtcgctgcctacaggacgccgatatgcaaggccaagcgaggaggcttcaaggacacctacccagaggacctcctcactgttgttctcaaggctgttctggacaacactagaatcaatccagctgacatcggtgacatcntcgttgggacggtgctcggccctggttcccagcgtgcaaaccagtgcaggatggctgcgttgtttgctggcttccctgaaaccggccctggtagaactggcaaccgccagtgttcatctgggctacaggcagtaaccgatggtccagctgctataaaggctggttactatgacatagggatgggggct

SEQ ID NO: 10942 - DNA, 599 bp, Zea mays
  unsure (1)..(599): unsure at all n locations; Clone ID: LIB3279-184-Q1-K6-A2
ccccgcgtccgaccagnatacattacacaccagcctcttgatgcaggttttagtgccattgtggaatcatgcaagggcctcaggcggctttctgtttcaggccttctcacggacagtgtatttaaatccatcggggcacatgctgaccgtcttgagatgctctcgattgccttcgccgggaacagtgatttgggcctccattacatcctatcgggctgcaagagcttgaagaagctagagattagggactgcccatttggtgacaagcccttgctggcaaacgctgccaagctggagacaatgcgatccctttggatgtcgacgtgctcaatgaccttgggcgcatgccggcagcttgcgcgcaagatgccccgtcttagtgtggaggtcatgaatgatcctcgacggggattccccttggactctctaacagatgagagccctgttgagacgttgtatgtctaccggacaatttcaggtccaaggtccgacacaccagcttgtgtccagattctctaaggggcagctgtggtctacaaaggtactatggaagcatccattttcaatcacatcatgtaccttcaacaccttactagcat

SEQ ID NO: 10943 - DNA, 671 bp, Zea mays
  Clone ID: LIB3279-184-Q1-K6-A3
ctcagccaagctcgtgagagcagaggaactctctttcctcacacaccaaagcagcagtggcaaagctgcgctagaggccatcaggccataatagcccagagagcagacgaggcatggcgacgtccgtggcctgcgccttcttcttcttcgacgcggcggagccgctgggcgagaccgggcggcggcaagcgctggacgcctgcgcgctctgctccaagccgctggcccgcaacagcgacatcttcatgtacaggggcgacaccccgttctgcagcgaggactgccgctacgagcagatgcaccacgacgcggcggccacggcctacgcgcggcagcaggccagcagccggcggaggcagcagcggagcaggggcggctccgtgtccgccaacgaggcggacgtgtacgtggccagctagtttaagagcaggcgcaagcgcggcgaggccgaggatggtgaaggccgtgcgctgcctggttcaagctagagaatcccgtcggtggaggcgcaggcgctccctgttggctgtccgccactgcgccgcacgagctttgtgaagcggggatggaagagtgaagaagcgatcaggagacagatccagacaacccgcgggttgaaaaattgaggaaacgtgctctcctctgctccccttgtttctgttttcccttcc

SEQ ID NO: 10944 - DNA, 688 bp, Zea mays
  unsure (1)..(688): unsure at all n locations; Clone ID: LIB3279-184-Q1-K6-A4
caagccagaggccacctcagaggtgttcacactatcatggatgaagctcgcagtggagtgcttatcagagctgcacaccaatatagccaccctgattactgagcttgagctgcccttatcagactgggatgagaagtgggtggacatttacctgaacagcagtgtgaagctgctggacatctgcattgccctgagctcggagctctctcggttggatcaagggcagctgcttgtgcgatatctcctgaatgtgttgaactctgggagcgacatgccatcccaggagcagctcaggagagctgaggtgtctcttaaggaatggatagagcgagcaagtgaaaggtctcccaggcttgatagttgcttggcagcgctacaggagctttctggaaaccttagcctgatgaaggttaggcattctgctaaggggaaagtgctcatgcgagcattgtatggaatcgaggctgttaccgtcttaatctgcagcgtacttgtagctgtactgtcgggtaccttcaagccactggtggactntgatgtccctgagaanattggttggtctacggccttcattgatcttcagaaaggccataagcgtgaacttagcaggcaactgtccagaggtagtgttgcagctgtaaaagactggaggatgntgatgtatgtgctaaacgctgcatacattgac

SEQ ID NO: 10945 - DNA, 614 bp, Zea mays
  Clone ID: LIB3279-184-Q1-K6-A5
gagcgatccgatccgatccggaactgtgccggccagccatggcgactagggtttggctcaccaccctcctcctcgccttcctcctcgtcgccacccccttcaccgcccgagttgctagagctgattcggaggaagatgctgctgcagctgaggttgttgaaggggctgatctaggtattgtgggtgatgatacacaggtttccagtgacggacctttaagccctgctcctggtgtagagacagtagttgtattccccaaaaatgctggcaaaattgtactagcaggtgaagaaactgaattactagttggtctgcaaaatgagggtgaatcgactttgaatgttgttgctgttcattcaactctccatcttccttttgaccataatatgtatggccagaacctaactgttcagaatttcttcaacgcatcagttcctgtttctgtgcaagcaaccttcccttataaattcgttgtgagcaagttcttgcagcctggagcctatgatctggttggttacatagtgtatgagatcgaccagcacccttaccagaatgtattctacaatggcactattgaggtcgttgaggctggaggcttactcagtgttgagtct

SEQ ID NO: 10946 - DNA, 372 bp, Zea mays
  unsure (1)..(372): unsure at all n locations; Clone ID: LIB3279-184-Q1-K6-A6
gggttcagaacattcaaggtttcatgtgggccgaggagaaagtggacgatgaactagaaaggacatgagcagtgcttttcaacacatgaaggccatgtgcaaatctttggtgctgccgaagtgtgtcgtgacattggaattgcaggtctangaaaaacaagctcattagatttctgaaaaaacattagaagttattagattggtagcatttttttaagatttaaaattttatagaagtcatcattttcgtttattggaagaaatatttttggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggg

SEQ ID NO: 10947 - DNA, 580 bp, Zea mays
  unsure (1)..(580): unsure at all n locations; Clone ID: LIB3279-184-Q1-K6-A7
gtgaaacgagccctgacctcaaagaccggctgagatcggacggattggccttccccgcttgctgcgccgccgatggagatgatgggacagacgcatctccgacgccgacgagtgggtcgtcgacagcgaggtcgctgagtagatccccgatggtgagcagcggacctccgactccccgcatcatcctctttccgtcgtcgtctgtacgagacgagagggacgtgggcctcactgcattctgtatcagcgaaccgattatgggcctcaatgaaccctgatagagcccaacaagtgtggtctgaagagaaggtctggctccggctaaggacattcttgtccagaagctccatttcaccgtttggcttttgttcggttattttcaattcatatatattgtaggggattgatatggattagagaagattttgatttgctagggattgaaaccccctcaatccatatggattggggtaggtggtttgttcatgaaaatcgcagaaccaacggtggtaatgcacacaggtttgctagaagctctntaattagcagcacttgtatggttttcgtcactacctaccta

SEQ ID NO: 10948 - DNA, 657 bp, Zea mays
  unsure (1)..(657): unsure at all n locations; Clone ID: LIB3279-184-Q1-K6-A8
gcaggctattcagagaagtcgttcaaggattgctgcagctcagcagcgaagccaaaggatcgagcagtcttcacaatctgtgaacgtgactactccagcacaagcagagcaggatgctcacattgctgaagcctcccatgctgttgcatctggctccggctcaactgaaagagaagctgtagcaaaccctgctactgttttggctgatgacaatttgaatgtgtcttctttggcagcagaaggctcattgaatactccatccaaaccaatggatcctgcccttgctgacaagaaactttccggttcaatagagaaggtagagaagttggtgaggaaaaacctgaagcgaacatcgagggctgcccaggcctccaggagggccacccaaaggcgcaatcttatgtccatgcgatgaatttattgctgtactttgctgggggaagagaaagtccacctcaggcttgtcctccttcctcttgtctgtgctgctcttcttccaatacttgccgtggcgtgatgctcacggtcattccttgttcccttctcgaggacaagaatatggaagccattggctctctgctttgagttctaggactgcagctactagtgtgaggtgtgatctggntcatgctatngctgatgtatgcatacttttct

SEQ ID NO: 10949 - DNA, 661 bp, Zea mays
  unsure (1)..(661): unsure at all n locations; Clone ID: LIB3279-184-Q1-K6-A9
cacagacgcgtctatctcagcttgctgcgctgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggggatgtcgtgttccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccgccgcgctgcccagcaagtgcggcgtcgccctgccgtacaagatcagcaccaacgttaactgcaacacgattaattaaatgaggcgtcctgtgcgcgtccgggcgaggaatgcatgcatggcggagagtaataaagtaatgctactggtattttaagctagatcgaggtgtgcctgtctctagtcatttatggtgtttagcaatcgtctacacagttcgtaaacggtgtatcgtggatgcatgttgccgcgagcagnatacgtaggcatgaac

SEQ ID NO: 10950 - DNA, 650 bp, Zea mays
  unsure (1)..(650): unsure at all n locations; Clone ID: LIB3279-184-Q1-K6-B1
gtaactgaggaagnatacagtaatacctagaggatatgcattcacttgagtatgctgcacacagcgagacatgacaaaatgcctacaagcaagcagactgggagaaaagcggacaacaggagggtattagttgatgttgagcgaggcagaactgttccaaattggcgtcctaagagattgggtggtgggttgggatcaagcaggatgggtggtactgatactgacaaaaaggattccactagggagcaacaacaaggtggacgccctagatcagaagagcctcggagggatgatcgtcgagccgatagggatcgtgaaaaatctcgtgaaagggtacgggaaagagaccgtgaggagaggacccgtgaacgttcgcatgaccggactcgtgatagagatctacgagatgagaagcatcaccatagagaccgtgagaggactcgggatagggagagaggaaaggaccgtgaaagagaccacggccgtgaccgggagcgtgatcgtcgtgacagggacaaggatcgtggtcgggactatgatagagaaagggaccgtggtcgctctcatgatcgccatcgtgagagaggcnnaggaccgtgtgaaagagatatgagcgcaccaccatgaacgtgaccgtngtcacatgcatg

SEQ ID NO: 10951 - DNA, 608 bp, Zea mays
  unsure (1)..(608): unsure at all n locations; Clone ID: LIB3279-184-Q1-K6-B10
tgtttgggtgcttttggaccaatggtcagatttgcagcgcgacatctcgtcttcttatccatacaaaattgctaaaaaatttaatgagaggatggttgcatgggccaaaaatattaaggtttcggatccacttgaagagggttgcaggcttgggccagttgttagtgaaggacagtatgagaagattaagaagttcatatcgaatgccaaaagccaaggtgctactattctgactggaggtgttagacctgcgcatcttgagaaggggttctttattgaaccaactattattactgatatcaccacatcaatggaaatctggagggaggaagtctttggtccagtcctgtgcgttaaagaatttagcactgaagatgaagccatcgaacttgccaacgatacacagtatggtttggctggtgctgtaatttctggtgatcgggagcgctgccagaggttatctgaggagattgacggtggatgcatctgggtaaactgctcgcaaccctgcttctgccaagctcccttgnggcgggaacaagcgcagtggatntggacgtgagcttggagaaggggcattgataactacctgagcgtcaagcaagtca

SEQ ID NO: 10952 - DNA, 646 bp, Zea mays
  unsure (1)..(646): unsure at all n locations; Clone ID: LIB3279-184-Q1-K6-B11
gggggtggtggtggtttccagcgcggggtgcaagggtggcggcggggggaagagggccgccggcggcagaggtggcggggaggaggagcggcggcggcgggcggcggttctggagctgctgctcgcggccgtgcggcgctccgtggtggcgtgccgggtggagcgcggggccgccggaggcggggggccggcgagagaggaggacgcggcggtggcgctcgaggagatggagatcggctggcccaccgacgtccgccacgtcgcccacgtcaccttcgaccgcttccacggcttcctcggcctccccgtcgagttcgaggatgagatgccctgccgcgtgcccagcgccagcgccagcgtttttggtgtctcggctgaatcgatgcaatgcacgtacgatggcaagggaaattcagtccccacgatattgctgctcttgcaggagaggctgtatgcccacggngggctgaagtctgaggggatctttcgcattaatccagagaatgaccaagaggagcacgtgagggaccagctgaacaaaggaattgtacctgatgacattgatgttcactgcttggctagcctgattaaggcatggttcagggaacttccagaaggtgtcctggatggcctgtcccctcagcaa

SEQ ID NO: 10953 - DNA, 629 bp, Zea mays
  unsure (1)..(629): unsure at all n locations; Clone ID: LIB3279-184-Q1-K6-B12
tgtttaacccgnccacggaggcattagaggaggagaggggggcagctggagaaagcagagtccaccgtgtttgtggcgtcagggatgtatgcagctgtggctatgctcagcgcacttgtccctgctggtgggcacattgtgaccaccacggattgctaccgcaagacaaggatttacatgggggggggggtgcctaagaggggaatttcgatgactgtcattaggcctgctgacatggatgctctccaaaatgcgttggacaacaataatgtatctcttttcttcacggagactcctacaaatccatttctcagatgcattgatattgaacatgtatcaaatatgtgccatagcaagggagcgttgctttgtattgacagtactttcgcgtcacctatcaatcagaaggcattaactttaggtgctgacctagttattcattctgcaacgaagtacattgctggacacaatgatgttattggaggatgcgtcagtggcagagatgagttagtttccaaagttcgtatttaccaccatgtagttggtggggttctaaacccgatgctgcgtaccttatccttcgaggtatgaagacactgcatctccgtgtgcaatgtcagaacgacact

SEQ ID NO: 10954 - DNA, 587 bp, Zea mays
  Clone ID: LIB3279-184-Q1-K6-B2
tgacaacacttttgatgctgtttacgccattgaggcaacatgtcatgcacctgatccagttggttgctacaaggagatatatcgtgtgttgaagcctggccagtgctttgccgtgtacgagtggtgcattacggatcactatgatcctaacaatgcaacccacaaaaggatcaaggatgaaattgagcttggcaatggcctgccagatatcagaagcactcggcaatgtctccaggcagtaaaagacgccgggtttgaggttgtttgggataaggatcttgctgaagattctcccttgccttggtacttgcccttggatccaagccgattctccctgagtagcttccgtttgacctctgtgggacgcatgattacccgcacaatggtcaaggccctggagtacgttggtcttgctccgcagggcagtgagagggtctctaatttcctggagaaggctgcagaagggctggtagagggcggaaagaaggagatcttcacgccaatgtacttctttcttgttcggaagcctcttctggaatgagctcttggatcaccttttcagagagagaaaggcagtggtcatttcg

SEQ ID NO: 10955 - DNA, 623 bp, Zea mays
  Clone ID: LIB3279-184-Q1-K6-B3
cggacgcgtgggacacaatcgtcctccgccaccctccattaaccctagcggcagcagcgctcgtttgatccccgcggcggtccggcgtccgggtaggggagcgaggatgacggagtccctggtgcggaacaagccggggatggccagcatcaaggagatgccggtgctgcaggacgggccgccgccgggcggtttcgcgcccgtgcgctacgcgcgccggattcccacctcgggccccagcgccactgccatcttcctcacggccttcggcgctttcgcgtatggcatgtaccaggtcggtcaggggaacaaggtgcgccgggcactcaaagaagagaaaattgctgctcgtagtgctatactgccgatgctccaagctgaagaggatgaaagatttgtcaaagagtggaagaagtatcttgaggaggaggcgaggattatgaaagatgttccagggtggaaggttggcgagagtgtgtacaattccgggaaatggatgcccccggccaccggtgagctccgccctgaggtgtggtaagggcctgttgtaggcattgagaatgcaatcatgtcatgagggcatgaataaggctatcagacatgggcatccttctttgttcact

SEQ ID NO: 10956 - DNA, 617 bp, Zea mays
  Clone ID: LIB3279-184-Q1-K6-B4
cctctctctctctcaggttggaaggggttgctgaaggacgagaatgctcagaagcttgcgttgcagcactggctggaagcgattgacccgcggcaccggtacggccacaaccttcactgctactacgactgctggctccactccgaaagcaagcaacctttcttctactggccgcacttgaagaaatcttatatcagtttgaggaaaaactccaagctgaaagagaggaagctgctaggaagcaggaagagttgcaagcacaactacaagctcaacaggccgcacttgaagaaaaccaaagtttgctgcgccaggcccaagaggaagtgaaggggatgcataccaagtttgaagagaccaatgcactgctacgagctgtcctgaaacttcagaaagattgaggtagggatgcataccaagtctggggatgatgcctttgcttaaggtttttctaccttgctagaacatatctgtggttagaactttgtcagaactacgtgcaatctgtttgaatgcttcaaacctttgtggtggaacctttgtatgtttgaacctctgttgtggaagaactagtgtgctggaaatgtgtatgacttgtgatgagaatgttgtgtatg

SEQ ID NO: 10957 - DNA, 553 bp, Zea mays
  Clone ID: LIB3279-184-Q1-K6-B5
ataattcttgcaagggaatctggtttggggcttgaactttctgatattcctgtacgaagtcttgtgccggaggcacttaagtcatgtacctcagccgatgaatacatgcagaagttaccatcttttgacgaggattgggcaagagagaggaaaaatgctgaagctgcgggagaagttctgcggtatgttggagtggtggatgtggtcagcaagaaggggcaggtggagctgcgagcctacaagagggaccacccgttcgcgcagctatctggttccgacaacatcatagccttcaccacctcgaggtacaaggatcagccactgatcgtgcgaggtccgggggctggtgcagaagtgactgcaggaggcgtcttctgcgacatactgcgcctgtcttcctaccttggtgccccctcgtagtctgtcaaggttttgcggtgccgtggtgttgtgttgctgctctactactggttttttttgttgttgttagtgcttggaatagctggagtaagtatggattaagtgagttctggggtgttaaggggtgggtgtc

SEQ ID NO: 10958 - DNA, 666 bp, Zea mays
  unsure (1)..(666): unsure at all n locations; Clone ID: LIB3279-184-Q1-K6-B6
gggttttgctgctctccgaccccgagctccgaaggccgcagcatcaggcgaggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggatctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtaccttgcaaggaagctggctggtgatccgaaccttcactttgttgaagctgttgctcttaagcctccggnagttaccatcgacatggctatgcagc

SEQ ID NO: 10959 - DNA, 653 bp, Zea mays
  unsure (1)..(653): unsure at all n locations; Clone ID: LIB3279-184-Q1-K6-B7
cgactgggttaccgacgcagccgccctcagccaggtgcgcgcgtcttctttgggcccttcgctggtgacgagcgcccactaggatcgaggcgtggtgatggtcgttgggtacttccatttggtgctaatctgtgtgggaggtggaattcatggacgttgttaccgggcccaagtttaatcctagcaatttcagggtttctggtgcctgctcattctgaatggcagaccttacggacatcggttgctgcagttgctttagctttttaaggaagcccagtgtacctgtacgtcaacatcaggatgctgatggcatgttatctgaagatttactgaagcgtcaatcagctgaagatcctgatggaagtttctacactggggatgatcctgatgtaagcttttataacggggatgatcttgatagaagcttctacaatggagatgatcctgatagaagcttttacgatagagatgatactgattatattgagggaagcgatgatggaccaccaaggaagagttctgaagatattgtacagttaagaactcaaaatggctttgcatgtagagaaatctcagttaaagagactaanaaagtatttcgctcagaggatgaaaatggtaataagatggtcaatcaatatgtccacttggga

SEQ ID NO: 10960 - DNA, 635 bp, Zea mays
  unsure (1)..(635): unsure at all n locations; Clone ID: LIB3279-184-Q1-K6-B8
ggagaggtgcgagctggtgagatggatcggttggaggagcggaacattaagaagggggagagggagatggaggaggcgcgcaaggaagaggagcggaaggaggaggcgggggacaggaatacccaggagccgcagcaaggtcaaggcctcagcctctcactcgccaacggcagcgacagcggcaggtctggaatgttgccgatgtcgaacccttcagctaatcccacacagcttacaattttctatggtggatcagtatgtgtgtatgactcggtgccaccagaaaaggctcaggcaatcatgcttatagctgcggctgcagcagctgcggcagccaccaaaggcagtgctgccactgcttttaatcctccaatggtacatacagccactgtcgccccagcagcagtcttctctcctgtgcttacacggtctccatcactgcagagcacttctgtagcagctggacaagctcaggttgttgctgaccctagctcaataagcaagcttcaggctgatctccccattgccaggaggcactctctccagcgcttccttgagaaacgtcgtgacagggtcgtgagcaaagctnncgtacagccccgccagtcgttcgatggcatggagtcagcgggaat

SEQ ID NO: 10961 - DNA, 640 bp, Zea mays
  Clone ID: LIB3279-184-Q1-K6-B9
cgcctatgtgcaataactgtaaccttccaggccactttgcagcagaatgcaccttacaaactgtttgctggaactgcaaagagtctgggcacattgccagtgagtgcaagaacgaggccctatgccacgcctgcaacaagacaggtcacttggcacgagactgccctacctcaggtgctaacgtcaagctatgcaacaaatgctttaaatcaggccacatcgccgttgactgcaccaacgaacgggcctgcaacaactgccgtcagccagggcacatagctcgggagtgcaagaacgacccggtctgcaacctgtgcaatgtctctggccacgtcgcgcgcgtctgcccaaagacgactctggcttcagtgatacagggcggcccgttccgagatatcctgtgccgcatctgcggtcagccggggcacatcagccgcaactgcatggcgaccattatctgcgacacatgcggtgggagggggcacatgtcttatgagtgcccttcggcaagaatattcgggctccgcaggctctgaagagcttttcgccaaaagctccgctttgttctgatggctgagaattcgccaggatgtttcatttgtttctgacagtattggaacagttttccttctgccgttgt

SEQ ID NO: 10962 - DNA, 546 bp, Zea mays
  Clone ID: LIB3279-184-Q1-K6-C1
gcttcgagttctttttccttttggcttactgcgcaagagggtaacgagaggacggcggcgatggcgaagaggctgctcccgtctctgaaccgggtgctggtcgagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggtgacactgttctcctgccagagtatggtggaactgaagttaagcttgcagctgataaagagtacctcctcttcagagagcacgacattttgggcacacttgtggactgattcagagcatcagcaagcctgtcactagtcgttggttctagacttctagtgtgagatgcgtagtatcagattctgggatcaaaatccctgagaaagaactctgaactgtcgtgatgtcatagattttgtgatgaaacatcataattgcctgcttcttgttgcaagcgaacttttgcgtttaaaatggtt

SEQ ID NO: 10963 - DNA, 601 bp, Zea mays
  unsure (1)..(601): unsure at all n locations; Clone ID: LIB3279-184-Q1-K6-C10
tttcttttgngagagagcacagttttgttgcaacgctggcacatatgatagcaatgctttccacatggatggttttggagggtctttggttgaatatatggttagagaaactgaaaagctccatgcacaggttgggaggtacaagagcccagatgagcaccctttcttttccaaggatctgcctgagccccagttgccacctatgcaatacccaagggttttgcatcccattgctgattctatcaatatcaacaaagagatttggacaatgtattttgatgaacttcttccaagattggtgaaagaaggaagtgatggtaatgctggatccaatgctctttgtgacacaacctgcttgcaggcactctccaaaaggatccactatgggaagtttgtggcagaggccaagtttcaagagtcccctgaagcttacacgccagccataatagcccaagaccgtgatcaactcatgcgccttctcacatatgaaacggtggagcgtgctgtcgaacacanggtggaagccaaagccaagatcttcgggcaagaggtgaacattggtgctaaggacaacggcagccaaccagtctacaaaatcaag

SEQ ID NO: 10964 - DNA, 650 bp, Zea mays
  Clone ID: LIB3279-184-Q1-K6-C11
ctccttcctcgcttcctttcttacctcttctccacgaaatctgccattgctgctcgtttctcttctgcagcctcgctacttcgctagacatcgctaacaggaggacgtgggcacgtggcagtggtgctggtgcacctctataccatcctcagcggcgtgcatatggcctgctgcgggggaacgcggcgtcgcgcggcggggatacaccgccatcaccttcgacatacgcggcgctccacggggcgtgcgtcggtcacgggctccaccgaggccggacgtcgtcgccgtctaccgatgtgtcgcagagaacatcaggccgcgtgacatcctcctcgtcggatcctcatccggggcaccaattgctggacctgcagttgatatacagtgtgtttggttagaggcatccaatggtccagagtcatccgaacctaaaacagcgtttggttaccgtcacggattcatctcatccatcatccactcattccgatctaaaactaaaatctagaagctgcccattcctcgtaaaacagacggaccaactcattcctcccatccgaacctgcaaggagtgagtccatactggatcacctggttccgaacaggttattccactaaccaaacatactaatagtggatgacatgattgggta

SEQ ID NO: 10965 - DNA, 655 bp, Zea mays
  unsure (1)..(655): unsure at all n locations; Clone ID: LIB3279-184-Q1-K6-C12
ctccctcttctctctcttctctcctccccttgctgcttgtctggtcgccgcacccgtgcaaaaggatcttgagaaattctcctcctcctcctgacctcctcccactccctctgcaatctgcaccacaccaccgttccagcgagcggagtcctggtcgacttctccgggcagcaggcggcgcgaggcgccctcgccgcttcactcgacccccaccgcttctgctatgccgtcggcgccagccgccgtcgcgctagagccacagaagctttcgctgacaccgacgccgacgcagtagtgccaccggccgcgctcgccgctcgccaacggcttgagccgagcgcccctgcagctccctgcaggagaggaatgctgggaaagtttcctcctgaaaatatgagactgaaggtccctataaaatggcctaaaagtcgtgatgtagtatggaaagcaaatattccacacactcaccttgcaaaagagaagtcagaccanaactggatggttgaagctggtgaaaaaatcaatttccaggtggtgggaaccattttcaccatggagctgacanatacatatcaaatattgcaaatataacaatataaacaatgaggggatgcttcgtacagttcttgatgttgggttgtggagttgctagttt

SEQ ID NO: 10966 - DNA, 349 bp, Zea mays
  Clone ID: LIB3279-184-Q1-K6-C2
gttggggtcggggtggcagctccaggcccgcaagttggggcatatcagcaacgacaaattggtcatatgaattggagacccagcttttgaagaaggtttcttaattatctgtaattagggggggtcacaagagcctttatgtaacatcagtaggctccttttgacgggaagcacctttgtttttagtgcagctctttctgatctatttaagctataacaaggtttttgttagcttttccttcccccaggtgaattcaatgtcccatctgaactggtatgtagattgtgatttaaacattgggcaagatctcgcacgagcaccaaggttgagtgccttccattttgttct

SEQ ID NO: 10967 - DNA, 472 bp, Zea mays
  Clone ID: LIB3279-184-Q1-K6-C3
agcaaatggaagtgtcctcgcaaggcaagccctatgttggtcgtccaatgaagcagctccggttggggcagtgggtgcgccgtatgaattgacacctcaacgtctgcatcctgttcagaagagtatgcatcatcaagttgacagtttggaccagtttcagctcttccagtctgtaggagcgcatgtcgctcaagtaggactagatcattataatatctttatggttgtagctatcttcttgtgctactgctatcccagtacaattttttcatagcaccagggtacgtatcagcagaagaccgaactgagacaaattaaatgatgggtaccaaattctgtaaatcttgttttcagatgagattctatgtttttttgttgatgttttgcgaatctctgttgatattagaatacatgggtgaacttagaacttgtagaagttagctatatcatgcaatctatcaattgtttatct

SEQ ID NO: 10968 - DNA, 665 bp, Zea mays
  unsure (1)..(665): unsure at all n locations; Clone ID: LIB3279-184-Q1-K6-C4
gcagcaggaaccctagcaccgccgcatccgcagccatgggtatcgacctcgttgccggtgggaggaacaagaagaccaagcgcacagcgccgaagtccgacgatgtttatctcaagctccttgtcaagctctaccgtttcttggtcaggaggaccaagagcaacttcaatgctgtcattctcaagaggctcttcatgagcaaaaccaatcgcccaccaatctccatgcgccgccttgtcaagttcatggaaggaaaggagaagaacattgctgtgattgttggcacagtcacagatgacaagaggatccaagaggttccagcaatgaaggttactgccctgaggttcaccgagacggcaagggccaggattgtcaatgctggtggggagtgcctcacatttgaccagcttgctctccgtgctccacttggcgagaacacagtcctcttgaggggccccaagaatgcccgtgaggcggtgaggcacttcggcaaggctcctggagtgccgcacagccacaccaagccatatgtgcgctccaagggaaggaagttcgagaaggctcgtggcaggaggaacagccgtgggttcaaggtttaagaaagtgtgggccatcagcatagtaatcacttnctaccgagtagtagcacattntgntgccttggc

SEQ ID NO: 10969 - DNA, 601 bp, Zea mays
  Clone ID: LIB3279-184-Q1-K6-C5
cacaacagcagctcaaaaacccacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgggcggcggcgggcccacgcgcacctacgtccgcgacgcgcgcgccatggcggtcaccccggccgacgtcaaggagctcccgggcgcgtacgcgttcgtggtggacatgccggggctgggcacgggcgacatcaaggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacatggacaagatctcggcggtgtgcagggacggcgtgctcaccgtgaccgtcgagaagctgcccccgcccgagcccaagaagcccaagaccatcgaggtcaaggtcgcctgaggtgggactaggtcgaccgatcgtggctctga

SEQ ID NO: 10970 - DNA, 651 bp, Zea mays
  unsure (1)..(651): unsure at all n locations; Clone ID: LIB3279-184-Q1-K6-C6
cggacgcgtgggctcgggtcaaaccctaagcaggnagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgaatccaaggtgaacgagactaaggcaaccgtcaagttccagctcaagaaggtcctttgcatgggcgtcgccgtcggcaacttggcgatggaggagaagcagatccagcagaacatccagatgagcgtgaacttccttgtttcccttctgaagaaaaactggcag

SEQ ID NO: 10971 - DNA, 615 bp, Zea mays
  unsure (1)..(615): unsure at all n locations; Clone ID: LIB3279-184-Q1-K6-C7
attcctcttgcagccacttcgggcgcgggtgggatcggcccgtggccggcggagatgtccggattcgtcggtgtcgtcgtgtccgacccctcgctgcaggggcagttcacgcaggtcgagctccgatcgctcaaggccaagttcgtgtctctgaagagagattccggccatgtcaccactaagaatctcccggcgatgatgaagaagctgagggggctcaatgaggtggtctctgtggaggagatcgcggccttcctgtccgagtcgtaccccgacagcgatcaggagattgaattcgaatccttcctccgggagtatctgaatctgcaggcgcggatgagtgccaaggagggtggtgccggcggtggccggggtggcaagtcgtcgttcctcaagtccagcaccactacgctgctgcacaacctcaatcaggcagagaaatcttcgtatgtggcgcacatcaatacttacctccgtgaagacccattcctgaagaagtacttgcccatggacccgtctggaaaccagctgttcgatctcatccgggatggtgttctgctctgcaaactgatcaatgtagctgtacctgngaccattgatgagaggggcataaat

SEQ ID NO: 10972 - DNA, 382 bp, Zea mays
  Clone ID: LIB3279-184-Q1-K6-C8
ctttattgttgacctcaaggcagacaagaaaaagacaaggctgcagtcaagaagatgtatgacattcaagcaaagaaggtcaacaccctgatcaggcctgatgggaagaagaaggcttatgtgaaactgacacccgactacgatgcccttgatgtggccaacaaaattggcatcatctaagttaataggcaactggattcgacatctatgtcctactagttctgagcataccaacagatttttctatgttactagtaattttgtttgtcatattgggttgtttttttgcaactaagtcttgttcgcagtcgcagactacatatgcctgtattgagttcctggttgccaaattaaccatcttgaactggcattattccacttt

SEQ ID NO: 10973 - DNA, 668 bp, Zea mays
  unsure (1)..(668): unsure at all n locations; Clone ID: LIB3279-184-Q1-K6-C9
ttgtaaacccgaaccagnacacaacggtttgctttcaaatcatacaatccgaggtctcaaagtcgaagagggttaatcccctcccgttccactgttgcccaagtccaaccaccagcgagatggcggggaccgtgaccgcgaccgcaaccacggccaccaccgaggtcgggaccacagtgaccgcgagccacctccgagatggaggccaccgcgaccgcagccacctccgagctggaggccaccgcgaccgcagccgccatcgggccgccttcagccatccccgataaatatatgcataaaaaccggttgcagtcatttgctgaacgaacatataagaaaacgccaatctacaaggttgagtctgaaggccagtctcatcagcctaagttcacatgcacagtggaagtgggtgatcaacagttctcatcaactggtagttttagtcgtaagaaggaagcagagcaggacgctgcgagagttgcttatgagatcttgacaacagttagtgagagtgacgttaaggaggcatttgagctaattgatcaggatgcagttttctgcaaatcaattctcattgaatttgctgtcaagacaaagaccactttgccctcttactctgtagtttgtgtttgtctcaaaaagcctttgaccctgttcgctgcatttgg

SEQ ID NO: 10974 - DNA, 563 bp, Zea mays
  Clone ID: LIB3279-184-Q1-K6-D1
gcctccttcattccgtcccgttcgtgacgacctccggtcccgggagggggagggggagggggagggagaggcgaggtcatggcctccggcaccggctccggccagccgcaacccgcagcagctgatgctgacccgggagccggcgacaacaagctcgtcttcgagacgccgctgcagccgcagcccgtgagggaggactacgtcgagaacgccgtcaagttcctctcccacccaaaggtcaggggctcccccgtcgtctacagacgatccttcctcgagaagaagggcctcaccacacaggagatcgacgaggccctacgaagagtccctgatcctgaacccatcactacggctaccgcttctccacagcagcaggttggcagccagaatcaatcagctggggcgcaaacttatgcgccagcgcgatctatgcacccagcaaccgctggccctgtcgtccgaccccggttcagctggtaccaagcattcctcgctgcagggctcttgcttggttttggtgctagcacggctgtctttatcaagaactgttccttccttagctc

SEQ ID NO: 10975 - DNA, 157 bp, Zea mays
  Clone ID: LIB3279-184-Q1-K6-D10
aaacgcattactgtggtttgctttgtataacgccgccgaaacatcgaacggtttcctttatcacctgctgttctgttaagcttgtaatctttctgaacgtgcagttacctgcccagagctgagttcattatacaataaataccgggatgttaatgtt

SEQ ID NO: 10976 - DNA, 353 bp, Zea mays
  Clone ID: LIB3279-184-Q1-K6-D11
gttgcagcctgacgctccttttgaactggatattgagctactggaagccgtttctcctgccaaagaatgagcttttctgtttccagcagacaggggggcacttatggagtgtgccagatttcagaggaatggattacataatctactgacattttgaggtccatgctggctagatatgcaattgaaataacctatgattagatgcatgctgagatggtggttgctgggacaattttatttttttgggttcaaggcacagcaatttctttttggacaataagcagaaatgtggtgtgtaaattgtttccccttctcgaagtaaaatacatgtataaatttccttcattattttc

SEQ ID NO: 10977 - DNA, 574 bp, Zea mays
  unsure (1)..(574): unsure at all n locations; Clone ID: LIB3279-184-Q1-K6-D12
agnacgcgagcgggccgccctgggggggggggggggtggcaaaaccatgcaatcacgagcacaccagtacataacatcagaaaatgtgggatacacataatccggaaagcaagcttgggagcaacaacactaggactgactgacgcactccgcaaaagtgacacaatcttgaggggaggcggggggtgtgtttatgccagggcagggaactgagcctggtcttcgatcgctggagcagcagctggtccccgataaccggcgttgtaaccaccacggaaccccccacggcccctaccacggccacggccactagggttatagtacctctcgccttcagctggcttcaagaactcgttgatgctcagggacttcttgccccgttcttctctttcagcactttctttctttttcaagtccttgtcagagcccagcttgataaacacttcatcgccatcctttttaactgacagttgttgcatggcctgtagctccttgtcaatttcaacttttctctcctcagccttaagggagagtaaagcttttcgtttttcctccaggaccttttcatattcct

SEQ ID NO: 10978 - DNA, 637 bp, Zea mays
  unsure (1)..(637): unsure at all n locations; Clone ID: LIB3279-184-Q1-K6-D2
gcacagtacccgcaaacccaaccagcatatggtgatcaagcagctcaagccaatgcgaactatgggtaccagggagctccagcagatcccaactacggaagtgcgtacccacagcagccagggtatggtcctcctggtcaggcaactggtcaggctggttatgcatcctctgcgccagcggccagccagcctgtgtatggccaggctggatatacccagccacctacaaatcctccaagttatgatcagtctgcagcaccagcggcgactcagagcggttatgctgcgccccctgcaaatccacaacagcctgctgcagcaaaaggggtctcgccacagcctgctgctgctgctgctgctggatatggtgctagcgggcagtggacggcatgagcctcgtcttccgaacttcgatgacagcaaggtcaggttggatatccgcttttggcgcgtgtttgaatgtttgcatcttttggatgtctgtggacgcatcatgtagggcttgaccccgttatcgaaagagattgtaaccccttgagttgtgatactggacatcttctgtagtatctacgagtagttgcttaatgtgacttttaaacattctattcagttgggatgttccttgntcttgctaaaa

SEQ ID NO: 10979 - DNA, 656 bp, Zea mays
  Clone ID: LIB3279-184-Q1-K6-D3
gatgatgaagatgaggaggataagaaggatgaggagggtaaggttgaggatgttgatgatgaaaaggaagaaaaggaaaagaagaagaagaagatcaaggaggtttctcatgagtggcaattggtaaacaagcagaagccaatctggatgaggaagcctgaggagattaccaaagaagagtatgctgctttctacaagagcttgaccaacgactgggaggagcatcttgccgtgaagcacttctctgttgagggccagcttgagttcaaggctgtactctttgtgccaaagcgggcccccttcgacctctttgacaccaggaagaagcagaacaacatcaagctctatgtgcgacgtgtcttcatcatggacaactgtgaggagctgatcccagagtggctgagctttgtcaagggtattgttgactctgaggatcttcccctcaacatctctcgtgagactctccagcagaacaagatcctcaaggtcatccgcaagaatcttgtcaagaagtgcgttgagctgttttttgagattgcggagaacaaggaggactacaacaagttctatgaggccttctccaagaacctcaagcttggcatccacgaggactccacgaacaggaccaagattgctgagctcctgaggtaccactc

SEQ ID NO: 10980 - DNA, 518 bp, Zea mays
  Clone ID: LIB3279-184-Q1-K6-D5
gatcgggtcacttttcttggatcttctatctggaagtggaatgttcaccaaacaggagatcgatgagattgtggagatcggttatctcaatgggctctttgtgcttgcacgatcaattggcctgatcgggcataccttcgaccagaagaggctcaagcagccactctaccgtcacccatgggaggatgtactgtacaccaagtgagaaagccattctttgcaaggcataataaagtattattatcgcctagagcttccagttgcctagcttccagttgcctgtacacttcattaaatcgagcacttgcaaaaaagaaagccagagagaggaagacgaacatcactagtcagcactagattgtgtgttttatgttgagttgcaaattcaggtcctgatttttgtcctgccatgaaccgttaggcgatattgtattggaaaggatgcttccgttattgtttcacgatataccgcctcagagtagaagtttccagtaaaaatgaactctgatttgttcgtc

SEQ ID NO: 10981 - DNA, 634 bp, Zea mays
  Clone ID: LIB3279-184-Q1-K6-D6
ctcctcgtctcctcggtctcccctccctgtcttccagaaccagagcaggcgctcttcggtcggggagaacgcgacccgacctgggctttatctcgttcgtcggccgggttctcttcgcctccctcttcctcctctcggcctaccaagagttcattgaatttggaaatgacggtggacctgcagcgaagaccttgaagccaaagttcaatttgttcgtcaagctagtgtccaagaatactggactggggctgccgcatatggatataaaaactgtcattgcagctaccatgtttcttaaaggctttggtggtcttctgttcatagtcagcagctcatttggagcattcctcctgctcatttacttggcgtttataacccctattgtgtatgacttctacaaccatgaaatggagtcaacactgtttgtcgatctttttttcaagttcatacagaacttggcgtttatgggtgccctgcttttcttccttgggatgaagaactcaattccaaaacgtcgctccaagggaaggacaacaaaaaccaaaacaaactgatgtcagtggttgtaggaggggaaagcattgggctcattatgtttgcatactatacaggaatagatgtcccacttttgttc

SEQ ID NO: 10982 - DNA, 527 bp, Zea mays
  unsure (1)..(527): unsure at all n locations; Clone ID: LIB3279-184-Q1-K6-D7
gtgatctaattcaactactacatgatctattttccatggacatgatagtaaaggtaatcaaatacagtacagagatggtcaagtggatgctccgttacattttctgtacccatctgatactgacggaagcgaggaaacctgagttctatggtttagagcagtttgggaaccccatttttacaagnggaaattagttcatttttctttgagaaaatagaaatcccttgngaaaaatggagttcccaaactagccaagaattccaccttgctggtctataacagttcagattccaccttgctggtctataacagttcatgctttagttcggatgctgaaactagctcctgtaaaatcagtctaacgaactcttgcagcctgcagcttgcccatgagaagttgagatatatccaccgtatgccacattgtgtatattgattgtcagatgctgaaactgaagattgtagggtgctgcggtgtaagatgtgtaaaagcggtcatgtatgtatggttctaaagctgtctgtat

SEQ ID NO: 10983 - DNA, 563 bp, Zea mays
  unsure (1)..(563): unsure at all n locations; Clone ID: LIB3279-184-Q1-K6-D8
ctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcggttaggtcgcccctctcccggtggcgaattacgtggtggcggtggcggtcgtgttgtgttcttggtctagttagtctgtgttgtctttatcggtgctgttttctgtggtggttgtactgcatcgttctagtttctagtccatgtgctgtaatatctcgctgctgtaatcaatggaatgtcctcgtttcaagcctcaaaaaanaaa

SEQ ID NO: 10984 - DNA, 617 bp, Zea mays
  Clone ID: LIB3279-184-Q1-K6-D9
ccccgcgtccgcttttgtaaatcggatttgttttacttgcctgcattattctcttttggagaagtttcctgacaatgtagatatatctgtagaggctgctactcttggaatttctctcgattgctttaaaggaaggtgtagaactccagacatcattaaattggggtgatgaactatatgatggtgaatcaaataaacttcagagtattggccttcagtcaggagatgcctactcaccgcctgaaaattggtgtgcagaacgtttagggagtcagagacctggcaatctccctctgcacgaagttttacaggttcttgtttattgtttgcaaagttcacttaaatttgttcattacaaaatgttgcagtttatctagacacatgcatgttatatacaaaactgtttctttcctgttatcgcatatcctgtttttggtaggcttagaatactaagttgtcaatgtgtaaacaaattatttatagaaggattgcctttgtattagatcaaatttagctagctaaagctgtcatgcttcgcaaacaaagttatatatcttgttaacttcctgttttacaggttttatttaaccacttggcatgctaatatgaacatcaac

SEQ ID NO: 10985 - DNA, 518 bp, Zea mays
  Clone ID: LIB3279-184-Q1-K6-E1
ccccgcgtccggcttatgttcctatatgactactagctagaagttagagcctagatgatggctgcttctgttggcgtgaaagctcgagtgctcctaaatggtcgtcgtattagctgatacgacatcgaaccgatgcaatagataatattgtttacacgtattctcgccgagaagggagtagtagtattacctgatatctatgctaattcaggtggtgtggtcgttagctactttaattgagtgggttcagaacattcaaggtttcatgtgggccgaggagaaagtggacgacgaactagaaaaggacatgagcagtgcttttcaacacatgaaggccatgtgcgaatctttggtgctgccgaagtgtgccgtgacattggaattgcgggtctagaaaaacaagctcattagatttctgaaaaaacattaggagttattagattggtagcatttttttaagatttaaaattttatagaagtcatcattttcgtttattggaagaaattttttggaagtt

SEQ ID NO: 10986 - DNA, 581 bp, Zea mays
  unsure (1)..(581): unsure at all n locations; Clone ID: LIB3279-184-Q1-K6-E10
cggacgcgtgggcggacgcgtggaagtgcggcatcaactaccagcctcctagcgttgtgcctggtggcgacctggccaaggtgcagcgtgccgtgtgcatgatctccaactccaccagtgttgtggaggtgttctcccgcatcgaccacaagttcgacctcatgtacgccaagcgtgccttcgtgcactggtacgtcggtgagggtatggaggaaggtgagttctctgaggcccgtgaggacctggcggcgctcgagaaggactacgaggaggtcggtgctgagttcgatgagggcgaggatggcgacgagggtgacgagtactagagaagtttgctgatgacgcagcatcaggccagtgtgctgcccttatcccgtgatctgccgagagttgctcctgctatcgtgttatgtgtgtctgttctgaagtattgtgtggtttacaacacctgatgttgtaagagttgttaattcccctgcattgctaccgggttattgagaataattatggctgtttacgttgttgcttcatctcggagatgctntacatttaccaccttgttcatcttttgtcatcagtaa

SEQ ID NO: 10987 - DNA, 628 bp, Zea mays
  Clone ID: LIB3279-184-Q1-K6-E11
cccagcgtccggcgaaagcgtggtgcgggatgtggagaaggctgcaattgaattgcttgctgccagagctttcactgtctctgagcttaggaagaaactacgaagtaagaagtatccttttgatacaattgatgccgtgattgctgatttcaagtcaaggggtttgttgaatgatggtttttatgctgaatcattttcgcgatcccggtggctaacatcaacatggggtccaaggcgaataaaacaggcacttcaccaaaaaggtgtcccagaggcagaagtagatcaggcaacgagacgagtgttccaggatggtgacgactatggaaaggaggcaacgttcggcatgtccgaagcttccatggatcgtctgtttgctcaggcgtccaaacagtggcagcgtgggcaaagcttgaccctggagagccgacgtgcgcgcatggtgaggtggcttcagtaccgagggttcaactgggctgtgaccaatgccgttatcaggaagctggaggctcaacaccctccaccctgactcttctgactagatgaatggcaacaaacatatcaagttcaaactgagaagttcaggcggatgctgcctcgccttctgtgctgggctctgtttttttta

SEQ ID NO: 10988 - DNA, 624 bp, Zea mays
  Clone ID: LIB3279-184-Q1-K6-E12
ttttgctacaatggcggcagctgctagtgccctgggcgtcctgctctgctcagccttctgctcccttgcccaccgggcggccggcgtcgactacggctcgtggcagagcgcccacgccacgttctacggcggcggcgacgcgtctggcacgatgggcggcgcgtgcggctacgggggcggggcgggacggggtacggcaccaacacggcggcgctgagcacggcgctcttcaacgacggcgccgcgtgcgggtcctgctacgagctgcgctgcgacaacgacgggcagtcgtgcctgccgggcaccatcaccgtcacggccaccaacttctgcccgcccaactacggcctccccagcgacgacggcggctggtgcaacccgccgcgcccgcacttcgacatggcccagccggccttcctccagatcgcgcagtaccgcgccggcatcgtgcccgtcgcgtacaggagggtgccgtgcgtgaagaaggcgggatcaggttcaccatcaacggccactcctacttcaacctggtgctggtgaccaacgtggccggcgccggggacgtgcagtccgtgtccatcaagggctccagcaccgggtggcagcccatgtcccgcaactggg

SEQ ID NO: 10989 - DNA, 437 bp, Zea mays
  unsure (1)..(437): unsure at all n locations; Clone ID: LIB3279-184-Q1-K6-E2
cgnggttggtcaaaagggagtggagcccatctccagcacggcggatgagatgaaatcggcccctaagaccgcagttacatgccaaagatgcaaccatggnagaagcatacttcaagcagatgcagattcgatcagctgatgaaccgatgacaacaatatacaggtgttgcaaagaagaatgccagcatgaatggagagaggactgaccatagcattcgcactttgcttacacttcgctccctgtgcttcttcagttttgagtgttgggatgccctgttgcacatgtaatgcttctaatcagcgtatacttaagtacaaatttttggaaatgtatgttctatactatggcatcgctttttggctgcaaaagacattgcatgacacatcatctagagttatttgtgatgatgatctcaatcatcagtgagagctcactt

SEQ ID NO: 10990 - DNA, 646 bp, Zea mays
  unsure (1)..(646): unsure at all n locations; Clone ID: LIB3279-184-Q1-K6-E3
ccccgcgtccgccccgcgtccggcttgcttgattgttccagatattcgcagttgaccgggtcctcggagcacgatgaagtttgttgctgcctacttgcttgctgtcctcgctgggaacgccagcccctccgctgaggatttgactgccattctggagtcagttggctgtgaagttgacaatgaaaggatggaactcctgctgtcccaactgagcggtaaggacatcaccgagctcattgccgcgggcagggagaagtttgcttcagtcccatgtggtggcggtggtgtcgctgttgcggcagcttcacctgctgctggcggagctgctcctacagctgaggcaaagaaagaagagaaggtggaagagaaggaagaaagcgatgatgatatgggcttcagcctcttcgactaggctgcacagtcatcacagtattgtttcgggcagtgaaaccagaggaaaaccagagtcatgtttagattttaaccttgttttatgttggaaagtactgctacttgtctttatatttggtaattcagccgtaggttgctatgctggttgggatttactcgtgaaccagagtttttctatcttatatcctgaatttgttatcccaaagtttcctggctttttaactantttnngtgt

SEQ ID NO: 10991 - DNA, 616 bp, Zea mays
  unsure (1)..(616): unsure at all n locations; Clone ID: LIB3279-184-Q1-K6-E4
cttattacggccgccggnanagggacaaggttctcccggcgggatgggcaagcagcccggccttccgggcgaccgcaagcagggagacggcaagaaagagaagaaatatgaaccacccgctgccccttcccgtgtcggccggaagcagaagcggcagaagggctccgaggcggcggcgcggctccccgccgtggcgccgctctcaaagtgccgccttcgcctactcaagctcgaacgcgtcaaggactaccttctcatggaagaggagttcgttgccagccaggagcgcctgcgccccagcgaggataagacggaggaggaccgatccaaggtcgacgacctccgcggcactcccatgaacgtcggatcgctggaggagatcatcgacgagacccatgccatcgtctcctcgtccgtcggtcccgagtactacgtcgggatactttccttcgttgataaggaccagctcgagcctggatgtgccattctgatgcacaacaaggttctgtcagtggttggtattttgcaagacgaagttgatcctatggtttctgtgatgaaagttgaaaaggcacctttggagtcttatgctgacattggtgggcttggatgctca

SEQ ID NO: 10992 - DNA, 566 bp, Zea mays
  Clone ID: LIB3279-184-Q1-K6-E5
ctcattcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggaaaaggcgtacagtggcgggagcaacgaggcaaagtcgcccaagaaggccgccaagtcccctaagaaggcatagactgactgtccggagtg

SEQ ID NO: 10993 - DNA, 528 bp, Zea mays
  Clone ID: LIB3279-184-Q1-K6-E6
atacagcaacaagtacaaggtgaatgtggtcatcccctttcttcttctggttgctactggctgcagtcttaatcttgcagatgttcattacgaagagggtcttgaggacattcaagcacacgagattcctagttaggtgaaattcctttgtagggggatagtagctaggctctgacaagtagtgcttggtgcgtaatttctgcctttgctctttttccctttgtcagcgtcgaattttggtggtcggttgtaaagcttgtgttgagggggcttttgcggcttgatttttgtcctggattcgagttttgacaccggaggttgaagaagcggtaggatgatggtagtcctttagatcctgttgtaatgtatttaactgtgaggtgaggctggacacaataaattctgtaggcgtgtttagaggaagaagggggaagttgtgtgtgatggtttcttcagagaagattcctgctactgtgtacttcgaatctgtttttggatggagttaaattgacattatcgatgtcgtcc

SEQ ID NO: 10994 - DNA, 633 bp, Zea mays
  unsure (1)..(633): unsure at all n locations; Clone ID: LIB3279-184-Q1-K6-E7
cggccgcgtggggtcacatggcttactgatcctatgcatggnaaacaccatcaaggccccttgtggcctgaagactcgtccatttgactccattctggctgaagtgcgtgccttcttcgatgtgcatgaccaagaaggaagccaccctgggggcgtccaccttgaaatgactgggcagaacgtgaccgagtgcatcggtggatcacggaccgtgaccttcgacgatctgagcgaccgctaccacacccactgcgacccaaggctgaatgcctcccagtccctggagctcgcctttatcatcgcagagaggctgaggaagaggaggatgcgatcggggctcaacagcagcctgccactgccgccactggctttctgagtagccggagccaaacacaaaggagggtaggaatagctgtggtgactcggaagagaaagagacagtcgacgccttgttttgttgatgcttagtgtggtgacctggtggtggtggtggtgggtgttcttggcacaagttacatgcntgggatagctataggaggtacctgttgaggtgtgtaagacagtagctagcaaccgtatgccttggtttcctgtttgggtgcgtgacttgccgactttctagctgcttctggg

SEQ ID NO: 10995 - DNA, 646 bp, Zea mays
  Clone ID: LIB3279-184-Q1-K6-E8
cggacgcgtgggcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagatccatttgatcaggatgactggagcacttatgccaaactcactgatgagattggacagaaagtgcagattgtaggagatgatcttctcgttaccaaccccaccagggtcgccaaggccatcaatgagaagaccctgcatgctctc

SEQ ID NO: 10996 - DNA, 387 bp, Zea mays
  Clone ID: LIB3279-184-Q1-K6-E9
cagcggtcgagaaccaagcgcaggaccgtatccaccgaattgggcagttcaagccaatcaagagcactaggtttgtgataaaggacacggttgaagagcgcatactgcaactgcaacagaagaagcagctggtgtttgaaggcaccgtgggggactcgccggatgccatgtcgaagcttacagaggcggacctcaagtttctgtttcagatctaaatgctgacgtagttaagcatgagtagggagggccaggctatgctaggactaggagcactgacttgttggaagttggaaccctgacgctgccataacaccaggacggacggggtcggcggtgcgtcgactgctgctgtgcctgttggaactgatgtacttttgcagtgtgtgt

SEQ ID NO: 10997 - DNA, 638 bp, Zea mays
  Clone ID: LIB3279-184-Q1-K6-F1
cccacgcgtccgctgctctgctgctcctcgcgccgccgcagcgacgtaatggcttccgccgcggtgctccggaacgccggctcccggcgcctcttctcctaccctactctccgcgccgctgcgatatatgtaccttctgcgctacccgatgcgcccgcggcggcggcagcgccggcccagccgccaccgatggccgggaccctctgggcgaggtccatggccaccttcacgcgcacgaagccccatgtgaacgtcggcaccattgggcacgtcgatcacggcaaaaccactctcactgctgccattaccaaggtcctggccgaggcagggaaggccaaagccgttgctttcgacgagatcgacaaggctccggaggagaaagccagaggaatcaccattgcgacagctcacgtcgagtatgagacggctaaaaggcattatgctcacgttgattgtccaggtcacgcagattatgtcaagaacatgatcactggagctgctcaaatggatggtggtattcttgtcgtgtcagctcctgatggcccgatgccacaaactaaggagcatattcttcttgcccgtcaggttggtgtaccttcccttgtgtgcttcttaaacaaattgatgctgttgatgat

SEQ ID NO: 10998 - DNA, 642 bp, Zea mays
  unsure (1)..(642): unsure at all n locations; Clone ID: LIB3279-184-Q1-K6-F10
ctagggctaactttacttttggcccaggccccaactccccaagcccaattgcacataccccttcaattcactttttttctctcgtcaccatcataatggtgcggtctggagctgcttctccgcctccagtggtccagccacctggatgcaggactacagtggggacaaggcctttggaaagaagggagatgggtgttactggctgccaggcatctggggcagcttcacagcccagttgtaagggctgtgtacctctgcttgattttaatatttgactaaactgaccaggatatcttggcctattctatttttaattctggttcttttacatctttgtatgatctccttactgaaacataccgattatattatgcaatatcggtttaatggttccttggcgctcctgcagttatcaaatggacatttgaaactaccttcttattttggggcaattgcggtgttagtctgcttcgtgtctgctggtttctctcttgcatttgctttcgctatcattccacggcaggttatgccatggacaggtttgctactgatgcttgagtggatctttgtggcattcttcttattgtttgggagttatctncgtgttgtctaccggtggggaagtatcagtgcaaaccatgt

SEQ ID NO: 10999 - DNA, 629 bp, Zea mays
  Clone ID: LIB3279-184-Q1-K6-F11
ccccgcgtccggctggatctgacaataggatacacagcctgtttgagagagctctagctgatgataagttgcagaagtctgtcctattgtggcgctgttatctagcctatgaggcagaaatagtctgcaactcttctgcagcacggcgtgtgttcttcagagctatacatgcctgtccatgggataatgctgacatgtttgatgttggtgtggttttgtctcccttgcagccttctcctaaacgttgttctgtagtcaattgaataaaaaacaagttatttgttatgaaaattgatctacaatttctcctgataccggaccatgaaaagttaatcttgttagaggatgatatttccttttcagctgttgatatctacttaagggcaaccttctctttcaatatggttcctgtataagaaaaaaatgcagtcactattaatttatgtatgtactcataacacctgaacagcttatgaactgtttgctagggacatcttgcagattttttattccttcccatgtgattgtaaaaagtgttttgaggacatcaagtgcattttagtttcatcacgtttaccaattctcttgacatttgtcattatcttatattaactaatcctttatcagta

SEQ ID NO: 11000 - DNA, 659 bp, Zea mays
  Clone ID: LIB3279-184-Q1-K6-F12
tactcgggagcagaatcaagaaacgagatatggggtgatgtggtggcttgcatatggtggtcgaaccattgagctatataagtttgcaagacgaattgttagtctttgtgcttcatcatccggttgtgagcggaattggagcaagtttgaatttgatttccctttgccaatagcattgggggagaacagtggaaggtgcaagactaacgagcatggggagaagatacttccggatggaactccgtgggttccaaaactgatgaaagaaattactgttgttatctcaaacgggagcaagcccattcatgttgatcagaagttaattgatggtccaaaccctaacaatcgctggaagatgttcataccaattatacttgcagtggagtacttcttggtagtaaaaggaatccggagggcgatccatgcagatatcgcaaatgggaaggtggatgactgggagcagcgttaccgggacttggttggaagcagggaccctgtggagcagaaaggttctaccaccaggaaccgcaaagcctaagttggtgttagcagaaatgattttattcgtgttgtgacccactcgatctgcttgctgttccttttcctaattatgtgttgagggctttatagaggtcgctggttctacttgaaaaataatt

SEQ ID NO: 11001 - DNA, 676 bp, Zea mays
  Clone ID: LIB3279-184-Q1-K6-F2
gctgcgtcgggcagaggtggttgcgggaagcagtgggggttatcaagttcaatccaagcaaccccgatctcttcctatctggtgggtccaagggttcccttaaactctgggatattcgatgtggtctggtaacaaaagaatttcagagaagccttagaaccatccttgacattgacttcagtgctgatggaagacaatttatctcttcaactgacacaaccagaagcaatattagtgagaacactataattgtttgggatgtcctgcgacaagttcctttatctaaccaggtttataccgaagcattcacatgcccgtgtgtaaggtaccacccacgtgaagcatcatttgttgcacagtccaatgggaactacattgctattttttcagcaaggccacccttcaagctgaacaagtacacgcggtttgaaggacatggagtgtggggtttccctgtgaagtgcagcttttcccttggcgggagagaactcgcatctggttcatccgatgggtccatttacttctatgattacaggtcggcaaggcttttgaggaaaatagaagccttcaaagaggcgtgcactgatgtcgcgtaccacccagtaatgcctaatgtgatcgctgcttgtagctgggctggtgaaaatctgtctttgagtgacatgattataatgct

SEQ ID NO: 11002 - DNA, 140 bp, Zea mays
  Clone ID: LIB3279-184-Q1-K6-F3
aacgattcatgtaatagacgctatatatgaagtgtatttggcttccttgtgatgatcgagaggctaattaatgtaccatacatatctatctcttgagtatcgcttggcatatgcagtattaattgattacgtgcctaatt

SEQ ID NO: 11003 - DNA, 470 bp, Zea mays
  unsure (1)..(470): unsure at all n locations; Clone ID: LIB3279-184-Q1-K6-F4
tctttcttctttagttgcaagtttntgaaaattaaaggctttcctttgagtggagttcttatgacaatcatttcaggaattattggatgcacaaaagttaagatactaccttaaatgattgtctttctctatggtttcagtgcattgattctaatgggaaagttcgcataactgaaactttgccgtggatcttgtgaattttagtgggaatttgatcgtggaaagtttatgaagttttgttgggattatggatgcataagatagtggtgtatgtgatttgcccatagtttctgcagcctcattgttttccatttgggatcaataaaacttcatgctcatggatagggctgatacatcaggttttgtcagtggtggtatacattacatgaacatccatgtgtattttcattttgtgtatactatgtgcttcctcagtggtgaagttgtaaagctggagttctagatcgcga

SEQ ID NO: 11004 - DNA, 267 bp, Zea mays
  unsure (1)..(267): unsure at all n locations; Clone ID: LIB3279-184-Q1-K6-F5
tccgcccaatcgggccatctcttcccgctcgccgnaggggaggctgacatcattgtcaagtccctgctgctcggnaccgatcatctgtcgtcgtcggcctcacagcctcctcattctccatgaatccaggtcgtcacgtgtagtccgttcgcatttcgttgcccgtctctcactgtttctgtggggggaccgatgctgcaggattctctagcgttgtagctaggatgctctgtttttctaaataatggaactaagttttagcctacg

SEQ ID NO: 11005 - DNA, 600 bp, Zea mays
  unsure (1)..(600): unsure at all n locations; Clone ID: LIB3279-184-Q1-K6-F6
cccccctccggcgaatggcccccaagcgagtggcagggcgccggtgccggccaanagnaanacggataagtgacgaaccctctattcgagaagnagccgaagcagttcggcatcggcggcgcgttgccgcccaagaggacctgcaccggttcgtcaagtggcccaaggtcgtgcgtatccagcggcagcgccgcatcctcaagcagcgcctcaaggtaccaccggcgctcaaccagttcacccgcaccctcgacaagaacctcgctacgaacctttttaagatgcttctcaagtaccggcctgaagacaaggctgccaagaaggagaggcttctgaagagggcccaagctgagaatgaaggaaaaactgttgagtcgaagaaaccaattgttgtgaagtatggccttaaccatgtgacttacctcattgagcagaacaaggctcagcttgttgtcatcgctcatgacgtggatccgattgaactggttgtgtggcttccagccctgtgtaggaagaatggagtcccttactgcattgttaaaggaaagctcgtcttgggtcgattgttcacaagaggatgcatcagtcttgtgtcttacc

SEQ ID NO: 11006 - DNA, 563 bp, Zea mays
  Clone ID: LIB3279-184-Q1-K6-F7
cgtccagcaggaagaatcgagcgccaggagaggagaagaggctcgtacgaagcagaccgcccgcaagtccaccggaggcaaggccccgcgcaagcagctcgccaccaaggcggcgaggaagtcggcgccgacgaccggcggcgtgaagaagccccacaggtacaggcccggcaccgtggcgctgcgcgagatccgcaagtaccagaagagcacggagctgctcatccggaagttgcccttccagcgcctggtccgtgagatcgctcaggacttcaagacggatctgcggttccagagccacgccgtcctggccctccaggaagccgccgaggcctacctcgtcggtctgttcgaggacaccaacctctgcgccatccacgccaagcgcgtcaccatcatgcccaaagacatccagctcgcccgccgcatccgcggcgagcgcgcgtaggcgtatctcgcgcccggccccagtggcggcggagggatggaggagtgcaatttgtaactttatgctgtttgttcgcttttagacggcgtggcgaagtagtgtaaaaacggcttta

SEQ ID NO: 11007 - DNA, 624 bp, Zea mays
  Clone ID: LIB3279-184-Q1-K6-F8
cggacgcgtgggcgcgctgcggttcgacctcgagtccggccacaccaagtgcatctccgacgagatcaaggttaacgccatggccgtcggcaagtaccacatcgtcagccccgaccccaacttccccgatgcccagctccccgaatcgcaccgcatctccctcagggtgacgtcgccgtacgggaacagcatgcactacgcggagaacgtgcagtcgggccacttcgccttcacggcggcggaggccggcgactacctggcctgcttctgggcgcccgaccataagccaccggtcaccatcgggttcgagttcgactggaggagcggcgtcttcgccaaggactatcccagcgtcgccaagaagggcaaggtcgatatgatggaattggagctgaagaagctagaggaaactataaaaaatatacatgaagagatgttttatctgcgtgaaagggaagaggaaatgcaggacctgaacaggcgacacaaactcaagatggcttggttagggttcctctcccttggcgtctgcttatcggtggcaggtttgcagctggggcacctgaagaccttctttgagagggaaaagttgctgaagttgcccacggtatatttttgggtgaa

SEQ ID NO: 11008 - DNA, 622 bp, Zea mays
  Clone ID: LIB3279-184-Q1-K6-F9
cggacgcgtgggcggacgcgtggggcgctctgcgccgccgccatggaggacgacgatgactgccctcctctcgccgttgagctccctccgcgggtgccgtcccctccagagcaatctccctcagacgcctcgccagttggcgtcaccgtcatcaccggctacctcggggctggcaagtcgacgctagtcaactacattctgaatgagcaacatgggaagagaattgccgtgatactaaatgagtttggagaggaaattggggtcgaaagggcgatgatcaatgaggggcaaggtggtgcacttatcgaggaatgggtggagctggccaatggatgtgtctgttgctctgtaaaacacagtctggttcaagcacttgagcagcttgtgcagagaaaggatagaatggatcatatattacttgagacaacagggttggccgatcctgctccacttgtttctgttctttggctagacgatcaattggagtcgtcaattgtgctggattctattattacggttattgatgcaaaaaacttcagggttcagattgacgagcacaaaaactcttcctcattccctgaagcatttcatcaaattgcatttgcggatgttgtgatattga

SEQ ID NO: 11009 - DNA, 667 bp, Zea mays
  Clone ID: LIB3279-184-Q1-K6-G1
attttgaggaaactaaagaagacatcaaactattgcgcatccaaattgaagatgatctacgaaatggagttgctggggctgttccagttccacctgatgagggtggcaaagaagatgttatcaattcattggttgccaatgttgaatcaatgattaaagcagaccggaagatcacatcattgaaacaacttcagggtcatatttggaggattggatttcaaaagaaagagctacagggagttgtctttgaggatgttcctgtggcgctaaagaactggcatgctagtggcataaaggtctacatatactcaagtggaagtagagaagcacaaaggcttctatttggcaatacaacatacggtgacctgcgaaagttcctgtgtgggtattttgataccacaactggaaacaaaagagaaacaaggagttattttgagatctctcaatcactcggcgtggacagtccatctcaaatcttattcatcaccgatgtcttccaagaagccattgctgctaaaaacgctggttttgaggtgataatctccattcgcccgggaaatgccccacttcctgacaaatcatgtttccgcactatcaaatcattcagcgagatctgaggaatctggtgatctggacatgtctagatatatgtaattcgcgagtgctt

SEQ ID NO: 11010 - DNA, 591 bp, Zea mays
  Clone ID: LIB3279-184-Q1-K6-G10
cgaggcgaccctccctccttcgctccttccgcgccgcctcccgggcgtcgccgccatggtgaagtactcgcaggagccgggcaaccctaccaagtcggctaaggccatgggcagggatctgagggtccacttcaagaacacaagggagacagcctttgcgcttcgcaaggtgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggcttggatgtggacaacctctatgtttcacacatccaggtgaatcaagcccagaagcagaggcgccgcacctaccgtgctcacgggcgcatcaatccctacatgtgctcaccttgccacattgagctgatcttgtcagagaaggaagagcctgtgaagaaagaggctgacaacattgtcgcaccagggagcagtgaagtatatcagcatgctgatcg

SEQ ID NO: 11011 - DNA, 296 bp, Zea mays
  Clone ID: LIB3279-184-Q1-K6-G11
gtcgcgttgttaaaaaaaaaaaaaaaaaaaaagggggggggggggggggggggaaaaaaaaaaaaaaaaaagaaaggaaaaaaaaaaaaaaaaaaatataaaaaaaaaaaaaaaattaatatagatgaggaaaaaaattgatttacgtggcgctgggattcctatttatcttttctttttttaatcccttttctggtcgctgggggggggggggggcgaatttcaatttgtcccggcggggggggagactcaccttttctttcggggcgggcccggtttttacttttctggcgggg

SEQ ID NO: 11012 - DNA, 523 bp, Zea mays
  unsure (1)..(523): unsure at all n locations; Clone ID: LIB3279-184-Q1-K6-G12
tttcattcaactttgngatcaattacagaatggcatgggagtggatcctaacatatgtaatacaacatgttgggggccttcggcttccgaaggtcctcaaaaacatgatttgacaatgttttccaagtgaaatttgtgaataggtatcttcggatttggatcatgagcatacagagcatgggtgagaggagagcttgagccagacgaaagatgattatgacgaaggacaaggtgatcacgaagctgtgcgcagggaagcttcggcatgacagcagaaaaggggaaccgacttaaagatgaaaaggcaaattagacctcgaaagattactatagagttattagcaaatgtaaagggcatgaatgtaattttacatgggctgcgtcccttgcttataaatagatgaacggtacccccgtactgttcacgttgacttggcattcgctctcgcgtcacgcttgtacccttgtttcccttcaagccgaaggtacatttgtaatttgttattgcttatacaagtaacgt

SEQ ID NO: 11013 - DNA, 624 bp, Zea mays
  unsure (1)..(624): unsure at all n locations; Clone ID: LIB3279-184-Q1-K6-G2
atttgaaagtgaagattctgttgaaagggtcatatcagaggggagaatgcgtgatcttggtgggaagcaggttgaaataaagaaggctgaaccaaagaacatggatctgaccacagcagtaatgggagatcaaaccacggaggtggagcttaccgcaattcttaccgtagtggtggtggagctggtagtggcagcagtggaggcggcggtggttatgggtatggtggtgcttatcgatctgctgcagcaggttatggatatgatggtggcgcaggagcaggatatggctatggtagagggtatggctatggaggcaatgctggctttgggtctagttttggtggtggttatggtggatccatgtatggaggtgctgcctatggtgcatatggtgcctatggtggtggcgcctatggaggaggtgcctacggagggggtgcctatggaggtggtgctgcctatggtggcgccccaagtggttatggcactggcggatacggcagttatggcggagcaggtagtactggtggtgggagcacaggtgctcggngttctagcaggtatcatccatacngaaaataagcgacgagtttaaactattttttctgggtctcaggtgttcct

SEQ ID NO: 11014 - DNA, 626 bp, Zea mays
  unsure (1)..(626): unsure at all n locations; Clone ID: LIB3279-184-Q1-K6-G3
ngatattctgttcttaccgagttgtgaactgctgaactctagttctgtgtatttgttacgacacctagcactagcaggcatcaggactctaggtgtgacacttngaaattgttacagattaagacgcactgacggtaccctgcgctcagttgctcgatactcgaggcttgtaggtgattgtatccagtagtttgaagaactggttatctaattatttattttccgtggatccaccattttggatacgcttcatcaatatataaaagagctccaattatgaaagttaggagaaaatggcgatctctaaactattcttgagttgtcgtccagctcccaagactaatggaattgcagtttaatgtctctgatatattgtaacgtgtcatctcgctccaaacttatacgttggtctgctgttacatgccagttctgtaaggagaaatggcaccgattactacttgtttagattggacaagctctctcctcgtctctatttaatctcttcctctgtttttctctatttgccccttcgttcactctttctccccccttttcttgtctcgttatcgtctgctacgccaaaccctagccccaaatcagtagcttgaagctgcccacagcgctcc

SEQ ID NO: 11015 - DNA, 643 bp, Zea mays
  unsure (1)..(643): unsure at all n locations; Clone ID: LIB3279-184-Q1-K6-G4
ccccgcgtccganagaattgaatcatggaaggagggggtagcaacacgcccttctaccgcggcaacaccaccgcactcgccaccaacccttctgctgctgctgctgctgctgctgcgaatggggcacagaaaggggacagggaggctgccatcgatgccgagatagtgagggttaacgacctaccagctcatagttcctacgccatacaccgcatgaaggtgctaaacaaacttcgtcatctgctgtccatcaagaggactacatctcaagatgaggagctcgaacttctcttcgcaagcctttcaatctaaagtgtatccttgataagccagtattttaaccctgctaggggagcccactcttctgcctatctctactgttatgtcgttacctctcatagcatgcttccttatagtttcgaagtgcaaggagatcccgttacttgtctgtatcataactcataaattgttcgaaactttgattgaggatgtggcgtgctctgctcctctaaacctggacgatgtggaatggtgggaaaaccccccctactattgtgttgtttgtgaatgtaccgttgtaaccacaagtgaacttgctgtctcggacaagactattaactaaataccctggtactgcttgttg

SEQ ID NO: 11016 - DNA, 658 bp, Zea mays
  unsure (1)..(658): unsure at all n locations; Clone ID: LIB3279-184-Q1-K6-G5
cccacgcgtccggggagtaacatctgtgattttcaaataaaataataggaacattttgtgtgcattttatatatcatggaaattttctcgaactgtctaaccataagtccatgaatatgtcttttctagaggaaccgttctttattttttgttcgtgaacaaaaaagtttgacagactgcacataggtaatgaagatggatttgttttcagtctgctgtaacttttcttaaaattgagcacccaggtgccttttcagcaccatttaactgagcccttatctcactgaaaaaaaactactgtgctacattgttccacaaaatgatcctgagaactgctttggtagcccagttcaatattagggtgtctcacttcctgatttcccatatgcattctgctactaatgatttcttcatggccttacatagcatcctggaacatagaaacaaagctactgttggcagtgggtctggcagtggaggcaacaaaagatactgtatcagtgtttgcagcttcatgttcacacaacagatgtgcttaaaggagggaggttgatgcggactggcagcttgctgtttctcctattcttcaaggaatgaggatgcaccatttgttctctatacattcatatntctccctttgcagattatgtttaaacct

SEQ ID NO: 11017 - DNA, 619 bp, Zea mays
  Clone ID: LIB3279-184-Q1-K6-G6
ccccgcgtccgataaaaggatcccgggactctgaccctccttggggcagctggttgtgtaatgctgactatgcatttcactgtgcaattggtgtcacaacatctcttctattggaaaaccccaggagcagaaagccatacttattattgtgctgatggctccactatacgctatctcttccttcgtgggtcttcttgatatccagggtagcaagacatttttcacattcttagatgctgttaaagaatgctatgaggcactggtgattgctaagtttatggcattgatgtacagctacttgaatatatctatcagcaagaacatagtccctgatgaaatcaaagggagggtgcttcatcattccttccctgtttctcttttcctgccccgcaatgtccgattggagcacaagacattgaagcttctgaagtattggacctggcaatttgttattgttaggccagtatgttccattctgattattgcactccagcttcttgggctgtaccccagctgggtcagctggacgtttagtattatactgaacttttcagtctccatggccttatatgcattggttctcttctaccacttgtttgctaaagagctggcacctcac

SEQ ID NO: 11018 - DNA, 590 bp, Zea mays
  Clone ID: LIB3279-184-Q1-K6-G7
attcctcccatctcccaagacctcctgagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcgtggggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgccaagtcccccaaggaggcatagggtttgggggcgggatccgatgttgtcatgtgtaggttgtaagcgggcaatgtgattg

SEQ ID NO: 11019 - DNA, 585 bp, Zea mays
  unsure (1)..(585): unsure at all n locations; Clone ID: LIB3279-184-Q1-K6-G8
cactgctgnaagggtggacgagnaanagcgacgtgtacagcttcggcgtggtgctgctggagctcatcgccgggcgcaagcccgtcggggagttcggcgacggcgtggacatcgtgcactgggtgcggacggtgaccgggtcgagcaaggagggcgtgatgaagatcgccgacccacggctctggacggtgcctctgtacgagctaacccacgtcttctacgtcgccatgctgtgcgtggcggagcagagcgtggagcggcccacgatgcgcgaggtcgtgcagatactggccgacatgcccggctcgacatccacgacgtccatagacgtgccccttgtcatcgagccgaaggaggaggacgggggcccggagaagaagcagcagcagcagcaggaagggccacacgactcgccgccgcagcaggatcttcttagtatctagaagcgcagttgcgagagttggtcgtactgatggtacttggtagcatccctgcctgccctgttctttgagtgaagcgttggaacgtggcgtgtgtgtagtgtaactgtgtatgcaggcggtgatttatatgcatgcttccttt

SEQ ID NO: 11020 - DNA, 543 bp, Zea mays
  Clone ID: LIB3279-184-Q1-K6-G9
ccggtgctgcggtggcggcgccaacgagctttcccccgtgctggtgcctgctcccaggtgtcgggcggatgggaggatgacggtggctggatcgtggattctgggttgtgcggctgtgatgagaacacgcatacccctttcgcgtatcctgatctggtctgtcggattgggatcggacgggatagagtgcatcatcggcgtggacaattgttaaccatggatctcggatccggtggcccgtattcaataccggttcatcagtgaggtaaatctaatccgagcactcggattgtaatccaacggctacaagatgacccataccccttcagccgacccgttttacaaaagagcccttacactttccagaaaacaacccgcagttccgcggcagtatagtttgagtctgggccacttttgcgttattgcccctggactcttgtgataacttgtgcgcagttcagaaattagtaaaaatgaataaatgatttcggaaattgattttttagtatataaataattccagaaactcgtttaattcataaa

SEQ ID NO: 11021 - DNA, 658 bp, Zea mays
  unsure (1)..(658): unsure at all n locations; Clone ID: LIB3279-184-Q1-K6-H1
ctttttatttttgggaggcgccgcccggaactaaaggagggagatggggagagcgtgcgtgagctccaatggcgactgctcgtgtcgggaggcttagtaggacgactacgagcaggcgggcgcgtgcggggtgctgcgtgcatggaggccaagccgggggaagccagtgttgggcatgcgcctgcgcctatggcggcggcagcaccggttatggcggcgccaccactagaggagactgtgagcttccagcagccgctgccggcgccggccgcggcggcggagaggggcagctcgagcgccgtcctggtgccgcctcttgctacggcggcgggaggcggcgcgatggcgctcgtgccggtgctgatgaaggtgccgaagaagcgagggaggccgcgcaagtacgggccggacgggagcctgatccgcccgctcaacgccacgccgatctcggcgtccgcgcccatgccggccgccgtggcgcctgggcactacacgccggcctccgcggtgggcgccgccatgaagcgtggcaggggacggccccttgacttcgccgncgncgncaagcagcagcagcagcagcatcaccaccagctctaccagcatcagcagcagcagttcggctttcacttcgactccattgntgatatgggggcat

SEQ ID NO: 11022 - DNA, 575 bp, Zea mays
  unsure (1)..(575): unsure at all n locations; Clone ID: LIB3279-184-Q1-K6-H10
ccctatagccagcaggcgcctcnatacatgtgggacacagggggcccccagctctgccccagcccgcccacaggagttcccgcatctccctctctggtctggtcacaggagctccgagacctctccaatggcgggtaagatctacgttgtgtactattccatgtatgggcatgttggcaaactgggtgggagatcaagaaaggtgccttatctgttgaaggtgttgaggctaagatatggcaggtccctgaaattctctctgaagaagtgcttggaaagatgggcgcgccccctaagcccgacgtgccagtcatcacaccgcaggaacttgcagaggctgacggtatcctctttgggtttccgacaaggttcggaatgatggcagctcagatgaaggcgttcttcgatgccaccggtgggctctggagggagcagagcctcgctggcaagcctgccggcatgttcttcagcactggaacccagngtggtggccaagagactacaccgctgacggcgattacccagctgacgcaccacggcatggtgtttgtgcccgtgggctacaccttcggcgc

SEQ ID NO: 11023 - DNA, 555 bp, Zea mays
  unsure (1)..(555): unsure at all n locations; Clone ID: LIB3279-184-Q1-K6-H11
ttttcttcccagttcgcttcacgtcgcggaggagggggtggggctccgtccccgcgagaagcgagagcatggacacccaggtgaagcttgctgttgtggtgaaggtgatgggcaggaccggctccaggggtcaggtgacccatgtcagagtgaatttcttggatgaccagaaccgtctcatggtggggagcgtcaagggccctgttcgtgagggtgacatcctcaccctgctcgagtctgagagggaggccaggaggctgcgctgaatccctggtggccttggatgtaattctgttaattttgttctatttttgtcnaacttgccgtgtgaccttcacaacatctgctttgagatttactcagcctggattgcanttttattttatgttcctgctggaaagtgacttgccgagacatagttatcattggttatctataataactcaatcnacgcgtgcaatctgacagctttgttatatctggtaagggcgtctatgtagttttgtcatacttaatgtcggttggctcaaatctgaaggttttgtatatgtggga

SEQ ID NO: 11024 - DNA, 591 bp, Zea mays
  unsure (1)..(591): unsure at all n locations; Clone ID: LIB3279-184-Q1-K6-H12
tatanttcaagtgaagagaagtagaactggggggggggggggaacaggagattagatcagctcgcacgcaagccaaaggaaaggcaagatgcggagcccaaggggtggaggcggcctggagcacgtggatctgattcccggcatccccgactactttttcttggactgcctggcccgcgtggggggcgcgtcccaccgcgcgatgcgccgggtctgccgcggctggcggagcgccgccgcggcgccggccttcgcgtcggcgcgcgccgcggcgggcgccaacgaggacctggtgtacctgatgcagttcgggaacccgtccgccgacgacgggcccaaggacggggacgacgggccgggcaacaccccggcgtacggcgtggcggtgtacaacgtgactactggcgagtggcggcgggagcgcggcgcgccgcccgtggtgccggtgttcgcgcagtgcgcggcggtggggacccggctggccgtgctgggcggctgggacccgctgagcttccagcccgtggcggacgtgcacttgctggacgcggcgaccgggcggtggcggcgccgggcgcccatgcggtcggggcg

SEQ ID NO: 11025 - DNA, 643 bp, Zea mays
  Clone ID: LIB3279-184-Q1-K6-H2
ccccgcgtccgcaaggatcagatctatgatatcttccagcttcttccatccaagattcaggtcggtgtcttctcagctaccatgccccctgaggcccttgagatcacgcgcaagttcatgaacaaacctgtgaggattctcgtcaagagagatgagctcacccttgagggtatcaagcaattctatgtcaatatcgacaaggaagattggaagctcgacactctgtgtgacctgtatgagaccctggcaatcacccagagtgtcatctttgtgaacacacgccgcaaggtggactggctcacggacaagatgaggagccgggaccacaccgtgtcagctacacacggtgatatggaccagaacaccagggacatcatcatgagggagttcaggtccgggtcctctcgtgtgctcatcaccaccgacctgctcgcccgtggtatcgacgtccagcaggtctcacttgtcatcaactacgacctgccgacccagccagagaactacctccaccgcatcggccgtagtggtcggtttggaaggaagggtgttgccatcaacttcgtcacccgcgacgacgagcggatgctgtttgacatccagaggttctacaacgtgaccgttgaggagctgccggccaatgtcg

SEQ ID NO: 11026 - DNA, 648 bp, Zea mays
  unsure (1)..(648): unsure at all n locations; Clone ID: LIB3279-184-Q1-K6-H3
cggacgcgtggngaaagctcgccccgctcccagctagggtttcctcttcccatccacagccgccggggcgccgccgacgaggacagcgccgccacgatgttggagttgcgtctggtgcaggggagcctcctcaagaaggtcttggaggcgatccgcgagctggtcacggacgccaacttcgactgctccgggaccgggttctcgctgcaggccatggactcgagccacgtcgcgctcgtcgcgctgctccttcgcgccgagggcttcgagcactaccgctgcgaccgcaacctctccatgggcatgaacctcaacaacatggccaagatgctccgctgcgctggcaacgaggacatcatcaccatcaaggctgacgacggctccgacaccgtcactttcatgttcgagtcgcccaagcaagataagatcgcggatttcgagatgaaactgatggacattgatagcgagcacctcggaatcccggattccgagtaccaggccatcgnccgcatgccttctgctgagtttatgaggatctgcaaagatcttagcagcatcggagacacagtcgtcatctcggtgactaaggagggcgtgaaattctccacatctggagaaattgngagtgcaaacattgtctgcaggcag

SEQ ID NO: 11027 - DNA, 476 bp, Zea mays
  Clone ID: LIB3279-184-Q1-K6-H4
gtggatccagatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgcccgcccgcctgaactccacgagcccaagaagaccgtcaaggcggagtagcggcgctgctgccttgcttctcgtgctgctgttcctggattggagaggtgatctgacccttccattgagttgaatgaagtagcctggaactgtggtagttcgtcttttacatcttaagctgctgatagacttcaaataaaatcttgtccaagaaaacattctgtgagcgtacatgttgtcgtcgagctgtgtaattgagcaaatcgtcagattgaaactcgttgtctgccttgttcttcaaataccgcttatccagacggtgctttttttttgatcgcga

SEQ ID NO: 11028 - DNA, 601 bp, Zea mays
  unsure (1)..(601): unsure at all n locations; Clone ID: LIB3279-184-Q1-K6-H5
gtggccaaanaaagcgcttttgtaaggcttgctggcgagggagattggcatcatcaatttaaggctgtagctttactcaggatttctccatttccgtatatagtttttaactatgcttctgtggctacaaatgtcaaatattacccatatatcgctggttccatggctggaaccatacatgaaactttccttgcaatatacagtgggaaacttttacagagcttggctgtagcaactagccaagggtccttcttgtctgtggatcagatcatctacaatggaatcggatttacagttgctgcagcttctactgccacgatcactatttatgcaaagaaagcacttcaaaggctccaagcagaggaggaaatattgtgagcgcatgaggtccaagcccaggatcaaaacccataacgctagtttcctttcangtgtattatacatgaagggcttgtttggcagcaaggggaggggaatctagcccctccaaccccctccatttcccttgctgccagacatgcctgaacagttgctactaatcttgtttcctgtgtcgactacctgactgccacttaccatcttagagaggaaagggtgggtg

SEQ ID NO: 11029 - DNA, 555 bp, Zea mays
  Clone ID: LIB3279-184-Q1-K6-H6
gtagcagcagaaaagcagtacatctatgggtgtggatcaaacaattgatccaaatgaaccgacatactgtatatgccaccagatttcatatggtgacatgattgcttgtgacaatgagaattgtggaggaggtgaatggtttcattacacgtgtgtgggtcttacaccagaaacgagattcaaggggaaatggttttgcccaacgtgcaggaatcttcagtgagaggttctccaagtagaaccaaggccattggcgagaatggaacctgctggaatgatatacaaggggtaatcgttttgctcgacatgcatgatcttcatccggaggttgttctgtgtgaagaacttgtcgcaatttggtcgctcggagttgttgcttaaagcgagtttaacattagagactcgcccttcatctcttggctgtctgtctatacttggcactgattttccttgcttggaataacttatggtcagattcacaaacgtttgtagttgtgatatgaaacgctgtgtgttcttttcgacatcgagcaatttagcattatcacgttttgg

SEQ ID NO: 11030 - DNA, 574 bp, Zea mays
  Clone ID: LIB3279-184-Q1-K6-H7
cgcaccgctcctgtccaccctgccacgggggacgccgggccgccgcagcaactgtcaccgtcgctatggcccgtatcaaggtgcacgagctccgggggaagagcaagacggacctgcaggcgcagctcaaggagctgaagtctgagctctccctcctccgcgtagccaaggtcaccggcggggcgcccaacaagctctccaagatcaaggtggtgcgcacctctatcgcgcgcgtgctcacagtgatctcgcagaagcagaagtcggcgttgcgggaggcgtacaagaagaagaacctgctccccctcgacctccgccctaagaagacccgtgccatccgccgccgtctgaccaagcaccagctttctctgaagacggagagggaaaagaagcgtgagaagtacttccccatgaggaagtatgctatcaaggcataggtcagaactgtgagatgctgtgctttgcatatcatcggctgtgttttaatttttggtttgtatggacatttgttgtggctcgggagtacgatgtattcctctgttgccttataaatggctagattgggttgactggc

SEQ ID NO: 11031 - DNA, 567 bp, Zea mays
  unsure (1)..(567): unsure at all n locations; Clone ID: LIB3279-184-Q1-K6-H8
cgctcacgagccananaagaaggaggggggaggggagggaccgcggcagctgcgacctgcgaccgcgaggagtggcgcacgacgaccagcgcgngagaggtggagcctgcggcggggagatttgctcgcccggctggggttgcggtgggaagagggtaggaggcagagacaaccaggggggggggggtccgcgaggcccggggagagggcgaccagcttcgccgtcgcgtgcagcctcctcagccgcttcgtccgacagaacggcgccgcgcccgcccagctaggcctcgggatcaaaggcgaggacgagcagcaaaggacgccggcgacaattaacttgctccccggagcggacggcgaggagaccgagaggaggaaggagaccatggagcttttcccgcaaagcgccgggttcggtgtcaaggatcccgctgctgcccctagagagcaagaaaataaagagaagcctaaacagctcacaatcttctatggcgggaaggtgctggtgtttgacgatttccctgccgacaggcaaaggacctgatgcatctggccagcaagggcagc

SEQ ID NO: 11032 - DNA, 644 bp, Zea mays
  Clone ID: LIB3279-184-Q1-K6-H9
cacgtaatatcgcgacagcgttgcttgggcacatgaaggggagatcgctggatggatactgtgactgcgggaacgacatgctcacgaagggcaccgtggacaggagcacgctactgggccttctccgagggaagggcaccaaggcggacaagcttcgtctggctgtgacctacctcctctgtgtcgagacgccagagctagagcaggtcgaggcggcgctgcgtgagtcagaagtggacatgtcagcgtttcagtatgtgaagaggatcaaatcgctgaacacgcagtttagtgcctcgtcgtcaagcagtgcaacgaggagcaacattgttgattgggcagagaagctgtatgggcagtccattagcgcagtgacagcaggggtgaagaatctcttgtccagtgggaggcagcttgcattgacgaggacggtcgaagctctcatggaagggaagccgaatccggaggtggacaactatctgctgtttgacccacgtgcccctagatcaggaagcggtgggcagttcaaagggccattcagagaagcaattgtgttcatgattggtggtgggaattacattgagtacaggagcttgatggagctggcagaagctcgcagccgccttcttccagcatgtcatata

SEQ ID NO: 11033 - DNA, 598 bp, Zea mays
  Clone ID: LIB3279-184-Q1-N6-A1
agtctcaagtgtgagttccatttattcatcacccaaaaggtagcaggtatatcgacatatcaactcacaaggctgtcattatctggtatgcttgctcatgcccaacgatttcgatcaacgattacatccacagcaatgaaggtgtgcagatcactcagcagcctttcctttccggcgattgctaccgcccgctgaggctccggtgcctcctgtctccaacaggtagcagaccatcgagtccacgtcctcgccgaatatgctgtaggcctccatgacctggatgtagctgaagcccattgcgaggagcaactgcatgctgcgagtcagtgcagtatctggaagcacaaagtagtcctctttgcctctatcagctccagcaactgaacgggaggaaccactaattgctgcggatgaagatggctctgcccttgatgtcgatgactcacgaatgttaagctttttctccttggcgagatattctgaacgagaggactccatcaccatccgttctatttccctctctgttaactccagatcagagtagaatcgcgcttctgctaaaatgcattctcaatttgctggtcttgctgagctttta

SEQ ID NO: 11034 - DNA, 632 bp, Zea mays
  unsure (1)..(632): unsure at all n locations; Clone ID: LIB3279-184-Q1-N6-A2
agaggctccaagtacaattgttccaatagtacagtacattgtggcagcattggaatgatcccatatttttttatacatngaaaagaactaggcacgctaagaaaacaaacccaagtttcctcaagacgctatctagtagttcctgtaactcatcgagtgtcctccctacagttattaacacctgaaagggaccctgagtctctcaccctaaactcccagaaacagttgtacagctaagcagagattatgacaggattaccgaggtcaccagccttgctacttcaaggagacgatccaggttatgctagtaaggtgttgaaggtacatgatgtgattgaaaatggatgcttccatagtacctttgtagaccacagctgccccttagagaatctggacacaagctggtgtgtcggaccttggacctgaaattgtccggtagacatacaacgtctcaacagggctctcatctgttagagagtccaaggggaatccccgtcgaggatcattcatgacctccacactaagacggggcatcttgcgcgcaagctgccggcatgcgcccaaagtcattgagcacgtcgacatccaaagggatcgcattgtcttcagcttggcagcgtttgccagcaagg

SEQ ID NO: 11035 - DNA, 467 bp, Zea mays
  Clone ID: LIB3279-184-Q1-N6-A3
ggccccaacaacctttaatccacacacagcccaaaagatcccatcgggggagggaaaacaaaaacaaggggggccgaggggagcccgtctttttcaatttttcaacccgcggggtggctggatctgtctcctgatcgccttttttacttttccatcccccggtcacaaaactcgtgcggggcaatggcggacaaccaacagggagcgcctgcccctccaccgacgggattttttaacttgaaccaagcagggcacgggctttaccattcttgggcttcccccgcttgcgcctgcttttaaactaactggccacgtacacctcccccttgttgggggacacggagccccccctgctccgctggtgcctcccccggctgttggccttcttccccgcgtaagccgtggcccccccgtcgtggggcatttgctcgtaacggcagtcctcgctgcaaaacggggggtcgccc

SEQ ID NO: 11036 - DNA, 552 bp, Zea mays
  Clone ID: LIB3279-184-Q1-N6-A4
attaagacctgacctctgcagcaaccttgccgccgtttgaaaacctgagattacaaagtagtgcatcacgccctgtaagcacaatatgggaagaagtcatccacccgcttcgacagcgagtccaaccccaactggagcctttcagcacttttcgacatccgggagatgcagttcagcagttcctctctcctttccaagcaactgatatcagtgacaacaccagtgtcctgctttgtgttatcatcttggtgtcctctgtcaattattttctcaggcgccatcacttcctttgtatggccaatggtctcggtatcctccttgatatcagctgtatccattcctccttctgtagtaatactttgcagcatgatcacttcatgctgacagctactatcatcagccaacttgagattatccgcatggcctcttccctgggctgtagtatctgccaggaccacttcctttgaacggctaaatgaatgagccaggctggcattctcctcttcaagctgaacaatgcaagtcaatgtatgcagctgtttagcacataca

SEQ ID NO: 11037 - DNA, 596 bp, Zea mays
  Clone ID: LIB3279-184-Q1-N6-A5
aacaaaactttgtttgaagaaaagttccatgtgaagtacacaaggtcggaaaatggtgtcaacaaagatgttcgaccacgaaactacatttttcagcacctccttaggcatctatctttctgcagaagtcacttgtgaagggctaccctcaaatgcctcattctagatcctccaaggattaactagtctggagagctagcttcaggtctgcttcttcttggatttgcttctctgcacaaacgaagtgccctccagccactcatcgatgttggcatcagttgttccagttccgagctccaccttgggggccttcttcgttttcttcgagagctgctgaacctggccatatgcccataatccaaagagaccaagaagagcgattccaagggtgatgaggaacacagactcaacactgagtaagcctccagcctcaacgacctcaatagtgccattgtagaatacattctggtaagggtgctggtcgatctcatacactatgtaaccaaccagatcataggctccaggctgcaagaacttgctcacaacgaatttataaggggaaggttgcttgcacagaaacagggactgatgcgttg

SEQ ID NO: 11038 - DNA, 288 bp, Zea mays
  Clone ID: LIB3279-184-Q1-N6-A6
cccaaaaatttttttcccaaaaaacgaaaggggggccttctttaaaatttaaaatcttaaaaagggcccccaatctaataccctctaagggttttcaaaaaatcaaaggggctgggttttttggcccgggaattccaagggcccgccccccttggggggccccaaaaattggcccagggccttcatggggggaaaagcccggcccatgcccttttttaggtaatgggccactttttcctgggcccaaaagaaaccttgaagggtttaacccccggccccggggggcgc

SEQ ID NO: 11039 - DNA, 421 bp, Zea mays
  Clone ID: LIB3279-184-Q1-N6-A7
ataacacacctacattcgtttagttggtcgggaataaaattacaaacaccatctgggggggggggagggacgaaaaccatacaagggctggtaattaaagagcttttagcaaacctgggggcattaccaccggggggtctgggattttcatgaacaaaccacctaccccaatccatatgggttgggggggtttcaatccctagcaaatcaaaatcttttttaatccatatcaatcccctacaatatatatgaattgaaaataaccgaacaaaagccaaacggggaaatggagcttttggacaaaaatgtccttagccggagccagacctttttttcaaaccacacttgttgggctttatcagggttcattggggcccataatcggttcgctgatacagaatgcagagggggccacgttcct

SEQ ID NO: 11040 - DNA, 597 bp, Zea mays
  Clone ID: LIB3279-184-Q1-N6-A8
atgctaaatttctcatggtgccgactggcttacatattgaagttcatataatacaagcggccacaacacgaaaatattcatacactaatacctagtggttatggtattagtggcttagtgcggcagaaaagtaaattaaagatttatttgttcaacggcccacagggatacacagaaaagtatgcatacatcagcaatagcatgaaccagatcacacctcacactagtagctgcagtcctagaacctcaagcagagagccaatggcttccatattcttgtcctcgagaagggaacaaggaatgaccgtgagcatcacgccacggcaagtattggaagaagagcagcacagacaagaggaaggaggacaagcctgaggtggactttctcttcccccagcaaagtacagcaataaattcatcgcatggacataagattgcgcctttgggtggccctcctggaggcctgggcagccctcgatgttcgcttcaggtttttcctcaccaacttctctaccttctctattgaaccggaaagtttcttgtcagcaagggcaggatccattggtttggatggagtattcaatgagccttctgctg

SEQ ID NO: 11041 - DNA, 419 bp, Zea mays
  Clone ID: LIB3279-184-Q1-N6-A9
aaggaaaaaaaaaatgggggggggggggcactaaaaaggaaaaaaatgggggaaaaaaacccccgggggcaaaaatttttaaatgggggggggccacaaaaaaaagcccccaaaaggggtaaggccaaaaaactttgggggggggaaaaagaatccaaaaaaaaccgttaaaaaacgggggaaaaaaggggtaaaccccaaaaagggttggggaaggggcccccctgttttagttaaaaaaaccaggggcatttttttattattttccgcaaagaaagaatttttcgcccgggcgcccaaagggggcctaataaaaaaaaacgggggggaaaaaaaggggggggtgatttttgacggggggggaaacccccattttttgggaaaagggggggccccgtttaataagagccccccccccg

SEQ ID NO: 11042 - DNA, 502 bp, Zea mays
  Clone ID: LIB3279-184-Q1-N6-B2
atccatgaagtactcttatgcaaaccatcttatttatgccactgagaggtttatggcgaaaaggattccaacccccacctagaaacgaataacctcaagcagcaaaacaactgaataaacacaaagctgaacagttactaacctgttcgttaactttcctcctacacaggagagctgaaggttttcttgattccaggttccctctcctcggcttcttcgaaatgaccacttgccttctctctctgaaaaggtgatccaagagctcattccagaagaggcttccgaacaagaaagaagtacattggcgtgaagatctccttttttccgccctctaccagcccttctgcagccttctccaggaaattagagaccctctcactgccctgcggagcaagaccaacgtactccagggccttgaccattgtgcgggtaatcatgcgtcccacagaggtcaaacggaagctactcagggagaatcggcttggatccaagggcaagtacc

SEQ ID NO: 11043 - DNA, 517 bp, Zea mays
  Clone ID: LIB3279-184-Q1-N6-B3
gcaagaagcaggctgttttctttcttatattccatagtagtttcttaatatcaaacaagggacacgttacatcaatgcacgagcatagatgaggcaaagcgtcggcttcatattattaaccagccagatttcataagagtaaaatagatacaggtttttgaacagctgatccttagtgaacaaagaaggatgcccatgtctgatagccttattcatgccctcatgacatgattgcattctcaatgcctacaacaggcccttaccacacctcagggcggagctcaccgggggccgggggcatccatttcccggaattgtacacactttcgccaaccttccaccctggaacatctttcataatcctcgcctcctcctcaagatacttcttccactctttgacaaatctttcatcctcttcagcttggagcatcggcagtatagcactacgagcagcaattttctcttctttgagtgcccggcgcaccttgttcccctgaccgacctggtacatgccata

SEQ ID NO: 11044 - DNA, 559 bp, Zea mays
  Clone ID: LIB3279-184-Q1-N6-B4
catacacaacattctcatcacaagtcatacacaattccagcacactagttcttccacaacagaggttcaaacatacaaaggttccaccacaaaggtttgaagcattcaaacagattgcacgtagttctgacaaagttctaaccacagatatgttctagcaaggtagaaaaaccttaagcaaaggcatcatccccagacttggtatgcatccctacctcaatctttctgaagtttcaggacagctcgtagcagtgcattggtctcttcaaacttggtatgcatccccttcacttcctcttgggcctggcgcagcaaactttggttttcttcaagtgcggcctgttgagcttgtagttgtgcttgcaactcttcctgcttcctagcagcttcctctctttcagcttggagtttttagtcaaactgatataagatttcttcaagtgcggccagtaaaagaaaggttgcttgctttcggagtggagccagcagtcgtagtaacagtgaaggttgtggccgtaccggtgccgcgggtcaatcggttccaccagtgctgcaacgc

SEQ ID NO: 11045 - DNA, 585 bp, Zea mays
  Clone ID: LIB3279-184-Q1-N6-B5
gatccaggtatatatatttatggtgacaccaatgaagtaacgtatggatacattccttacagcccagccttttttatttggttcttcactagactagccattggcttactgtcagcaaccgaacaaacctggagactccacacaagattattgcaacacgcaagaacacggtgaacggattccattccctccaatacgaccttctaactaagacacccaacccttaacaccccagaactcacttaatccatacttactccagctattccaagcactaacaacaacaaaaaaaaccagtagtagagcagcaacacaacaccacggcaccgcaaaaccttgacagactacgagggggcaccaaggtaggaagacaggcgcagtatgtcgcagaagacgcctcctgcagtcacttctgcaccagcccccggacctcgcacgatcagtggctgatccttgtacctcgaggtggtgaaggctatgatgttgtcggaaccagatagctgcgcgaacgggtggtccctcttgtaggctcgcagctccacctgccccttcttgctgaccacattcaccactccaacataccgc

SEQ ID NO: 11046 - DNA, 588 bp, Zea mays
  Clone ID: LIB3279-184-Q1-N6-B6
acagctgacaatagaacattatattagcactaagaggattgccacaacttcatcttaaaacaaggtttatgaacaaagacatgtataaagtagccagcaaattcatggcgactattccaatccatttccacactcaaaagttgcaacaagtccaaggagaaaaagatgatccagacaatgataactcaagagagagtccaccctagaacaacttaaatcgtgcaaggacacaactcctgctcaagtccaagactcatgatcctttctactcaatcagatcatcatcgtcatcaggaagaggttgtgcagctgctgcagcaagctcggcttcatgctgctgctgcatagccatgtcgatggtaacttccggaggcttaagagcaacagcttcaacaaagtgaaggttcggatcaccagccagcttccttgcaaggtacaggaaaggtttctcaaagttgtagttgctcttggcagaaatttcatagtactgcagattcttcttcctgtggaaagtaacctgcttggctttgacctgcctgttcttcacatcaaccttattaccgcagaggacaatggggatgttttcac

SEQ ID NO: 11047 - DNA, 484 bp, Zea mays
  Clone ID: LIB3279-184-Q1-N6-B7
gggagcagacagacggggggttttactgtcattagggttacactcgagattctctactaaaagaaacatgttcagtcgagcgcccaacactcgttggaaattggggacccgaaacaacaaacaaacaaacaaaaaaacaaactcatcgtcaaggctacgttttgccaacctttatcaattatctacactagacctgtggactatccgaggatgctttgttattggacttcttcgcggacatcattccttttcctgcggccaaacccacatttacagatgaattcagggactgggccctcatcaccagcaacccaaggatgctcaaccgcagcctgcagcgtgatgcgatctcctggatctttgcataaaagccttaggagcaaatcagcaagttgggggttcatgtctccaggtatttgcacaggatcattggcaatcttatcataagtttcctgcgatgtatccccaagagatggataatgcc

SEQ ID NO: 11048 - DNA, 602 bp, Zea mays
  Clone ID: LIB3279-184-Q1-N6-B8
agtggacaacgatcaatcaatgtaacaaagtcaacaggcgtagcagtacggtatgcggtattgaggaatccacttcagaatacaacctagcacgcgacaacaaagcaacgacagtaaaatagaggtgttaaggtccccattattagtgcggttccacgctgctgctacgacatatataatcacataaataccaatataataaaaccaacagcacgtccctgccccttcctccccacagcgtcagccagcctttcaccgttcagacttcagacttcgcggctccccaacctttcaagatactgggccttgcgccctgcttgccgtccgcagtcatctccattcccgctgactccatgccatcgaacgacttggcggggctgtacggagctttgctcacgaccctgtcacgacgtttctcaaggaagcgctggagagagtgcctcctggcaatggggagatcagcctgaagcttgcttattgagctagggtcagcaacaacctgagcttgtccagctgctacagaagtgctctgcagtgatggagaccgtgtaagcacaggagagaagactgctgtctgggcgacagtggctgtatgtaccatt

SEQ ID NO: 11049 - DNA, 621 bp, Zea mays
  Clone ID: LIB3279-184-Q1-N6-B9
aaaccatgacctggcaattttcacacgagccgttacagcaatgtttgagcccacaaagggctatcctgattaaaaggggggaaaaaaggaagttttcacccgcaacacatcctacagaatcattcctcaactacaacggcagaaggaaaactgttccaatactgtcagaaacaaatgaaacatcctggcgaattctcagccatcagaacaaagcggagctcttggcgaaaagctcttcagagcctgcggagcccgaatattcttgccgaagggcactcataagacatgtgccccctcccaccgcatgtgtcgcagataatggtcgccatgcagttgcggctgatgtgccccggctgaccgcagatgcggcacaggatatctcggaacgggccgccctgtatcactgaagccagagtcgtctttgggcagacgcgcgcgacgtggccagagacattgcacaggttgcagaccgggtcgttcttgcactcccgagctatgtgccctggctgacggcagttgttgcaggcccgttcgttggtgcagtcaacggcgatgtggcctgatttaaagcatttgttgcatagcttgacgttagcacctgaggtagggcagtctcgtgcc

SEQ ID NO: 11050 - DNA, 458 bp, Zea mays
  Clone ID: LIB3279-184-Q1-N6-C1
gtgtttttttttttttttttttttttttttttttttttttttttttttttttttttttttttttttttttttttttttttttttttttttttttttttttttttttttttagggaaccaattaaaacccaaaaattcctttgcaaaaaaaagcgggggagagaaaaattttttttaaaaaaactatgaaaatacaacaggtaaaaattttttttaaaggattttgaccccaaaaattgaaacctcccttttcaaaccaaaaggctaaaaacaacaaataggaaaagggttggttaaacttttaaaaaatccaaaagggggcccaaaaaagggggctcttttaaaaaaagggagtttttaaaaaggggaagataaaattaagttgcaccaaactttggagaaaaaaaaaaggaaactttctttaaaaaaaccggaaaaaaaaaaggattgcttgggggg

SEQ ID NO: 11051 - DNA, 349 bp, Zea mays
  Clone ID: LIB3279-184-Q1-N6-C2
agaacaaaatggaaggcactcaaccttggtgctcgtgcgagatcttgcccaatgtttaaatcacaatctacataccagttcagatgggacattgaattcacctgggggaaggaaaagctaacaaaaaccttgttatagcttaaatagatcagaaagagctgcactaaaaacaaaggtgcttcccgtcaaaaggagcctactgatgttacataaaggctcttgtgaccccccctaattacagataattaagaaaccttcttcaaaagctgggtctccaattcatatgaccaatttgtcgttgctgatatgccccaacttgcgggcctggagctgccaccccgaccccaac

SEQ ID NO: 11052 - DNA, 420 bp, Zea mays
  Clone ID: LIB3279-184-Q1-N6-C3
ggaaaaaaaaaagggaggaggggggggaaagggaaacttcaaaaagtttaaaggcccccccggtttttaaaataaaaagggggttggcaaaacataaacaaaaaaacataaaatttttttggaaaaaaaaatttaaagaatgggggccccaaaattaaaatgggcaaaatgggggttttgggggaaacccccccggggggtaaaaaaaaaatggccggggaaagcaggccccaaaaaaaatggcccccccccaaaaaatttttaaagggtctagcccccctggggggaaagggccccctaaaaaggggaaaaggggaaacggggccaaacgggaaaatgggggaggcaaacctttttaaaaaggaggaaaacctggggggggaaattaaaagggggcccccatgggccaaacggggggtg

SEQ ID NO: 11053 - DNA, 547 bp, Zea mays
  Clone ID: LIB3279-184-Q1-N6-C4
caaaagaacattgtcttcttgctcaaccagtaaccagtagacaaggcacgaaaatccttaaatatctttcaaaatccaagccaaggcaacaaaatgtgctactactcggtaggaagtgattactatgctgatggcccacaacttttttaaaccttgaacccacgggtgttcctcctgccacgagccttctcgaacttccttcccttggagcgcacatatggcttggtgtggctgtgcggcactccaggagccttgccgaagtgcctcaccgcctcacgggcattcttggggcccctcaagaggactgtgttctcgccaagtggagcacggagagcaagctggtcaaatgtgaggcactccccaccagcattgacaatcctggcccttgccgtctcggtgaacctcagggcagtaaccttcattgctggaacctcttggatcctcttgtcatctgtgactgtgccaacaatcacagcaatgttcttctcctttccttccatgaacttgacaaggcggcgcatggagattggtgggcaattggttttgc

SEQ ID NO: 11054 - DNA, 607 bp, Zea mays
  Clone ID: LIB3279-184-Q1-N6-C5
agatgaacatactgaaagcatccggcatggttcatacgaaaccgaagcccatacatcagataggaattggtagacagacaccgcgaccgaaggaagcaaacacgcacaccagaagcacccccactacagactacgattattcctcgccacattccacacaggtagaggtcctcacaactcgctggcactgctcccacatcttcagagccacgatcggtcgacctagtcccacctcaggcgaccttgacctcgatggtcttgggcttcttgggctcgggcgggggcagcttctcgacggtcacggtgagcacgccgtccctgcacaccgccgagatcttgtccatgtcggcgttgtccggcagcacgaacttgcgcatgaacttgcccatccgccgctccatgcgcaggtacttggcgtcctcgcgctcctcccggcgccgctcgccgctgatcaccagcacccgctcgtcctccacctgcaccttgatgtcgcccgtgcccagccccggcatgtccaccacgaacgcgtacgcgcccgggagctccttgacgtcggccggggtgaccgccatggcgcgcgcgtcgcggaccgtagtgcgcgtgggcc

SEQ ID NO: 11055 - DNA, 585 bp, Zea mays
  Clone ID: LIB3279-184-Q1-N6-C6
atattgatcctttcaagcaatacttagagcgccaggatacttatagtagtaccaccatttctgaaacatagtagcgccagagcgaaatataggatcgtccaaaaacatatccttaacaagagtttaattcaataaaacctcggtgccagaacctagcagacttcacaaaagagcatacttagaacaccctgtatggcttccccatggtgctcttgacgtagaggcatctcacattctgccagttcttcttcagaagggaaacaaggaagttcacgctcatctggatgttctgctggatctgcttctcctccatcgccaagttgccgacggcgacgcccatgcaaaggaccttcttgagctggaacttgacggttgccttagtctcgttcaccttggattcgagggattcctggtgagtaaccagggtcgggaacttgcctgccttgttgagaccaggaccaaggagacggggaatctgcttgatgatggcctctgatgccaagaaagcatggtacttcttggcaagcctcttaacaagcttcttgttcttgttcattttcttgagagcctcaaatccatgtagtc

SEQ ID NO: 11056 - DNA, 557 bp, Zea mays
  Clone ID: LIB3279-184-Q1-N6-C7
tcgcgatctagaacatcgcgaggggccgccctttttttttttttttaggcaaaaacacttttgagtgtatgttatgtacaggcacggttcagagcagcaacagcattacaagcgatgaccagtccaataaacatatgaacgaattgaccgacaagatacataaagaggtaaaaccttgcatgggtgcgtgtgccacaaatacagaaactacccggccagcgacatatactatctttcccgccccgccccctatagtctaagcagattccatgaacaaagggcatctatatctatctgcacttgctgtatctatcaagctaccatactcatgaagcagaagtattaaaaaaaccacttctggtagcgacgactttgagcaccatgaaaagcactgttccctgtataaaaaaacagcactgtgtgtgggaaaagaactgggtctgcataactataaccatcaggaccctgccacaccatttccgttttcagtggatggggcgtttgaagtagcatcatccgttgtcaaattggatacgctatcagacagcgagttcacc

SEQ ID NO: 11057 - DNA, 384 bp, Zea mays
  Clone ID: LIB3279-184-Q1-N6-C8
aaagtggaataatgccagttcaagatggttaatttggcaaccaggaactcaatacaggcatatgtagtctgcgactgcgaacaagacttagttgcaaaaaacaacccaatatgacaaacaaaattactagtaacataggagggagggggtggtttttttttaactagtaggacatagatgtcgaatccagttgcctattaacttagatgatgccaattttgttggccacatcaagggcatcgtagtcgggtgtcagtttcacataaggccttcttcttcccatcaggcctgatcagggtgttgaccttctttgcttgaatgtcatacatcttcttgactgcagccttgatctttttcttgtctgccttgaggtcaacaataaag

SEQ ID NO: 11058 - DNA, 547 bp, Zea mays
  Clone ID: LIB3279-184-Q1-N6-C9
tcgcgatctagatcgcgagcggcgccctttttttttttttttttttttttttttttttttttttttttagataaagggtggtaccattcgttcgttatatttttgggggaaactgatccagccgaattgttatgcagttacaaaatgcaggggggggggggggaagtttttttttttaaagcaacctacaacgatatgcaggggtttgggcaaacaacatgacaggcagaggtaccaagacgaatcgaatgccaaaagggtgaccacaggatcctagatgttgatgggtgaaaagttaatgacccttggcaacccatgggggggtgcctcctggtccttaaactttgcccttgggcttttttgagcgacttacatttgctgacgatgggttcacagatgtcccaactgcagggacaacattgatgcctcgttgaacagctaatgaggaagattcatttggcaaaacagggggtggatcatctggtctgccatatgctgcatatgaaacaggccgtgtaaactggataggagtaaaagaagctggggg

SEQ ID NO: 11059 - DNA, 420 bp, Zea mays
  Clone ID: LIB3279-184-Q1-N6-D1
gggggaaccaattccgggggacggatcaagcggactatttctagcttgcgcaggcattagtttattttacagaggcgaaaactattttacagaaaccagaaggttttaggaaggggcttgcgaaaacattaaaaaaactattaacaaaataactacctactgattagtttaccacgactcgccctcggggttctaagttaacgaccaaaaaccaaaagaagggatactatcctccacattttgcatactgacttttcagctgcacattaagttaactggttcccgggtcgagggcttttcagcctgcacagggtgatttttttcccaggccgacgagtcaatgggcaaattctgagtacaactacaggggggccccggcaactaatctgcaaaaaaccgcaagcctttttttgccaacgg

SEQ ID NO: 11060 - DNA, 626 bp, Zea mays
  unsure (1)..(626): unsure at all n locations; Clone ID: LIB3279-184-Q1-N6-D2
agcaagacaaggaacatccaaactgaatagaatgtttaaaagtcacattaagcaactactcgtagatactacagaagatgtccagtatcacaactcaaggggttacaatctctttcgataacggggtcaagccctacatgatgcgtccacagacatccaaaagatgcaaacattcaaacacgcgccaaaagcggatatccaacctgaccttgctgtcatcgaagttcggaagacgaggctcatgccgtccactgcccgctagcaccatatccagcagcagcagcagcagcaggctgtggcgagaccccttttgctgcagcaggctgttgtggatttgcagggggcgcagcataaccgctctgagtcgccgctggtgctgcagactgatcataacttggaggatttgtaggtggctgggtatatccagcctggccatacacaggctggctggccgctggcgcagaggatgcataaccagcctgaccagatgcctgaccaggaggaccataccctggctgctgtgggtacgcacttccgtagttgggatctgctggagctncctggtacccatagttcgcattggcttgagctgcttgatcaccatatgctgggtgggtctgcgggta

SEQ ID NO: 11061 - DNA, 610 bp, Zea mays
  Clone ID: LIB3279-184-Q1-N6-D3
cccagtcaaacatttttttagtcccacaggtgaatgttttctaccactgatgcgatgagaaactgaccacgcaaaacaacaacaaaattaactagaagacagcagagacaatagtagcactagcataccaacaacagattgcataatagcataagtggtaagacccacagaacagacccgatgttctctctctttcctccataagaataaacccagcttagtcgacctcctccatcttgctctcgccagcgtcatcctccagagggggcatgtcggtgtcagcctccggagcctcctcgtcctcgtcgatgctcaggcccagcttgagcatgcggtggatgcggctgccaaaggtgttgggatcgtcgaggctaaagccagaagtgagcagcgccgtctcgaacagcagcatgacaaggtccttaacggacttgtcgttcttgtcagcctcggcacgcttgcggagctcctccatgatggcgttctcggggttgatctccatcgtcttcttggaggacatgtacccagacatgctggagtccctcagcgcctgggctttcatgatccgctccatgttggcggtccaaccgtactcgccggtcaccaggca

SEQ ID NO: 11062 - DNA, 491 bp, Zea mays
  Clone ID: LIB3279-184-Q1-N6-D5
gtgtgtgtgtttttttttttttttttttttttttttttttttttttttttttttttttttttttttttttttttttttttttttttttttttttttttttttttttttttttttttttttttttttttccccaaaaaaaaaaaattttttgggggggggggggctttttttttttgggggttttggggaaaaaaaaggggggggcccctttcaaaaaaaaaacccccaaaggggtaagggggggaaaaaaatcgggcccgggtttggcaacccaaaaaaaaaaaaaaaaataaggggggcccagggggggggggctcccccttttggggtttttttttgggaggggccccttttaaagaaggggccaggcaacgggaaccttggcaacgggaagctttgggggaaaaaaaaccttttttttccccggaaaaaaaggggttttcacctggggggacaaaacatccccacatgggcacccgaaaaagggtttt

SEQ ID NO: 11063 - DNA, 602 bp, Zea mays
  unsure (1)..(602): unsure at all n locations; Clone ID: LIB3279-184-Q1-N6-D6
gtggggggttttttagactatgcgacttaatatatttttttactgtcaaagcagttcttgtagcaaaatggaatgtgacataagaacacatcgcaacataagaaaataaaattgcggaagataacttaaatatcctacatgctaagttctggatgcncggggcatattttttttggcgcaccaagaacaaaagtgggacatctattcctgtatagtatgcaaacataatgagcccaattgcttcccctcctacaaccactgacatcagtttgtcttggtttttgttgtccttcccttggagcgacgttttggaattgagttcttcatcccaaggaagaaaagcagggcacccataaacgccaagttctgtatgaacttgaaaaaaagatcgacaaacagtgttgactccatttcatggttgtagaagtcatacacaataggggttataaacgccaagtaaatgagcaggaggaatgctccaaatgagctgctagctatgaacagaagaccaccaaagcctttaaaaaacatggtagctgcaatgacagtttttatatccatatgcggcagccccagtccagtattcttggacactagcttga

SEQ ID NO: 11064 - DNA, 560 bp, Zea mays
  Clone ID: LIB3279-184-Q1-N6-D7
ggtgtgtttttttttgttgcgatttggatttatacagacagctttagaaccatacatacatgaccgcttttacacatcttacaccgcagcaccctacaatcttcagtttcagcatctgacaatcaatatacacaatgtggcatacggtggatgtgggggaagttcttattgtgtctttgctgcaggctgcaagagttcgttagactgattttacaggagctagtttcagcatccgaactaaagcatgaactgttatagaccagcaaggtggaatctgaactgttatagaccagcaaggtggaattcttggctagtttgggaactccatttttccaagggatttctattttctcaaagaaaaatgaactaatttcccttgtaaaaatggggttcccaaactgctctaaaccatagaactcaggtttcctcgcttgcgtcagtatcagatgggtacagaaaatgtaacggagcatccacttgaccatctctgtactgtatttgattacctttactatcatgtccatgggaaaaagattatgtaggtggtggaattagatcac

SEQ ID NO: 11065 - DNA, 519 bp, Zea mays
  Clone ID: LIB3279-184-Q1-N6-D8
gggttggttttttttttttttttttttttttttttttttttttttttttttttggggcttgaaacgaggacattccattgattacagcagcgagttattacagcacatggactagaaactagaacgatgcagtacaaccaccacaaaaaacggggggggtgaagacaatttattctaactagaccaagaacacaacacgaccgccaccgccaccacagaattcgccaccgggagaggggcgacctaaccgccgaaaccgtagagggtgcggccctggcgcttgagagcgtaaacaacgtccatggcggtcacagtcttgcggggggcgtgctcggtgtaggtgacggcgtcgcggatgacgttctcgaggaaaatcttgagcacgccgcgggtctcctcgtagatgagcccggaaatgcgcttgacgccgcccctccttgccaacctgcggatcgccggcttggggatgccctggatgttgtcacgcaaaaccttgcgggggcgctttgggccgccctt

SEQ ID NO: 11066 - DNA, 598 bp, Zea mays
  Clone ID: LIB3279-184-Q1-N6-D9
gtgttttttttttttaacaacaacaacaacaacaataacaataataataaccataagacctacaatccataagcgtaataaaaaaaccactaaaagcaatatgcgtcttccacgagcatgtcaccaagatctgtacagcaggccaatgaagtggagggggcacatctacttttgtacaggacaaacctgaagctaggcgaatgatcctgataacttagaaatctcatttcaataacatatgttggtccaacgctctcctcccaatatgattccagtgtaacccaacattaaattttaaaaaaatattatgggtcacaaggagaccagtactatattctaagatcataggtaacctctgaaggcttctactaaggcagataaagacactggataagtggatatagaatcctggtgaatagtgaactgattggtctgtcttttccatatcttattccttgatggatagcccaacaaaatgaatcggaatcttcaagacagtttaatcttcatctcctcctcaacaagctcaaatatttcatcaattctactccggttgatgttcatattagcatgccaagtggttaaataaacctgtaaa

SEQ ID NO: 11067 - DNA, 519 bp, Zea mays
  Clone ID: LIB3279-184-Q1-N6-E1
aacttccaaaaatatttcttccaataaacgaaatgatgacttctataaaattttaaatcttaaaaaaatgctaccaatctaataactcctaatgttttttcagaaatctaatgagcttgtttttctagacccgcaattccaatgtcacggcacactttggcagcaccaaagattcgcacatggccttcatgtgttgaaaagcactgctcatgtccttttctagttcgtcgtccactttctcctcggcccacatgaaaccttgaatgttctgaacccactcaattaaagtagctaacgaccacaccacctgaattagcatagatatcaggtaatactactactcccttctcggcgagaatacgtgtaaacaatattatctattgcatcggttcgatgtcgtatcagctaatacgacgaccatttaggagcactcgagctttcacgccaacagaagcagccatcatctaggctctaacttctagctagtagtcatataggaacataagccggacgcgtggg

SEQ ID NO: 11068 - DNA, 437 bp, Zea mays
  Clone ID: LIB3279-184-Q1-N6-E2
aagggagctctcactgatgattgagatcatcatcacaaataactctagatgatgtgtcatgcaatgtcttttgcagccaaaaagcgatgccatagtatagaacatacatttccaaaaatttgggcttaagtatacgctgattagaagcattacatgtgcaacagggcatcccaacactcaaaactgaagaagcacagggagcgaagtgtaagcaaagtgcgaatgctatggtcagtcctctctccattcatgctggcattcttctttgcaacacctgtatattgttgtcatcggttcatcagctgatcgaatctgcatctgcttgaagtatgcttctccatggttgcatctttggcatgtaactgcggtcttaggggccgatttcatctcatccgccgtgctggagatgggctccacctcctttttgaccaacctcg

SEQ ID NO: 11069 - DNA, 599 bp, Zea mays
  Clone ID: LIB3279-184-Q1-N6-E3
aacaacaaaatagttaaaaagccaggaaactttgggataacaaattcaggatataagatagaaaaactctggttcacgagtaaatcccaaccagcatagcaacctacggctgaattaccaaatataaagacaagtagcagtactttccaacataaaacaaggttaaaatctaaacatgactctggttttcctctggtttcactgcccgaaacaatactgtgatgactgtgcagcctagtcgaagaggctgaagcccatatcatcatcgctttcttccttctcttccaccttctcttctttctttgcctcagctgtaggagcagctccgccagcagcaggtgaagctgccgcaacagcgacaccaccgccaccacatgggactgaagcaaacttctccctgcccgcggcaatgagctcggtgatgtccttaccgctcagttgggacagcaggagttccatcctttcattgtcaacttcacagccaactgactccagaatggcagtcaaatcctcagcggaggggctggcgttcccagcgaggacagcaagcaagtaggcagcaacaaacttcatcgtgctccgaggacccggtcaactgc

SEQ ID NO: 11070 - DNA, 566 bp, Zea mays
  Clone ID: LIB3279-184-Q1-N6-E4
aaaaagaataaaattatcatattaatctaggattgaaacctaggatgctagtcatacatgtccacgcctgcacacagacaaccaacattcaacatcatcttgactcgtcgctgccatttcatatatccaagtactcatagggggataactatttgtttgagttgtgtgtttccaaccaaaataaatgctgtaagcaaacattttcggaccatttaagcagattacaaacgccagttctctcactaagactaatagcgctgctgatgagtctcacatatataagccctccggcacgccttctttcttcttgaacataaccttttctttggccttcttgaagtctgcatgcgtcaccttcatccgccgctctctcaaagcaagcaagccagcttcagtacaaatggccttgatgtcagcacctgaaaactcatcttttgacataataaactcttctaggtttacatcatcagccagtgtcattttcgatgtgtgtatctggaagatgcgccgcctagtcttgcatcaggtaaagggaattcaatctttctgtcaattcgacctgggcg

SEQ ID NO: 11071 - DNA, 431 bp, Zea mays
  Clone ID: LIB3279-184-Q1-N6-E5
cgggtgggggggtttttttttttttttttttttttggttttttttttttttttttttttttttttttttttttttttggccccccccggaggaaacaaggggtttttttttcccttcttaatggcaaagggcaacttgggggggggcccattcccgggggggggggggtggttcttttttttggcccacccctcaccgcatactggggacaagggaccgcttaaccttaggtcactccgggcggggggtctttgccttcttaggggacttgggggcctttttgggagactttgcctccttgctcccccccctggaccccttttccgccgtctttttgggccgccgaacagggttgattttggggggcccaccgccgggaggggtggttaccccccccaaccgtttcccaggcccctcgttgttcccggtcg

SEQ ID NO: 11072 - DNA, 528 bp, Zea mays
  Clone ID: LIB3279-184-Q1-N6-E6
ggacgacatcgataatgtcaatttaactccatccaaaaacagattcgaagtacacagtagcaggaatcttctctgaagaaaccatcacacacaacttcccccttcttcctctaaacacgcctacagaatttattgtgtccagcctcacctcacagttaaatacattacaacaggatctaaaggactaccatcatcctaccgcttcttcaacctccggtgtcaaaactcgaatccaggacaaaaatcaagccgcaaaagccccctcaacacaagctttacaaccgaccaccaaaattcgacgctgacaaagggaaaaagagcaaaggcagaaattacgcaccaagcactacttgtcagagcctagctactatccccctacaaaggaatttcacctaactaggaatctcgtgtgcttgaatgtcctcaagaccctcttcgtaatgaacatctgcaagattaagactgcagccagtagcaaccagaagaagaaaggggatgaccacattcaccttgtacttgttgctgtat

SEQ ID NO: 11073 - DNA, 559 bp, Zea mays
  Clone ID: LIB3279-184-Q1-N6-E7
gaggcatcaagggatcaatttattgagcaccagttcagcaagcattgcactccgattatctttttattctttccttaccgaggtcaaaaccccagaagcagctagaaagtcggcaagtcacgcacccaaacagggaaaccaaggcatactgttgctagctactgtcttacacacctcaacaggtacctcctatagctatccccagcatgtaacttgtgccaagaacacccaccaccaccaccaccaggtcaccacactaagcatcaacaaaacaaggcgtcgactgtctctttctcttccgagtcaccacagctattcctaccctcctttgtgtttggctccggctactcagaaagccagtggcggcagtggcaggctgctgttgagccccgatcgcatcctcctcttcctcagcctctctgcgatgataaaggcgagctccagggactgggaggcattcagccttgggtcgcagtgggtgtggtagcggtcgctcagatcgtcgaaggtcacggtccgtgatccaccgatgcactcggtcacgttctgcccagtcatt

SEQ ID NO: 11074 - DNA, 545 bp, Zea mays
  Clone ID: LIB3279-184-Q1-N6-E8
agaccagcaagattacctgttccatcaaaatcagtttaggcaaacgacattacaacgagtgcagaccaccactcgtcagaatctagagagattgaaaaaaaaacagttcttttctgcttttggggctcccacgacaaaatcacctgagtagctctcgagcaaacacgaccatacatttattgcgaccgtacaaacattgtaacaaaaggcagcagcgagctagtatagctccacaagaaaacatccccatcctcttcctttcttagtagggctccactggtgccctgaactttgctccggcgtagaccgcggcatcaccgagctcttcctcgatcctgagcagctggttgtatttggccaggcgctcagaccggcaaggagctcccgtcttgatttggcccgtagacaggccaactgagaggtcagcaatgaaggtgtcctctgtctcgccactcctgtggcttgccatcactccccatccggcgcgcttggacatcctgacagcttcgatactctcggtcacagacccgatttggttcaccttc

SEQ ID NO: 11075 - DNA, 387 bp, Zea mays
  Clone ID: LIB3279-184-Q1-N6-E9
acacacactgcaaaagtacatcagttccaacaggcacagcagcagtcgacgcaccgccgaccccgtccgtcctggtgttatggcagcgtcagggttccaacttccaacaagtcagtgctcctaggcctagcatagcctggccctccctactcatgcttaactacgtcagcatttagatctgaaacagaaacttgaggtccgcctctgtaagcttcgacatggcatccggcgagtcccccacggtgccttcaaacaccagctgcttcttctgttgcagttgcagtatgcgctcttcaaccgtgtcctttatcacaaacctagtgctcttgattggcttgaactgcccaattcggtggatacggtcctgcgcttggttctcgaccgctg

SEQ ID NO: 11076 - DNA, 589 bp, Zea mays
  Clone ID: LIB3279-184-Q1-N6-F1
gctagaaaaatgtttatgatgagactagtattattcaatcaaagttatgcccaacttgcgtgtcaaccaaactaaccgtggtgttacacagcaccacgcctcaacaataaaatggtggccactggccaggccaggtctgcctttgctcaggcattccaagaaaaatgcaaaagaaaacccggtgctttgcgctcgtttctaacccggtcggacatatcaacactcgtttgttcactgaattgctacggagaagaaagtggaaactgatcagctaagaactttggagacgactccagcaccgaccgttcttcctccttccctaatcgcaaatctttgcccaggttcaagaggaacaggtgatatcaactcaaaattcgcagttacattgtcaccgggcaaaaccatcttcatctccccaagcagctcaacccttccagtgacatcagctgtcctgaagtagaattgggggctgtaatttgtgacaaaggcagtgtgccggccaccttcatcctttgtcaggacatatatttccgcctcgaactttttgcatgtctttagactaccaggtttgcacaccacctgggcacgc

SEQ ID NO: 11077 - DNA, 140 bp, Zea mays
  Clone ID: LIB3279-184-Q1-N6-F3
aattaggcgcgtaatcaattaatactgcgtatgccaagcgatactcaaaagatagatatgtgtggggcattaattagcccctcgatcatcacaagggagccaaatacacttgatatatagcggctattacatgaaacgtt

SEQ ID NO: 11078 - DNA, 470 bp, Zea mays
  Clone ID: LIB3279-184-Q1-N6-F4
tcgcgatctagaactccagctttacaacttcaccactgaggaagcacatagtatacacaaaatgaaaatacacatggatgttcatgtaatgtataccaccactgacaaaacctgatgtatcagccctatccatgagcatgaagttttattgatcccagagtggaaaacaatgaggctgcagaaactatgggcaaatcacatacaccactatcttatgcatccataatcccaacaaaacttcataaactttccacgatcaaattcccactaaaattcacaagatccacggcaaagtttcagttatgcgaactttcccattagaatcaatgcactgaaaccatagagaaagacaatcatttaaggtagtatcttaacttttgtgcatccaataattcctgaaatgattgtcataagaactccactcaaaggaaagcctttaattttcaaaacttgcaactaaagaagaaaga

SEQ ID NO: 11079 - DNA, 577 bp, Zea mays
  Clone ID: LIB3279-184-Q1-N6-F6
gggtggtttttttttttttttttttttttttttttttagaagcaaagctgcatggatctgaggcatcacataaacactgtaaactctgtcttgcaaagcttctaaacatgggctggggggcagaaacatatgaaactagattcggaaaaccgcggggggggtcattattttttccccgtcaaactacagggcagacacagcagtagacaatctaggtcatccgctgcgcagcctccttggcgagcagcttttcccgggccttggtcttggcctgcgacttggatcccatgatgccacctccccactttttcctgacctcatcgaacttgtcgttgaagtttgccttaatagcctccaagatcttgctgaactcaagcttatcctcgttcttgacagtggtaagacacaagactgatgcattcttcttgtgaacaatcgatccaagacgagcctttcctttaacaatgcagtaagggacctccatcttcctacacagggcttggaagccacacaaccagttcaatcggatccacgtcatgagcgatgacaacaagctgagccttgttctgctcaatga

SEQ ID NO: 11080 - DNA, 574 bp, Zea mays
  Clone ID: LIB3279-184-Q1-N6-F7
gggggggggtgtggtgtgtttttttttttttttttttttttttttttttttttttttttttttttttttttttttttttttttttttttttggaaagccggttttacactacttcgccacgccggttaaaagcgaacaaacagcataaaattacagggggcgcgggggcatcctttctccgccactggggccgggcgcgagaaacgcctacgccccctcgccggggatgcggggggcgaagtggatgtttttcggcatgatggggacccccttgggggggatggggcaaaggttggggttctttaacaaaccgacgagggaggcctggggggtttcctggggggccaggacgggggggttttggaaccggaaatcccgtttgaaggcctgagggatttaacgggccaggggctggaagggcaactttcggatgagaagctgcgggcttttttgggacttgggggaagggggcagggccaaggggcgcgggcctggacccggggggtttttttacgccggcggttgttggggggctattttctttccgcttgggggggaattgtgtgggggggcc

SEQ ID NO: 11081 - DNA, 609 bp, Zea mays
  Clone ID: LIB3279-184-Q1-N6-F8
aaaatgaagacaatttagtttctctttgaagttccttagaggttcactggacaggctaaagcatagtgaagcatatttctctagtatctggcatagcgtttgctacatgggattccaagcatagtgaagtatattggggggggggggggcatagcgtttgctacatgggattccaagcattgtgaagcatatttctctagtatctggcatagcgtttgctacatgggattccaagctctgtaacacatctgacagttcacccaaaaatataccgtggggcaactacagcaacttcttcctctcaaagaaggtcttcaggtgccacagctgcaaacctgccaccgataagcagacgccaagggagaggaaccctaaccaagccatccttgagtttgttcgcctgttcaggtcctgcatttcctcttccctttcacgcagataaaacatctcttcatgtatattttttatagtttcctctagcttcttcagctccaattccatcatatcgaccttgcccttcttggcgacgctgggatagtccttggcggagacgccggtcctccagtcgaactcgaacccgatggtgaccggtggcttatggtcgggcgc

SEQ ID NO: 11082 - DNA, 601 bp, Zea mays
  unsure (1)..(601): unsure at all n locations; Clone ID: LIB3279-184-Q1-N6-F9
aagagttgaattgtcttaaacagtatacaagcattgttaacatagcaacccatgatgatggcagctcaatgccacaaacagcaaagctatccatgatggcacctgatgccccggaaatggacagtgtgaatgggggcctccaacataaaggcaatttancctcaccagaaaaatggccaactaacattgtgcaaggcaaacagatactcattatcagctcttgcaaccactaaaagaatcttgaagtacattgatatccagattgcggcctatgacaactatcttgttcatgcgagactctgtctcagaccattttcgagccggcacaacttcatagacctccctcactgcctgtaatgtatgaacttggtctgaatcatggatatataaaatccctttacagcgatatatgtccataatagatttcttttcccaaagaagatcttcaagccaagactccaccttagccaagttaacagaatcctgttcatagatgcacaaggtggaaatactgttatcatgacggcgactaggtggcactgatttactatagtccagcagttcttgcatatgagatgaattcttggcaccatatgcttgc

SEQ ID NO: 11083 - DNA, 559 bp, Zea mays
  Clone ID: LIB3279-184-Q1-N6-G1
acacaacgaaccaaagtttttatttcgccatgtaacttattgttaagtcacatcgttttgacatgctggggggctataatgcttctactgcatgaactggtccgcgggctaaagcactcgcgaattacatatatttagacatgtccagatcaccagattcctcagatctcgctgaatgatttgatagtgcggaaaccatgattgtcaggaagtggggcatttcccgggcgaatggggattatcacctcaaaaccagcgtttttagcagcaatggcttcttggaagacatcggtgatgaataagatttgagatggactgtccacgccgagtgattgagagatctcaaaataactccttgtttctcttttgtttccagttgtgggatcaaaatacccacacaggaactttcgcaggtcaccgtatgttgtattgccaaatagaagcctttgtgcttctctacttccacttgagtatatgtagacctttatgccactagcatgccagttctttagcgccacaagaacatcctcaaagacactccctgtagctctttcttttg

SEQ ID NO: 11084 - DNA, 608 bp, Zea mays
  Clone ID: LIB3279-184-Q1-N6-G2
acgccatagcccaggtcgcatccctgagttcatttccatttgtagaatgtaaatcaagtcataaaatgtaaccaaatcctctaatgggtccctagttgtaatcaccacatgtggcaacagttaatcttgcaatggcaatgttagagcacggaatatagttctaccgcaccaaatactgttcctaccataaaatgctcgatctcagggttctaaactctgcatataccaaactaaagaatacaacacaggttttatgtgtagcttgtactgcaaacaaggcaggcagggaggctcagctgcagcaattacacagttctcacggtgacttaattagacccaactacgttccaatgcccactgtttagatggacatgccatgaaatctgaacttctaggagaagaggaacacctgagacccagaaaaatagtttaaactcgtcgcttattttccgtatggatgatacctgctagaaccccgagcacctgtgctcccaccaccagtactacctgctccgccataactgccgtatccgccagtgccataaccacctggggcgccaccataggcagcaccacctccataggcaccccctccgtaggcacctcct

SEQ ID NO: 11085 - DNA, 610 bp, Zea mays
  Clone ID: LIB3279-184-Q1-N6-G3
aatggcaagacattttttcactcaaacatttgatctcacattgtagcaaaaggtagttcacattctaacaaaaggtggtgtgcgttacatagtactctttatattacatgacatttattccttctcaatcaccacagccaacaacatccaaagaacagctctgcctagcaaatacgaggcattttgacgaccataacctaaacccaccaaagtcccaacttgagcatctaaactgagaattgcccagctccgtgcgcttcctttgttgtcgtcccagtgcaagaatgtccttttccttagctatcctgcaaagcatacaagcaactttcctcccggtgccaaaatgggcaggaggttcaatcttgctgcattcaggtcacgtcacattaaaaagaacacaacgtagttaacaaagcttctttggagcagagctcttcagttcaacttaccctgtgtctggggccatgtagaaattgtcatagcgaccatggccgcgtgaacctcaacaatttgcctacaattcagtctaggagtaatcaacggtggcttccctttcgtcctgcgcctaaatgacgatagcacacacaattccccaattcgtcatgaatgc

SEQ ID NO: 11086 - DNA, 488 bp, Zea mays
  Clone ID: LIB3279-184-Q1-N6-G4
gtggtttttttttcaacaaacagtaccatgggtatttagctaataattcttgtccgagacagcaagttcatttgtggttacaacggtacattcacaaacaacacaatagtagggggggttttcccaccattccacatcgtccaggtttagggggggggggcacgccttttcttcaatcaaagtttcgaacaatttatgagttatgatacagacaagtaacgggatctccttgcacttcgaaactataaggaagcatgctatgagaggtaacgacataacagtagagataggcagaagagtgggctcccctagcagggttaaaatactggcttatcaaggatacactttagattgaaaggcttgcgaagagaagttcgagctcctcatcttgagatgtagtccttttgatggacagcagatgacgaagttcgtttagcaccttcatgccggggatggcgtaggaactgtgagctggtaggtcgttaacc

SEQ ID NO: 11087 - DNA, 626 bp, Zea mays
  Clone ID: LIB3279-184-Q1-N6-G5
ggggggtttttttgcaaatgcactcttaagctatatatgtgaagtgaatctgaatatgagttagttatatgtctggaaaaaataataaatcaagatccattcaaaaaccgtactatttgggagtaaatataacaaaaattataagggtttaggcggggggcgaggcacccaggtttaaacataactctgcaaagggagaaatatgaatgtatagagaacaaatggggcatcctcattccttgaagaataggagaaacagcaagctgccagtccgcatcaacctccctcctttaagcacatctgttgtgtgaacatgaagctgcaaacactgatacagtatcttttgttgcctccactgccagacccactgccaacagtagctttgtttctatgttccaggatgctatgtaaggccatgaagaaatcattagtagcagaatgcatatgggaaatcaggaagtgagacaccctaatattgaactgggctaccaaagcagttctcaggatcattttgtggaacaatgtagcacagtagttttttttcagtgagataaaggctcagttaaatggtgctgaaaaaggcacctgggtgctcaattttaagaaaattacagcagactgaaaac

SEQ ID NO: 11088 - DNA, 563 bp, Zea mays
  Clone ID: LIB3279-184-Q1-N6-G6
ggtgttttgtttttttgtagaacaggacagtagcttttattcataaaaggattcgccaagtccgcagagagagagagagagagcgcgcgcgctcgtacaagacgaacagtcctggctatatagcctcggcgacaacgttcaaaaaaccaaaagggggggggcggcaaaattattcagcgcgcaaggacagtgtaattttacagcgcgacaactcgctaccaaatacgctactcgcgagactcgatgaacttgtgtatgtcgtccatccgtgaggaaatactggtgctccatctccgagcgaccagaaagcagagaggttttttccttctttcattctttttggaaacctggttcattcgttcttcttctcaaacttggccctgtcagcgccgctgtagggggcgacgtggtatgcgtactgctggatgacggagaacaccaccatctcaaggatcaccaggacgttctggatcgcctcctggatgtgctccacgtccagccagaaatggtgggatttgatcacgcctgcttgggttaaaacatcgagcgcaaaaccctgccag

SEQ ID NO: 11089 - DNA, 582 bp, Zea mays
  Clone ID: LIB3279-184-Q1-N6-G7
gggggggggggggtgaagaaacacggcatttcctattccattaggaatgacataaagcaacttgagcgaagcagatacacagccaatcacattgcccgcttacaacctacacatgacaacatcggatccgcctccaaaccctatgcctatgtgggggacggggggggcttcttgggcgacttggcctccttgctcccgccgctggacgccttctccgccgtcttcttgggcagcaggaccgggttgatgttgggcaacacgccgccgtgggcgatggtcacgccggtcagcagcttcccgagctcctcgtcgttgcggatcgccagcagcacgtggcgcgggacgatgcgcgtcttcttgttgtccttggcagcgttgccggcgagctccaggacctcagcggcgaggtactccaggacggccgcgaggtagacgggggcaccgctgccgacgcgctgcgcgtagcgggccttcttggagtagcgcccgatgcggacgacggggaactggagcccggccttcacggacctcgtcaccgacttctttctcggtccgccgggcttgcgaccgggcgctcccttt

SEQ ID NO: 11090 - DNA, 576 bp, Zea mays
  Clone ID: LIB3279-184-Q1-N6-G9
gctgggtgttttttttttttttttttttttttttatgaattaaacgagtttctggaattatttatatactaaaaaatcaatttccgaaatcatttattcatttttactaatttctgaactgcgcacaagttatcacaagagtccaggggcaataacgcaaagaggggcccagactcaaactatactgccgcggaactgcgggttgttttctggaaagtgtaagggctcttttgtaaaacgggtcggctgaaggggtatgggtcatcttgtagccgttggattacaatccgagtgctcggattagatttacctcactgatgaaccgggattgaatacgggccaccggatccgagatccatggttaacaattgtccacgccgatgatgcactctatcccgtccgatcccaatccgacagaccagatcaggatacgcgaaaggggtatgcgtgttctcatcacagccgcacaacccagaatccacgatccagccaccgtcatcctcccatccgcccgacacctgggagcaggcaccagcacgtggggaaagctctttggcgccgccaccgcagcaccgg

SEQ ID NO: 11091 - DNA, 546 bp, Zea mays
  unsure (1)..(546): unsure at all n locations; Clone ID: LIB3279-184-Q1-N6-H1
ctaatgctgatttaagccaagggtgggcgtgatccaatacagatacagatacagggtgccaaactaaaccagcacgtaaggtaaaggtaataatcccgacacaagaatttaatcgacaaggtagcctaaataaaaacacacgccgtttgcacactcaaactgtggtgttaatagctgctgcactacacacacgcactccccgacaatggcagcaagtgcagttgttagactcccctcctcctgcctggcgcgctcatcatacagcaacaactagactagaccgcccctagtgcgagatttgcagcaagagtcaggaacaaatgaaccaatccatgaccccatccttccatcttccagcggggaccttggctcccagtcagtgcgtgggtggctagctccggctgggtttcagagtgctcatgatccggacgtggtcatcttcaggtccccagacgacggcgtcctggacaccttggncatcggctgctgcggctcaggggacaacacccagctctggtccgcgccgtaggttcctcccgggaccgt

SEQ ID NO: 11092 - DNA, 578 bp, Zea mays
  Clone ID: LIB3279-184-Q1-N6-H2
gcatacgacaaaataaacttaaaacccatccttcgccacaatacgaacagaccccggaccttaccactcatccaaagcagagaaaagttggcgtattttaacaaaaacaaactcctttatccagaaaccttagcagccatactatctagagaaggtcggcgacattggccggcagctcctcaacggtcacgttgtagaacctctggatgtcaaacagcatccgctcgtcgtcgcgggtgacgaagttgatggcaacacccttccttccaaaccgaccactacggccgatgcggtggaggtagttctctggctgggtcggcaggtcgtagttgatgacaagtgagacctgctggacgtcgataccacgggcgagcaggtcggtggtgatgagcacacgagaggacccggacctgaactccctcatgatgatgtccctggtgttctggtccatatcaccgtgtgtagctgacacggtgtggtcccggctcctcatcttgtccgtgagccagtccaccttgcggcgtgtgttcacaaagatgacactctgggtgattgccagggtctcatacaggtcacac

SEQ ID NO: 11093 - DNA, 129 bp, Zea mays
  Clone ID: LIB3279-184-Q1-N6-H3
gttgtttggttttttttttttttttttttttttttggagcagtcacagaaaactagctgaagcagtctagcctaaggaatacacatcacatcccttcttcgcttgcaaagagtagctaagcaaacaacg

SEQ ID NO: 11094 - DNA, 478 bp, Zea mays
  Clone ID: LIB3279-184-Q1-N6-H4
tcgggatgcaaaagaaagcaccgtctggataagcggtatttgaagaacaaggcagacaacgagtttcaatctgacgatttgctcaattacacagctcgacgacaacatgtacgctcacagaatgttttcttggacaagattttatttgaagtctatgagggggttaagatgtaaaagacgaactacgcacagttccaggctacttcattcaactcaatggaagggtcagatcacctctccaatccaggaacagcagcacgagaagcaaggcagcagcgccgctactccgcctatgacggtcttcttgggctcgtggagttcaggcgggcgggcatccttgccccaacccacgccgcgggtagcctctaggtattggtcgacgaggtggcggcacttctggtggtggttgatgccctcgatgcggtagcaccagcggaggcgctcccggatgatcttggcggtctcgatctggatccac

SEQ ID NO: 11095 - DNA, 467 bp, Zea mays
  Clone ID: LIB3279-184-Q1-N6-H5
ggggggggggggggtgtgttttttttttttttttttttttttttttaaacaagaacccaaaacgtaagtttttctggggctgtttttctttacaattgcttcagcacccacccttccctttcctcaaatggaggtggcagtcaagtattcggggggggggggcggattattatcaactgttcaggcatgtctggcagcaagggaaatggagggggttggaggggctaaattcccctccccttgctgccaaacaagcccttcatgtttaatacacctgaaaggaaactagcgttatgggttttgatcctgggcttggacctcatgcagtcacaatatttcctcctctgcttggagcctttgaagggctttctttgcataaatagtgatcgtggcagtagaagctgcagcaactggaaatccgattccattggggatgatctgatccacaaacaaaaaggacccttggc

SEQ ID NO: 11096 - DNA, 575 bp, Zea mays
  Clone ID: LIB3279-184-Q1-N6-H6
gggggggggggggggtttttccaaacgtgataatgctaaattgctcgatgtcgaaaagacacacagcgtttcatatcacaactacaaacgtttgtgaatctgaccataagttattccaagcaagggaaaatcagtgccaagtatagacagacggcggggggaggaagggcgagtctctaatgttaaactcgctttaagcaacaactccgagcgaccaaattgcgacaaggtcttcacacagaacaacctccggatgaagatcatgcatgtcgagcaaaacgattaccccttgtatatcattccagcaggttccattctcgccaatggccttggttctacttggagaacctctcactgaagattcctgcacgttgggcaaaaccatttccccttgaatctcgtttctggggtaagacccacacacgtgtaatgaaaccattcacctcctccacaattctcattgtcacaagcaatcatgtcaccatatgaaatctggtggcatatacagtatgtcggttcatttggatcaattgtttgatccacatccatagatgtacctgctttcttgctgctac

SEQ ID NO: 11097 - DNA, 458 bp, Zea mays
  Clone ID: LIB3279-184-Q1-N6-H7
ggctggggggggggggggtttgccaaaaaaaccaatctagccatttataaggcaacagaggaatacatcgtacttccgagccacaacaaatgtccatacaaaccaaaaattaaaacacagccgatgatatgcaaagcacagcatctcacatttttggggttggcgggggtagcatacttcctcatgaggaagtacttctcacgcttcttttccctctccgtcttcagagaaagctggtgcttggtcagacggcggcggatggcacgggtcttcttagggcggaggtcgagggggagcaggttcttcttcttgtacgcctcccggaacgccgacttctgcttctgcgagatcactgtgagcacgcgcgcgatagaggtgcgcaccaccttaatcttggagagcttgttggatgcgcctcccgtgaccttggctacgcggaggatggagagctaaaactt

SEQ ID NO: 11098 - DNA, 550 bp, Zea mays
  Clone ID: LIB3279-184-Q1-N6-H8
ggggggggggggggacgacaaggatactcagaatccattacaatcacttgttctgcatacatcaaggctagagccaaacgatctggctttcagaaaaataaaaaagacatatacttctctttgcacttctatcattttccttagcatggggggttcggagtggccgttttttaacaccccccaaaaaaaacttctctcggtcatggctggctacttatctttacatccagaactatgtgacaagagggcgtaggaccatggcctaaacagaacactaaaacacgataacgagaggatatttatggtttcggtactctagtggcaaagcatggtttcggtactctagtggcaaagcatattttcagatcgtcctgcaaaggctttggtgaggtttgctgtgccgtcttatttggctgtgtcgttgtgtgctagctcaagttcaggttggacttgacggcattcggtcctaatccaagccatgcctggctctcgggctccttcttgactggtgcaccgtctgaaggagaaatttggtatggtgcatttgcat

SEQ ID NO: 11099 - DNA, 630 bp, Zea mays
  Clone ID: LIB3279-184-Q1-N6-H9
ggtgggttgtgttttaaccagtataaaaaagatgcggatcagattgcactaacatattctcaacgaatataaaccatacaaaaggaagcaaatgatcatatcatatctgacaatgttcaaacgatgtgaaagaacccccccttatttattagggggggggggggtggagggttgtttccaccacccagacccagccccgctttctgccccagttctgcaagttgctcgatgaactccaccccgttgacaatctcagttgctccgtatatgacatgcttggaagaaggcggctgcgagcattctgccagctccatcaagctcctgtactcaatgtaattcccaccaccaatcatgaacacaattgcttctctgaatggccctttgaactgcccaccgcttcctgatctaggggcacgtgggtcaaacagcagatagttgtccacctccggattcggcttcccttccatgagagcttcgaccgtcctcgtcaatgcaagctgcctcccactggacaagagattcttcacccctgctgtcactgcgctaatggactgcccatacagcttctctgcccaatcaacaatgttgctcctcgttgcactgcttgacgacgaggcactaaactgcgtg

SEQ ID NO: 11100 - DNA, 596 bp, Zea mays
  Clone ID: LIB3279-185-Q1-K6-A1
gcagttcaccggcacacacaacttcagcacgggcagtgactgcgaggtcatcatgcccctgtacgagaagtacggcgagaacttcgtggacatgctggacggggtgttcgcgttcgtgctctacgacacccgcgacaggacctacgtggcggcgcgcgacgccatcggcgtcaacccgctctacatcggctggggcagtgacggttccgtctggatcgcgtccgagatgaaggcgctgaacgaggactgcgtgcgcttcgagatcttcccgccgggccacctctactccagcgccggcggcgggttccggcggtggtacaccccgcactggttccaggagcaggtgccccggacgccgtaccagccgctcgtcctcagagaggccttcgagaaggcggtcatcaagaggctcatgactgacgtcccgttcggggtcctcctctccggcggcctcgactcctcgctagtcgcctccgtcaccaagcgccacctcgtcgagaccgaggccgccgagaagttcggcaccgagctccactcctttgtcgtcggcctcgagggctcccctgacctgaagccgcacgagaggtcgctgacta

SEQ ID NO: 11101 - DNA, 615 bp, Zea mays
  Clone ID: LIB3279-185-Q1-K6-A10
ccccgcgtccggaatggtcaaggctggctttgctggtgatgatgcgcccagagcagtgttccctagtatagtcggccgccctcggcacacgggtgtgatggttggaatgggccagaaggacgcctatgtaggtgacgaggcacagtcaaaaagaggtatcttgaccttgaagtaccccattgagcacggtatcgtgaacaactgggatgatatggagaaaatctggcaccacaccttctacaatgaactgcgtgttgctcctgaagagcacccagttctgctgacagaagcacctctgaacccaaaggcaaacagagagaagatgacccaaattatgttcgagacattcaatgcaccagcaatgtatgttgctatccaagctgtcctttccctgtatgccagcggtcgcactacaggtattgtgctcgattctggtgatggtgtgacccacaccgtgccaatctacgagggatacgcgctccctcatgccattcttaggctggatcttgctggccgtgatctgactgactgcctaatgaagatcctcacggaaaggggttattccttcaccacgacggcagaacgggaaatcgtgagagacataaaggaggagct

SEQ ID NO: 11102 - DNA, 471 bp, Zea mays
  Clone ID: LIB3279-185-Q1-K6-A11
ttttgggttcgcgtcgcagcgtcttccgggcggggtggggcaatgccgaagcagatccacgagatcaaggacttcctgctgacggcacggcggaaggacgcgcggtcggtgcggatcaagcgggccaaggacgccgtcaagttcaaggtgcgctgctccaggtacctctacaccctgtgcggggaggactccgacaaggccaacaagctcaagcagtcgctcccgccaggtctgactgtccaggagatttaaggtatcaagccgcaaactgtgcctttttttgcggtgtcagggacgtttgctccagtgtttactttagtatgtaggtgggctccattgctgtgtttgaatgaattatgaagtttgagtttgggatgtgaatgatgtgtcgaacctatgagcatgtggtgtaatggtaccccagaacgcaaaagatggcaatctatcataagttaaactgatttctgtgag

SEQ ID NO: 11103 - DNA, 624 bp, Zea mays
  unsure (1)..(624): unsure at all n locations; Clone ID: LIB3279-185-Q1-K6-A12
gtttctaccaggaggacttcggcgtgcctgcgggcggcggagctcgccgaatggtcgcccacaggttccatcagtaccaggtggtgggtcgcgcgctgccgaccccaaccgatgagcaccccaagatctaccgcatgaagctctgggccaccaacgaggttcgcgccaagtccaaggtgtggggcttgctgagaaagctcaagaaggtgaagaagagcaatggccagatgcttgccatcaacgagatctttgagcgcaacccgaccaccatcaagaactatggcatctggctgcgctaccagagcaggactggttaccacaacatgtacaaggagtaccgcgacaccaccctgaacggcgcagtggagcagatgtacaacgagatggcctcccgccaccgcgtgaggtccccctgcatacagatcatcaagacagcgacggtccacttcaagctgtgcaagagggacaacaccaagcagttccacaactccgagatcaagttcccgcttgtgtaccgcaaggtcaggccgcctaccaggaagctccggaccactttcaaggcttccaggcccaaccttntcatgtgagaggtatatcgtacccgtgttctgtgtcttgagcgcc

SEQ ID NO: 11104 - DNA, 675 bp, Zea mays
  unsure (1)..(675): unsure at all n locations; Clone ID: LIB3279-185-Q1-K6-A2
ggggatcgaagcggagaagcagggagcggtcgagcgggtgacatcatcgtcatccagggtttctcaatcggcagcgatggcgaccagggcggcggcgaggttcctgcagcgcaggtttctgtcttctggcggtaaggtcctcagcgaggaggagaaggccgccgagaacgtgtacatcaagaaagtggaacaagagaagctggagaagctcgcacgcaagggccccagctcaggagagcaaccctcgtcaaccacaggctctgcagcaagtgatgtgaaggccgatgctgggccaacggagtcagcatctgcaagtgtgtcgacggacaagaacaggaactatgctgttctggcaggcgcagttgctgccctgggtggcttgggttggtatctattgtcaaagcctaagaagtcggaggaggttgtggactgaagagggaggttgtgaatgcgatctgcggatggtcggccttatatctcaccatggttttactttctgcgcatagacctgcaacttctggaaataattgttgaaatttactctgcactactcgttcttaggcctgttgcatcacagaaccttgaagtatgcactcgagttgntcagtagttctctccctcgcttggcaggttgcaatgntgagtgatgcttgtagtgctgcctgcatcgntgct

SEQ ID NO: 11105 - DNA, 639 bp, Zea mays
  unsure (1)..(639): unsure at all n locations; Clone ID: LIB3279-185-Q1-K6-A3
gtccgtcccctagtccctacgaccctactccctaccgcacgccaccgcccaccagcgccgccgaggggcaaggccgaaccctcctccgttcgccgaggcggagcacgcccttccaggccagcttccaccggagcaagagctaagtcgcctcgaattcttcccagctagtagcgtgtgccgtaccccgtcgctcaaccgggatggcgtcgagtggggatccgcccggatctgctgatgagaagaaaactccaatatccgaagggtcttccgacgaacgtcaagggcttcctccagcaggcttttcaaatccttttgattttggttctatgcaaagtttgctcaatgatccatctattaaggagatggcagatcaaattgcaagggatcctgcattcaaccggatggctgagcagctacagaaaagtgctcaaagcacaggagaacagggcacacctccattaaatcctcaacaatacatgngaaacaatgcaaaaggtcatgngaaaacccccagtttatgaccatggcagagcgtctggggaatgctcttatgcaggatcctgctatgtccagtatgctggaaacctttagtagtccatcacataaggagcagctggaagagcgtatgtctcgcattaa

SEQ ID NO: 11106 - DNA, 617 bp, Zea mays
  Clone ID: LIB3279-185-Q1-K6-A5
ccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcaatcagagccagtatcctcgcattgttaccgaggacttcttgccact

SEQ ID NO: 11107 - DNA, 652 bp, Zea mays
  unsure (1)..(652): unsure at all n locations; Clone ID: LIB3279-185-Q1-K6-A6
cagnaagtctccgtcaaccactttttcagcaggatacggaagcaattcctgaggacacagaggaaggcaactccgatcagcttctgcgacataaaaagcgcagttgctagcttcgtgccctacaccctcctgctgaaactagtaagacttggttccggttatctacacgtgatgttatctagtgttaggttacagcaagaagttcaccgaaagccttctcgtcgacctgagttacacaagaccatcaatgctcctaacattggtcttaacaacaaagctcccgttcctcctactgagcaactgggtgatctgataagctttgccggagatgctggtgttaaggaggatagtggtaatgccgatagtcaggagggtaaggtgtcatcctatcatggtgacttgatggggcttccctacaccccaccgtgcagcgttaagaaaattgatcacatgatagaggccaacctatcgagcttttcaagtcacgagaaacgttgtagattaactgttagtggttgtagtgtaagcaggagggtgcatggagacaaatagagggtgtttggtttgatcatgacatgtaatgttaccctnggcattgtgggtttcgtgtgatgatgcctaagaattctgttctggcataacagctttgtag

SEQ ID NO: 11108 - DNA, 426 bp, Zea mays
  unsure (1)..(426): unsure at all n locations; Clone ID: LIB3279-185-Q1-K6-A7
gaatctgcggagggtcagtaagatggattcagtctcacgacctgctgctgctgatgttgaggagtgaccagaaccagaaccgtcgtcctcgattctgatagattatcttctagtataccttgtgttgtcgttgtcgtcggcgcgacgatcgtcgtcgtcgtcgcgccggtgtatgcgatgaagctgccattgctgctgttttaattaagcattctagatgttataccgcatgctttgtttcggtttctatgtcgataaatggtggccggatgctggttttcgtgctccgagccggccaccaggaagaagacctgcctgcccttgtgggtgcagcgttgttagaatgacctacggtgtatttgactttgacaggcctgctgcctagtggactgatattctgttatgcgcaaagctatttgccttgng

SEQ ID NO: 11109 - DNA, 588 bp, Zea mays
  Clone ID: LIB3279-185-Q1-K6-A8
atttcattctggttgttcataagtgaaagccatttgtgtgaatgtctggttagatgagttacatcttctcaactcttcatttaggctggtacccctaatcaaactgcaggaagtgtcgggatctccgagctcatggagattttgttatacctagttctcttgcaaaaccatttgtgaaggtaccatttcctgaatttcttctgctatgcacttagctattatcgtctcggggagaatgctgacgagaaggacgctgaggagattattgacttggctagcaaagcttctattgctgatcagcagaaacaagtgcaggataatgttcattatgaacttacgcatatgtgccaagcaatggatagcattttatgtcctgatacaataaacgacccatcaaaaggaccttcagaagcacataatcattctcagcgtagtggcttaagttttgccgttggtggtgctgcatctgcaaacaagcaaagtgcaattatccctgctacacgacctttaactcgagcagaattgtcaaagaaattcagggatcattttgggtacacacttgacatcggaccatctggaattcctcat

SEQ ID NO: 11110 - DNA, 681 bp, Zea mays
  unsure (1)..(681): unsure at all n locations; Clone ID: LIB3279-185-Q1-K6-A9
ccaagcgttgnttggctagnaagcaataacggggaggatggcagcagaaagatacccaaattgttgccaaccaatttgatctccaccttcggtcagtgcagcgcgtatggaacagaggtaaaatacaacttgcaaactcggtgccggttgtggttgctagtctaaaaaaggaagagttggtcgtgaagcaattcctattgatttggaagttttgcgtaacattcctttaaaggataggatgaccttagaggatgtttgtgccaagctaaacatgagtaaatggaaggtgctaaggtatttgaaacaaggtttgcttaggcgtcattctagtagcatcaagccctttctcactgaaggaaacaaaaaaactaggttgaagttttgtattgacatgattaagagggggttgaatggtgatccaagctttagggattttttttgacttcgttgtcattgatgaaaaatggttctacctatcccaaaagtctgaaaaatattatttgctccccgaagaagatgatccacataggacttgcaagaacaaaaactacttccctaggctcatgtttctcgctgtttgtgctagaccgaggtttagagatgggcagtgcatttttgatggtaaaattggatgttttcctcttgtcaatatgaaccggctataagagaaatgctatattg

SEQ ID NO: 11111 - DNA, 636 bp, Zea mays
  unsure (1)..(636): unsure at all n locations; Clone ID: LIB3279-185-Q1-K6-B1
agcagccgctctccccagccccactctccccatctagccccctaactgcaccggccgccacaccaccccgaccggaccctccacaacaatggccaccgtcctgggcagcccccgcgcgccggccttcttcttttcgtcgtcctccctccgcgccgcgccggcgcctaccgccgtggcgctgcctgcggccaaggtgggcatcatgggccgtagcgccagcagcaggcgcaggctgcgcgcgcaggccacctacaacgtgaagctgatcacgccggagggggaggtggagctgcaggtgcccgacgacgtgtacatcctggaccaggccgaggaggacggcatcgacctgccctactcctgccgcgcggggtcctgctcctcgtgcgccggcaaggtcgtctccggctccgtggaccagtccgaccagagctacctcgacgacggccagatcgccgacggctgggtgctcacctgccacgcctaccccacctctgacgtcgtcatcgagacgcacaaggaggaggagctcaccggcgcataatcatgcccatccatctctctctctatatatctctgngtgtcgntgtgtgtaatttgagtacgcgcgtacgtactgcttgngtttcatttgagtgc

SEQ ID NO: 11112 - DNA, 606 bp, Zea mays
  Clone ID: LIB3279-185-Q1-K6-B10
caattatatttggtgctcatgtttctcacccttctgttgtagatggttctactggcccttctattgcttctgtcgttgcatcccaagactggcatgaggtgtctaagtataatggtgttgttcgtgcacaaggtcacactgaagagatcggtggccttgaagacattgtcaaggagctccttcatgcatttgcaaacgagtccaaggagaagctccagcagctgatattctacagggatggcataagtgagggtcaattcaatcgaattttggagaaagaaatcccagcgatagaaaaggcttggaacgcactgtatgacaatgagaagccacaaatcaccttcgttgttgtgcagaagaggcataaactgaggctgttccccgtggacgacaactataagatccgttctgctaagaagaaaattgttgagcctggcacagtggttgatagtgagatatgtcacccagcagaatttgatttcttcctttgcagccaatctggtgttatcaaaggcccaaggcgtgctgtgaggtaccttgtactgcgagatgataacaacttcacggcagatgaactgcaggctctcacaaataacctgtgctaca

SEQ ID NO: 11113 - DNA, 607 bp, Zea mays
  Clone ID: LIB3279-185-Q1-K6-B11
ctctccatcgcgagctgcgaaagagagcagagggagggagggcaaagcgaagagaacacaaccgcgccacccacccacccacccacgcacccggagcgaaggggagaccggccgcaacagaaggcagagagagctagagccgcgcgcggcaatgggcaacagcatcggcgggcggcgcgggggggccaaggtgatgcagctggacggcacggcgttccgcgtgaagccgccggcgtccgcgggcgcggtgctgcgcgaccacccggggttccagctgctcgagtccgaggaggtgaagctgctgggcgtgcgcgcccggccgctggcgcacgacgcgcagctgcgcccgggcaggctctacttcctcgtggtgctgccccggccgtccgtcccgccgcgccgcgcctggtccggcgcgctccaggtgggcgcgcgggagcggctggagtcgctcatgctcacgcgccgctccacctccgacctctccctgccggcatccgcggtcacgggcacgggcacggcgccggcgtccccgctctccgagtccgagggtgggcccgtccggctccggatgcgcctgccccaagcgcaggtcgagaggctcatg

SEQ ID NO: 11114 - DNA, 628 bp, Zea mays
  unsure (1)..(628): unsure at all n locations; Clone ID: LIB3279-185-Q1-K6-B12
ttttaacaagcagnaccagctagctggggggtgcggggggtgtcacccgggccccgggcagccatctcgctgaaagagaaaagcgcagccatgaagactactagctcgggcattgcagtcgtcctcctgggggcgatgctggcagtccagtccgcggtggccgacatctcntgctccgaggggcgggacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaagagctgcccggcgactgcggcctctcgctgtgctacaacatcacccccgacatcgactgcgacaagatcgaatgaagggatactgtgcccttaccagaatccatacgacgggatggtgatgttcagtgccctgctagcagtaggctgcatctgcactgagtgactagaataaaggatttggtgatgtttgtgctgattggggtgttcgcctgtaatcgtgtgatgccgtcgttggcttcttatatcccggtct

SEQ ID NO: 11115 - DNA, 488 bp, Zea mays
  Clone ID: LIB3279-185-Q1-K6-B2
gttacaacagatactaggtcggaagcataaaaaaatcttcatactatatacatactccacccgacactgggactgagaacagccgttatggcgatgcaactttttgttgacggggaggtctggaagaaagttgtatatgtcgacagacttgtgcagctattcagatatgtaccacgtgaacagctcaccattcctgattttgtcttccagcatgaccttgaagtgaatggtggaaagggcataatcgttgacccaagaacaaagcatatctaccagagaccatctggttgatctgtcataaacctgcaaatgaacgcttcacagtaccactctcactatgtacagactctccatgactctgtccagtcctctgtagaagagtacccttctagagctgtgcattttgtatctagttgacattgttgctctgtgctattccttcgcctttttgggaggcatatttatgtatcttaataactattctgtat

SEQ ID NO: 11116 - DNA, 635 bp, Zea mays
  unsure (1)..(635): unsure at all n locations; Clone ID: LIB3279-185-Q1-K6-B3
gcggtctctttcttccttctctctactttcttcctcaccaaattcggatcaaacaaattcgttaaataatctcagaaaacacacggttaacgggatcgaagggattaaaacgaaaacgttccgatcctgtggccaggtctcggtgctaatcgtgtgttttttttttgggtgggattttgtgatctgtggttagggtttcggatctggaggattagttctcccaagttccgagtcagaccatgaatgagcagctgatgcgaccaccggcgccgctgccgttccaccagatgtgggcggcggtgccggcgatggagcctcctttcaagccggtgcgggcggcgtggaagcgggcggcgcggacgccctggaagcgcaaggcccagcctccggcgtcgggcggcgcgaggtggggcggtgcggcggccccgcgcaacacgacgtcgttcctgatccgcgcgaagcgggcgggcggcgtggcgtcgctggtgtccccgtgccccgtgacgccggcggtgctcccgacgcccgtgctgtcgccggcgcgggaggtgctggtggagatggccaagnaggcgtggggcgtggacgggtacgggtccatgaaaggcctcattcgcctgcgcgccgacgcccgg

SEQ ID NO: 11117 - DNA, 86 bp, Zea mays
  unsure (1)..(86): unsure at all n locations; Clone ID: LIB3279-185-Q1-K6-B4
acgagatctctaagattatgagaagacatatgaccccctattgcttttgttcactttgctaaaactgaaagtccgagttcacatng

SEQ ID NO: 11118 - DNA, 657 bp, Zea mays
  Clone ID: LIB3279-185-Q1-K6-B5
tcgcttcctcgcccaccacctccgcggacacggagcggaggaagcacgaactgctgcgcgcggttcaggaaacgcggcgcggattcgcagcggggcccgaccaacgcgctgccatcgaggaggccgtcgtggccgtggaggagcgtggtgcggggaagggaacgccgatagatctcgcggcgctcgatggcacctggaggctgtgttacacatcggcatcagacgtgcttgtgctgttcgaggcggccgagaggcttccactcctgcaggtgggccaaatataccagaaatttgagtgcaaagatcgatcagatggtggaattgtgaggaatgttgtaaggtggagcatcgagaacttgctggaggagcaagaaggtgcaacactgatggtctctgcgaagtttgttgtcctgtctaaacggaatatctttcttcaatttgaggaggtcgctgttgaaaatatcaagattagcgagcaactgcagacactaatagctcctgctatacttcctcggtcatttttgagccttcagatattgcagttccttaaaacctttcggactcaagttcctgttagtggtcctgaaagacgatcacctggaggattatattatctgtcttaccttgatcgtgatatgctcctgggtcgttcagttg

SEQ ID NO: 11119 - DNA, 642 bp, Zea mays
  Clone ID: LIB3279-185-Q1-K6-B6
cggcgcgtgggcaaaaggtgacaaaggtaaaggagaatccgttgaagcagttcttcccagcaaggatgatctgaggaagaccattactgaaatcctcaagaagttgacttcaacacggcaactttcagtgacatccttaagaagcttgacaatcactataaaatggatctggccccaaagaaagaagccatcaaagttatgatccaagacgagttaaccaagttatcagaggaggacgaaggagagggagccggagacaccgagaagaaacagcagcagcctcaggcgaaggagatcgaggcatgaggattcgtggaaccccatagctgtagtagccgctgttaattatcctgtacttaatgtgtttgtttgcgtcgcctgtacaggcatctcgttgattatcgccgcaccaactcgagaacctcacccctgatcgtgtatgttatggggcatgatgtgtaggcagcctccacacctttttagctgactgatcggagagttactcctaggcaactcttgtttctagatttgcaaatggtgtctgaaactctgcgtttgctgcggcagaacgtgtacttaattgttcgtgataggtctgaataacacatggatggtatcaaaaaaaaaaaaaagggcggccgc

SEQ ID NO: 11120 - DNA, 639 bp, Zea mays
  unsure (1)..(639): unsure at all n locations; Clone ID: LIB3279-185-Q1-K6-B7
cggacgcgtggggcanaaagnaaccccacccgacgtaccgcgagccggcgatggcgacggtggcgatggacatctcgaagcccacgccggcagcgtccggtgacgaggcagcggcggcggcgaaggggaggagcggcggcgggggcgaggggctgcggcagtactacctgcagcacatccatgacctgcagctccagatccggcagaagacccataacctcaaccgcctcgaggcccagcgcaacgacctcaactcccgagttagaatgctcagggaagagttgcagttgcttcaagagcctggctcatatgttggtgaggtggtgaaggtcatggggaaatcaaaggttctggtgaaggtacatcccgaaggcaaacatgtggtggatatagataagagcattgatatcactaagatcacaccttcaacaagagttgctcttcggaatgacagttatatgctccatctgatcctaccaagcaaagttgatccattggtcaatctcatgaaagttgagaaggttccggattctacctatgatatgattggaggccttgaccagcanattaaagagatcaaagaggtcattgagcttccaatcaaacattcggaactgtttgagagccttggaatgcaca

SEQ ID NO: 11121 - DNA, 637 bp, Zea mays
  unsure (1)..(637): unsure at all n locations; Clone ID: LIB3279-185-Q1-K6-B8
ggcgaaacattgtcaccagnaatactggagctaccatgggcttctttcctgtggaccatgtgacattggattaccttaaactgacaggccgcagtgatgaaactgtgtcaatgattgaagcatacctgcgagccaataaaagtttgtggactacaatgagcctccaacagagagaatatactcatcttatcttgagctgaaccttgatgaggtggagcctagcatgtctggcccaaagaggcctcatgatcgtgtccctttgaaggaaatgaaatcagattggcatgcttgcctggacaacaaagttgggttcaagggttttgcagtgccaaaggagcagcaggataaggttgtcaaatttgactttcatgggcagccagcagaaatcaagcatggtagtgttgttatagcagcaataactagctgcacaaacacctcaaatcctagtgttatgcttggtgctggtcttgtagctaagaaagcttgcgagttgggtcttgaggttaaaccatgggtgaagacaagccttgcccctggatcaggagttgtcacgaagtacttgcttcagagtggtcttcaagaatacctcaaccagcaagnattccatatcgttggctatggctgtaccacttgcatt

SEQ ID NO: 11122 - DNA, 641 bp, Zea mays
  unsure (1)..(641): unsure at all n locations; Clone ID: LIB3279-185-Q1-K6-B9
cccacgcgtccgcggacgcntgggcggacgcgtgggcgngaaagagcaggaggccattgcagccgccgcggagtcggaggagctcgagcggggagcggaggctgatgcggcggcggctgcaacggcaacggcaacggcagatgaggagggagaatcttctggcggcggctggagctttggcggcctgatcaggacgctcgcggaggagattgaggcgcagcgcaatgagaatgagaaggaggctgcctccacggcggaggaggacggagagcagggaatcgatgcggaagtcgcggcggtggatggggaggagggggcgccggctggggaaagctcagacggcgggtggagcttcgggggcctggtgagtacgttcgcgtcgcggtcggagtcggtcctgggagtctaccgccgcgacctcgaggacctcggctcggggctccgcctcgagacggccgcgctccgggccgccgccgcgcgcgccgcctcagcgctacctggcgcgctggaggccggcgcgtctgtcgcctccgacaggcttgagtctgtcggccaggccgttgacgacctcggtgccgccgccgctgggctcctctcgcatgccaacgagggcctccggtccgctgaaactgaccgtgttg

SEQ ID NO: 11123 - DNA, 540 bp, Zea mays
  Clone ID: LIB3279-185-Q1-K6-C1
cccacgcgtccgcaaacatctattagctaagctctgaaccaaggttgtagaaaactgccgctatcagtagccgccactgcaaaatcaagcggagtactcctacatggattagagtaagatacttagcttggccaaggagggaactccgagctaaaacttgggcaattgaatttgagaaatggatggaaccaaatttgattgagaaagaaaaggcaatacttggtttcctccaattttctcatgttcggttgatcggatgtgtaggtggcagtgcagcaagatgagacctgtctgaagaatttggaagctgaaggtgagcgttggcggaaaccaagtctccaactgcacgcaaagcacaagatttagttccctccaatgtctcatcttcaaatgtctcaaatcaatgcaaatctcgaggcgttagtaggatcattattatcctccaaatacggtgttcctagttaagcaaagtaatgggctctttgtttgcaccaatttggcgtttcgtgttagacaatttcatatcgggtgaacatttcc

SEQ ID NO: 11124 - DNA, 649 bp, Zea mays
  Clone ID: LIB3279-185-Q1-K6-C12
ttcccacctacctccgcttctctgcgggggggggccggaggccctcgccatggcgtcgcgggtcctggcccgatccaagtcccttcacctcgtcgccgccctcacccctgccgctgccaaagcagcaacgcctatcgccggagcccgcgcgctctcgtccctgccccgctacccgtgggggcgggggccccatgggctcggcaaggttctgggatatgaaccaacatctcacctcagtggaccacaagttttacctcgttggttttcctctctagcatccaatggatctcaggtgcagaagtcacagatctctgagacatacaagtcaggtggtgaaatgaaacagtctgagacacggaaatcaagtgaggaagccacaccaaaagttgtggcgttcagtccgctagaagcagctatcgctaaacctagaagtagtcccctgacaagtgagagttctaaagtaaggcgatcagagatagcaacccaagtcaccttttacatgatcccagccctgcttcttgcctccaagaacagcataagtacctcccttctggtcggcgccgtgttccatcaagtatacatgttccacaaggagattcttctggactacgtgcaccatgatatcaccagaaagtgggctttgatttac

SEQ ID NO: 11125 - DNA, 619 bp, Zea mays
  unsure (1)..(619): unsure at all n locations; Clone ID: LIB3279-185-Q1-K6-C2
gcggggggtgtacgaggngnaagctccgcagcggtgcgcacctccaccgcgnacccaccatcaacccaggcctcggctcgccccggtgcccgcgatgcctctccctcctcaaccccaccgcgggnaaagaggactgggccatcacctccgtcctgcacgacgccactgccgtggctggttccggtgccggcgctttgctcagtgctgtgcacgggtttaacacagggatcccttttgtccagaagcatgtcaaggggccgaagtggctgcagttgctcgttggggtgccaccactgctgatattctcaggtgccagtgctgtatttggtgcatatgcacttccaaggtttgttcagctcacagtgacgtcttactacgcggcatcaactggctcgcagtatgctgtttcacagatcacacggcagatcgaaagagctcattttccagaatcagcccaggaatctgagtgagttggttggcattcagtctgttctattgggggtgcaatgtacatggtatagaaggacgtttagtgctgcttttgccgtgttgcagtacagtattagttttactgtgtttcagacagcacgcagtgaataaaattatattgtcttggtct

SEQ ID NO: 11126 - DNA, 664 bp, Zea mays
  Clone ID: LIB3279-185-Q1-K6-C3
cggcgctccccccgtcttcttcttcttcttcttcctgtactatatagcctcccctcgcaaatcgtcactgacgttcattccgcttgcttgattgttccaggtattagcagtcgaccggttcctcggagcacgatgaagtttgttgctgcctacctgcttgctgtcctcgctgggaacgccagcccctccgctgacgatttgactgccattctggagtcagttggctgtgaagttgacaatgaaaagatggaactcctgctgtcccaactgagcggtaaggacatcaccgagctcattgccgcgggcagggagaagtttgcttcagtcccatgtggtggcggcggtgtcgctgttgcggcagctgcacctgctgctggcggagctgcttctgcagctgaggcaaagaaagaagagaaggtggaagagaaggaagaaagcgatgatgatatgggcttcagcctcttcgactaggctgcacagtcatcacagtattgttttgggcagtgaaaccagaggaaaaccagagtcatgtttagattttaagcttgttttatgttggaaagtactggaaagactgctacttgtctttatatttggtaattcagccgtagattgctatgctggttgggatttactcgtgaaccagatttttctgtcttatata

SEQ ID NO: 11127 - DNA, 626 bp, Zea mays
  unsure (1)..(626): unsure at all n locations; Clone ID: LIB3279-185-Q1-K6-C4
tcgattgtcgttcatgaattctgaaggacgagnaaattgaatcacaacttctgcctatagctacagcctcgttgaacataangagaaaagcatgtcaaggcttacctgggcacaacgccaggtgcaaagcccaagttttggcttgcttttcctgtgtctgttccacctcttggtttcaatacttatttcgtctcaaacttgaagaaatcagcacatatttcttcgaagtccactcagtactcacctcaaggaagtgaaagtagtaatctacaagttggtcaaggcaacttgaaacttcaatataatgaagctggaaaattatccctgtactccgatagtaagactatggttcaagcaaactttgagcagaaatacaagtattatattggacaggatggaaatggaagtgatcctcaggcttctggagcatacatattccgccctaatggcacagttccaatcagtactgatgggcaggtttctctcacagttctgcgtgggcccatattggatgaagtgcaccagcagataaattcatggatttatcagattaccagggtttacaaggagaaggactntntggaaactngatttatagttgggcccataccagtagatgatggaaa

SEQ ID NO: 11128 - DNA, 638 bp, Zea mays
  unsure (1)..(638): unsure at all n locations; Clone ID: LIB3279-185-Q1-K6-C5
cgcggcggcgagnagcgcgaagtaggaggaggcgtcggccatgacggggaaggcgaagccgaagaagcacacggcgaaggagatcgccgcgaagatcgacgcggcgacgacgaaccggggcggcggcaaggtcgggcaggcggatcggctagggcaggacaagggcgggcacgcgaagctggcgtgcccgctctgccgcaccccggcgcccgacatcaagtccatgcagatccaccacgaggcgcgccatcccaagctccctttcgagccggagaagctcgtcaacctgcactcctccaccccctccgccgccgaggccaccacctccaagcccaagcccggggtccgcggcagcctcaagaagtagctggctggcttgcctgcctgactgcctggggtaattcccttcgatttcaatcccatccaccgacccgatctacaatcaatcaaagtaccgcccgccctccggcctgcggtgtactgttagtctgctgctgcttcttatcgttgttatattgctgatacatgtctcgcgtgatagatgtgtcaactatatatcagtctcgtcgccggcaatgctgtcatgcttaaacatgtgtcgctgctgctccgtgatgccggcgacggctgctattagt

SEQ ID NO: 11129 - DNA, 671 bp, Zea mays
  unsure (1)..(671): unsure at all n locations; Clone ID: LIB3279-185-Q1-K6-C6
ccccgcgtccgcggccgcgtggggccgtcgtgcgctcgctacccctctccctcgaggcctttgccggcgaagagcgcccagtcgcccaccaggatgaagtttgttgctgcctacctgcttgctgtcctcgctgggaactccagcccctctgccgaggacttgacagccattctggagtcagttggctgtgaagttgacaatgaaaagatggaactccttctgtcccaactgagcggtaaggacattaccgagctcattgccgccggcagggagaagtttgcttcagtcccatgtggcggtggcggtgtggctgtcgcggcagctgcccctgctgctggcggcgctcctgcagctgaggcgaagaaagaagagaaggtggaggagaaggaagaaagtgatgacgacatgggcttcagcctcttcgactaagcttgtgcaatagtcaagaatattgtttttgagtcgcggaagcagaggggataaaaatcttagtcatgtttggactttaactttgttttatgttggaaagtacttgaaagacttttcctgtggtaattctaggcgtaggttgctgtgctggttggggtttactggtgaaccagagtttttctatcccactatgaatntgttacctcaagttacctggatgttcactgtttttgtggtaaaaa

SEQ ID NO: 11130 - DNA, 583 bp, Zea mays
  unsure (1)..(583): unsure at all n locations; Clone ID: LIB3279-185-Q1-K6-C7
ggagaacaggaagcaagtcgacgctgccattgctaaagcgaaggagtgtccactgcctgatccatctgagctcttcacaaatgtttatgttaatgactgcggtttggagtcgtttggtgtagacaggaaggaggtgaggaccgttcttccgtaggctggcaaacaaaaaaaaaggttctactgatacaggcgaagcgaagggatcctctcctctgttaccgtgtatttgtttatctggtagtacgaagaagtttgctgcgtatgtatatggacgcatcacaccgcagtagtttcctcacttgtggttatggtcctatgaaccccgggttataatttcctctgctcgtcgagctatcacaatgtgcagccaagatgttgtcaggtgctcatgtcatgccgatgtttcgtcttccacaaatcccctttctgaacagtgcccccacgtaaacagtagtagttggctgcattagctagggggcagctaatagctntttattagttacaaagcagtttctttgttaactntagctgcacccaaacatgaaactaagcgtgtgttttgttagcgggttgaacctgtatc

SEQ ID NO: 11131 - DNA, 473 bp, Zea mays
  Clone ID: LIB3279-185-Q1-K6-C8
ccgatgcggatgttgacaacgtggggcgcgtcaacctactagaccttgcccatggtggtcaccttgtgcgctttgtgatctgggcccaagacgcgttcaataagctagatgtggagtctgggagcctatgacgccccgtcagcagaacaagatggctttgagctaccacacgcctaagatgtgcaacgctgacctgggcatgatcatcaactttgacgaggtgcatactgcggagaagccactcaacaggggaagtgaagccgtaggtgagaagaggtaacaacccactctaaaacatggctgctgcgctaaaactcaaaccgtacctggcgactgcctgatagatggccacctttgctgaggctgctcgcttgatggccacaatggctaaactcgactccaagacgaccaaacttaccccggacactgccaaggttaaagctgctgtgaatgcatgggacaagaccataggc

SEQ ID NO: 11132 - DNA, 598 bp, Zea mays
  unsure (1)..(598): unsure at all n locations; Clone ID: LIB3279-185-Q1-K6-C9
gaccgtctccttccttccccaccatgctcccctccacctccacctccaggctcctccgccgcggcgaaacccgccgcaccanaaccccacccggaggaagggcgaggagccgtggctcgccgcgagcctccgcccggcgaacttcctcccgggcctcgccatcgggttcctcctgaggcctcctcctcgacttgtcctcgtcgtggaggcccaagtccagccccgcgccggctccggccgccgcacccgcgcgggcctccagctccaagcgggcgtcggggacctcgtttgcctcgggcggcgaggagcttaagatggttttagtggtgcgtcaggacctcaagatgggggctggtaaaatagcttcccaatgtgcccatgcagcgactggcttgtacgcagaattgttgtcaagcaatcggggtttacttagacaatgggagcaacttggacaagctaagattgttttgacatgcaagaatcaacaggaaatgaacaggctaaaggaaactgcagaacatagaggtattcctacatttattgtagctgatgcaggccgcacacaggtgctggctgggtccaaaacattcttgcaata

SEQ ID NO: 11133 - DNA, 686 bp, Zea mays
  unsure (1)..(686): unsure at all n locations; Clone ID: LIB3279-185-Q1-K6-D1
atcgtcgccctcaaattcgttccgtccaggcaaggaagaaatcgagcagccaaggagaggagaagatggctcgtacgaagcagaccgcccgcaagtccaccggaggcaaggccccgcgcaagcagctcgccaccaaggcggcgaggaagtcggcgccgacgaccggcggcgtgaagaagccccacaggtacaggcccggcaccgtggcgctgcgcgagatccgcaagtaccagaagagcacggagctgctcatccggaagttgcccttccagcgcctggtccgtgagatcgctcaggacttcaagacggatctgcggttccagagccacgccgtcctggccctccaggaagccgccgaggcctacctcgtcggtctgttcgaggacaccaacctctgcgccatccacgccaagcgcgtcaccatcatgcccaaagacatccagctcgcccgccgcatccgcggcgagcgcgcgtaggcgtatctcgcgcccggccccagtggcggcggagggatggaggagtgcaatttgtaactntatgctgtttgttcgcttttagacggcgtggcgaagtagtgtaaaaacggctntacaagtctattttgtgtggtagttcgtgtaccgcttcgtnccgaagcgatcttggtaaaagactgatgattcgtgttgccaaacgacacatttcgt

SEQ ID NO: 11134 - DNA, 609 bp, Zea mays
  unsure (1)..(609): unsure at all n locations; Clone ID: LIB3279-185-Q1-K6-D10
atattaactagcttcttctagctctagctaggctcgtctgctgcaagaaggtaacagcgcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagttgtccctcaccagggcggtgttttacatcatcatgcagtgcctgngcgccatctgcggcgcgggcgtcgtcaaggggttccagcaggggctgtacatgggcaacggcggcggcgccaacgtcgtcgcgcccggctacaccaaaggcgacggcctcggcgc

SEQ ID NO: 11135 - DNA, 663 bp, Zea mays
  unsure (1)..(663): unsure at all n locations; Clone ID: LIB3279-185-Q1-K6-D11
ccccgcgtccggagagctccaaaacagaggcgagtgaagatatccctgaaattgagccatgggatgcaaaaattttaatttatgccacatatgaggatatctctgtggagaagattaatatggacaaaatcaccatatatgttgaacatccagaaccatatgatccacctgctgaacctgcgccaccaccgccccagccactgaagttgactaagaaggagcagaagaagttgagaacacaaaggcgtcttgctaaggaaaaagataggcaagaaatgattaggcaaggcctcttggagccacccaagcccaaggtcaaaatgagcaatcttatgaaagtactaggctctgaagctgtgcaagatcccacacggttggagatggaagtaagaactgctgctgcagagcgtgagcaggctcacgttgaccgtaacattgcccgcaagctcacaccatctgagcgccgcgagaagaaagaacggaagctttttgatgatcctactaccacaatagagactatagtttgtgtttacaagataagagacctgtcccatccacaaacacgcttcaaagtcgatgtgaatgcacaagagaataaactaacaggtgctgtggtcatcactgatagtatcanttgtgtggttggtgaaggggggaagaagt

SEQ ID NO: 11136 - DNA, 591 bp, Zea mays
  Clone ID: LIB3279-185-Q1-K6-D12
gccagtcttgcatcccgtccccgtgcgggcggggcgacgccgccttttcgtccccgcgtcagcgtcgcggctccactgagcgtgcgtgtcaccggcgggaggcaagggcaggcggtggtggcgatggcgtccgctgacgcgcgcttggcggggatcgcctcctccatccgcgtcatccgggagtgccccaagccagggatcatgttccaggacatcacgacgttgctgctcgatcccaaggcgttccgtgacaccatcgacctctttgtcgagcggtacaaggaccaagggatcaccgtggttgctggtgttgaagctagagggttcatttttggtcctcctatcgctttagccattggcgcaaaatttgtgcctttgaggaagccgaagaagttgccaggcgaggtgatctccgaagagtattctttggaatatggaactgacaagatagaaatgcatgtcggagctgtacaggccaacgaccgggctcttgtagtcgatgatcttattgctaccggtggaacactatgtgcagctgtcaaacttattgaacgtgttggagcaaagttgttgagtgtgcttgtgtcattg

SEQ ID NO: 11137 - DNA, 462 bp, Zea mays
  unsure (1)..(462): unsure at all n locations; Clone ID: LIB3279-185-Q1-K6-D2
cggacgcgtgggcggacgcgtgggggggctacacatcttcccctgtagcagctctgcgcccaaagatgtctnacacctggaaatcgactcctgcatacgagctgccccctgtcatctgctgtagcaaaccgcccgctgtcgccccatcttcctctgaagaagccacagttcagcgctactttctctatctcgcaccgtatcttcggtgtcgcgctgggagttgccatcatatccgtccccctcgccaccaagttcagcctgatgtttggcgtttgagagcgatttgctgcatcttatgaggaactgcatttccccgttcctgtgactgtttcatcgttcgtctgggttaccttgcaacacaactttaggtgcagttggaataacatctttgtcatgctgacagacttctgtaatacagtaataagtaaaactataaaatatcagtgcaaggaggtttgcccc

SEQ ID NO: 11138 - DNA, 659 bp, Zea mays
  Clone ID: LIB3279-185-Q1-K6-D3
cggacgcgtgggcggacgcgtgggcgccgcgtcgtcgcagcgccacgcctcctccgagtacagcgccagcgccgtggccgacgactcgcccaggaagccgccaccgccgcccgccaccacggacgcccacgcgccgccgccgccgcccgccaccgccatgaggcgcggcggggccggcgcgccgccggacctggggtccgtgctcggccaccccacccccaacctccgcgacctctacgcgctcggcaggaagctcgggcaggggcagttcggcaccaccttcctctgcaccgagctcgccacgggggtcgactacgcctgcaagtccatctccaagcgcaagctcatcaccagggaggacgtggacgacgtgcgccgcgagatccagatcatgcaccacctctccggccacaccaacgtcgtcgccatcaagggcgcctacgaggaccagctctacgtccacatcgtcatggagctctgcgccgggggcgagctcttcgaccggatcatacagcgcggccactacagcgagcgcaaggccgccgagctcaccaggatcatcgtcggcgtcgtcgaggcctgccactccctcggtgtcatgcaccgggacctcaagcccgagaacttcctgctcgtcaacagggacgatgacctctcgc

SEQ ID NO: 11139 - DNA, 623 bp, Zea mays
  unsure (1)..(623): unsure at all n locations; Clone ID: LIB3279-185-Q1-K6-D4
caacgagccaatcattcaaatcctctccggaaccgcgttgagcagggcacggtcgattggatctagattctagggtgagggtccgtcgccgaagaactcgcaggcggtcacgaggaggcggcgggggagggcggaggagatggcctcggaggagatgacggcgacggaggtggctgcgctgctggacttgaagccgcacccggagggcggcttctacaccgagaccttccgcgacggctccatcacgctcaccacgtcccagctcccgccccactacaaggtaaaccgtgctgttagcaccgcaatctatttcctacttcccgcagggagtgtttcccgtctccaccgcattccctgtgctgaaacctggcacttctacaagggagagcctctcacggtcttcgagcttcacgacgacggtcacattgaccttactgtcattggcccacaccttgaggcaggtcagcgcccccagtataccgtgccaccgaacgtgtggtttgngtcgttccccacactagacgtcgagtcgttcgcatctgatggcagcgttcttgtcaagtctcggaagagggaccctgagctgcattactccctttgttgctgcacctgtgcccctggct

SEQ ID NO: 11140 - DNA, 646 bp, Zea mays
  unsure (1)..(646): unsure at all n locations; Clone ID: LIB3279-185-Q1-K6-D5
ccctaatcccacctccagtctctgggcaccaaatttccggcggcgatggcggcggctgtggcgaggtcagggttccggcgcatgttctccgtctctgccttcgcgccgccgaaggcgcccgccgcgcgccccaaggccgacccatcccccaacctcttcgtctccggcttaagcaagcgtaccacaagtgaaggacttagagaagcctttgcggagtttggtgaagttttgcatgctcgagttgtgaccgatcgtgtcagtgggttttctaagggatttggctttgtaaggtatgctacgaccgaagaggcagccaagggaatagagggaaaggatggaaagttccttgatggatgggttatttttgcggaatacgctaaacccagaccaccaccggaggaaacagggatgaattcgcagccccagcagtcatggggagctccatcaggttcctggggtgcacagtagatgaagtgatattgtgagagcccctccctgtcccagccctagggctcgtagcggatcgtgagggatgattttgtgtggtgtgtcgcaggtgtgaaatgcctttgttgtcccaatattcctaccgtgttggggggtggtcgcttgctcgcgtncacgtctttcacatgaattggttact

SEQ ID NO: 11141 - DNA, 662 bp, Zea mays
  unsure (1)..(662): unsure at all n locations; Clone ID: LIB3279-185-Q1-K6-D6
gtgcccgtcgcgttcaggagagtgccgtgcgtgaagaaggcggcatccggttcaccatcaacgggcactcctacttcaacctggtgctggtgaccaacgtggcgggcgccggcgacgtgcgctccgtctccatccggggctcccgcacggggtggcagcccatgtcccggaactggggccagaactggcagagcaactcgtacctggacaggcaggcgctctcgttccaggtcaccgccagcgacggccgcaccgtcaccagcaacggcgccgtccccgctggctggcagttcagccagaccttcgagggcggccagttctgaggatgaacagctagcgcgcgcgcggctagctattggataattaattacggtactgtcgatttggtttttttgccttgttttttttttgcgcgacgacgacgaagaggaggatgaagacgaagatgaagacgaggcctctctccgggtatattgaaggaaggagaaggcttttgcgcgcgctatgctgaggctgctaatctagcacccgcctagacgtttcccttttctctggtggattacggactggatcggaccaaagatcgatccagctcctagtactaataatatagttgtacttgaggaaaagaataattgtaatttattgtttttnttgggacc

SEQ ID NO: 11142 - DNA, 590 bp, Zea mays
  Clone ID: LIB3279-185-Q1-K6-D7
gtcgtccccttctcccatcagcgggagggcggcgtcgtcagccggccaaaaagcaaagcgtcacgagaagctcgttccttgacgggcagccatgattccaaggacgtcctcggtctcttcgtcggcggcggcggcggcgcccaccgcgggcgcgccgccggcgtggccgagcggcagcgacgcggcggcgttccaggcctcgggcagctcgggacatcagcaggtggtcatcagcaacggggtgctcctcgcggcggtcatcttcctcttcatggtcgtcgtgttcgtcttcctcctctacctctacgccaagcgctacctgggcgccgggaacccgctcgcggcgccgccgtcctcgcggttcctcttcgtggccgcgtccccgctcccgcagcgcggcctgcccgcctccgccctgcgctccctccccgtcgcggtctacggcggcggcggcggcggcggcccgggcaccaagggcagcaaggaggcgctggagtgcgccgtgtgcctgtccgaggtggccgacggcgagaaggtgcggacgctgcccaagtgcgggcacgcgttccacgtggagtgcatcgacatgt

SEQ ID NO: 11143 - DNA, 591 bp, Zea mays
  Clone ID: LIB3279-185-Q1-K6-D8
ccaatcttcagcccttgttcatcaacaaaccacatggccgcgctcggtcctgcttctgttacctccacgggcttggcgctgcacacccctgcgattcctcatcgtcggcgtcgccacgggaatgcagtggcctgtgcgtcgtcgtctcaacaccagcgaagccttaatggcttggcgatgagttcttcaggcacgaacaatgccttgcccatcaaaggaattaccactacacgggttcctgcagtcggtcgttcggtccctgcagcgaatccgtcgccgtcaggagggaacaacctcccggtgcccaagattcctccgtgggtcaagtgggtggctggcgccgtcatatttgcagtgcccatgtacaggaggttcagagctttagaagacaagatagagaagacggcggaggtggcgatcgaggtgatcgacaaggtggcggaggcgacggagaaggtcgccggcgaggtcgccgacgagttccccggcaacgagagcatcaaggaagcagcctccaggatcaagaaggtcatgcacgtggtcgaggaagacgccgacaagggctgagccctgatcgagaaggtcgacgag

SEQ ID NO: 11144 - DNA, 653 bp, Zea mays
  unsure (1)..(653): unsure at all n locations; Clone ID: LIB3279-185-Q1-K6-D9
gggtgaagatcggatcaaatgctccaagtgccctgacttcgacctttgcgtggaatgcttctctgttggcgctgaagtcaccccacatcgcagcaaccatccttacaaagtcatggacaacctgtctttcccacttatttgcccagattggaatgcagacgaagaaattctcctccttgagggaattgaaatgtatggtctgggaaactggcttgaagttgcagagcatgttggtaccaagtctaagttacagtgtattgatcattacacaacagcatacatgaactcaccttgttatcccctaccggatatgtctcatgttaatggcaagaacaggaaggagcttctagctatggctaaagtgcagggtgaaagtaaaaaagggacttcactgttgcctggagaactgactcctaaggctgaatctccattttctccctccagggtcaaggtggaagatgcacttggagaaggtctagcaggtcgatcaccttcgcacatagctgttggtgcaaataaaaaagcttcaaatgtgggacatattaaagatgggtctaatgtatcaaaagttgaagatggtcatgtcgatagaagtgtntggtgtgaagaagccccagaattctgcagatgaaggcccttcgttgactgaactg

SEQ ID NO: 11145 - DNA, 485 bp, Zea mays
  Clone ID: LIB3279-185-Q1-K6-E1
gttcttctccttcacgggcagcaaagcttcattcgcaggagatttgaatttctacggcaaggctggcgtgcagttcttcacccagatcaagacgatcacgcagcagtggaaggagtcgccggtgcagcgggtctcgctctccatgcccacctcgcagaagtgagacgtcaaaggacgctcacgccactctccaaagctccactcctctggacatagacccacgcatggccacaagagaaggataattggtaggcatggcgacactccatgcacggccatgatactagtgtgtgctcgctttgctcttttgtctggacatcttgcatgcgcattcagaacatccaatgacgaaggtttagatatatgtgagcgctgcccattatgctgttaggattactgtaaaagccccaggtcctttgatcgagtgtcatgtgtaaacccacaataagaggagaaataaaaatgtcgccgtgctggtttgtggc

SEQ ID NO: 11146 - DNA, 634 bp, Zea mays
  unsure (1)..(634): unsure at all n locations; Clone ID: LIB3279-185-Q1-K6-E10
ccccgcgtccgccacaccgcgcgagatctccgatccccgcccaaatcccacgacgccggcggcggccatgggcggcaaggacctgacggaggaccagatcgcctcgatgcgggaggccttctcgctgttcgacacggacggggacggccgcatcgcgccctcggagctgggcgtcctcatgcgctcccttggcgggaaccccacgcaggcgcagctccgggacatcgcggcgcaggagaagctcaccgcacccttcgacttcccgcgcttcctcgacctcatgcgcgcccatctcaagcccgagcccttcgaccgcccgctccgcgacgccttccgcgtcctcgacaaggacggctccggcaccgtcgccgtcgccgacctccgccacgtcctcacctccatcggcgagaagctcgaggcccacgagttcgacgagtggatccgcgaggtcgacgtcgcgcccgacggcaccatccgctacgacgacttcatcctccgcatcgtcgccaaatgatcccgtcccttctccctcgagtctccgattcgccgatccaccgnccccgcgctcttcgtctgtaatgacttcgtctcccgtccgccgtgatttgattttatttacccgctagctcatttg

SEQ ID NO: 11147 - DNA, 625 bp, Zea mays
  Clone ID: LIB3279-185-Q1-K6-E11
atcttcaatctccccagcaatccctagcagaagccttccatcctcactcgctcgatggcccgcacgaagcagacggcgaggaagtccaccggcggcaaggcgccgaggaagcagttggcgactaaggcggcccgcaagtctgcccctgcgaccggcggagttaagaagccccaccgcttccgccccggtaccgtcgcgctccgggagatccgcaagtaccagaagagcacggagctgctgatccgcaagctgccgttccagcgcctggtgcgggagatcgcgcaggacttcaagaccgacctacgcttccagagctccgctgtctccgcgctgcaggaggcggctgaggcctaccttgtcggtctcttcgaggacaccaacctctgcgccatccacgccaagcgcgtcaccatcatgcccaaggacatccagcttgcccgccgcatccgtggggagagggcctaagcatcgtatattctgtcatcagtgcccgatcagaagatgtagagatgtgctgggttctgtagtttgggttactgtcgaatcatcgagtagttggttgttcactgctgtaacttattatcatgatgcatatgaaatgggcatgaactatgttatcagttct

SEQ ID NO: 11148 - DNA, 568 bp, Zea mays
  unsure (1)..(568): unsure at all n locations; Clone ID: LIB3279-185-Q1-K6-E12
ttctgtgttccgggctcccctcctgttgtggggcgaggggggcgccgcttcgcctcctcctcgcaggcaagaagagcagccagccgcttcgcgatcggggacgcggagaggggaaaggcgagtcgtcgtccgtccacggcagcttccctccctctcctctccgcccccgcttacctagcgggggggggggtacncccccccccctcccgccgccgcacgatgagcacctctccggccgcgtccgccgccgcgtcgcctccgccgcctattgcctctgccgccgaggcctcncgggcgacggagacgttggtggtcgacgagagggtcgcctcacacgtggacccgttcctcgtagaggcgctcgacaaccctcgccaccgcctcatggttctacggatggaactggatatacnaaactttatgcagaaccctcagctgcaggagttcgaattccagaactttccgacttcttacctacgctgtgctgctcatcgtgttgcacaacattatggcttagagactatggtggcagatagtttagtagaaggctcanttagcaggatcgttg

SEQ ID NO: 11149 - DNA, 641 bp, Zea mays
  unsure (1)..(641): unsure at all n locations; Clone ID: LIB3279-185-Q1-K6-E2
cttcctccggctactcgctcgttccgccccggcgtcccgcccttagccgccgccgtcgccccctccctcggttcgcctcgtcgtcgtcatgggcaaggcctccaaggacaagagggacatctactaccggaaggccaaagaggaaggctggagagctcgcagcgccttcaagctcctccagatagaccaggagttcaacatcttccatggagtgaagcatgtggttgacctgtgtgctgctcccggaagttggagccaggttttgagccggaacctgtatgtaccagcaaaacagtcttctgattgcaaggaaggtgatcttcctctcatcgtcgcaattgacttgcaaccaatggccccaatagaaggtgttatacaagtgcagggcgacatcaccaatgctcggacagcagacgtggttattagacattttgatggatgcaaagcagacttggttgtttgcgatggagccccggatgttactggccttcatgatatggacgaatntgttcagtcccagcttatactcgcggcattggcaatcgtgactcatgtactcaaagttggtggaaaattgtggcgaagatattcggggtaaagatcgagtctnctgtactgccagctaaaactgttcttctcgc

SEQ ID NO: 11150 - DNA, 683 bp, Zea mays
  Clone ID: LIB3279-185-Q1-K6-E3
cccacgcgtccgcggacgcgtgggctcgtcggcagcctctgcgtctacgccgccatctgccggaaggagggcacgacgctccggtggcccggctctcgggtcacttgggagggcttcagcgacgcctccgacgccgaccttatcgccgagcacgagatctgggccgccgtggatccgttcgccaagaacgaggccttcaattgcagcaacggggatctcttcaagtggaagcagctgtggccgatactcgccgaccatttcggcctggaatgggctggctacgaaggtgaggagaacaggttcaagctcgaagaggtcatggccgggaaggaagctgtctgggcggagattgtcagggagaacgaccttatagccacggagcttgacgagatcacgaattggtggttcgtcgatgccatgtttgctgtggagacccagcttctggacagcatgaacaaaagcaaggagcatggcttcctcggcttcaggaacactgtcagctctttcaacacatggatcgagaagctgaaggtcttcaagattgttccctaataataattcatccttgctattcacttctatactgttgttctgcatccttattatcctgctcatttatcagcaccagttctcctgtaattcaaacatcttgctatctgtgccaggtttgcatgttatatact

SEQ ID NO: 11151 - DNA, 384 bp, Zea mays
  unsure (1)..(384): unsure at all n locations; Clone ID: LIB3279-185-Q1-K6-E4
ggnaaatgatcgtcagaagctggataaggatgtgcaaggcaagcgtgacaaaaacagctggttgaagattctcctactgatgatgagcttgacgactacccatttttggacaacagtcctgttaagtttgagctgaaagatgagtcagtgattccagatattggagcaatctgaagtgatagtgtttgtgcgattgttctgtagcaatctatgtagtacgatgtttagtacatgttgtttgttctgtagcaaactatgtagtttgagctgaaagatgagtcagtgcctcatcgggtacttttgagtaccgtagcggttgtcaagtttcatgctctcctgaaaaatccttcgcaactcgcaagtgaaactctggtttatgccctg

SEQ ID NO: 11152 - DNA, 601 bp, Zea mays
  Clone ID: LIB3279-185-Q1-K6-E5
tgcgaaggcgaccctccctccttcgctccttccgcgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggcttggatgtggacaacctctatgtttcacacatccaggtgaatcaagcccagaagcagaggcgccgcacctaccgtgctcacgggcgcatcaatccctacatgtcctcaccttgccacattgagctgatcttgtcagagaaggaagagcctgtgaagaaagaggctgacaacattgtcgcagcaaggaagcagtgaagtatatcagcatgctgatcgaggcca

SEQ ID NO: 11153 - DNA, 611 bp, Zea mays
  Clone ID: LIB3279-185-Q1-K6-E6
acgcaccataacataaggtagtagatcaaggacgccgtgctgcgcaatgaccggcagtgggaagcacgggcgccatggcagtgccaggctccagggccaaggcaatgctgctcgccttgggcaagagctttcctgaccaagttctgcctcatgtagaaggttgtggagagctacctgcaagaaagcatctgctacgatcccgccaccagggccaagcttcagcgcctttgcacgactacaacagtgaagacaaggtacactgttatgtccaatgagctattggataagcacccagagctgaagatggatggtactccgacactgacaccctgccttgacatctgcaatgccgcggtgatcgaccttggtgctgccgcagttcgcgctgcccttgacgaatggggtcgccctgcagctgatattacccacctcatctacatctcattcagtgaccttcgtctaccagggggcgaccttcacctggctgctcgtcttggccttagcccaaacaccgtgcgcacttcccttctcttccttggctgctccggtggtgctgctgtcctccgcactgccaaatacattgctgagaacaatccagggagccgtgtcct

SEQ ID NO: 11154 - DNA, 608 bp, Zea mays
  unsure (1)..(608): unsure at all n locations; Clone ID: LIB3279-185-Q1-K6-E7
ctgctcgcgccgccccatgctcctccagccaggcacggcgcctttttctcctcctgccaggtgaggtcgcgcgccccttctcctccagccaggcacggtcgcgcggctcttctcctccagccaggcgcgctccaaatggcggtcgacgatgcagcagctgcccaggccgcggaggaccagcgcctcgcatttgaggccgaagcccgccgtgctgaagacgtccgccgcgccgaagaaacccgcctctgttctgcccctttggatgagtttgagcgcgcccatgaggccctctgggcgcaagccactaccgtcgtcaacgtcaaggtgctcatccctgtcatcctcgaccaggcaacgaacacctacaccaagtggcgcggcatgttcatcaccgtcctcggcaaatacgccctgactcgtcacgtccttgaggatgaagccttcccatcacgcccggcatgggttcaagtcgattgctgtgtcttgacatggatctacaacaccatctccagtgacctgcaataatctctaatgatgcggcagggccttgctcgcggggcgtggtgctacctcgaggnatgagtccttggccaaagggaatccgggcg

SEQ ID NO: 11155 - DNA, 598 bp, Zea mays
  Clone ID: LIB3279-185-Q1-K6-E8
gacggtgatcaggccaagcttgcagaagagcaaatgggacgagctggagaactggaacgaggaattcggttcgagctgacggagacgcgcgctgcctgatgatgatgatcaagcggccctatttccagatgtacatgatttatgtctcacacacacatggtggcttacacacacacacgcgcccatcggccatcgatgcgtcctcagtctggacagcgcgtcttcaacagaagcagaaggtacaatataatgctgggaacagccctatatgtatacccattgaaatgccgctgcccaagttatttaaaaaaacaaacctctagtgtgtgttattattagcctatagctgctctgggccgccgagggcgaaatcgaagtatcgtcgggcgtgttcggcaggctgcaagccgacactgttgcagctgtttggactgctgcagctgcaatccatagagagaaaaatactgtagaagccgcagccgcagccggattgcagccgcagcaagccgcagcgaacaagccggtcgttgtgtaaaaagaaacacaaaacctacatgcttaatgactcgtatatgtgttattattagcccatagctgc

SEQ ID NO: 11156 - DNA, 634 bp, Zea mays
  unsure (1)..(634): unsure at all n locations; Clone ID: LIB3279-185-Q1-K6-E9
caagcccaagttggcccggacagcagcagccgccgtggcgtccggggtctcggcccggccggccgcgccgatgagggcttctgcgggacgccgcgctcggctgtcggtggtgcgggccgcgatatccctcgagaagggcgagaaggcgtacacggtgcagaagtccgaggagatcttcaacgccgccaaggagctgatgcctggaggtgttaactcgccagtccgtgccttcaaatctgttggtgggcagccagtagtgttcgactctgtaaagggttctcgtatgtgggatgttgatgggaatgagtacattgattacgttggttcctggggtcctgcaatcatcggccatgcagatgataaggttaatgctgcattgattgaaactctgaagaaaggaactagctttggtgctccatgtttgctggagaacgtattggctgagatggtcatctctgccgtgccaagtatcgaaatggtccgctttgtcaactcagggacagaagcctgcatgggagcgctccgcctcgtgcgcgcattcaccgggcggggagaagatcatcaagntncgaaggctgctaccatgggcatgccgattccttccttgtcaaagccggcagtggtgtggccaccc

SEQ ID NO: 11157 - DNA, 555 bp, Zea mays
  unsure (1)..(555): unsure at all n locations; Clone ID: LIB3279-185-Q1-K6-F1
ctcttcctacgaccataccctacctccaaatcccaatgtcaacctctcctcagattcgagtgaccatgtcggggcgcggaaagggcggngaggggctgggcaagggcggcgcngaacgtcaccgcaggtcctccgcgacaacatccagggcattacgaagccggcgatccggaggctggcgagaagggcggcgtgaagcgcatctcggggctcatctacgaggagacccgcggcgtgctcaagatcttcctcgagaatgtcattcgcgacgctgtcacctacacggagcacgcccgccgtaagaccgtcaccgccatggacgtcgtctacgcgctcaagcggcagggccgcaccctctacggatttggcggctgaggggtcaggggtgtccgccagctgctgctggtcgtggcagaagtcttgggtcgcggtcacgaaatggagtgattcgagagtattcttgcccatgggcttagtttcgtaggcttatcactctagactctagtgccttggtccagtagtagcatacgacttgtactgcatttctttgttctg

SEQ ID NO: 11158 - DNA, 570 bp, Zea mays
  Clone ID: LIB3279-185-Q1-K6-F10
tctctctctctctgtctctctctctcgcctccctctcgcctccctctcgacgacgatctcaggcgctcgcggggagtcgagtcgagaccagcttcgttccttcataaaaagctcacttagttgttgtccccgcctctttttttcgctgttcttgtttgattacatcatcttattttgtgcttgaatctaacctgccattaagtttttatcgcttcgttatttctctgttgtgcttgtcttgttcttttgttgctctaaccatggacgcaggctcccgctcgatctcctcggcgaagaaccgcgccgccgccgtcgccgccgcgccccggccaccgctgcaggaggcgggctcccgcccctacatgccatcgctgagctcgggaccccgcaacccgtcggccaagtgctacggcgacaggttcatcccggacaggtcggcgatggacatggacttggcgcactacttgcttactgagcccaggagggacaaggagaacgcgtcgggcatggcggcgtccccgtccaaggaggcgtaccggaggctgctcgcggagaagctgctcaacaacc

SEQ ID NO: 11159 - DNA, 450 bp, Zea mays
  Clone ID: LIB3279-185-Q1-K6-F11
gtgcctacccacatctacctccgatacaggggggccatggtggacaccccgaacatacactgaagaactctcggacccgtacacttatatggtgatcataccggggctgggcacggcctacatgatggtgcacatgctatacaagcccatctctggaatcaggggttagcgaaggcggggggggggggaggacctcaatacctacgcatgaatcatgggatggtcaagttcatgcgcaaggcaagaccttcggtacaatatcatacatgatacaaaatctccggagtttacacacgacagcgtactcactccgaccttttagaatctgccccaatctcgacacatgactttcataaccataaaggtaaatgtcgcttgtggaggaactatgtcagatcaatcaatgctctcaaaatacattatcagcgtcagatagatgctatgacatat

SEQ ID NO: 11160 - DNA, 553 bp, Zea mays
  Clone ID: LIB3279-185-Q1-K6-F12
ttttttgcttctccgccgtcgagggcggggggcgggggggggagactccaactcagatggccagccgctgggtccggcccgaggtgtacccgctgttcgcggcgacgggcgtggccgtcggcatctgcgggtttcagctcttccggaacatcactggcaacccggaagtcatggtaaaggggggggggggggcagctggtgtgcttgagaaccatgaggaggggagacgttacgccatgcatggcctaagaagctttgtgcacgacaagactcctgagatcatgcctgcagttaacaagttcttcactgaccctaagtgaagcatgttgattggcatactactactactacttgctactggggattttacactttgctggcaactcaatatgttggggacatccatgacctctaaaagtactttgagcgcttggtgatgacttggtatatgtatgatggtggatgagtttgatcgtccatgcttgatgttcatattcatctgtcatctggatttgccgcacttcagtgataaaattgtcatttggatactggg

SEQ ID NO: 11161 - DNA, 636 bp, Zea mays
  Clone ID: LIB3279-185-Q1-K6-F2
tgtttttgtacttcaaagaagctaatgctttttccccttatcatgggtatagggtgatgtggttcatgttcatgtccaccctgtacagcccatgccttcgcacctgtgtcacaaatatgtggccgtcacatttcttctcaaccaatccaatgcatatagaggaaaccctctaatccaatgcatacagaggaaaccctctctgccccagtttttctcttctttcacaaaataagctcgcggcctaccttctttctcctgagaattcatttcgatctctgtctgaatattggtaactatgacaacacaatcaatgtgcagatctgcaccaagaaggaaaggatgcatgttttactatcgttgcttgagagggacgcaccgaagtctgcaatcatatttgttgctgggcagtctgagagatcaaagaaggctggaaatcctccttcaaccatggtggtctctgatttcttgagaaatgaatacaagggaagccttgatgtgatgctgctggaagaagattgaacttcaatgctcgagctgtctcgttctccgaagtgaagggaagaggattcctgctggtctcaaccgacatagcgagcagagggtttgaccttcctcaaccagccacgtatacaacct

SEQ ID NO: 11162 - DNA, 464 bp, Zea mays
  Clone ID: LIB3279-185-Q1-K6-F3
catattaaaatcgagagttgatgctaaaaaacattagtgacaatattgtttagatataaatttgagatgtcggaggaagctgcagaaaaggttaactttatctctggggctaagcttcaattcgacattcgcccattcttcagtattaatgtcgttgccgccgagtacaatagtgattccccggtgcatccacaccaaggatttcatcaccaccagccccatcaacgattacaatggtgaagagtttgtcttctactctacaaggaagtaccgtgccaaaaaactcaataatagagtatcacagcaaccaaaatggctaattgttgccactagagagaatgtatagcctattatgtctggcacttagtgaatcgatagctttaagggcaagttatgcactcgagtgactacaatagggaagggaggccttccaaggcaagaaagtgctcgttgtcggttgtgat

SEQ ID NO: 11163 - DNA, 658 bp, Zea mays
  unsure (1)..(658): unsure at all n locations; Clone ID: LIB3279-185-Q1-K6-F4
cccacgcgtccgcaatgccccatccccacctttcggcttgtttacgctacgcctttttaatcccttccgccctctccgctccccgttgcccccacccagaccaaacccaggcttcccgttccctcgcttttgtccggcggccatggcggaggagcagcagcatcagagatggcaggagggccaccgcctgtgcgccaacaattgcggcttcttcggcagccccgcgacgctggacctctgctccaagtgctaccgcgacctataccagcagcagccagcaggcgcggcggcgggcccctccgctcccaccgcgtcggccttccagcattcctcctcggcagtctccggcgcggcggcggtctctcccgatctcgaacctcccgcgacggcccctgctggcgccaaggcgggcaggtgctccagctgccggaagcgcgtgggcctgacggggttcgcgtgccgctgcggagctaccttctgcggcgtgcaccgctacccggagcggcacgcgtgcgccttcgatttccgggccgccggccgcgacgccatcgcgcgcgccaaccccgtcgtcaagggcgataagctcaaggacaagatctgaggagcaggaaccgncgnctctcgcttcagantcatgtcttccccccgtcagcgggac

SEQ ID NO: 11164 - DNA, 526 bp, Zea mays
  Clone ID: LIB3279-185-Q1-K6-F5
gcgctacgcccccgatggctcacctccagctcctcttctcatactcgcggcggaacccgcagcgccaccgcctgctctcactcttccacttctcctccgacgccaagtccagctccgcctcgccgccgcctcctcccatcaagcccgtctcctacgctccgaagccgcagcagcaggccccgcccgaggagtctgccgccccgacaaccccggacgttgcccctagggaccaatccccactgccacgacggcctcagcagccgatgccgccgcgggagtggacgcggcaggatatgcggtacgtgaaggacgcggcgcccgcgatctcgcccgtctcgtacccgtccagggtcgcgccgctgccggaggaccgtccggtcggcggcgaggtggaggaggtgcaggacggggggctgcagggggagtcggagcggatccagatgaacgcggtgcgtcccaccaggagcgtctttgggatgcacgaggaggataggctgccgtacccgacggtcatacccgtcgtcaa

SEQ ID NO: 11165 - DNA, 660 bp, Zea mays
  Clone ID: LIB3279-185-Q1-K6-F6
cggacgcgtggggccgccgttgccgtctcctcctccgacccatcactctctgctcgcgcactctcacctgcccgcgccgtcttcgaccgccaccaagatgaacaaggagaggctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccaaagtgcaagcttccatcgcggcaaacacatgggtggtcagtggatctccacagacgaaaagtaagaatactcattcctcgttttcatttgatgtactggtcatgtggtaacctagagctataccgttttccgatcagtgggtgttatatctatatggtcattggttgcccaagtacagcagctaggctttgcaaaaatccttatgagatgtttggaaatccgaaatctggattactagtcttctcacctacaggattttgcagctggttaatctgaacatatttctaggttcttctgtttcttcaaactacatttttattcagtaagttgctatctgagtggtttctaa

SEQ ID NO: 11166 - DNA, 363 bp, Zea mays
  unsure (1)..(363): unsure at all n locations; Clone ID: LIB3279-185-Q1-K6-F7
gtttcgattttcacatgtagaattgagggcatctcaagtaacgtgggtatgaagaaggcgctacagctgccggattacctaaagccgacggagctgaagatgatgctcaatacgatcaaggccttcctgccgattgtctttgtaagggaggcatgacacctggatgtatcatttgggagcaaactttaaacgtctacctcttttaactaagatgtatcattttcttccaaagacacgaaagtatgacacattgggtttgttaccggttagaagctcgtaagacgtcttcttgacactactacaaatcgtgttatatgagatggttaatttttagttattaagatgcttataaagtgtccanna

SEQ ID NO: 11167 - DNA, 640 bp, Zea mays
  unsure (1)..(640): unsure at all n locations; Clone ID: LIB3279-185-Q1-K6-F8
tggngtcttcagacaccatcgacaacgtcaaggccaanatccaggacaagnagggcattcccccagaccagcagcggctcatctttgctggnaaagcagcttgaggacgggcgcacgctggccgactacaacatccagaaggagagcaccctccacttggtgctgcgcctcaggggaggcatgcagatcttcgtgaagaccctgactggcaagactatcaccctcgaggtggagtcttcagacaccatcgacaacgtcaaggccaagatccaggacaaggagggcatcccaccggaccagcagcgtttgatcttcgctggcaagcagctggaggatggccgcacccttgcggattacaacatccagaaggagagcaccctccacctggtgctccgtctcaggggtggcatgcagatctttgtgaagacactcactggcaagacaatcacccttgaggtggagtcttcggataccattgacaatgtcaaggccaagatccaggacaaggagggcatcccaccggaccagcagcgcctcatcttcgccggcaagcagctggaggatggccgcaccctgncggactacaacatccagaaggagagcaccctccacctggtgctccgcctccagggtggcatgc

SEQ ID NO: 11168 - DNA, 392 bp, Zea mays
  unsure (1)..(392): unsure at all n locations; Clone ID: LIB3279-185-Q1-K6-F9
catctcctcgcatttcttcccatccgatccccccttcgcaaccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctgaggccgncaagctcgcgcgct

SEQ ID NO: 11169 - DNA, 620 bp, Zea mays
  Clone ID: LIB3279-185-Q1-K6-G1
cccacgcgtccggtcaaatgtgcaaggttatttgattgtttgattacatgtcatgccatatctgacaaaagctggaggacagatcaactgtacagattgtaactagttgagtgcttttttggggcacttgatttctaagactaagcagcatttgctacgaacccacttgatgggcagcagttcaatttcagagatgatgtattgtactgtttgatcttgaaagcaaagcataaagtttactttcagccagtttctgtaaaccatcatacaaactttcggatgctgcacttgattggtttgcaattattagccactgctgttacaaagctgcatgtttcacctttttttggctttcttacatctgaaagatagtcgaaaagaacattcagaacgaaatggtccttttaccagattcatcagtcctggcctttatggttaaaaaaaatcagcttcggtgcaagtgatagctgctggcttcttgattcccactgttgggagccctctgacccttacaacctaggaaaaagttactggtgaacgcagttgcttcagacctttgcaactgcaatgttcttggctttccttgaaccaagagtaaagaaagctttgcatggtaatcg

SEQ ID NO: 11170 - DNA, 657 bp, Zea mays
  Clone ID: LIB3279-185-Q1-K6-G10
ctccggtgtacctctcaccagcatccctcctcgcggagctcaatgaaatcggtggaaagcatgggattgggcgtatcgacatggtggaaaacaggctggtcggcatgaagtcacgtggggtctatgagacccccggtggcaccatcatggcagccgcggtacgcgagttggagtccctgaccctgggacagggagaccatgcagtggaaggacatcattgccctcaagtacgccgagctggtctatgctggccgctggtttgacccgctccggcagtcctttgatgccttcatggagaaggttaccgcgacgaccactggttcagtgaccctgaagctgtacaagggttccgtgaacgtcgcgtcccggaagagcccctacagcctgtacagggaagatatctcctcgtttgagaacggggagatctacaaccaagctgacgccgaggggttcattaggctgtacggcctaccgacacgggtccgggcgatgctggagaagggtatctgagtagttgcctgcttgatttagaaataaaaacatctgtttcccagtgattgcagacagatgggtgtttggtggggagttaaccatgctgttttaccatctgtttacattgtccaaaccaaaaattatcattactacatcagctgcttt

SEQ ID NO: 11171 - DNA, 583 bp, Zea mays
  Clone ID: LIB3279-185-Q1-K6-G11
tttttgatatcagtgaggtgcgagtgggggggtgtgggggctctggattacctagacaacttacaagatagagctcgttccactgaacaaggcgatgcaattgtttttgaatccgaactggacagaatatatctgggcacaccatcgaaaattgccattattgatcatgagaagaaaagagggggggtggtgaggaaaggaggccttcctgatgctgttgtttggaacccctgggacaaaaaagcaaaggctatgtcagattttggggatgatgaatataaacgaatggtatgcgtggaggcggctgctattgaaaagactgtcactctgaagcctggtgaagagtggactggaaagttggaactttttgctgtgccatctagctattacagtggtcagctagaccctgaccgtgtgattcaggattccactgtcccggaggactccatcagctagtccttattctatttttgcaggtagagcattgtatcattatgcataagagatgctggcaacaagggctgtccacatgtttcttccattctgttcaaatcttcggtgtttttttattccgaatgcatat

SEQ ID NO: 11172 - DNA, 652 bp, Zea mays
  unsure (1)..(652): unsure at all n locations; Clone ID: LIB3279-185-Q1-K6-G12
accgtactcatattggttttagcagtaagagcgtgcttatgggtgcaaaatgtcatagtgaaagatgttttattgcattgcatttagttaataacatgtcacttcaaagtgtttgtggggtagaaatttcctttctgacgctgggatatgggcgcgggaaaatttgaacggtcctatggggagaattataccagaaaagagaagggtatgcgttactagtagcttcccccaaactgctggcgctatgatcaaaatgtgctttcccaatttagccactgcatgttgcctcataatttctagtttttcgatatctgacaatgccctgaccgccgcggaatgtcacgccaccggacaccgacatctactccattccgagggttcttgccccgatgccgtagaagtacgcgaggtgcacgaagaaaaactttggccgttaccacgtgagcgagccaccagttgagcatttgcgcgattcactgtacaagacagagagggatgtcatgaaggtgattagtccagctatgtttggtagtgaagggcgatgtccanagagtaagaatgaggcgacacagtatggactcgatatgactgagcaataatatcttgagcattcgattccatggatagctgccaatgatgttgtacatttata

SEQ ID NO: 11173 - DNA, 619 bp, Zea mays
  Clone ID: LIB3279-185-Q1-K6-G2
tttttccccccatgtttcacagaaagtgaagacgcgagtggtcaagaagagcatcaatccggaatggaacgaaaaactcaccctctctattgaagaccctgccgttcctattagactggtacgccttcgcttccacctttccttcccgaactctacaagtattctgagcaaacgagtaacagaggaaataatttactgctagctagtagtaccaatctattactcgtcttccttgatatgtgcaggtgtagctgttagttgttatatgtacaatcaattgaacgaaacattcgtgagccatatatgtttcgtactacagtttttttaaaaaagattaaagttgttctgtacggtgagaaaatcacgtctctcctgatgtaatattagtgattatatatgctaactcagcatgcggtcactaccgaatgacttccatattatggaaattaactttgtctattcttacatgcacacttgtaatttgcctatgccagccaatacagttcagattaagccatatttacggtgttttaagcttttacgttgcacgcatcagtttcgtgagcctgcctgtggttttgatatttgagttgagtcccaagactttcctagctcaaaa

SEQ ID NO: 11174 - DNA, 655 bp, Zea mays
  Clone ID: LIB3279-185-Q1-K6-G3
gttctagatcgcgagcggccgcccgctcgcctcctcctcccgtccccatccagatgatgcttagggtttcctcgtctccggccgccgcggtggccaaccatctctctggtggggccgcggcgaccacggctcctgccagggtgacggcgcagcgcagcggcgtctcgctgtccgccgccgccgccgccggcaaggggaaggaggtgctcagcggggtggtgttccagcccttcgaggagatcaagggggagctcgccctcgtgccccagtcccccgacaggtcgctcgcgcgccacaagttcgtcgacgactgcgaggcagccatcaacgagcagatcaatgtggagtacaacgcctcgtatgcgtaccactccctcttcgcctacttcgaccgcgacaacgtggccctcaaaggatttgccaagttcttcaaggaatccagcgacgaggagagggagcacgctgaaaaggtcatggagtatcagaacaaacgcggaggcagggtgaggctccagtcgattgtggcgcctttgaccgagtttgaccaccccgagaaaggcgatgctctgtacgctatggagctgactctggctctggaaaagctgttaatgagaagctgcacagcctgcatggtgtggcaacagggtgcaatgat

SEQ ID NO: 11175 - DNA, 511 bp, Zea mays
  Clone ID: LIB3279-185-Q1-K6-G4
ccccgcgttcgggccgtccatttggttctggccctcctggtgaccgtccaagggccctggccgttttgaagacagaccaaggtttgaagacagggatgagtaccgtggtggtcctcgtggcgcttccggtgactttggtggcgataatagtggagctcctgcttatttccagacatctttcacgagttctggctcgaggtctggctttggccgtggtggtggcagtggctttggctctggtcccacctcttgttccatggagtgaacattgaatctgaccttattttggacatgatgtttcccctcccatgaggcgtttaatttttaatgacctatattatgtactagtaatgttttccggatcggttagtgctgacatgcaaaaaaaaattcacatatttatacattggttccagtatagaactctttgcaaaacgtttggattctcaagttattacgtactagctaatttaccagtgatcggtcctccgtaaaaaaaaaaaacaaatat

SEQ ID NO: 11176 - DNA, 621 bp, Zea mays
  unsure (1)..(621): unsure at all n locations; Clone ID: LIB3279-185-Q1-K6-G5
gccagttatgaaaggtttactggagaacccatttctgtgaaggaattggctgatcgtgtggcaagttatgttcatctttgcacgctgtactggtggctcaggccttttggttgcggtgttattcttggaggttatgatagggatgggccacagctctacatgatagaaccctcaggagtttcctacaaatacttcggtgctgcattggggaagggaagacaggctgcaaagactgagatagaaaagttgaaactttcggagcttacctgccgggaaggcattgttgaagttgcaaagataatttatggagtgcatgacgaagcgaaggacaaagcttttgagttggagttgagctggatctgtgatgaatcgaaccgtcagcatcagaaggttccaaatgaactgttggagcaggccaaagctgctgctcaggcagctcttgaggagatggatgctgactaagaaacaggacgatttgcccagacttggtgtttttggtgctgttgaaatctccgatccctttggggtgacccactggacatggccaatttgtcacaatntattattttgacccatgtcatgtgaaactcctttcngtgaagtctggtatctagattgact

SEQ ID NO: 11177 - DNA, 465 bp, Zea mays
  unsure (1)..(465): unsure at all n locations; Clone ID: LIB3279-185-Q1-K6-G6
cccgtnctctcttgcctatagcaggagcacgtgcttatgcgtgcaaaagtcatcactgaaagagtgttcttgcattgattccagttaataacatgtcattcaagttttggggtaaaattattatgccctgatttggcgcgtaaaatagaacggcccttggtagaatataccagaaacgcaaaaggtatgcgttactagatgctttccccaaactgctggcgctatgatcaaaagagctttcccaatttatccactgcatgatgcctcataattgctagatctgctatatctgacaatgccctgacccactcgaaatgtcactccaccgaacgacctacatctactccattcctgaggttcttgccccgattccgcaaaatacgcgaggagcacgaataaaaaactttgacctggttccacatgcagcgagccacctagatgagcatttgactctactcactgtac

SEQ ID NO: 11178 - DNA, 332 bp, Zea mays
  Clone ID: LIB3279-185-Q1-K6-G7
cccagcgtccggtgcttgggctctcaggggagcagtagctggtgctggagcgctgcgttgggtacttgggttcattaattaattagcggtgtggatttgccgaagcgattgattgagctgagattgatttttcaaaaaaaaaaaaaaaaaaaaaaaaaaaaaaaaaaaaaaaaaaaaggggggggggggaaaaaaaaaaaaaaaaaaaaaaaaaaaaaaaaaaaaaaaaaaaaaaaaaaaaaaaaaaaaaaaaaaaaagggggcggcccttttaggggacccagttttactaccccgtccttgcaaggtaatattttttttttggggccccc

SEQ ID NO: 11179 - DNA, 649 bp, Zea mays
  Clone ID: LIB3279-185-Q1-K6-G8
tgcattctttgctagctcatgaggatagagagtctcaagacatactcctcttacttgagaacaattctcaagttatggtaccaatcaataaagtttgtttcagtgagttttgtttgtcaaaaattggtggcaagttaaaaccgataggagtattaggtgccatcactacaacaaaataaaaggaaaagtttagcactatgtatactttaatattttaataaaagattctccccactatatgttctgtaatcgaataatcatcttcctctaacaatatatagtggacaagattcatgtttaataagttgtattgagctttggcaacacatcttgaaacataatgatataggtaagcaatatttactaatcatatccgatgtgactcttgtctgctgggtggtatccaatgcccttgctcctaacatcaagcccaagtcacaaatccgatttgatagtctgtttaaggaaaccaacactatacatgcagatgtctgatatccattctattagattaaactaatcgatggcactcttctttgcctggccaacaaagtgatggttagaatcattgcaggcacaacaattcgaaggacatcaaaatgcacttcttagtttttctaagggaaactactgtatcacatttagcgca

SEQ ID NO: 11180 - DNA, 652 bp, Zea mays
  Clone ID: LIB3279-185-Q1-K6-G9
actagcactagcatatatgtttgacggaagatggatgaagttgctttggttggagcatcctcagatagcagttccaagagtgttaatgttgagggagctagaagaatagcatttaagcatatagaaacctttgtgctcactttctcagatccacaaatgttctctatggctgctgcctcctcagccccagcagcgctgtctcatgttgctgaagcagtgtttatacacgaagctggacacctgagatgcagtcgctctgagattggtagatttgtttccatgcttcggaatccttcaccaattcttcgtgcttgtgctgcctttgcccttcttcagttcacaatcccaggaggtcggcatgcagtgcatcacgcaggtctcttgcaggaagcaggggcaggtcgggtgttgcgcgcagcagcggcagcgacaacagcttctattgaagctaaaatctttgccaggattgtactcaggaacttggagcaccatcagttagggatgtcaacatgaacacccagcagaggttcatcctccaataaacaaaggcctctgcatcgatgggctgcttggccaatgcagaatcaaacagtttggccttcggagccttttgacatcacaacagttttggtctgtgcagacagtgactgaa

SEQ ID NO: 11181 - DNA, 657 bp, Zea mays
  unsure (1)..(657): unsure at all n locations; Clone ID: LIB3279-185-Q1-K6-H1
cctggtatgaatatgcagtcacttcattcgttgttattttggctcagctaaccatcaggaggtctggaggatcacaagtgccttggagaaccacaagtatgaaattgctgactgggaccttggtgnccggaatatacatagacttctacattctgaagaactcaatgcaagaaagaaatgccatggatgattcggattcactcgaggagatgagtgaatcatgcagaagtttctttggccgactaaacgaatcgttgttagtctggggaagcaaattacctgttgagtcaagggcatgctactcgaagatggcagaggagctatgcgcgcttctggtggacaccccaagcgagacgctgaacctacccatggggtgtcttctgacgatgctcaacgctccagttccggacgagagcaggtcgtcgtacctgcaggacgcactctccgtcttcaccgaaatcctttgcagcgatccgtagcacaagggtccacggtgttgccgtaatctgggtgaagggaagtgaagcctacaggcaacacgcctaagagtttgtacgtctcatgtttggtacttgtagaaaattaggaatgtataactatgacctgatgttgctccagtgaatttgtaacgccgtctgaagactgtgtcgggatttt

SEQ ID NO: 11182 - DNA, 529 bp, Zea mays
  Clone ID: LIB3279-185-Q1-K6-H10
ttgttgtattgatggcgcccaagggggggggggggggggggggaaaaagtggcggcggaggagccctcctagaaggcggctccggcggagaaggccccctcggggaagaagcccaaggcggggaaccggctacctgcgggcaagtccgccgtcaacgatggctgcgacaagaaggggggggggagggcgaagaagagcgtggagacctacactatctacatcttcaaggtcctgaatcaggtgcaccccgacatcggcatctcctccaaggccatgtccatcatgaactccttcatcaacgacatcttctagaagctccccgcggaggccgccaagctcgccctgtacaacaagaagcccaccatcacctcccgcgagatccatacctccgtccgcctcgtcctccccggcgagctctccaagcaccccgtctcggagggtaccaacgccgtcaccaacttcacctcgtcttagcccccttgtagtaggcgtacctgttgtctgcttctcaagcaagcactgtgatgtg

SEQ ID NO: 11183 - DNA, 460 bp, Zea mays
  unsure (1)..(460): unsure at all n locations; Clone ID: LIB3279-185-Q1-K6-H11
gctcggagctgctgatccgcaagctcccgttgccagcgcctggtccgcgagatcgcgcaggacttcaagacggacctccgcttccagtcctccgccgtcgccgcgctgcaggaggccgccgaggcctacctggggggcctcttcgaggacaccaacctctgtgccatccacgccaagcgcgtggccatcatgcccaaggacatccagctcgcgcgccgcatccgcggcgagcgcgcctaggcggttcggttgcggcgcctgctcgctactgctggaggtgcttagtttagcccgtcatggttgtgttataggtgtgcgttgttttcaagagtaggcttcttgctatgtgctgatgttaacggaggattatgattagcagttcntgaaaaaatgcaatggatgtgatctgctctatctacatgttttaaaaaaaaaaaaanaaaaaaaaaaaaaanaaaaa

SEQ ID NO: 11184 - DNA, 600 bp, Zea mays
  unsure (1)..(600): unsure at all n locations; Clone ID: LIB3279-185-Q1-K6-H12
ccccgcgtccngataccacgtcttgtcgtatgtctctcgtggaaaaaagaccaggctttcagcatcacaagaaggctggtgcaatgaatgcactgattcgtgtatctgctgtgctgacaaatggtgcctatcttctcaatgtggattgtgaccattacttcaatagcagcaaagctcttagagagagcaatgtgcttcatgatggatccagctctaggaaggaaaacttgttatgtacaatttccacaaagatttgatggcattgacttgcacgatcgatatgctaataggaacatagtcttctttgatatcaacatgaaaggtctagatggcattcagggtccagtctatgtgggaacaggatgctgtttcaataggcaggctttgtatggatatgatcctgttttgactgaagctgatctggaacctaacattgttgttaagagctgctgtggtagaaggaagagaaagaacaagagttatatggatagtcaaagccgtattatgaagagaacagaatcttcagctcccatctttaacatggaagacatcgaggagggtattgaaagttatgaggatgaaaggtcagtgcttatgtcc

SEQ ID NO: 11185 - DNA, 623 bp, Zea mays
  unsure (1)..(623): unsure at all n locations; Clone ID: LIB3279-185-Q1-K6-H2
tccgggnaaagtgtngactcttattcagcaacgnacttcaggcatactcgtacgcaaaatgaagaaattccaagtggatcagaacttgaaccgactgcttggacgaacctgatcccatcgtctgtccggacgcagtatcccaagctgatgatgtgaactggtgggggcacaaatttggatttttatcaggagggtttctaggagcaaaatcccgtaaaaataaatcttcacaaaaaaatcctgctaatgtccgccagacatttgcagaggaagatcaagaaatttgtacaatcttgttcaggataaagctacttctggaaagcagggtcttggcatcaaaggcctgccaatgaaagttgctggccaacgttggaagggaaacaaaacttcgtttgttgatagtgatgatgataattcagcccagcccgatgaatattcagaaatcgaagagaatggcgatgaggaagaacatatcagtgcttctgaatcaatagacacagataagaatgcagacaaanaattgcttgtggctgctagacccaaaaccaaggtcaagaaactttgcaaaagatacttcgtcaggccccatctcagtcaatgaaattgaagatcttaagtcgccg

SEQ ID NO: 11186 - DNA, 424 bp, Zea mays
  unsure (1)..(424): unsure at all n locations; Clone ID: LIB3279-185-Q1-K6-H3
cgtactggttctcgcatcttgctngaagttcagacgtgaaagctctaccaaacggtctttcgctgctccttaacaagatgaatcctttgaagagggagcaggtcattgatggcctcaggcagcttcttggttgatcgatggtggcaaagtggagcatgaagccctgtttagttgggaacggattgttctggttgtagtcatgtatttagctgtttaacatgtatttaattgggtggcgttactccacgtcatacggtacaacagcaatcctgatcaagtgattatttattcttcaatcgaagtagtacatgattttcatcagtaagctttgtgcttgcaattagggataaaatcggatggaaatgaactgaaaaacactcattttcgtttctatatttttttttataaaaatggattctaattc

SEQ ID NO: 11187 - DNA, 620 bp, Zea mays
  Clone ID: LIB3279-185-Q1-K6-H4
ccccgcgtccgctctctgcgccgccgccgccgttgcagtcgcggccacatcgtcgcctatccatccccaccgctcccactgccacgattcacaagaggtgtcgagatgtctcagaacaacccctcccagctcctcccctcagagctgatcgatcggtgcatcgggtccaagatctgggtgatcatgaagggggacaaggagctcgttggcaccctctgcggctttgatgtctacgtcaatatggtgctggaggacgtcaccgagtatgaatacactgctgaagggcgccgcattacaaaacttgaccagatcctcctaaacggcaacaacatagccattttggttcctggtggttcaccacccgatgtgtaatgagcttttgctccccagagtaaccattcgaggcgaaggcatctccatggactttgcacgttattttgggtaatcattggatgtttcgtcatctcggatgtgttcatcctgttcgtgattataccaagtttattgttaactctctttcagcatggaagctgccttctgtatcgaacttactgacctgaagtagtgtgcttgcatagctgtggttatatgattggctaaaaaaaaaaaaaaaagggcgg

SEQ ID NO: 11188 - DNA, 595 bp, Zea mays
  Clone ID: LIB3279-185-Q1-K6-H5
gcataaatcacgatggtgtgatggggcacttgttttgttcacagtatatcaaaatataaagtacaacgatattttgccaatattgtcgcaatcatacacgattttttgacatgacaaaaaacgaggagccaaccctgtcttcggtacttcatacatttggaaccattagcctttagctaggtcgtggcccgaaatggaagcatcgctgctcggctcttgtcaaaacaggtatgtgtaagcctgtataaagcataaagacacgtcagaacaagcataagtaaatcaaacagaaacctaaaatgattcaccagttaaaagacatggattgagagggatgatataatataagagtagagttatgcattcacttagatcatgctgctctacaacaacctgtcacgttatttattcattttcagattcttgtatctcccatcatttattcttattccttcgttacttatggtgagagtgtttatcaaccaaaggttggagcttagactgcaataaaaattgtttatgtgcaaacctcttgcagaaaccagagcatttattatacatttatttagtcatctatattcaaatggatgatgca

SEQ ID NO: 11189 - DNA, 662 bp, Zea mays
  unsure (1)..(662): unsure at all n locations; Clone ID: LIB3279-185-Q1-K6-H6
gctctttcccttctcgcttcaaaccaaaccaaaatcggagcggcggagcaaaacgatccgtagcctcgcttaccttcgattcagctcgaccagggcactaaccgggaagccaatgccgcgcgagtcgcgagatctgtagcgccaatcggcttcaccggcggcggggtgggcatggaagcgcagaacggctcctgcggaggggcgcccgtggtgctcaacgtgtacgacctgacgcccatgaacaactacctctactggttcggcctcggtattttccactctggaatcgaagttcatggtatggagtacggatttggagcacaccagtttccggcaagtggagtattcgaggtggaaccgaaaagctgtcctggtttcatctacagaagatctgtgtggatgggcacaactgacttgtcagagcagagttccgctcgttcattgaaaatcttgctggaaagtacaacggcaacacgtatcatttgatttcgaagaactgcaaccattttacagatgatgtctgtaagagcttgaccaagaaatcaatccctgngtgggtgaataggctagcaagagtgggttcattttttaattgtcttctaccagaaagcatccaagtttccacaatgatgatatggattcggtatcttcatcggttcttg

SEQ ID NO: 11190 - DNA, 585 bp, Zea mays
  Clone ID: LIB3279-185-Q1-K6-H7
gtgactgacacgcagccacaaccgccgctgcgccaggggcttcagcaaagggaagaaagatggcccctgggactatctatgggtcaagccatacatatatgctgggaacacaagatccatcatcccttcctaaaggggggatctgcttaataatcaaaacccacacaaggcagacggcaccatacaacccaaacaactggatgccatgcatgatgttcctggcatccaattttgaggaatctcgcacagaagataagctgctgaaccaaaatgaggacttcactgacatggatgacacatactgctcacaaaaggaacaggaagcaagagaaggaaggcaagactaagaacacagacttcaagttctaaggacataccagcgatgagctcgtcatcatgcaccggagtagctgtaccaaatatgactggcttgatggtttaaatactgccatctgacacatgcggtccgtgttcctaagatccaatccgagcaggtaggcgctcattcgcattggttgagaacctgctatgctcaggcatcccagatccgtcagatccgccgtaagatggttgagattatgatca

SEQ ID NO: 11191 - DNA, 649 bp, Zea mays
  Clone ID: LIB3279-185-Q1-K6-H8
taaaaaacagcgacctctaacgcttagctagcggtgttgggtcagcgcctgagcatcgagctattggcatggcgcactccaccaccttggccctggtgattgtcgttgtgctggcgctcacctttggtgccacggtcagtgtctccgctcccgtgaacaagtcgtgcgtcagcggtagcgcgggggccagcgtgagcattggctacggcggggcaagagccagcgccggcgctggcgtgtcccttggcgccgacgcgtaccggagcacgtgcccccgtgccgaggagatcatccgtgcggccgttgagagggccgtcgctgccgacccacgcatggcagcgtctctcctgcgcctccatttccatgactgcttcgtcaacggctgtgacggctccgttcttctggacgacaagccgttcttcatcggcgagaagacggctgtgcccaacgccaactcaatcaggggcttcgaggtcattgacgccatcaagaccgagctggagcgggagtgcccagatacagtttcctgtgccgacctccttgccatcgctgcccgtgactccgtcgttgtgtctggcgggccgagctgggagattgaggtcggccggaaggacagccgcaccgccagcctgcagggcgcccacaccaa

SEQ ID NO: 11192 - DNA, 644 bp, Zea mays
  unsure (1)..(644): unsure at all n locations; Clone ID: LIB3279-185-Q1-K6-H9
cccacgcgtccgcgccgacgagctcttccacaacggccagatccgcctcgccgccgcgctgctgctgcagccggacggggacgcggacacggaccccgccgcgggcgcgcagcacgagaaccagcagcgggcggaggcggcggacgagcgcgggcgcgtgcggagccgctccgtgcggcgcaaggcgcgctccatgtccccgttccgcacgcactggcggtccgcgtcccaagtcccggtgccgaagcctgagtcggccggcgagtcgcagcaacagcagccggcggcggcgtcgcggtcgtcgtcgtcgtcgtccaccgcatcctcgtccgcgtcgtcgtccaggggctcccgccgctggagcgggttcctcaaggacctgctccaccgcagcaagtcggacggcggtaagagcagccagcagcagccgcactcccaccaccaccgcgctggcgctcccccagccgcggcggcgccgtctccgtctccgtccccgtctccgtctgtaaaggttgggaggggcaggaggaggtccgcgcacgagcggctgtacgaggcgcggcgcgccgaggccgaggagatgcggcgccggacgtcgctgccgtaccgncagggccagctnctcttcggctgcatcgggctcg

SEQ ID NO: 11193 - DNA, 563 bp, Zea mays
  Clone ID: LIB3279-185-Q1-N6-A1
acgtatatattgtttttcttctttcttctaaatctaagaacgtacagatatgatccagacatacagacacggacatactttttttccccttctaaatctaaaaacgtacagatatgatcgagacacacagacacgtacgctgggggcagtacaacacgtaacaatagcacgtgctgcggcaccgggatatggccggtgggcacgcacgacacacacacacacaggtaccagtcgttcttatcctccagtttattggcgctgatcggctgtgctcgcacagtgcatgctgcaggatgcagcccggtagaagcagggaggtgcgcgagcacttactctcgtcagaccgcgatcgcgactgcgacgtccttgccgttgaccgtgccgttcgccgcgccgtggccgccgccgttggccaccgccggcttaccgccggtgtggtcggtggcggcggagtcctgggaggagatgaagcggccggaggggtcgttggaggccttccactgctccacccactcgatgggcgcgggcgtgctgcaggcgatgctcgggccccacgggaccgt

SEQ ID NO: 11194 - DNA, 526 bp, Zea mays
  Clone ID: LIB3279-185-Q1-N6-A2
agagcgtgcttttggaattgaatcaaaaagattgtttgggagaaagaaattgaagtagattgaggcctggtttagtgcctccccttctaaaccaagctatccaaaaacctatccagcaacgatgcaggcagcactacaaggattactcaacattgcaacctgccaagcgggggggagaactactgaacaactcgagggcatacttcaagggtctgggatgcaacaggcctaaaaacgagtagggcagagtaaatttcaacaattatttccagaagttgcaggtctatgcgcaaaaaggaaaaccatggggagatataaggccgaccatccgcagatcgcgattcacaacctccctttttagtccacaacctcctccgactttttaggctttgacaatagataccaacccaagccacccaggggagcaactgcgcctgccaaaacagcatagttcctgttcttgtccgtcgacacacttgcagatgctgactccgttgggccagcatcgggcttcacattacttgct

SEQ ID NO: 11195 - DNA, 599 bp, Zea mays
  Clone ID: LIB3279-185-Q1-N6-A3
gatccggaaacaactttttcatatgtgcttaagtgatcagaaatgggagtggggaaaacacaagtcacgaacggtagaccattacaggccagttcgaacacccacatgctaatagcatttaggcataacagatttaaggaccatgacatgtggctatccagacaaaaacaaccggtatgagaaaaaaaacatgacaccaagagtccaagtgtatacgaaaggcatggtattcaaaggaaggcgtccttctcgagcaacttcagaacctcgtcctggttattcagcttggcgacatcgataggtgtcttcccgtccaggttttggagagttacagcagcaccgtgcttcaaaagaagatccacacactccttgcggccgtagccagcagcgtaatgcaacggggtgttcttgttcttgtcaagagcgtgcactgcagcaccagcttcaagaaggatctgggcacacttcaactcaccgtacccacatgcaaaatgtaaggcccttcttccctcagagtcttcttcatccttgtcggctccaccatctagtgctttcttgagaccctcttcatcaccaacactggcagtgtgatgaacgat

SEQ ID NO: 11196 - DNA, 605 bp, Zea mays
  Clone ID: LIB3279-185-Q1-N6-A5
gctcttcggagtatcatttcagtaaaaattacgtcctggcgcacaaaaacagaagtacagacgcagcaaagaagattacaattattctctagcgggctcacatgaccctcacagcggaatcggaatgcacatgaaaattacaaaatatagagctcagtaggagtgattaggcttggcagttcctgtgacatgtccttgggaaaactggtgatgataaacattgcttaaagatcctcagggccattgacatccttgttctcaagtacgtctccatctggaatctccaacttcactccaggcttggcgataattgtcaccttgcccttgagtgtaattccagagccaaaccagacatcaccagaaaccttcaagctgtcaagctcaactatgctggggatggacttgaaccgaccaaggaaattggcaaccttcttgaactcaggtccaagctcaattgaaggggtagctggattcgctctggatgggttgcggatgacaaagccatcaaccaaggtgtaaagatcagactgcacaagcaacagatcagatgtagccttcactgggagaaaccttgagcggggacattaattccaatcgctttgtcg

SEQ ID NO: 11197 - DNA, 593 bp, Zea mays
  Clone ID: LIB3279-185-Q1-N6-A6
gcaataagagaacattatggagtaattgggtttgctacaaagctgttatgccagaacagaattcttaggcatcatcacacgaacccacaatgcccagggtaacattacatgtcatgatcaaaccaaacaccctcttatttgtctccatgcaccctcctgcttacactacaaccactaacagttaatctacaacgtttctcgtgacttgaaaagctcgataggttggcctctatcatgtgatcaattttcttaacgctgcacggtggggtgtagggaagccccatcaagtcaccatgataggatgacaccttaccctcctgactatcggcattaccactatcctccttaacaccagcatctccggcaaagcttatcagatcacccagttgctcagtaggaggaacgggagctttgttgttaagaccaatgttaggagcattgatggtcttgtgtaactcaggtcgacgagaaggctttcggtgaacttcttgctgtaacctaacactagataacatcacgtgtagataaccggaaccaagtcttactagtttcagcaggagggtgtagggcacgaagctagcaactgcgctttt

SEQ ID NO: 11198 - DNA, 620 bp, Zea mays
  Clone ID: LIB3279-185-Q1-N6-A8
ggggtgtttgtgtgcataaattatttatctttcatagataatcattgggatagacacacataaaaggagtaacaaatgtaatcctttaagcaccacaaaggacctgagagtagaacttacatgagtagcttaacttttatcatgatggggaggggggcaccaaagtatgtaataccaaatgacgaattaagtcaaaactgtcatctcgatctcaggagcttaccaatgctcagttgcaatttccaggggggaaagaactaaaaaagttagccaaaaaaatgcacaaccagaatgatacagaagtgctaaactagctccatctcctcttatcctcttcttcatcgacagggctgtaccactctggtcgtctttttgagttactgtaacggtaattaagaaagagctcttcatcacatatggaccttgtgctcaccagcactagcgtcttcagtactagagaatcaccagcctgattatcagaacctccagacttgaaatagaaggagccaaacctcttcatcctaatggtctcttgaccaccaaacgtaatgttagggatgtatactctcatgtccttctctgtcaaaggaaaatctatgggcagatcatgacattaggac

SEQ ID NO: 11199 - DNA, 588 bp, Zea mays
  Clone ID: LIB3279-185-Q1-N6-A9
ggggtgtggggggtttttttttttttttttttttttttttttttttttttttttttttttttttttttaatggccgggaagactttgttaatcatgaattctctaataacatctcttgggatactttgaatgggcttcataaccatatttcgcgggggggggccaatttttgcatttcctcttatagccgggtcataattgacaagaggaaaacatccaattttaccatcaaaaatgcactgcccatctttaaacctcggtctagcacaaacagggagaaacatgagcctagggaagtagtttttgttcttgcaagtcctatggggatcatcttcttcggggagcaaataatatttttcaaacttttgggatagggagaaccatttttcatcaatgacaacgaagtcaaaaaaaatccctaaagcttggatcaccattcaaccccctcttaatcatgtcaatacaaaacttcaacctagtttttttgtttccttcaaggagaaagggcttgatgctactaaaatgacgcctaaacaaaccttgtttcaaataccttagcaccttccatttactcatggttagcttggc

SEQ ID NO: 11200 - DNA, 464 bp, Zea mays
  Clone ID: LIB3279-185-Q1-N6-B1
gagacgatggcagggcggtgtctgaaaactccacgcttacatgaactgcgctcaaatgaaacccaagcagtacgtacgcgcgtactcaaattacacacaacgacacacagagatatatagagagagagatggatgggcatgattatgcgccggtgagctcctcctccttgtgcgtctcgatgacgacgtcagaggtggggtaggcgtggcaggtgagcacccagccgtcggcgatctggccgtcgtcgaggtagctctggtcggactggtccacggagccggagacgaccttgccggcgcacgaggagcaggaccccgcgcggcaggagtagggcaggtcgatgccgtcctcctcggcctgggccaagatgtacacgtcgtcgggcacctgcagctccacctccccctccggcgtgatcagcttcactttgtaggtgggctgcgcgcgcaacctgcgcctgctg

SEQ ID NO: 11201 - DNA, 489 bp, Zea mays
  Clone ID: LIB3279-185-Q1-N6-B2
atacagaatagttattaagatacataaatatgcctcccaaaaaggcgaaggaatagcacagagcaacaatgtcaactagatacaaaatgcacagctctagaagggtactcttctacagaggactggacagagtcatggagagtctgtacatagtgagagtggtactgtgaagcgttcatttgcaggtttatgacagatcaaccagatggtctctggtagatatgctttgttcttgggtcaacgattatgccctttccaccattcacttcaaggtcatgctggaagacaaaatcaggaatggtgagctgttcacgtggtacatatctgaatagctgcacaagtctgtcgacatatacaactttcttccagacctccccgtcaacaaaaagttgcatcgccataacggctgttctcagtcccagtgtcgggtggagtatgtatatagtatgaagattttttttatgcttccgacctagtatctgttgtaac

SEQ ID NO: 11202 - DNA, 647 bp, Zea mays
  Clone ID: LIB3279-185-Q1-N6-B3
ggccgggaggtggaccatctcgaagcggctgaggtcgtggtccaggcggcgctccacctcgacgtgcccctcgacgtcgctctcgccggagcccgagtcgtcgccggccgcgtcccgggcgtcggcgcgcaggcggatgaggcccttcatggacccgtacccgtccacgccccacgcctccttggccatctccaccagcacctcccgcgccggcgacagcacgggcgtcgggagcaccgccggcgtcacggggcacggggacaccagcgacgccacgccgcccgcccgcttcgcgcggatcaggaacgacgtcgtgttgcgcggggccgccgcaccgccccacctcgcgccgcccgacgccggaggctgggccttgcgcttccagggcgtccgcgccgcccgcttccacgccgcccgcaccggcttgaaaggaggctccatcgccggcaccgccgcccacatctggtggaacggcagcggcgccggtggtcgcatcagctgctcattcatggtctgactcggaacttgggagaactaatcctccagatccgaaaccctaaccacagatcacaaaatcccacccaaaaaaaaaaccacgattagcaccgagacctggccacaggatcgggacgttttcgttttaatcc

SEQ ID NO: 11203 - DNA, 85 bp, Zea mays
  Clone ID: LIB3279-185-Q1-N6-B4
catgtgaactcggactttcagttttagcaaagtgaacaaaagcaatagggggtcatatgtcatctcataatcttagagatctcgt

SEQ ID NO: 11204 - DNA, 610 bp, Zea mays
  Clone ID: LIB3279-185-Q1-N6-B5
gcatgtaatctctttgaattcaaagtagatcatggcaatctctttaaaaactagaatgaggtgataatcacatatttgcattgcaaggtatatataccccttgtaagttggcaagctcaaggacagctgttatgccatcagatgatatgctctcggttaccagaaaacctttatgtaagaggttgtgcctttgtgaaaacaaatattcccccaccaccaactgaacgacccaggagcatatcacgatcaaggtaagacagataatataatcctccaggtgatcgtctttcaggaccactaacaggaacttgagtccgaaaggttttaaggaactgcaatatctgaaggctcaaaaatgaccgaggaagtatagcaggagctattagtgtctgcagttgctcgctaatcttgatattttcaacagcgacctcctcaaattgaagaaagatattccgtttagacaggacaacaaacttcgcagagaccatcagtgttgcaccttcttgctcctccagcaagttctcgatgctccaccttacaacattcctcacaattccaccatctgatcgatctttgcactcaaatttctggtatatttggcccacctgca

SEQ ID NO: 11205 - DNA, 609 bp, Zea mays
  Clone ID: LIB3279-185-Q1-N6-B6
gataccatccatgtgttattcagacctatcacgaacaattaagtacacgttctgccgcagcaaacgcagagtttcagacaccatttgcaaatctagaaacaagagttgcctaggagtaactctccgatcagtcagctaaaaggggtggaggctgcctacacatcatgccccataacatacacgatcaggggtgaggttctcgagttggtgcggcgataatcaacgagatgcctgtacaggcgacgcaaacaaacacattaagtacaggataattaacagcggctactacagctatggggttccacgaatcctcatgcctcgatctccttcgcctgaggctgctgctgtttcttctcggtgtctccggctccctctccttcgtcctcctctgataacttggttaactcgtcttggatcataactttgatggcttctttctttggggccagatccattttatagtgattgtcaagcttcttaaggatgtcactgaaagttgccgtgttgaagtcaactttcttgaggatttcagtaatggtcttcctcagatcatccttgctgggaagaactgcttcaacggattctcctttaccctttgtcacctttttg

SEQ ID NO: 11206 - DNA, 546 bp, Zea mays
  Clone ID: LIB3279-185-Q1-N6-B7
ggataatccgagcaagtaaccattatgcagtgtccacatcgcgagctagcaatgtattagtaccgtaatctagctgatctgataaagccaatcaactttgcaacaacacactacagacgttataaggaaaactttaaacataagcatgcgcggcgcaacttgagataacattgtccagagcatgccgttacgccattccactgctttggtaaaagatatggatatgaaggcactgccactagcttcgggaaggctgtgaaaggtaggcacgagcctcacttccagagcttgcgcagggacatgttcttctccgtgtctttcttcatcaccttggccactgccatctcgaagtcctcctgggtaacgtgcacccttctctcacgaagagcaaacattccagcctctgtgcagacggccttgagctcagctcctgaggccccattcatcttttccgcgatctttttcagatcaatgccacgcatcaagttcatttttcttgaatggatcttcaagaatcgaaacgtgaatcctcgttaggatttggga

SEQ ID NO: 11207 - DNA, 402 bp, Zea mays
  Clone ID: LIB3279-185-Q1-N6-B8
gggggggggggggggggggaatttttttttccccccccaaaaaaaaaagggggcccccccccccccatttggaaaaaaaaacccggggggggccccctttataaatttggggaaaccagaggttccccccgggggggttttcccccccgccttccccctttgggaaacaatttttttggggccccaaccccgggaaaaattttcccctaaaaaaaggggttcccccccccccccggggttttttttcccccctttttttggggggggggggaaaaaaaaccccccttttcccccccaagagggtttcccttgggaaaccccgtgttttcccccgggaacaagggccccccccccccctttggggggcaaaccggggggggcccctcccccatttttcccccc

SEQ ID NO: 11208 - DNA, 582 bp, Zea mays
  unsure (1)..(582): unsure at all n locations; Clone ID: LIB3279-185-Q1-N6-B9
gtgaatctgaaatgaactatgtgtcatattcaaacaggaaggtggtacatgttggacttgcaacaaacgtatgctaactgggaaacaaattaccaacactaacangaaaaaacactaccattctatcgagttcttgcaaggaaactaatgagcccccactgaatttgaatcaccagtgtccatcacaatattcacattgtggcaatccatccacaaagcttcttcatcggcaccatacagattcaatttatgcttaggatggcagtctctctaatttagaagtccttcagacaactcagtgcggggctccacacgttctttctactcatcgacatcccaacttaggtcctcatcatcatcttccacagaattaagacgtctccggagatcctccactttgctgacagagcttgaccgtttgctaaccccattcttctgatcttcatcgccaacatcctcaatctcctcccagctaagatcttcctcctgcactaatggttgaggcaccactgagaaataccccccttagatgagtcagcagcctcaatcttctcttcttgtctggtcccattgcttgccttt

SEQ ID NO: 11209 - DNA, 507 bp, Zea mays
  Clone ID: LIB3279-185-Q1-N6-C1
ggaaatgttcacccgatatgaaattgtctaacacgaaacgccaaattggtgcaaacaaagagcccattactttgcttaactaggaacaccgtatttggaggataataatgatcctactaacgcctcgagatttgcattgatttgagacatttgaagatgagacattggagggaactaaatcttgtgctttgcgtgcagttggagacttggtttccgccaacgctcaccttcagcttccaaattcttcagacaggtctcatcttgctgcactgccacctacacatccgatcaaccgaacatgagaaaattggaggaaaccaagtattgccttttctttctcaatcaaatttggttccatccatttctcaaattcaattgcccaagttttagctcggagttccctccttggccaagctaagtatcttactctaatccatgtaggagtactccgcttgattttgcagtggcggctactgatagcggcagttttctacaacccttggcttc

SEQ ID NO: 11210 - DNA, 589 bp, Zea mays
  Clone ID: LIB3279-185-Q1-N6-C2
agaccaagacaatataatttttattcactgcgtgctgtctgaaacacagtaaaactaatactgtactgcaacacggcaaaagcagcactaaacgtccttctataccatgtacattgcacccccaatagaacagactgggtgccaaccaactcactcagattcctgggctgattctggaaaatgagctctttcgatctgccgtgtgatctgtgaaacagcatactgcgagccagttgatgccgcgtagtaagacgtcactgtgagctgaacaaaccttggaagtgcatatgcaccaaatacagcactggcacctgagaatatcagcagtggtggcaccccaacgagcaactgcagccacttcggccccttgacatgcttctggacaaaagggatccctgtgttaaacccgtgcacagcactgagcaaagcgccggcaccggaaccagccacggcagtggcgtcgtgcaggacggaggtgatggcccaatccctctttcccgcggtggggttgaggagggagaggcatcgcgggcaccggggcgagccggagcctgggttgatggtgggatcgcggtggaggtgcgcaccg

SEQ ID NO: 11211 - DNA, 619 bp, Zea mays
  Clone ID: LIB3279-185-Q1-N6-C3
gggataaccaattcaggatatataagacagaaaaactctggttcacgagtaaatcccaaccagcatagcaatctacggctgaattaccaaatataaagacaagtagcagtctttccagtactttccaacataaaacaagcttaaaatctaaacatgactctggttttcctctggtttcactgcccaaaacaatactgtgatgactgtgcagcctagtcgaagaggctgaagcccatatcatcatcgctttcttccttctcttccaccttctcttctttctttgcctcagctgcagaagcagctccgccagcagcaggtgcagctgccgcaacagcgacaccgccgccaccacatgggactgaagcaaacttctccctgcccgcggcaatgagctcggtgatgtccttaccgctcagttgggacagcaggagttccatcttttcattgtcaacttcacagccaactgactccagaatggcagtcaaatcgtcagcggaggggctggcgttcccagcgaggacagcaagcaggtaggcagcaacaaacttcatcgtgctccgaggaaccggtcgactgctaatacctggaacaatcaagcaagcggaatgaacgtcagtga

SEQ ID NO: 11212 - DNA, 616 bp, Zea mays
  Clone ID: LIB3279-185-Q1-N6-C4
aaagcaaaatttgccttataaaatgtccttagctttagaaccgtgctgacccacagcaggccatatcatgggttgaaccacaggtacacagcaggccacattattattttttatttcgaagccgcacgacaacttcatccagacctagtcgtctagtcggagacgattagagctgttgcttgtcactgatgtgatcaaagctgacgatgaatgtgcggatctccattggccccagctcaacgacgagcttcgaaggatccacagggccaccccgaaccaccttctcgtccgccgcagaaccttgcgccttccatttcaaacgcttcttctccatggctgcgcgttcttggtttgccgataagcttgtctcgatgaccttgccaatcttcttctccgggaacactctcttgaggtcgatactcgctaaagacgaaagatccttgtcctccccggcctcatatagatgagcaaaccgaaggagaacacttccatcttcaagctcctgaagggtaagcattgcaacattatcaggcaagctgtaagttgaatccatcgcagagaattttgaaacatgtgaattcgcccaggtgcctccattctgctctgtgaaagcaag

SEQ ID NO: 11213 - DNA, 451 bp, Zea mays
  Clone ID: LIB3279-185-Q1-N6-C5
atccaacaatacaaattattcatacccaaaacaatagaggatctgtcccatgaaaccctgacagttttaaacacccaacgggggacaaaacaattagggaactttacttgccattagaagaaaggaaacaagcaacagattcctgccattgttcaaggggacccgatcgacactaacattaacactaatagcagccgtcgccggcattacggagcagcagcgacaattgtttaaacatgacaacattgccggggacaaaactgatatatagttgacacatttatcacgcgagacatgtttcagcaatataacaaccataaaaagcagcagcaaactaacagtacaccgcaggccggagggggggcggtactttgattgattggaaatcgggtcgggggatgggattgaaatcgaagggaataaccccaggcaggcaggcaggcaaaagaac

SEQ ID NO: 11214 - DNA, 633 bp, Zea mays
  unsure (1)..(633): unsure at all n locations; Clone ID: LIB3279-185-Q1-N6-C6
accaacaaaacagtgaacatccaggtaacttgaggtaacaaattcatagtgggatagaaaaactctggttcaccagtaaaccccaaccagcacagcaacctacgcctagaattaccacaggaaaagtctttcaagtactttccaacataaaacaaagttaaagtccaaacatgactaagatttttatcccctctgcttccgcgactcaaaaacaatattcttgactattgcacaagcttagtcgaagaggctgaagcccatgtcgtcatcactttcttccttctcctccaccttctcttctttcttcgcctcagctgcaggagcgccgccagcagcaggggcagctgccgcgacagccacaccgccaccgccacatgggactgaagcaaacttctccctgccggcggcaatgagctcggtaatgtccttaccgctcagttgggacagaaggagttccatcttttcattgtcaacttcacagccaactgactccagaatggctgtcaagtcctcggcagagggggctggagttcccagcgaggacagcaagcaggtaggcagcaacaaacttcatcctggtgggcgactgggcgctcttcgccggcaaaggcctcnagggaaaggggtagcgag

SEQ ID NO: 11215 - DNA, 506 bp, Zea mays
  Clone ID: LIB3279-185-Q1-N6-C7
gatacaggttcaacccgctaaccaaacacacgcttagtttcatgtttgggtgcagctaaagttaacaaagaaactgctttgtaactaataaaaagctattagctgccccctagctaatgcagccaactactactgtttacgtgggggcactgttcagaaaggggatttgtggaagacgaaacatcggcatgacatgagcacctgacaacatcttggctgcacattgtgatagctcgacgagcagaggaaattataacccggggttcataggaccataaccacaagtgaggaaactactgcggtgtgatgcgtccatatacatacgcagcaaacttcttcgtactaccagataaacaaatacacggtaacagaggagaggatcccttcgtttcgcctgtatcagtagaaccttttttttttgtttgccagcctacggaagaacgggcctcacctccttcctgtctacaccaaacgacttcaaaccgcagtcattaacattaacattt

SEQ ID NO: 11216 - DNA, 441 bp, Zea mays
  Clone ID: LIB3279-185-Q1-N6-C8
ataaaaaactatgtgctcgtggaaatgcacaaacaacacgaacatgcaagacttgtaacagcttgttgtgatgatgcacgataaaacagagtgatggagtctatttactgtcaacataagctgagctactcaaaactgaactacccttgcctgctaagtgagtgacgccgagcccctttgagaagtaatgaaactccgtgtagtcactgtccaagaccatggtcttgtaccatgccttgccagcagactaaaccttggcagtattcggggaaagattggtcctgttgtgagtagagcttctccttgctggccttaacactatcagtctcagcaagggtggccatgtatacggcagggccaacgtatgggttgagtatgagcacacaagccatgttcttgaaagagttcttgctctaatacgtgcggtatacctacttggtg

SEQ ID NO: 11217 - DNA, 466 bp, Zea mays
  Clone ID: LIB3279-185-Q1-N6-C9
atggcataatgaggattgtctcaacaagaaatcttttgtttgccatggcatctcaaatgggccacctagaacttacaacttcacgaataaacatcaggttaacctttaaacgggtacaacgacaggcaactgtttctgatgctaaacggggcgcagggctcttcaactgggaagacagtactcatctccgagaggcagctgaagatcacagcaaacgcagtttcccagtaactgaatcgatgtcagctttcctccctggtcctattgcaaaaactgttttggatccagccagcacctgtgtgcggcctgcatcagctacaataaatgtaggaatatcctctatgttctgcagtttcctttagcctgttcatttcctgttgattcttgcatgtcaaaacaatcttaacttgtccaagttgctcccattgtctaagtaaaccccgattgcttgacaacaattctgcgt

SEQ ID NO: 11218 - DNA, 580 bp, Zea mays
  Clone ID: LIB3279-185-Q1-N6-D1
acgaattgtgtcgtttggcaacacgaatcatcagtcttttaccaagatcgcttcgggacgaagcggtacacgaactaccacacaaaatagacttgtaaagccgtttttacactacttcgccacgccgtctaaaagcgagcaaacagcataaagttacaaattgcactcctccatccctccgccgccactggggccgggcgcgagatacgcctacgcgcgctcgccgcggatgcggcgggcgagctggatgtctttgggcatgatggtgacgcgcttggcgtggatggcgcaaaggttggtgtcctcgaacagaccgacgaggtaggcctcggcggcttcctggagggccaggacggcgtggctctggaaccgcagatccgtcttgaagtcctgagcgatctcacggaccaggcgctggaagggcaacttccggatgagcagctccgtgctcttctggtacttgcggatctcgcgcagcgccacggtgccgggcctgtacctgtggggctttttcacgccgccggtcgtgggcgccgactacctcgccgccttggtggcgagctgtttgcgcggggccttg

SEQ ID NO: 11219 - DNA, 536 bp, Zea mays
  unsure (1)..(536): unsure at all n locations; Clone ID: LIB3279-185-Q1-N6-D2
gtggttttttttttttttttttttttttttttttttttttttttttttttttttttttttggggcaaacctccttgccctggttttttatagttttacttattactggtttacaaaagtctgtcagcatgacaaaaatgttattccaactgggccggagggggggttgtttgggtacccanaccaaccatgaaacagtccccggaaccgggaaatgcagttcctcataagatgcagcaaatcggtttcaaaccccaaacattaggcttaacttggtggcgagggggaccggttttatgggaactcccagcgcgacacccaaaataccgtgcgagataaaaaaagtggcccttaactggggctttttcaaaggaaaatggggcgacagcgggcggtttgctccaccagatgacagggggcaactttttttcaggagtccatttccaggggtgaacatttttgggcgcagagctgcttcaggggaaaatatgtaacccccccaccctttcccccacgctttcccggacccctgggtcg

SEQ ID NO: 11220 - DNA, 554 bp, Zea mays
  Clone ID: LIB3279-185-Q1-N6-D3
cacgcatggcatggacatcttgttatgcatttcatgggaatcaatcacaagagttgaatcagaatccccagaaaaaacacatccacacatacacctgacaaacatcttgaaaaaaaaattgcagaaggtttcgtggggcagcaagacaagacagaggaggaagtggctaggccacaagctgtacatcgtgttaagtttcagaatgcaccaggtgcgtccctcatgctgatattcaagctgtttctcattgtccgtcgaccgactcccatattgcccttggtcatcatggcaacaaactctccatagtcaatgcggccatcgttatcttgatcagcttcgttgatgacatcatcaagaaaagcatccggcatgttatgctctttgcaagcttgctgtagttcgtccactgtgatatacccactaccatctttgtcgaaatatgaaaaggctgccacgagatgttcttcgcgctccagcttattgagatgcaaagttgcagcaatgaattcaatgtagtcaattgttccattgttgtcgatatcagctgcatccat

SEQ ID NO: 11221 - DNA, 498 bp, Zea mays
  Clone ID: LIB3279-185-Q1-N6-D4
caacatcaagaccagctgttattctgtttcaatgcaccaaacgtttcaaccggtgccaccacaaaggtacagtttactgtctacactgtcgtgaaagcagaactttcatggaatcacactagaaagcaccgtgcgtacagtttgttttttttaaagtcgctgagaacccatccacaatcatctgaggctgctctggagttaatcggtggagggaataagaaacttgaggaaaggttcagccttgggagcgatggatctcacgtcctcaaatttggccatttcaaaatcctcgtactggaagccaggggcacaggtgcagccaacaagggagtaatgcagttcagggtcccttttccgagacttgacaagaacgctgccattagatgcgaacgactcgacgtctagtgtggggaacgacccaaaccacacgttcggtggcacggtttactgggggcgctgacctgccttaaggtgtgggccaatgacagtatggtcaat

SEQ ID NO: 11222 - DNA, 521 bp, Zea mays
  Clone ID: LIB3279-185-Q1-N6-D5
gatcatgcgtgcaggcactgccgacctgatcacggatgaaatgtgctgctgccacaccagacgtgagatgctgagtcgttatccagcgtactgcacagacacatgccacaagcagagaagagcgacgacattttccacggcagcaggtattatttgcaaaggttttcgactgttttcccggctgttgcaaattgttgacagcaatacttttgttttggtaccgtatccagaactacaactaccacagtaaccaattcatgtgaaagacgtggacgcgagcaagcgaccacccccaacacggtaggaatattgggacaacaaaggcatttcacacctgcgacacaccacacaaaatcatccctcacgatccgctacgagccctagggctgggacagggaggggctctcacaatatcacttcatttactgtgcaccccaggaacctgatggagctccccatgactgctggggctgcgaattcatccctgtttcctccggtggtggtctgggtttagcgtattc

SEQ ID NO: 11223 - DNA, 459 bp, Zea mays
  Clone ID: LIB3279-185-Q1-N6-D6
gggcccaaaaaacaataaattacaattattcattttctcaagtacaactattttattagtactaggagctggatcgatctttggtccgatccagtccgtaatccaccagagaaaagggaaacgtttaggcgggtgctagattagcagcctcagcatagcgcgcgcaaaagccttctccttccttcaatatacccggagagaggcctcgtcttcatcttcgtcttcatcctcctcttcagcggcggcgcgcaaaaaaaaaacaagggaaaaaaaccaaatcgacagtaccgtaattaattatccaatagctagccgcgcgcgcgctagctgttcatcctcaaaactggccgccctcgaaggtctggctgaactgccagccaacggggacggcgccgttgctggtgacggggcggccgtcgctggcggtgacctggaacgagagcgcctgcctgtccaggt

SEQ ID NO: 11224 - DNA, 250 bp, Zea mays
  Clone ID: LIB3279-185-Q1-N6-D7
caagaaagtttcttggtaaacatatgaacaaatccaccatttttttcctcaacaacaaccaaccagcatcggtcttttcctctgtttacacaggaaccttttgaccgaaagttcctttttcgaatcaagaggtgaagaaagaaagaaagaaaaggggggaacaaaaatgaacgcatacgcgcgctccggtgatcggcgagtcgagccaaatgcgacccggagctcggggggggggggggggggggatttt

SEQ ID NO: 11225 - DNA, 608 bp, Zea mays
  unsure (1)..(608): unsure at all n locations; Clone ID: LIB3279-185-Q1-N6-D8
agctggtagatttagttcgtttattccggtagtgcaacaacttattcatgacatctctcatcttatctcatctcttatttcgaacttctctcttagtacaatctacaatataaaagagtgttttacaccatcatatgcctgcatctcctgtttgtacgtaggaagccatggcacgagataaacatgagacgaaacgagacgcgtcctgttgcttccctttccgtccgagcaatgtttgcgctcctttcaattcaccgactgctgtcatcctttttggttcattctccgcgatttatccttggcaaccttgccgattataggatcgacaatcgaatccacatctttctttatctcgtcgaccttctcgatcagggcctcagccttgtcggcgtcttcctcgaccacgtgcatgaccttcttgatcctggaggctgcttccttgatgctctcgttgccggggaactcgtcggcgacctcgccggcgaccttctccgtcgcctccgccaccttgtcgatcacctcgatcgccacctccgccgncttctctatcttggcttctaaagctctgaacctcctgtacatgggcactgcaaatatgacggcgccag

SEQ ID NO: 11226 - DNA, 608 bp, Zea mays
  unsure (1)..(608): unsure at all n locations; Clone ID: LIB3279-185-Q1-N6-D9
atattgacgccatgcattccattagagacaagaatctggctgctagatgaattgtaataatcaatgtctggggttggtacaatggcatataattgagctcccaatggtacatacacgatgatacatataaactcaggcacctgtacctactacaaggcactaccacagctgaaacagtgcacaacaatggcagaaaggaaatgacaactcacgctacacattctcctaagggcaataatttttacaacttggctggaatgccttattgtgcttctgacaactgatacgaatttcagttaactatggccgatttgatctagtacagttccaccttcagctatggttcagacacgctgcaaggggcgaaaccaagacttgttttcttcggtatgtcacagcaggcaagcccaaaggcataagctagaccgtaggcaactccacatggttgcccagcttttttgttaccatatcataaacactatctactttggtaggatcaaccttaaacaagacgtgtgcgtcttccttctttaggacactacccttggatatctnctgcatcagcacctcctgcattctcaggtaatgactgggtagcagtctgttct

SEQ ID NO: 11227 - DNA, 470 bp, Zea mays
  Clone ID: LIB3279-185-Q1-N6-E1
gttttttttttttttttttttttttttttttttttttttttttttttttttttttttttttttgccacaaaccagcacggggacatttttatttctccttttattgggggtttacacatgacactcgatcaaaggacctggggcttttacaggagtcctaacagcataatgggcagggctcacatatatttaaaccttcgtcattggatgttctgaatgcccctgcaaaatgtccagacaaaagagcaaagcgggcccacactaatttcatggccgggcatggggggtcgccatgcctaccaattatcctttttttggggccatgcgtaggtctatttccaaaggagtggaactttggaaaggggggtgagcgtcctttgacgtttcacttttgcgaggggggcatggagagggaaacaccgtttaccggggactccttacaatggtgggtgatcgagttgaactggggg

SEQ ID NO: 11228 - DNA, 615 bp, Zea mays
  unsure (1)..(615): unsure at all n locations; Clone ID: LIB3279-185-Q1-N6-E2
aatcagtagtaaacactaaacagttacgtgctgcacagatccccagctcaaaattaccacaaaaaatgtttccaatcctttttttatgaaggttctgtagagagagactagagagccaggtccaggacccagcgaaagcaacttctgtgcaccgtccaggacctgatccgtttacgggctgcggctcaggagtctgcggacggcttgatggcgtcggcgccggcgccgtggctggaagccttcttcatctgcagggcggtcttgtaaggcggggcgatgggaggctgcacggggtccaggctccggtacgagccaccgtccgtgctgctgggcagcgggtacgagcggtcggagtcatagccgctgagatccccgcaggccaggaacgggatgtacaccttgtttggtccctccagccatccgcttctgcaatctagatcgccagctcctgagggagtacccactttctctagcaggtggtataggtcttcctccttgaacccttcaggaggtgagtagttctcacanaccgcaaacagctcgatgcttgagttccggctactttttggcttggcaaacgtaacttgcgaagaanaacagtttagctggcagtac

SEQ ID NO: 11229 - DNA, 594 bp, Zea mays
  Clone ID: LIB3279-185-Q1-N6-E3
gcaatgtgttgatctttattggtccctagtatataacatgcaaacctggcacagatagcaagatgtttgaattacaggagaactggtgctgataaatgagcaggataataaggatgcagaacaacagtatagaagtgaatagcaaggatgaattattattagggaacaatcttgaagaccttcagcttctcgatccatgtgttgaaagagctgacagtgttcctgaagccgaggaagccatgctccttgcttttgttcatgctgtccagaagctgggtctccacagcaaacatggcatcgacgaaccaccaattcgtgatctcgtcaagctccgtggctataaggtcgttctccctgacaatctccgcccagacagcttccttcccggccatgacctcttcgagcttgaacctgttctcctcaccttcgtagccagcccattccaggccgaaatggtcggcgagtatcggccacagctgcttccacttgaagagatccccgttgctgcaattgaaggcctcgttcttggcgaacggatccacggcggcccagatctcgtgctcggcgataaggtcggcgtcggaggcgtcgctg

SEQ ID NO: 11230 - DNA, 391 bp, Zea mays
  Clone ID: LIB3279-185-Q1-N6-E4
cagggcataaaccaaagtttcacttgcgagttgcgaaggatttttcaggagagcatgaaacttgacaaccgctacggtcctaaaaagtccccgggggggccctgactcatttttcagctaaaactacatagttggctacaaaacaaacaacatgtcctaaacatcgtcctacatagatggcaacagaacaatcgcccaaaccctatcacctaagatggccccaatatctggaatcactgactcatttttaagctaaaacttaacaggactgttgcccaaaaatgggtggtcgtcaagctcatcatcagtaggaaaattttcaaccagctgggttttggcacccttgccttgcacatccttatccagcttttgacaatcatttcccggcacc

SEQ ID NO: 11231 - DNA, 621 bp, Zea mays
  unsure (1)..(621): unsure at all n locations; Clone ID: LIB3279-185-Q1-N6-E5
cttaagagctattgtattacgagctgaacttacagtccaacacagtagttcagtacagaacatagataatccagatttaaaacatcggtgccggaaacgtctcgagaggcaaggctgccntgaaaaggtacataaaagagctacggctataatacttcgacaaaatggcctcgatcagcatgctgatatacttcactgcttccttgctgcgacaatgttgtcagcctctttcttcacaggctcttccttctctgacaagatcagctcaatgtggcaaggtgaggacatgtagggattgatgcgcccgtgagcacggtaggtgcggcgcctctgcttctgggcttgattcacctggatgtgtgaaacatagaggttgtccacatccaagcctttcacatcagcgttactctcagcattcttcagcaaatccaggatgaacctggctgatttaacgggccagcggccctgcccattggagtggcgcgctttagcttgcgcggtgcgaccaacacccccacagtatctccgggaaggaattgcctgcttgtgagcaataacatcctcaaggtatcgcttagccttggtcaaagacaacttgcgaagcgcaaagctgtctccctt

SEQ ID NO: 11232 - DNA, 565 bp, Zea mays
  unsure (1)..(565): unsure at all n locations; Clone ID: LIB3279-185-Q1-N6-E6
ttaaaaaatgattttgcctgtaatcagttcactcatccatacaagcagtattaaagtaatcctgcaatcattgcatagtacaggggaacaacactacaacaggctgttttttgccttatttgtacaagggggtggaggggaatttttttttttttacacggnccganagacgaagaacacaaggcggggaaaaancacccccccccaacggggggcgcagcngccaccgagacaccnaggcncncaaggggangggacggcacagaaaaccaaccnnnaggcncgccagggacccaccacnanacaagcgggagaaggggnncgnnacaccncgaaccagcaggccnncaaaggcgaggcccgggccaaaagccaagaacaanccccacgcngcacgaagggcccncggcnnaaacgcgnccctcaaggacgccagcacagagaagaaagnagggcggcncacagnnccatagcacaaaaaggcggggctgctaatctcgagcttctctggctgaagtttaaggcagaactcaagcctgttcaatattgctggtccaccaggatg

SEQ ID NO: 11233 - DNA, 625 bp, Zea mays
  Clone ID: LIB3279-185-Q1-N6-E7
gttgaatccaatatttaatctttttattggctaagtgtgaatctgttacacctgtataacttgtacactagagcaaactagttagtccaattatttatgttgggcaattcaaccaccaaaattatttaggaactaggtgtgagcctaattcccttttagcggcgctgcagcaacaagtgcggatggcggtgacggaggtcgtgcgatgatttccagctcctccaacagcaggtgctcacgagcctctgcaaacgtggggaacgaccggtgcatcttgaggatggacaccatgtggtggaacttgccgtcgaggccgcgaaggagcgtgagcaccatatgcctaccaccgatgggatcgccgaactcggcaagggaagccgccatcgactcaagctggtggcagtagtcggtgatgctcaaggactcttggcggaagttgcggattttttgtctcaagtagaagcgcccgggattccctttggccaaggaactcatcctcgaggtagcaccacgccccgcgagcaaggccctgccgcatcattagagattattgcaggtcactggagatggtgttgtagatcctgtcaagaacaacaatcgacttgaacccatgccgggcgtgagg

SEQ ID NO: 11234 - DNA, 503 bp, Zea mays
  Clone ID: LIB3279-185-Q1-N6-E8
gtgttttttttttttttttttttttttttttttttttttttttttttttttttttttttttttttttcgccctcgggggcccaaagcagctatgggcttataataacacatataccagtcattaagcatgtaggttttgggtttttttttacgacgggggccggttttttttttggggcttgctgggggtgcaatccggctgggggtggggcttttacagtatttttctttttatggattgcagctgcagcagtccaaacagttgcaacagtgtcggtttgcaacctgccgaacacccccgacgatactttgatttcgccctggggggcccaaagcagtttttggctaataataacacacactaaaggtttggttttttaaaaaacttgggcaggggcatttcaatgggtatacatatagggctgttcccagcattatattgtaccttttgtttttgttgaaaaccccctgtccaaactgaggacccattgatggcccatggg

SEQ ID NO: 11235 - DNA, 570 bp, Zea mays
  Clone ID: LIB3279-185-Q1-N6-E9
gggtgtgtttttttttaatcgtggaccagagatttattggcactgacaaaaacaagacccactaattcagaaagaggaacttacagaagctgtcctgctgctgcacaatacaaaacctcggtggcatatagaactaagagtacaagaacggtggggggggggaaatgctttttttttgcttgcttgaagcggaccccctatatccgcttcagaaccttctcagcggcctcgacggtcttctcgatgtcctgggaggtgtgcgccaagctggtgaaccccgcctcgaactgcgatggagcgaagtacacgccctcctccagcatgccacggtagaacctcccgaacttctcggtgtcgctcttcttggcgtccccgaagttgtggacgggcccgccggtgaagaagaagccaaacattcctctgatatgtcctccgcacatatcatgccctgctttcgcaccgacgtccagtatcccacggacgagttcgccggtgatcttgtccaagtactcgtaggtgccgtgctctgtcagccgcttgagcgtgtggatcccagcggtcatggctaga

SEQ ID NO: 11236 - DNA, 549 bp, Zea mays
  Clone ID: LIB3279-185-Q1-N6-F1
gagatcaagtgaatccacatttcatcatatttagaggttcagaacaaagaaatgcagtacaagtcgtatgctactactggaccaaggcactagagtctagagtgataagcctacgaaactaagcccatgggcaagaatactctggaatcactccatttcgtgaccgcgacccaagacttctgccacgaccagcagcagctggcggacacccctgacccctcagccgccaaatccgtagagggtgcggccctgccgcttgagcgcgtagacgacgtccatggcggtgacggtcttacggcgggcgtgctccgtgtaggtgacagcgtcgcgaatgacattctcgaggaagatcttgagcacgccgcgggtctcctcgtagatgagccccgagatgcgcttcacgccgccccttctcgccagcctccggatcgccggcttcgtaatgccctggatgttgtcgcggaggaccttgcggtgacgctttgcgccggccttgcccagcccctttccgccctttccgcgccccgacatgggcactcgaactctgag

SEQ ID NO: 11237 - DNA, 620 bp, Zea mays
  unsure (1)..(620): unsure at all n locations; Clone ID: LIB3279-185-Q1-N6-F2
gcaaaacattttcatttatttgtcatcggctgctgtacaacancgagaaaagacgtgacactgacacaagcatgcgattcacgtgggaatgtcgacggcccacctagagagatgcaataattcattcataggatgatgagacgatgaaacaagcaagtatctctatcctggaaagcaattcatgaggggcagctcttcctcttgggtgtggaacttgagctcattctgaaatctccgtagcacgaagtgctcttcctctgttataagggttgtcacgcagcattccaattccaacctggagaatggttgtctccctgttcttccagcacggtgcagatagtcggtcgccgtcttaggaagatctaggttgtatacgtggctggtttggggaaggtcaaaccctctgctcgctatgtcggttgagaccagcaggaatcctcttcccttcacttcggagaacgagacagctcgagcattgaagttcatatcttcttccagcagcatcacatcaaggcttcccttgtattcatttctcaagaaatcagagaccaccatggttgaaggaggattnccagccttctttgatctctcagactgcccagcaacaaatatgattgcag

SEQ ID NO: 11238 - DNA, 485 bp, Zea mays
  unsure (1)..(485): unsure at all n locations; Clone ID: LIB3279-185-Q1-N6-F4
gtgtttttttttttttttttttttttttttttttttttttttttttatttgaattttttttcattcagtaaacggccagcgatttcaccgccaggtttacacaatcgaaccgacgggcttgggttttataccaatcggagagtacacggggggggtgggggcaatccgattatccgtcccttctggccgtcggtcgtccttgcttttccggagttccgctgacggggggaagacatgaactttgaagcgagaggggggggttcctgctcctcaaatcttggccttgagcttatcgcccttgaccacggggttggcgcgcgcgatggcgtctcggccggcggcccggaaatcgaaggcgcacgcgtgccgctccgggtagcggtgcacgccgcaaaaggtagctccngagggggacgcgaaccccgttaggcccacgcgcttccgggagttggagcacctgcccgccttggcgccagcaggggccc

SEQ ID NO: 11239 - DNA, 526 bp, Zea mays
  Clone ID: LIB3279-185-Q1-N6-F5
ttgacgacgggtatgaccgtcgggtacggcagcctatcctcctcgtgcatcccaaagacgctcctggtgggacgcaccgcgttcatctggatccgctccgactccccctgcagccccccgtcctgcacctcctccacctcgccgccgaccggacggtcctccggcagcggcgcgaccctggacgggtacgagacgggcgagatcgcgggcgccgcgtccttcacgtaccgcatatcctgccgcgtccactcccgcggcggcatcggctgctgaggccgtcgtggcagtggggattggtccctaggggcaacgtccggggttgtcggggcggcagactcctcgggcggggcctgctgctgcggcttcggagcgtaggagacgggcttgatgggaggaggcggcggcgaggcggagctggacttggcgtcggaggagaagtggaagagtgagagcaggcggtggcgctgcgggttccgccgcgagtatgagaagaggagctggaggtgagccatcgggggcgtagcgc

SEQ ID NO: 11240 - DNA, 351 bp, Zea mays
  Clone ID: LIB3279-185-Q1-N6-F7
ataagcatcttaataactaaaaattaaccatctcatataacacgatttgtagtagtgtcaaaaagacgtcttacgagcttttaaccggtaacaaaccgcggggggggatacttttttttttttggaagaaaatgatacatcttagttaaaagagggagacgtttaaagtttgctcccaaatgatacatccaggtgtcatgcctcccttacaaagacaatcggcaggaaggccttgatcgtattgagcattattttcagctccgtcggctttaggtaatccggcagctgtagcgcctttttcatacccacgttacttgagatgccctcaattctacatgtgaaaatcgaaac

SEQ ID NO: 11241 - DNA, 383 bp, Zea mays
  Clone ID: LIB3279-185-Q1-N6-G1
agccgaaatgggtttcacagggccaagccaagttttcattaaaaaggacaccaaaatcgggggttttttcaagccaaatatgcctgcctgccctcaagggccccgggcattttttttccaactggggggcaagccccccctaatggtcaaccccacacacccccctaccaaaccaaggctgcccaagggaccacccaacccgagggaaacctgcttcgggttccaccccgaacaaaacaaggttctcccctttgggttccccttaaacggctcggatgaaccttttgaaccccttgggcccctgcctgtcgaaaaaaccctcaaaagacttgcccccctggagggttattaattgaaaaaccccgcgctacccccccccccaa

SEQ ID NO: 11242 - DNA, 615 bp, Zea mays
  Clone ID: LIB3279-185-Q1-N6-G2
aacatgtcaaatggcaagagctgggttcttttcaactagcaagagctgggtcgactgtctttaatccataacgatttctactatttttacactgcttttatctctatagattacaactacagttcaaatagattactttaatgtgaagcgaagaacctgagcagtgcaagctaggcagcgctcataactcttctcatacacccttagagccagggaggtggacccactgaagttggagctcgatttcgccacactctacgttccttagccgtacgaccaggtcttgcttcaccttcccctccgatatgtatatggagctctcctcggctaggcagttctgtctgttgggcaccagcttctttaccaccgttttgtcagcgacaccctggagcttcatcatcacaatctcgactaacgggcggatgtccagctccgcgttacccattgcatcatcaacgaaagtgtccttgtcaaatacttcctgaaaaaaaaaaatgagaaagagttattacttgtcaatactcagcatgagcgtctgtctctttaagagagttggaaaatgaagtcacgggtgtgtaatcgctaggctataaaatagtcttctgaaagacttgg

SEQ ID NO: 11243 - DNA, 604 bp, Zea mays
  unsure (1)..(604): unsure at all n locations; Clone ID: LIB3279-185-Q1-N6-G3
gaacgacaatataatgttcaaatataagagacaatcctccacgtaacatccatcatgtcatgtgggcaacgcaacaccgttctacaactaaaacactaanccaactggaaagaaaagaaaataatacaccacccagagctcagctccgtccacgccacccttgttggccttcaggccccttcctgaagcagcatctgatcaaagtgccacaccccgtgccccttgttgcccactctcctcagctgtgcgacatacttggagaccttatttatggcttccacctgctcctcgaggaactcactctcgatgaagtctatcagctgaggatcattgcaccttgttgccacaccatgcaggctgtgcagcttctcattaaccagcttttccagagccagagtcagctccatagcgtacagagcatcgcctttctcggggtggtcaaactcggtcaaaggcgccacaatcgactggagcctcaccctgcctccgcgtttgttctgatactccatgaccttttcagcgtgctccctctcctcgtcgctggattccttgaagaacttggcaaatcctttgagggccacgttgtcgcggtcgaagtaggcga

SEQ ID NO: 11244 - DNA, 507 bp, Zea mays
  unsure (1)..(507): unsure at all n locations; Clone ID: LIB3279-185-Q1-N6-G4
acggaggaccgattactcgtaaattagcgnaaaacgtactaacttgaaaatccaaacgttttgcaaagactactatactggaaccaatgtataaatatggaacatttttttttgcatgtcagcactangccgatccgggaaaacattactagtacataataaccgtccttcaaaattaaacgcctcacgggaggggaaacatcatgtccaaactaagggcagcttcactgttcactccatggaagaagaggtcgggccagcgccaaagccgctgccaccaccacggccaaagccagacctcgcgccagaactcctgaaagatggctggaactcagcaggagctccactcttatcgccaccaaagtcaccggaagcaccacgaggaccaccacggtactcatccctgtctccaaaccttggtctgtcttcaaaacgaccagngccccttgggcggtcaccaggagggccagagccaaatggacggcccggacgcgtgggcggacccgt

SEQ ID NO: 11245 - DNA, 590 bp, Zea mays
  unsure (1)..(590): unsure at all n locations; Clone ID: LIB3279-185-Q1-N6-G5
gcatcaaatcaagaaacagctctttattctgaaaaaagaaaaacaaagtcaacgaacagctaaaagtcagatgcacagttccngaaaaacacacacacagtccagtactccagaatccagtctgcgtaaaccacagctctggggcgggggaatctagataccagacttcaacgaaaggagtttcacatgacatgggtcaaaataataaattgtgacaaattggccatgtccagtgggtcaccccaaagggatcggagatttcaacagcaccaaaaacaccaagtctgggcaaatcgtcctgtttcttagtcagcatccatctcctcaagagctgcctgagcagcagctttggcctgctccaacagttcatttggaaccttctgatgctgacggttcgattcatcacagatccagctcaactccaactcaaaagctttgtccttcgcttcgtcatgcactccataaattatctttgcaacttcaacaatgccttcccggcaggtaagctccgaaagttcaacttttctatctcagtctttgcagcctgtcttcccttccccaatgcagcaccgaagtatttgttaggaaac

SEQ ID NO: 11246 - DNA, 508 bp, Zea mays
  Clone ID: LIB3279-185-Q1-N6-G6
gtggttttttttttgtttcctttttttctgagtcgggcttctcttctttgcatgcaaaagctctgcgagtctttaaacccacccaaaaggctcattgctcgtgcatatataagacacatctcttcctccagttcttataagggcatgagggggtgtgcatggttttaattcaaagcttgaaggctccttagcgcattaacctggatatctcatggccctggatcaccatctggttgcattgtcaagcgaaggctgataccttcactattgaaaagggttttaacaaagattaacctggcttattgatccttcgtgcacaaggttaatgggggggtctgatttaaaagaacaacgtttttgggagttatacatggaatttaatgctaaaaatattattgttaaaccatatatagttcatactgtgttgactgattattactctatggacatatacctgaactaccaaacatcactggactgatcacctttattacatacctatgtgttt

SEQ ID NO: 11247 - DNA, 334 bp, Zea mays
  Clone ID: LIB3279-185-Q1-N6-G7
gtggtttttttttttttttttttttttttttttttttttttttttttttttttttttttttttttttttttttttttttttttttttttttttttttttttttttttttttttttttttttttttaaaaaaaaaataaaaataaaaaagggggggggggggattctctttttttataaattaagaaaccaaagtccccaacggagggttcccgaccaagttttttttttttttgagagcccagaaccccttttttttgggtggacctttgtttctactcttaaatttcgaaccgttccctggggggttctctttttttctttaatggggtcttt

SEQ ID NO: 11248 - DNA, 603 bp, Zea mays
  Clone ID: LIB3279-185-Q1-N6-G8
gctgggggggggtttttttttttaaagggacatattatcttacatttaatatgattataagtgattttaattactatcttactttttctccatgcgctaaatgtgatacagtagtttcccttagaaaaactaagagtgcattttgatgtccttggggggggggggcctgctttgtttctaaccatcactttgttggccaggcaaagaagagtgccatcgattagtttaatctaatagaatggatatcagacatctgcatgtatagtgttggtttccttaaacagactatcaaatcggatttgtgacttgggcttgatgttaggagcaagggcattggataccacccagcagacaagagtcacatcggatatgattaggaaatattgcttacctatatcattatgtttcaagatgtgttgccaaagctcaatacaacttattaaacatgaatcttgtccactatatattgttagaggaagatgattattcgattacagaacatatagtggggagaatcttttattaaaatattaaagatacatagtgctaaaactttccttttattttgttgtagggatggcacctaatactcctatggggttt

SEQ ID NO: 11249 - DNA, 545 bp, Zea mays
  Clone ID: LIB3279-185-Q1-N6-G9
aacgaataaggaataaatatccataagttaagctatatgccagtttataattctcatcgactctaaaaagtttttacttgtacacgcaaaatgaactctagaaaattgcacactcaaccttaaacgtccaatacgcgaagggtcgccacttatgttttcattcagtcacttcacagttgtgggttataccttcggtggagctccttcagtcactgtctgcacagaccaaaactgttgtgatgtcaaaaggctccgaaggccaaactgtttgattctgcattggccaagcagcccatcgatgcagaggcctttgtttattggaggatgaacctctgctgggtgttcatgttgacatccctaactgatggtgctccaagttcctgagtacaatcctggcaaagattttagcttcaatagaagctgttgtcgctgccgctgctgcgcgcaacacccgacctgcccctgcttcctgcaagagacctgcgtgatgcactgcatgccgacctcctgggattgtgaactgaagaaggcaaaggcagcacaag

SEQ ID NO: 11250 - DNA, 455 bp, Zea mays
  Clone ID: LIB3279-185-Q1-N6-H1
gtgtgtttttttttttttttttaaaatcccgacacatgtcttcagacggggttacaaattcactggagcaacatcaggtcatagttatacattcctaattttctacaagtaccaaacatgagacgtacaaactgttaggcgtgttgcctgtgggctgcacttccctttacccagattacggcaacaccgtggacccttgtgctacggatcgctgcaaaggatttcggtgaaaacggagagtgcgttctgcaggtacgacgacctgctctcgtccggaacaggagcgtgtggcatcgtcagaagacaccccatgggtaggttcagcgtctcgcttggggtgtgcaccagaagcgcgcatagctcctctgccatcttcgaggagcatgcccttgactcaacaggtaatttgcttccccagactaacaacgattagtttattcggccaaagaaacttc

SEQ ID NO: 11251 - DNA, 473 bp, Zea mays
  Clone ID: LIB3279-185-Q1-N6-H2
gcatacgacaaaataaacttaaaacccatccttcgccacaatacgaacagaccccggaccttaccactcatccaaagcagagaaaagttggcgtattttaacaaaaacaaactcctttatccagaaaccttagcagccatactatctagagaaggtcggcgacattggccggcagctcctcaacggtcacgttgtagaacctctggatgtcaaacagcatccgctcgtcgtcgcgggtgacgaagttgatggcaacacccttccttccaaaccgaccactacggccgatgcggtggaggtagttctctggctgggtcggcaggtcgtagttgatgacaagtgagacctgctggacgtcgataccacgggcgagcaggtcggtggtagtgagcacacgagaggacccggacctgaactccctcatgatgatgtccctggtgttctggtccatatcaccgtgtgtagctgacacg

SEQ ID NO: 11252 - DNA, 505 bp, Zea mays
  unsure (1)..(505): unsure at all n locations; Clone ID: LIB3279-185-Q1-N6-H4
gggggggtggtgttgtttagccaatcatataaccacagctatgcaagcacactacttcaggtcagtaagttcgatacagaaggcagcttccatgctgaaagagagttaacaataaacttggtttatatcacgaacagggagtgaacacatgccgtgtgtggggagagcgtccaatgattacccaaaataacgtgcaaaggccatggagatgccttcgcctcgaatgggtactctggggagcaaaagctcattacacatggggtggtgaaccacctggaaccaaaatggctttgttgttgccgtttaggaggatctggtcaagttttgtaatggggggcccttcagcagtgttttcatactcggtgacgtgcttcaggaccatgttggcgtagacatcatagccgcagagggtgtcaacgagctgcttgtccccnttgatgatcacccggatcttggacccgatgcaccgatcgatcaatttttgaggggaggagcttggtagggg

SEQ ID NO: 11253 - DNA, 410 bp, Zea mays
  unsure (1)..(410): unsure at all n locations; Clone ID: LIB3279-185-Q1-N6-H5
gggggggggggggggtgtttttttttttttttttttttttttttttaaacaagaacccaaaacctaagtttttctggggctgtttttctttacaattgcttcagcacccacccttccctttcctcaaatggtagtggcagtcangtattccccgcgggggggggggttaatttcaagtgttcaggcatgtctggcaccaagggaaatggagggggttggaggggctaaattcccctccccttgctgccaaacaagcccttcatgtttaatacacctgaaaggaaactaacgttatgggttttgatcctgggcttggacctcatgccctcacaatatttcctccttttcttggagcctttgaagggctttattttcctaaatagggatcggggcagtagaagcttgggcaa

SEQ ID NO: 11254 - DNA, 487 bp, Zea mays
  unsure (1)..(487): unsure at all n locations; Clone ID: LIB3279-185-Q1-N6-H8
ggggggggggggggggcgaccaggatactcagaatccattacaatcacttgttctgcatacatcaaggctagagccaaacgatctggcgtttcaggaaaaataaaaaagacatatacttctctttgcacttctatcattttccttancatggccagggggcgcggggcgttttttaacaccccccaaaaaaaacttctctcgggcatgggtgggtacttatctttacatccagaactatgtgacaagagggcgtaggaccatggcctaaacagaacactaaaacacgataacgagaggatatttatgggttcggtactctagtgggaaagcatgggttcggtactctagtggcaaagcatattttcagatcgtcctgcaaaggctttggtgagggttgctgtgccctcttatttggctgtgtcgttgtgtgctagctcaggttcagggtggacttgacgggattcgggcctaatccaaaccatgcct

SEQ ID NO: 11255 - DNA, 570 bp, Zea mays
  unsure (1)..(570): unsure at all n locations; Clone ID: LIB3279-185-Q1-N6-H9
cactggaacaatccccttttttttaaacatggttgccactaactagttcacagtagtgactgacgagtaaccacactggaacacacactaccaccaccaccaccacactgacacacactacgacctggaggagacagcggggggggcgttgatcccccttgcgatgccgtagctacggccgccgagcccgatgcagccgaagaggagctggccctggcggtacggcagcgacgtccggcgccgcatctcctcggcctcggcgcgccgcgcctcgtacagccgctcgtgcgcggacctcctcctgcccctcccaacctttacagacggagacggggacggagacggagacggcgccgccgcggctgggggagcgccagcgcggtggtggtgggagtgcggctgctgctggctgctcttaccgccgtccgacttgctgcggtggagcaggtccttgaggaacccgctccagcggcgggagcccctggacgacgacgcggacgaggatgcggtggacgacgacnacnacgaccgcgacgccgccgccggctgctgttgctgcgactcgccggc

SEQ ID NO: 11256 - DNA, 669 bp, Zea mays
  unsure (1)..(669): unsure at all n locations; Clone ID: LIB3279-186-Q1-K6-A1
cggacgcgtgggcgngcaaacaagcttccttccttgcgaacgcaactagtctgctccggattcgccggcccccgccgccgcttcgtcttctctctccctcgtccacggcaaccaactaaccgtcgagatattggcggggcgccgatgctccctgactccccgtagcgcgttgcggatgctgtgggcctgtgaggctcgctgccgccgctttgggatctgggctgctgccggagcggcagcggcggttgtgactggcgccggcgatggcgatgtcggcgaaggagagaaagctgagcaggctcgggagttgtaagggcggtgcggcggctggaagtggcggcggcggcggcggctgcggttcgcctgctgccagggcccaccggtcggtggcggcggcgccgcagcggcgtgtcttcgcggcgctcttcgcgttcctgtgcgccggcgtagtcgtcctcggcggcgtgcacgtcattggagcaacgttccggccagtgctcaggacggcgtggccggcggcaaccctgaacgccatttcctccgatgccagagcgcagcgaggtggcagcagcgccgacaccaccgtgctgccgtcagtccaaaatccgcacgcggtcgccatgccgggacgtgtactcctgatcctcaagacgggccgtcgctgccggc

SEQ ID NO: 11257 - DNA, 635 bp, Zea mays
  Clone ID: LIB3279-186-Q1-K6-A10
gcagtctcctggaactctatgctaactggatattcacatcacggtttgagttctgatgctttgaaattcttcagatgcatgcgggcagagaatattagaacagatgagtttgggctctctgctgctctgaggtcttgctcagaccttgctgtacttcggctaggtagacaagtacacaggttgggcgtccaatctggttttgcttccaatgactttgtttcaagctcgctgatcttcatgtattctaagtgcggagtgcttggtgacgcaagaaagtccttcgaagaggcagacaagagtagctctgtgccctggaactctatgatgtttggttatgctcaacatgggcaggcacagactgtgaccgacctcttcaatgagatgctggaccttgaggttcctttggatcatgtgacctttgttgccctgattaccgcctacagccatggtggtcttgtagatgaagggtcagaaattctcaatacgatggaaactaggtataaaattcctatgcgaatggagcactatgcatgtggtgttgatctatatgggagggcaggacagcttgataaagcaaaagagcttattgagtctatgccatttcagccagacgccatagtttggatgaccctttt

SEQ ID NO: 11258 - DNA, 588 bp, Zea mays
  Clone ID: LIB3279-186-Q1-K6-A11
tttaatccactcaaaagtgagtgcagcaggggggtggacagtagcatcggatgtgtcccattcttcactagacacaatactagataagagtatgcctcgtagagttccatacacacgtttgcaccatttctcagaaacttgtttgcaccatttctcacacaccgacacctcgcagggggggggtaaaaagaagagacggaaccctcactcagaatggcctgaccggtacaaacaaagacgtttaagttcacatatggttcacatacacacatccattacacaggacaagaaaataagcatatgagaatcacactcagccttcttctgtttcttttactcctcgtgctcatccataaccgaagaaaacgcagtggaaattgactcaaggctgatccgagccactccctgacctacacatgcatacatgcgctctttctccatttccatatccttttcctctatttgaacaagttggtgaatgtcagtgccaaatgttcaatcggacctcttccaatactcaatcttcttcagtgtcaaatccgacatcttggagaaaaccctacacctttgttcaccagcacatcaata

SEQ ID NO: 11259 - DNA, 448 bp, Zea mays
  unsure (1)..(448): unsure at all n locations; Clone ID: LIB3279-186-Q1-K6-A12
tcttctcgtccgggcaagtccaagtcgggggggaggggggggggatgacgaagagggtagcgaggaggatgaagatgatgacgagtgatggagagctcgctcgagacaatggacggtgcttcatccaacaatggagcggctacacaaggccccgtggcgatcaaaaaaaagagcctatgtggcggtgctagaattattcagtttcactccacatcgtgatgttttatttttacttttgtcgtgctataacggatagcgctcctcgttggcgccactggcgggtggttctgcctctggtctggtgtgtttgtgtgtggtcacacttgccagctagcagaggcgcctgcttgtacctagattactgtttccattgtcgtcgtcatcggctaacattgtcataatgtcagtttgggtaatgttagattaagtaattattgtgttctgtgna

SEQ ID NO: 11260 - DNA, 627 bp, Zea mays
  Clone ID: LIB3279-186-Q1-K6-A2
tagatgacacagctgctttcaaaaacttcaataagtggggcaacattgtgtttcccctaccatttggaagagttctcagtccctccgaagttttatccatgaactggatgagaagacaagtgcgtctctgaaattcacggtactgaacccaaaaggacgcatctggacaatggttgcaggtggtggtgctagtgtcatatacgcagacactgttggtgatttgggatatgcttcggagctaggaaattatgcagagtacagtggagctcccaaggaggaggaggttctgcagtatgctagagtgcttttggattgcgctacctctgatcctgatggtcgtaagagagcccttctaatcggaggaggaatcgctaacttcacagatgttgcttctacatttagtggcatcattcgggctttaagagagaaggagtccaaattaaaggctgcaaggatgaacatttatgtccggagaggtggtccgaactaccaaactggactcgccaaaatgcgcaccctaggcgccgaacttggcgttccaattgaggtctatggaccagaggcgaccatgactgggatctgcaaagaagccattgattgcatcatggccgcgtaaatacaaatgtg

SEQ ID NO: 11261 - DNA, 604 bp, Zea mays
  Clone ID: LIB3279-186-Q1-K6-A3
tggtttgtacaagaaaaagttgtaagatattgactgctataatcagtgcacgaccaaagcttcggaatggcacacttccaaatggagatgcttcgaatttgaagagcaagcttacttcaacacatgatgtattgagaggtttggtcaattggctctgttcacagctgaggaatcctacacacccgagctgctctatttctacttccatccattgcctctccacttcgctaagagaaccatatgttaggacattatttgttcaagctgatggcatcaagctgctcattccattaatttccccagctgccacacaacagtcaattcagctcctttatgaaacttgcctctgcatctggcttttatcattttatgatgctgcagttgattatttgtccaccacaagagttataccaagacttgttgaggttgtcaagggatctactaaagagaaggtggtcagagttgctgtgttgtctttctgtaatttgctggcaaagggtgcatttgctgcccagatgatcgatcttggattgccgcaaatagtacaaaacttgaaagctcaagcatggactgatgaggatctgttagatgctttgaatcaact

SEQ ID NO: 11262 - DNA, 649 bp, Zea mays
  Clone ID: LIB3279-186-Q1-K6-A4
gccagcgtcatccccaacttcctcatgggcatcataatcggcgcagggatccaggggatcttcatgctggtgtcgggttacttcaggcttccgcacgacatccccaagcccttctggaggtaccccatgtcatacatcagcttccactactgggcgctgcaggggcagtaccagaacgacctcaggggcctgctgttcgacaaccaggacgacgagctgcccaggatcccgggggagttcatcctggagaccgtgttccagatcgacgtcgcccgctccaagtggctggacctggccgtgctcttcagcatgatcgtcatctaccgcctgctcttcttcctcatgatcaaggccagcgaggacgtcaccccctggctgcgccgctacgtcgcgcggcgccgggtgcggaaccgtcgccaccgcaagccggacctgcccgcccggacgccgtcgctccgcgggtacgtcgtcgacgcggccagcctgccggacgaccacccgtgacgaaagagcgcgagagaaaacgtacgggcagggatgtcatttcatatcatatcacacagaggctaaaccggatcgagctgataataacacactcactcactagtactgcaataatatgatgttaagttggtatagcaaccgctta

SEQ ID NO: 11263 - DNA, 650 bp, Zea mays
  Clone ID: LIB3279-186-Q1-K6-A5
cagaccagcagcggctcatttttgccggcaagcagctcgaggacgggcgcacgctggccgactacaacattcagaaggagagcaccctccacttggtgctgcgtctcaggggcggcatgcagatcttcgtgaagactctgaccggcaagactatcacccttgaggtcgagtcttctgataccattgataatgtcaaggccaagatccaggacaaggagggcatccctccggaccagcagcggctcatttttgccggcaagcagctcgaggacgggcgcacgctggccgactacaacattcagaaggagagcaccctccacttggtgctgcgtctcaggggtggcatgcagatcttcgtgaagacacttactggcaagacgatcacccttgaggtggagtcctcagacaccattgacaacgtcaaggccaagatccaggacaaggagggcattccaccggaccagcagcggctgatcttcgccggcaagcagctggaggatggtcgcaccttggctgactacaacatccagaaggagagcaccctccacctggtgctccgcctcaggggtggtatgcagatttttgtgaagacattgactggcaagaccatcaccttggaggtggagtcgtctgacacaatcgataatgtc

SEQ ID NO: 11264 - DNA, 451 bp, Zea mays
  Clone ID: LIB3279-186-Q1-K6-A6
cggcgttcaacctcttccggctgtacggcagcggcaaagggaggaagtgatctcccttcggcctgccactaggaacacagggccggcagcgccgcccctgtgctggcatttctcttaggttttaacacccagtatggaaccatagcgccatggatggatggatggtctcttcttcttctccggtttgagtttttctggtgttgggtaggcatacctgtcgtctgtcagcgtagacataaaaaaaaggtctctgggacgctcgcccatgtatgtatgtatatgatgtgaagtgatccaaggtggttcgcgtactatggcaataaacgtgtgggaaagcgatgtatcgtcgatgactgtcgccgcctgcagggatggcaggggaatttactctctgggttattatacaatgcggtagctggctttgctgatgctgtgccaactgccatcattt

SEQ ID NO: 11265 - DNA, 553 bp, Zea mays
  unsure (1)..(553): unsure at all n locations; Clone ID: LIB3279-186-Q1-K6-A7
cccgtttcgtcctcgcggtattcgcggcgttttctcccatgctgcgaacgcgccgacgagcgacgacaagaactgctctattcttcaaaaaaaggcgaccgttccagttaacccaaanaccttttctgaacaacctgnacagggaaagcctgttattgtcaaactcaagtggggtatggagtacaagggttatcttgcttctgtggactcatatatgaatctccagcttgccaacactgaggagtacattgatggtcaattctctggaaacctgggagagattctgatcaggtgcaacaacgtcatgtatctccgaggcgttccagaggatgcagagatagaggatgcagagtgagaagatgcgatcaatgttagattgataaatgtaatatggttctgacatctatgttcgaatatgccggtgacaagtagatctatcggatcgctttgttctcttgagtgatgaaacatgatggcggtcgggctaagggtgaagctgctttcagttagactatgctgtcattctgctgaatatatatcagacttcttgaac

SEQ ID NO: 11266 - DNA, 662 bp, Zea mays
  unsure (1)..(662): unsure at all n locations; Clone ID: LIB3279-186-Q1-K6-A8
tccgtttccaacgtgcgtaccggcgtccgggtccggggccgagggtgacggagtccctggtgcggaacaagccggggatggccagcatcaagnagatgccggtggtgcaggacgggccgccgccgggcggtttcgcgcccgtgcgcttcgcccgccggatccccacctcggggcccagcgccacgcggctcttcctcaccaccttcggtgctttcgcatatggcatgtaccaggtcggtcaggggaacaaggtccgccgggcgctcaaagaagagaaaattgctgctcgcagtgctatactgccgatgctccaagcagaagaggatgaaagatttgtcaaagagtggaagaagtatcttgaggaggaggcgaggatcatgaaagatgttccagggtggaaggtcggcgagagcgtgtacaactccgggaaatggatgcccccggctactggtgagctccgccctgaggtttggtaagggcctgttgcaggcactgaatgccatcatgtcacgggggcacggataaggcttcatttttcattaaggatcagctgtttaaagacctgtatttgttgtactggaaatctggctggttaataattggacatgtaaagacgacttttacattggatgtaacgtggttcttggtggttattgcttccc

SEQ ID NO: 11267 - DNA, 664 bp, Zea mays
  unsure (1)..(664): unsure at all n locations; Clone ID: LIB3279-186-Q1-K6-A9
gtcagnagcttcctttagagcagcaacttgttttagggcttcaacacgagcagcaacttaagtctcaacaattggcaaatgctctgcggcaacattcaggccaggaagaagaaggcacttaagtggggtctggccattggatgctgctgcccagtttatccgctcaggaaccagtccaaatcagatacacagtcgtttcgatctcctggagaaccttcagagatcgtcatcgtttgatcatcatgaacatctagaccgcagcttatccttacacgaacagttgcatatgggaggtcaaggtattcgctccctagagcggactggttctttgcctggtggtggtcctggaccaaacccagatgtcataaatgccctaacacgtcatcatggacttagtcagttggaaacacatggtgatgtataccctttaggccaaatgcctatgcttccttcaggtgttcatccccagcaacttaggcatcaggatcagcttcctggttctcacataggaaggcttgaaaggcactggtcggatgccaatggacagttacaaaacagcctaatggaatcttcacacatcaaccatttgcagattgaagcggagaaggagaggaggaatgtggaaatgaacctttctgttgacaatcacatgcatggggagccc

SEQ ID NO: 11268 - DNA, 621 bp, Zea mays
  Clone ID: LIB3279-186-Q1-K6-B1
cggacgcgtgggcgcgacccgtaccccgcctcccggttcaaccaaatccctctcgcctcatccccaccagcgcaaagccgccctatcgtcctgtcgtgagaagcaatggcgggccgtggcaaggcgattggcgctggtgccgcgaagaaggcgacgtcaaggagctccaaggctgggctgcagtttcccgtcggcaggatcgctcggttcctcaaggccggcaagtacgccgagcgcgtgggcgccggcgcccctgtctacctcgccgctgtcctcgagtacctcgccgctgaggtcctggagcttgctgggaacgcagcgagggataacaagaagacccgcatcgtgccgcgtcacatccagctcgccgtgcgcaacgacgaggagctgaccaagctgcttggtggtgccaccatcgcgagcggcggcgttatgcccaacatccaccagcacctcctccccaagaaggctggctcgtccaaggcttccaccgtcgatgacgatgacaactgaagctgcccactggagaagaggcattcgctaccgtcttgtttcctaggtttagcacgcagttagtcagcatgtctttgagagctcgatgtgtttgggaatgacaatagc

SEQ ID NO: 11269 - DNA, 547 bp, Zea mays
  Clone ID: LIB3279-186-Q1-K6-B10
caagaaccacagccaccgcgatggcgcagatcatcgatggcaaggccatcgccgccgacgtccgccgcgagggcgccgccgatgtggccgcgctctcgtcagcccacggactcgtgccggggctggccgtggtcatcgtggggagcaggaaggactcgcagacgtacgtgaacatgaagcgcaaggcgtgcgccgaggtcggcatctgctccatcgacgtcgacctcccggaggacatctccgagaccgcgctcgtcgccgaggttcatcgcctcaacgctgaccccgcagtgcacgggatccttgtccagcttccacttcctaagcatatcaacgaagagaagatactgagcgagatttccatcgagaaagatgtggatggcttccatcctctcaacattggcaagcttgcaatgaaaggcagagagccactgttcgtaccatgtacgccaaaggggtgcatggagctcttgtcaaggagcggagtcactgttaaaggtaagcgggcagttgtggttggtcgcagcaacatcgtcgggctacctgt

SEQ ID NO: 11270 - DNA, 576 bp, Zea mays
  unsure (1)..(576): unsure at all n locations; Clone ID: LIB3279-186-Q1-K6-B11
cccagcgtccggtaaaattgtacacaaataagagtgtggacttttgttattggcttcacatttacatccacctaaccaatagaacaaaccacatatatttatattttattaaaataatgtatactcataaaatatatagaaacgtgacaatgcactggtaactgactagtatacaaatgatagaggacgttctaagaatttaacatcctacactcatgtgatggccatagattatgataccgtggattaagaaatagactcgtgccttgttaggttgtcttcagtggaccgtgtaaaatatagtatttacattgtagatgatactgtttgcatattgaagtttgaaataaggtatgtgataggggatgaaatagggaagctactggtgatagccttagagtatgaagccgtgtattatggatacatatcaacaaggaacgaaacaacgttatcatttaacttctctactactataatgtgactgcacgtcccccactttcgtgcacgccctcacttaggggcgaaaccaactntaaatttatggtggtgcagtgctaaagcaacatacatagtttt

SEQ ID NO: 11271 - DNA, 604 bp, Zea mays
  unsure (1)..(604): unsure at all n locations; Clone ID: LIB3279-186-Q1-K6-B12
tattcaggccctcccaaatcccaagggggggggggggcgggagcccaccatgggcgcgcagtccttcctcctcgccgccactgccgccgccagggcccccgcgggcttcgccgctccctattcctccgcacgccctttccactcggtccacttcgtctccggcccatggggcgccggggcgggggggcgctcttcttcgcggacgccactaagaaggccgtagccgtcctcaagggcgcgtctgaggtcgagggcgtggtcacgctcacgcaggacgacgatggacctacaactgtgaatgtccgtatcactggacttacccctggacttcatggcttccacctccacgagtttggtgatactaccaatgggtgcatatcgacaggaccacattttaatccaaacaatctgacacacggtgcaccagaagacgaagtccgtcatgcgggtgacctgngaaacattgttgcaaatgctgagggcatagccgaggcaaccattgttgatacccagattcctttgactggcccaaattcagttgtttgggagagcatttgtggttcatgagcttgaagatgatttggggaaaagggggcctgagctc

SEQ ID NO: 11272 - DNA, 526 bp, Zea mays
  unsure (1)..(526): unsure at all n locations; Clone ID: LIB3279-186-Q1-K6-B2
ccccgcgtccgccccgcgtccgaggggcagtcctaccaccccgtctgctgcgaggtctgctcaaccgaggttggagtgttggacgaggacgaggtgtaccacttctttaacgtgatccctagcaactcctgaatgccgtgaactgttgctctgtaggagtgcatgatgcggttttgaaagggggtctccgcgagctctagctgtgatggctctttgttggtggccagcctgatctttgtcctgattggacgtgttcatgcttgctctagcagcaatgaatgattgttggatgaggtgtcaggtgtgtatgatgctgctaaacatatcccacatgggaacaaagctagcctgggcctggccgtgcctccagatcccaagacgagacaatggcgcgtgcgctctgattatgggtagattgatttgcctgccaattcaatacccggctagtcccggccccggcaaanaaaaaaaaannaaaaanannannnnnnnnnnannanaaaaaaaaaaaaaaaaaaaagggcgg

SEQ ID NO: 11273 - DNA, 518 bp, Zea mays
  unsure (1)..(518): unsure at all n locations; Clone ID: LIB3279-186-Q1-K6-B3
attgagtatcactaatcatcttctagtgttngacagaaaacaaacaaaatactctcacactcttgtaggattgccatcaatcaccaaaagggggagatcgaaagtatctaggaccctggttggttttagtgattaatgacaacataagattacatgcgactaacgtgtgttttgcagagcaaatggtatgttagttcacattgcagagagttgtgctacaatggtgaaaatatccccttagatgagaacttgaagcgatggctgaaaaaggtgaatcaaaagatgaaggactacatatcctaagtgttaaaggagttgaggacacttggtatagaattaggacttctatttttgttttagccgtactataaagaggggctgtggatgagtagtttaaccaagagaaatctagtgtaatgtcggtgcatgttcacacgcacaactagtgctaggtgtcactctataactcactcaaaagttagaatcgaaaactgtttagaaaaaaaaaaannnnnnaa

SEQ ID NO: 11274 - DNA, 624 bp, Zea mays
  unsure (1)..(624): unsure at all n locations; Clone ID: LIB3279-186-Q1-K6-B4
ccccgcgtccgcccacgcgtccgcccagcgtccgaagagtcaaaactctacatgagcatctcaaatgttgcacacaagcataaatgtacttgtttgagcttaaaaaaacttaacctgtagggggtaagacaacccctgggcacctggtccacccatacacaacggcaccatagcccatgtgagaatgactgcgactagggccgggccttgggcctgtttgtcatgggagtatgggacaaagtaggggatatttttaaccttagcctgaaatttactcccgtgaggagtcaaacacaggacctgtgtagtgctactcagaccccctatccattcgcctggtttgagcttatgctgtacgatttctgaacttgaaaatatgtatttgagatgaatatcccttgcggtaaaaactaggacaattatgcttgtaactttatttctgtaaatttgctttaagtaggctggacaatgatcttgaaattgtgacgtgtttgttttcattgcttcttgcttngggtctcaatttaccatgcttggttttcccggaaagacatatggattttgtaggaaagagcaggtgatgttggagccttcggcactgggtctgccctctgtgttgccctg

SEQ ID NO: 11275 - DNA, 572 bp, Zea mays
  unsure (1)..(572): unsure at all n locations; Clone ID: LIB3279-186-Q1-K6-B5
tggngnaaatagcacatggatcaaagccatcaagttttttggcagcattgtttgcttacttcatggaggatgccactgttcctaaatatcagtgtcctcaaaactttcaccatctagaaatcttcttgggactaatgctggcagccatatctcaacacttgatagattgtatttctgggagagcaagctttatgatgaagccaaggccagcagtgccatctgcaggaagtacggtgggaaatgtaagaagctaagacttcatgaatcaagaggggtgaatcaaattgataacgattttacccgtgcggcaagggaaagatgtcagtatcactgcatcctccaagatgatcggatatgctcttcaggacccatcaataagagagatggctgagcaaattgcaagtgaccctgtgttcaaccagatggttgaacagcttcagaaaagtgctcagagcatcttgggaatgcccttatgtaggatcctgctatgtccagaatgcttgagaacttgaccattctggctcataaggagtagcttgaggagaggatggcccgtatcaaggatgatccat

SEQ ID NO: 11276 - DNA, 341 bp, Zea mays
  Clone ID: LIB3279-186-Q1-K6-B6
cacgcccacctcacttctgcaagagcagtggtgccatttcacgcaacatcctccagcagctgcaggagatgggcatcattgatgtcgatcccaaggtggacggcgcatcacctcccagggaaggcgtgatctggaccaggtggctggaagggttgctgttgaagcttgagcaatctcatatttggtttctatgatgtcatgtttgattgttgagatggctacactttatttgcactttggattaggatttttgtgttaagagaactcaaggcattctagctatggttcacactgtattttccctgagtacctatttatcaaaacctattcgtatgtttggg

SEQ ID NO: 11277 - DNA, 567 bp, Zea mays
  unsure (1)..(567): unsure at all n locations; Clone ID: LIB3279-186-Q1-K6-B7
gattcacaaagctgaagagttcttagccagtacgctgagaagcgtcctgagaattctaaagggctcctccttgcacttgcccagattgctgctaatgccaaccattttcagcttgctgctgactcactatccagaatacctgacattcagcacatgcctgcaacagttgctacattagtggcccttaaagagcgcctaggtgactccaatgctgcagcttctgtacttgattctgctatcaactggtggaagaattccatgaccgaggataacaaattagatatattaacacgggaggctgctgcatttaagctcagccatggacgtgatgaagaggcttgtttgttgtatgaggaacttgtgaagagccatggaagcatagaagctttggctgggctagtaatgacttcagcgcgcactaacttggagaaggcagaacaatacgagaagaaactgaagccattgccaggcctcaaaggagttaatgttgagagcttggagaagactctggtgcaaggcatgtggaagggccccanagacatgaagtagatgttccccgagaagtga

SEQ ID NO: 11278 - DNA, 570 bp, Zea mays
  Clone ID: LIB3279-186-Q1-K6-B8
ggccgccagggctccgtcctctagcggctccgtccggtggtccggccagctgcctagctccctccgcggtccggccagcaccgcctcctgctcgcggccttgcccagctcctccgccctccggtgagacgtagatcttggtgcggcagggcgctacgggggcggggtggtgctgttgtgcgtgtgctggtggcctggtgctagcaaccgagtactatggatcacgaatgatgtattgtatgcaattcggcccggagcgtcactaaatcctggatccgcattggccgcagggccagtggccagtgtccagcctgccagctcagcccggcggcaagcgcccagcggctggctcgggcagcggccagtggcgagcagccgactcgtttcttcggcgttctccgccactgccccccagctatgcaccctgttccagtcccctcccagccctttaccgcaactcctgcaaaaaaacttgtttcaaggagcactgctgtgaggaaggccatccattttgtcaacctgtggacagctggaagtctagtggaaacctggctatgaactccgtaccaaa

SEQ ID NO: 11279 - DNA, 644 bp, Zea mays
  unsure (1)..(644): unsure at all n locations; Clone ID: LIB3279-186-Q1-K6-B9
cacgcggccctggaatatattcacctccaaggattgtgcaccgtgacatcaaacccgagaacatcttatttgatggagaattctgcgctaaagtcgtcgattttggagtggcgtgtgaagaaaaatactgcaatttgttaggcgatgatccaggtacttatagatggatggcaccagagatgtgcaagcacaagccatatggccggaaggtcgatgtgtatagctttggacttgtcttgtgggaattggtcactggttcactcccttatcaagatatgactccgcttcaggcagcttttgcggttgttaataagaacttgaggccggctattccattgagctgcccagcagcgctgaagcttctgatcgagcaatgttggtcctggcaaccagaaaggaggcctgagttccagcaaatagtttcagtccttgaaaacctcaagacagttcttgaaagagatggaacactcgacaagatcccaagctcgatctgccaggccctggaacccaatgaccagaacaagaagaaggctggcaactggatccagaggctgtcatacgctcaacctgctttctccggacctccaccccccaagntactgtagttacacgtcttcttgttcttagcagcttggtatctggta

SEQ ID NO: 11280 - DNA, 636 bp, Zea mays
  Clone ID: LIB3279-186-Q1-K6-C1
gcgtttcctcttgcgttcgggcgggcgggcggctgctggtagcgagcgcgaggcttgccgagcgagcgagcgacatgagctactacaggcttggggaccgcgaggagggcgacgaggagctgttcgagacggcatcgtccgtctccagcgccgacgccgactccgactccgacgacgagggcgaccgcttccctagcgccggcgccggcgccgacgcggcgggggccgagggtccgtgcgaccagcaggaccgccgccgccccgtgccgcagccgctgcggaggatgaactcggacagcatctacgacatggcgtccatggtgtcgcagctcccagccaagaaagggctgtcgcggcactacgagggcaaggcccagtcgttcgcgtgcatgtcggaggtgcgctgcctggacgacctgcgcaagaaggacagcccctacaagcagaagaaggtcaagtcgtcgtgcaagggctacgtcgcgctgggagggatgatgatggccaacaagcccccctcctccggatcctgcgccggcctgggcctcgccgccgccaacgggttcaggacgtccccgattcagaacgggtaccagtaggcaggctggcggcttggccagagagcactgcaactgcaac

SEQ ID NO: 11281 - DNA, 547 bp, Zea mays
  unsure (1)..(547): unsure at all n locations; Clone ID: LIB3279-186-Q1-K6-C10
gtcgacccagcgtccggtagctcaaaatattagctggtgacatgatgggggggcagaaaaaaaactacaaacaaaacgttgcatgcctagaaaggatggaaataagaatgaagaaatataaaagccgcactaccaagtattgccccttgactccatgctgagacgttataaaaacaatacgcagaagcaacatgaggggggttctactatcctcgtttcaattacactggtgccaccctcctctattatgaagtagctgcaatagccataaactggaaccatctaatactatctttctgcatcctcaggaatagatgatagcctctcttgctcaagaaatgatgaatcaagaaattttgcagcaaatgcccacaacctgtagacatcctcaaaatttgtaaggaacccaagagatgcagtgaccacttcggtcccaataatagcattcttgctatttttcttttggcggggggggggggggggggggggggggggggggggcggggggnnggggggggggnggcgggggggggggnggggggagaag

SEQ ID NO: 11282 - DNA, 641 bp, Zea mays
  Clone ID: LIB3279-186-Q1-K6-C11
gtactctgcaaatcgtatccatcaggatttatctcctatttccactactgtcgttcattgcggtttgaagacaagcctgattactcttacctgaagagactattccgcgatctctttattcgggaaggataccagtttgactatgtgttcgactggaccatcctgaagtatcctcagataggctccaacccgcggatgagggcaggtgaaaggactagtggagctgctggaccctcaatggacaagattgagaaggccacaggagaagcagccggtagaaggaatcttagtggtcctgtgaaccagactgacagttatgcacaacgaccgcgtgagaccgtatctatgtcattaaaggaaattatgcatagcactgaccggtctggggaaaggaccatggagagaccacgtacatcctcgcgcacaggcagtgcatcccgtagagctgttgcatcaagcagcaggcaggcctcatctgtggaaccaagtgagcagcagtatagccgggcaagcagattgttctctagcaacagtggcagtcgcccatctagcacccagagggtcaacccatcgccaggcgaggcaagggctacctccctctcacgggcggcagtcgcgagaggctcccgcgacgagccact

SEQ ID NO: 11283 - DNA, 606 bp, Zea mays
  unsure (1)..(606): unsure at all n locations; Clone ID: LIB3279-186-Q1-K6-C12
gcgcacttcacggccccgtcctccgggcggcgggtgctcatgtccgcggcgctatcgacggagctccgccacaagtacaatgtgcgttccatcccgatccgcaaggacgacgaggtgcaggtcgtgcgcggcacctacaagggccgtgagggcaaagtggtgcaggtgtaccgccgtgggggggggatccacgttgagcggatcacccgcgagaaggtgaacggctccaccgtgaacgtgggcatccacccttccaaggtcatggttacaaagctgaagcttgacaaggaccgcaaggcgctcctcgaccgcaaggcccggggccgcgccgccgacaaggctaagggcaagtttactgccgacgacgtcnccgccgctgctggtggcgccgccgccactggcgcgtctctccaggagatcgactaggcgcttcgcggggatctgatggtggtcctaccgcctattactccttatcgctctagtttttgctatcaatgattatgtgctaggagttttatgttacttataaactgctttgagcctcgatgggagttgaacttaatgtggagtgtatctgagatatgaagaactcattatatggctaat

SEQ ID NO: 11284 - DNA, 542 bp, Zea mays
  Clone ID: LIB3279-186-Q1-K6-C2
gtgtaaaagctacaagcttgttgccatcaagctgattgtcccatccaaaggattcgctgagaagcactaccatgatctcaaggaaaggcctttcttcaacgggttgtgtgacttcctcagctctggccctgtacttgcaatggtttgggaaggagagggtgtcatcaagtatgggagaaaactaattggtgccacagacccacagaaatctgaaccaggaaccatcaggggcgatcttggcgttgttgtgggaagaaacatcattcatggaagtgatggcccggagacagcaaaggatgagatcgccttgtggtttgaacccaaggagctggtctcttataccagcaatgcggagaagtgggtctatggggtgaattaaccagcgactaaatctcttgaggtttgcttttttcttttcagttttcacataattgccgacagaccaaggcaggatgtaataaagtagctaccgtcacctattacttttgagttggattgattgtggtgcagtaaggcacaaggaaaggaaggaatacaccgtg

SEQ ID NO: 11285 - DNA, 537 bp, Zea mays
  Clone ID: LIB3279-186-Q1-K6-C3
tcgacccacgccgtccgcggtacgcgtggggtcacgtgatagtcaattggtcgtcaacgtgtgacatgtgttgacatcccgttactaatatgaccgtccctccacgaagtgggtctaatttcgacgcactttgtatgtgcttcatgcatttcattctcatatctctataatctcttataaagcaccaattttatttctcccaccggcaccctttttgcaaaaaaggttcttatgcttttttctaaacaatccgcgatttataagtcagatctgatcctgcggactccacccgaccccacacatctcgcaaacggtagttttgattgaccctgcctgtacccttcctccttatcgcctcgcatcccaactcgacagggtgactgtcgggcctacgtcaggtgttccatgcctacattttcaggccttatccagcgatgaacaccctatgtacgcccgacctcgtctcctccgttcggccaccacgggacacccaggtgcagggaaggggtagcgacttccctgttgaagagtcccatc

SEQ ID NO: 11286 - DNA, 87 bp, Zea mays
  Clone ID: LIB3279-186-Q1-K6-C4
gtttggtgaaaaaaaaaaaaaaaaaaaaaaaaaaaaaaaaaaaaaaaaaaaaaaaaaaaaaaaaaaaaaaagggaggacgatataaa

SEQ ID NO: 11287 - DNA, 688 bp, Zea mays
  unsure (1)..(688): unsure at all n locations; Clone ID: LIB3279-186-Q1-K6-C5
cctctgtcttcgcctccgctgccgatcgaaagccccgtcctgtcccctcgcaaaaccctagctccagccaccatgaagggcaaggctgacacctccaagaaggacgagggcaggctccgggcgggcggcgccgccggaaagcgcaagaaggccgccgcgagcggcaagcccaagcgcccgccctccgccttcttcgtcttcatgtctgaattcaggcaggagtatcaggcgctgcaccctggcaacaagagcgttgcgaccgtgagcaaggcagcaggggaaaagtggcgtgctatgtcagatcaagagaagcaaccatatgtggaccaagctgggcagaagaagcaggactatgagaagactaaggcaaactttgataagaaggagagcacaagctcaaagaaggctaagactgaggatgaggatggctcgaagtcagaggttgatgacgaggatggcagcagtgacgaggaaaacgatgacgatgagtaaacactgtctccaaggccacgaggtagcaaatcaagtgttaggtccccaattagcttactgttttgctgcctttaaatgttaagttgnttcaaacaggtgtttatgaaggggatctattagtttcgcgatgtcgttaggttagtgcattagcaaagaaaaaccaaatgctgctagctgttctggtgcttttctttgc

SEQ ID NO: 11288 - DNA, 665 bp, Zea mays
  unsure (1)..(665): unsure at all n locations; Clone ID: LIB3279-186-Q1-K6-C6
gcggnaatctcccacccctatcagctggacagcggctgaacattgcgattgatattgcccgctgtctagattacctgcacaacgagcgggtgattccacatggcaacatcaagtcgtctaacgtcctgattcagaacactccatctgctctggtgactgactacagccttcacaggctgatgactccgatcggcatggcggagcaggtcctaaacgccggcgcgctaggatattcccctcctgagttttcaagcaccagcaagccatgcccatctttgaagagcgacgtgtatgccttcggtgtcatcctgctggagttgctgacagggaagattgccggtgagatcatctgcatgaacgatggcgtggtcgacctgaccgactgggtgaggatgctggatctggaggagcgtgtctcggagtgctacgacaggcacatcacgggtgttgagagctcggaaggcgccccacaggtactggatggcatgcggcgcatcgcgctccggtgtatccggtcagcatcggagaggccggaggtccggacggtgtttgaggatctcttgtccttatcgtcgtgaccgtagttattggtagtgtacatctcgtacttgcatcagcttgtggaaacttggagggtatactaacaaattgctagatttcgggtg

SEQ ID NO: 11289 - DNA, 609 bp, Zea mays
  Clone ID: LIB3279-186-Q1-K6-C7
gggtgtatgatcattgaaggtccgtggttatttgttggaatacctgatgcagtgaaggtttggaatatgcaaacagcagcggaaatgagccttactggaccaactgggcaagtctatgcactcgccgttgccagtgagttactctttgctgcaacacaagctgggaggattttagcatggagatttagtgccgcaactaactgttttgagccagctgcttctctagatggccataagcttgctgttgtttcattgatagtaggaggcatgaggctttattctgcttcaatggataaaactatcagagtatgggatttggcaactttgcagtgcatacagactctttctgatcataccgatgttgttatgtccgtgctttgctgggatcaatttctattatcttgctctttggatcaaacaataaaagtttgggccgctacagagagtggaaacttagaagtaacatatacacacaaagaggatcagggtgcacttgccctcagtggtatgcctgacgcacagtcaaaacctgtgctactgtgttcattaaatgacaacactgtccgcttatatgatctgccatcgttcagtgacagaggcagattattc

SEQ ID NO: 11290 - DNA, 650 bp, Zea mays
  Clone ID: LIB3279-186-Q1-K6-C8
ccccgcgtccggtttcagtgaagggaagaacgtaaaatcagcttgggactgagattcaggacaagggaaaaaagatcatcacatagtctactagtgttgcagtttcctttgccactgaagaagcaacttgtggatgattgggagtttgttacgcagatgggtaaggtatttagttctctgtctcttacccttcattagtatctcatgcaccatttgatgtctcatatcctagactaaatattaaaatgttgtgttaattggcatggaatttcagcaggcccaagtggcaagctcattagctcattcagaaaaagactttgcaactccattctcattcagaaggaagattttgtaactccatgtattccaattatttttaatggaaattcagcaatttgtcaacccttgtggtagccacttgaatattacagacatttgctgaattggcagttaaataagaaatgccgtccatgcaataggatccaaagaatgcggcaaacattttccatatatttatttatttctccaaaacatcaaacctcaagacagatttgtccgtgcaatagggtccaaaagacactaatatttgagtttgtatttttttctggacccactgataaatagggaaactctgtgtatcgttattagct

SEQ ID NO: 11291 - DNA, 532 bp, Zea mays
  unsure (1)..(532): unsure at all n locations; Clone ID: LIB3279-186-Q1-K6-C9
ccccgcgtccgcccagcgtccgcccagcgtccggtcctccacacacacccacacacgccacactgaggagccctgagccctccgcgccttaaaccctagcgagcgagccagcgagaggtctcatccccaccaacaccacccaggagctccgcctctaccacctcgcgctgctgctcggcctcgtcgcctgggcggcggctgctgccacgggagccgaggcgcagccggtgtgcgacccctccatcatcgccacccagatcgcgctcttctgcatgccggacatgcccacggcgccctgctgcgagccgatcatcgcctccgtcgacctcggcggcggcgtcccctgcctctgccgcgtcgccgcccaaccgcagctcgtcctcgcccgcctcaacgccacccacctcctcgcgctctacgcttcctgcggaggacaacacaccgtgggcgctcacctcgctgccgcctgccaaggtccgtcacctcccgccaccgttcctgttatcgccccgccgccgnccgccgcgccccg

SEQ ID NO: 11292 - DNA, 559 bp, Zea mays
  Clone ID: LIB3279-186-Q1-K6-D1
gccagcggcggcggccaaggcgcgatgggagcggctcccctggcggcgtggtgggcgcagccccggcggctgtgggtgctgccccggcgtcccatggcgcgctaccctgagccccgtccccggtggcggcgccccctagccgcggccctggcggcacgggcatggcggctccggcccagtgccggcgcatggcgcagccgctgcccttgcagcgcgggcggccaggccctcggtggcgcgcgggcagcctgggcgctgccggccctagccacggcccggcggcccggccccggtggctccccgtggagcggcggctatggccccgtccctggctcgccagcgggcggccccggcgcggtacaggcgcgcggcccggccacggctcggcgcgacacgggcgctctatggcggtgcggcctaggccaggcacgcgggcgcggcaccgacgcgggcgcaaccgcgacagcccgaccacagcagtgcgggggcgcggcccctggtaggcgagcgggcgcgacccccggtccgggcgcgacggctcggcggcgcacgggcgcgc

SEQ ID NO: 11293 - DNA, 559 bp, Zea mays
  Clone ID: LIB3279-186-Q1-K6-D10
ctcatctcttacgaaggaagagttcagcttttggagattgcccaagtatccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttggtcggttcaagtccatccccagcatagttgagcttgacagcttgaaggtttctggtgatgtctggtttggctctggaattacactcaagggcaagggtgacattatcgccaagc

SEQ ID NO: 11294 - DNA, 598 bp, Zea mays
  Clone ID: LIB3279-186-Q1-K6-D12
gcgatttattatattattatgttttctctaggagaatgtgtgggtttgacgaagacgcgaagtcttgtaaggattctagtgcaatagaattggcagaaacattaaataattggcctcaaatgaattattacatcacactttgcaaatttgttcttatgccattgaaatactctacaggctatgtgctgtgtgcgttattaatcatgcaaacaaatctatgtctgtgtttaatttcacaccaactccagaatggtgcaaagatatactactaaaaagattttgggaagctattcttcttatttcgaagaaatataaggcagcatacggtgtcaaacgtattagatggtcacatgacatttatatgtggcgacattcaattcgacccgatgctccaatcgacataaaaggtcttaatactggtcattttgctctgcacattatgtagtggtgggatagtggtataaaagcacaacttagtatggatggtgcgactctgcgtaggaatttatttattaatctgttgacatacgaggggaacacatatcgatttaacattcctggacatatacaagagtacccttgaccgcattatggaaaa

SEQ ID NO: 11295 - DNA, 543 bp, Zea mays
  Clone ID: LIB3279-186-Q1-K6-D2
cccacgcgtccgcctctcgttgctccaataaagtgcaccgtctttccattggtcaagctcgagaaatttgaggctgttgccaagaagatctccaaggccctgacagcagctgggatttcacatatcatcgacatgacaggtaatacaataggaaaacggtacgcaaggacggacgagattggtgtccccctggcgatcacggttgatcacaccacgagcgtgacggtgcgcgatcgtgacagcaaggaccagatccgcgtggatgtggacgaggtggcctcggtggtgaaggaagtgacggacgggcagagcacctgggctgacatcatgtggaggtacccggctcacacggcctcggccgccgacgaggatggggcacagccctgaagaggcacagccacaacaccacccaacgatcgttggtctctgatagttccttcctgcgttccttaacagaaacagactgcattgttgtgtaagcctacagtagccagattcctgcacatttaaatttccacaaacaaatagtagcctctgtgttat

SEQ ID NO: 11296 - DNA, 663 bp, Zea mays
  Clone ID: LIB3279-186-Q1-K6-D3
ctctcgcccacccgccccggccccatgtcgccgcccctcgagccccacgactacatcggcctctccgccgccgccgcggcgccgccgaccccgacctcctcctcgtcgtcctcgtcctcgccggcgccccgcctcaccctccgcctcggcctgccgggctccgagtcccccgaccgcgaccgcgaccgctgcgaggacgtcgccgccgcgctctccctcggcccgctgcctgctacccccaaggcgcccgctgccgtctccgccaagcgcgccttcccggaccccgcccagcgccccggcgctgccaaggctagcgacgacaggcaggcctcccccgccgcgccgccggccgccaaggcgcaggtggtgggatggccgcccgtgcggaactaccggaagaacaccctcgccgcgagcgcctccaggagcaaggcgccggcgccggcggcggaggacgccgcgtctgcggcccggcccatgtacgtgaaggtgagcatggatggcgcgccctacctcaggaaggtggacatcaagatgtactccagctacgaggacctctccgtggcgctcgagaagatgtcagctgcttcatcgctggtcaaagtgtcctgcataaatcatcgagcaaaccaggctaactaatggctcgagagtggatgccct

SEQ ID NO: 11297 - DNA, 598 bp, Zea mays
  Clone ID: LIB3279-186-Q1-K6-D4
gccttttgttgatgtcctcaaggaggaggcgtcctccctggcatcaaggttgacaagggcaccattgaggttgttggcactgataaggagaccaccacccaaggccatgacgaccttggcaagcgctgcgccaagtactacgaggccggtgcccgctttgccaagtggcgcgctgttctcaagattggccccaatgagccatcacagcttgccatcgacctgaacgctcagggtctggctcgctatgccatcatctgccaggagaatggtctggtgccaattgttgagcctgagatccttgttgatggccctcatgacattgatcgctgcgcttacgtcactgagaccgtccttgctgcctgctacaaggcgctcaacgagcaccatgtcctcctggagggtaccctcctgaagcccaacatggtgactccaggctccgactccaagaaggtgactcctgaggtgattgctgagtacaccgtccgtaccctccagaggaccgtccctgctgctgtgcctgctgttgtcttcctctctggtggacagagcgaggaggaggccaccccgcacctcaatgccatgaacaagctcagcacca

SEQ ID NO: 11298 - DNA, 534 bp, Zea mays
  Clone ID: LIB3279-186-Q1-K6-D5
agtgcgcgcagtgccacacggtcgacagggcgccggccacaagcaaggtccaaacttgaacggtctttttgggagacagtcgggtaccactgcaggctactcctactctgcgggaaacaaaaacaaggctgtagtctgggaagaagacactttgtatgagtacctgcttaaccctaaaagtacattcctggaaccaagatggtcttccctgggctgaagaagccgcaggagcgtgctgatctcatcgcgtacctgaaggaagcaactgcatagttcattgacatgccttttgccatgaagagaaaaattgttttgcagtttaataaaaaacattttagacaatttgggtcaccctgtttgaacagggtgcaaccacgtctcattattttcgttcttatggtgtcggtatggaatgcctaggtgtttagctgtgcacaaataacagttaaactttgacggctcctatttcaactgctggagaaatgccagtgccctatttttgaccaccagggtgtggaatggaaatcggtaatg

SEQ ID NO: 11299 - DNA, 620 bp, Zea mays
  unsure (1)..(620): unsure at all n locations; Clone ID: LIB3279-186-Q1-K6-D6
gcgcgacctgatcgtacggccggggaggctgccgcgcctcctgacctcgcttccgcctcgcctccccgaccggaccagcggcctccgtctgaagatgcagggcggcgtctccggattccagaacgcgccggtgacgcgggcggtcgtcgtcgcgagcggcctcctgtccgtcgtcttcagcgcgcagcggcgcgcccgcgccctcggcatctcataccaggacactataacgaattttcgtttatggaagatattcccatctgtatttgcttttcagtcaacaccagagttaatgtttggactgtaccttctgtattacttccgtgtgtttgagaggcagataggctctaacaaatactcggttttttgtctcttcactatcacagcatcatcgctcctcgagatcctgtcattggttatcttgaaagatacaaattacatcagcacgcttgcatcagggccttatggtctcatatttgcctcttttgttcccttctttcttgacattccaatcacatcacggttccgtatttttggtctgaatttcagtgacaaatcattcatttacttagctggttntcagcttcttttatcttcttggaagcgctcccttattcctg

SEQ ID NO: 11300 - DNA, 564 bp, Zea mays
  unsure (1)..(564): unsure at all n locations; Clone ID: LIB3279-186-Q1-K6-D7
ccccgcgtccgcccagcgtccggcgggcgagtacttcggggacaagatccacggcttcggcgtctacagcttcgccaacggccactgctacgaaggctcgtggcacgaaggcaagaagcaggggttcgggatgtacacgttccggaacggcgacaagcgatcgggggactgggattctgggacgctcaagacccccttgcccccggccgatccttctgtccagcgagccgtacaggctgcacagcgagctgcagagaacgcgtttcgcttgcctagagttgatgagcaggtccacagggcggtcatggccgcgaacagggcggccacggccgctcgagtggcggcgatcaaggcagtccagaacaggatggatgggaagttttgtgagacctatgtgtgaattgctgtgtgcgagaccatgtttcgctctctctttctaactgtacattagggtagggaaggacaataactaatcagtgaggtgaggtgagacgacgaccggngcagcacaaccgcgcgctttcgagtcagggttcagcaacgagacgacgggagcctgtctga

SEQ ID NO: 11301 - DNA, 512 bp, Zea mays
  Clone ID: LIB3279-186-Q1-K6-D8
gcgaataggagacctatcgattgaatttgtgcagtgaagggagtcttgtccataggatatgttctcttaacgtaaatgtttaatgagtttgcacatggtgcatattgagtttgttgccaccataaacctgcaccaagatatgaaacaaatatcacaatgaaaggagacttactgattgtccaagcaagactaaaaaagctaggagaaagggagccagtgcaatcttgtacgagtttcttctaaacatgcaaaagctaggagaaatggagcgaggtgcaaccttttatgtgtttattctaaacttgcaaaagttatctatattttcgtatagagtgagtcaggtagcattgaggatacatcatagcataaataactttgcattggaattaactatctcttttgtattggattagaaagtaacgacaatttagccttcatcagctattaggttcatagactttgaagcaataggttgtacttctcaagctatgggacaccacatatttttttct

SEQ ID NO: 11302 - DNA, 567 bp, Zea mays
  Clone ID: LIB3279-186-Q1-K6-D9
atctgctctgagtaaatacagcttgggacaggtagtacctcgcggtcgtcggtgaccttgagcacgagcttcccctcgcagtgccggtacttcatcacgtagcgggtctgcagagaaacgcgcaaggatcggacacacggacaagcaggaagaaactcagagaagaggagaggggatccggcgacgggcgtacggcgttggggtcgccgcggaagagctgcacggaccgctccacgaactcgtcccaggaatccacgtacaccatcggtgtggcggagaagaggagcaagtggcgtggccggatctggatgggaaaccttgctggacgaagagtccgccgcggtttagatagggtttgttttgcgcccttgttttgctcctcttcccgacgagctttttggaaccaggtatcaccaagactggacttctaaaaaatagtatttcaaacattttaattggagttttattattataatccgttcaacattggttttttgctatcggagtgtgatttagccgatgtcgagctactagtacgcgttgttatagcagtccatcttattgccc

SEQ ID NO: 11303 - DNA, 624 bp, Zea mays
  unsure (1)..(624): unsure at all n locations; Clone ID: LIB3279-186-Q1-K6-E1
ggggcatcgacggctcgacgcatcggctaccgcnacagcctcaaagctgcgtcggtcgccaccccctctagcagggcacacggagctcgatttcaccttgccgtgtgcgtcatgctatcacgcgccgaagccgatgccggcagtcgtcgccggcctggcactcgcggccactgcgagggtctcacccccgccacgaggagatgaccgccgtgcaggtacggtcgctgcacctcctccccgagccgccaggagctccgcgcaagagggccacaacggccgctcaaagagccagctgaacgacatgttgctgcatctgccgatcggcgccagctcgcgccccggcgggcagcacggtgcagccaccgaccgtgcagcgcgaagaaggtaatggttgctacagttcgatgtgatgaaattgcaaacgagaagtttggatgcataacctcagacacagaatggttggatgtggagagtgctgtccaatctggtccagtacctggttttggaaaaaaacttggcaatatcgtcgacgttcacttgcaagagtatgacaaagaagctgtctattntgatgaagctgtaagggaaaggaaacgacagcatttggagtccagaatactgaat

SEQ ID NO: 11304 - DNA, 589 bp, Zea mays
  Clone ID: LIB3279-186-Q1-K6-E10
ctcctactctggctaccaggacgagctgctgtgggcggcggcctggctgcacatggcgacggcggcgcaggggaactcgtcgtcgtcggacatgtacctgtcgtacatctactccaacgggcacatcctaggcgcggagcaggacgacttcaccttcagctgggacgacaagcgcgtgggcaccaaggtcctcctctccaaggcgttcctgcagggcaagggcaagggcaagggccacgcggatgacgacgcgctgcggctctacaaggcgcacgccgacgcctacgtgtgctcgctcgtgccgggcgccgcgggctttcagccgtcgcagttcacgccggggggcctcctgttcaaggagggcgacagcaacatgcagtacgtcacctccacggcgttcctcctcctcgcgcacgccaagtccctcgccggcgcgcgggtctcctgcggcggcggcggcgcgggggtgccggcgtccgcgctggtggccgccgccaagaggcaggtggactacatcctgggcgccaacccggcggggatgtcctacatggtgggggttcggggcgcggtacccgcggcacgtgcacca

SEQ ID NO: 11305 - DNA, 619 bp, Zea mays
  unsure (1)..(619): unsure at all n locations; Clone ID: LIB3279-186-Q1-K6-E11
cccacgcgtccgcccacgcgtccgctggaggaatgatattttagttgttatgtcttctggaggatgacagcaagtctttttagttgatacagcgtacgaaaccaaaatcgtggcgaatgagcaggctgagtatttagtagtgcctagcagtagtaataccagtacaaaaatgtacagagactagtttcagatgcattgttttaaaattttcgactggtgttaagcattgagcaccgaccaggtgtccttgtttttggtggtaaagaaaaattgatcacaagtatgtgacagcgacagcgatgaatggatgcaggtcgttcgagtcccggccatcggggagagcaacgcggtggacacaactggagcgggcgacctgttcgcgagcgggttcctgtacgggctggtgaaggggctgccgctggaggagtgctgcaaggtcngggcgtgcagcggcgggtcggtgacgcgggcgctcgngcgggaggtgcggccggagaactggcagtggatgtacaagcagatgcacgccaggggcttgctgctcccggagctcaagaactgaatgaaactattgctgctgtagctttagctagctaaatgcctgcatgctgcaccagct

SEQ ID NO: 11306 - DNA, 479 bp, Zea mays
  Clone ID: LIB3279-186-Q1-K6-E12
ttttgtttgggaagtcatcaaatcagaagggagccgtggtggactgggtgaagaagatgcaccaagagaagcagctggacatacttgtcgacaagggcctggggagcaaatatgaccgcattgagctggaggagatggtgcaagtagcactgctatgtactcagttcctccctggtcacaggcgggagatgtcagaggtggtccggatgctggaaggtgatggacttgcagagcggtgggaggcgttacaacacactgagtcacacaaattcaaggtgcccgagttctccttcagccgctgccactctgacctgacggacgactcgtcactgctggtgcaagcagtggagctttctgggccaagatgacaccaacggagaccgttgtttcccagtagaaaatgtaaataatacaaagtgaagcaactggtgctgcatcctgtcagaagtcgaagcaaatctcaatcagctgaactgtac

SEQ ID NO: 11307 - DNA, 625 bp, Zea mays
  unsure (1)..(625): unsure at all n locations; Clone ID: LIB3279-186-Q1-K6-E2
gccccagcagctattgtggtcgtccctcagccgcgtcgcaccgcatcgcattctacgattcgaagctctctctgctcgcagccatggcgaagaattacccaaccgtgagcgccgagtacagcgaggccgtcgagaaggccaggcgcaagctccgcgccctcatcgccgagaagagctgcgcgcccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgatttctaccagcttgccggagttgtggccgtcgaggtcaccggtgggcctgagatccccttccaccccggcagggaggacaagcctcagccgccacctgagggccgtcttcctgnatgccaccaaggttctgaccacctgaggcaagtctttggcaagcagatgggtttgagtgatcaggacattgttgccctctctggtggccacaccttgggaaggtgccacaaagagcggtctggttttgagggggcctggactac

SEQ ID NO: 11308 - DNA, 628 bp, Zea mays
  Clone ID: LIB3279-186-Q1-K6-E3
cggtcgcgtgggcggacgcgtgggcggacgcgtgggaaagaagaaggcatagcagcgggcagcggcatgggcaccagccccgtcatccctgcgacgatgctcttcgtcgctcttcttgtcgctgtctgcttcggcgccaccgccgccaggtccagccacgcccgccacaccgacgccgacgacgcgattcgtctccccagcagctttggcgctggtggtcgaccgtggaattgctgcgactccgctatcaaggacgcctccctgccggcgtggcgctgcaacgacgtggtggacaagtgctccgccgactgccaggactgcgaggcgtcgccggccggcgacggcttcgtctgcggtgactttatcttaagcctgaccgagcccccggtctgcacaccgaggccgtgggactgctgcgacagcgtggcctgcacaagggactacatccccaactgcatgtgcctggacaaggtggagtcgtgctcgagcaactgcgaacggtgcgagtttctgtatcattcggaccctcctcgcttccaatgccgagacatcttccacggctatcctggtcccaagtgccagacatggatcaatacgagcaactagcttcactcaactacttgctaaa

SEQ ID NO: 11309 - DNA, 599 bp, Zea mays
  Clone ID: LIB3279-186-Q1-K6-E4
cccagcgtccggtttatgctgcactacctggccgaggcattgatcgatacccatctggatggtttgggcacacgacacccggtggtcgcgtggacgatgcccagccacgcgtgattaagcctcaacctttggtccttgctcacggcgaagctctgaaaatgaagggcaactcgtgcaagctttttggaatccatctcgacagcccagccaaatctgaacctttgaagtctccgccaagcgttgccacaccggcagctgagaagtggatggcagacggaatcgacgcagacaaaagccctgagccgcacaagacgccaaagcaactcggtgctacacaggtggatcctgtcccagagagatgcccacaagcttcaaggggcacacagtgcaaatcacaaggcgggtcgactaggagctgcaagaaggtccacaagcaaggaatggcgctgggcaggtccgtggaccttaccaagttcaacggctacacggagctggtggcggagctggacgagatgttcgacttcaacggcgagctgaaaggctgtagcaaggagtggatggtcgtgtacaccgactacgaaggcgacatgatgctggtc

SEQ ID NO: 11310 - DNA, 269 bp, Zea mays
  Clone ID: LIB3279-186-Q1-K6-E5
tttgtctccaaaagtgccttctgttgggaccatgcttcgtcgccgaagtcctgaaggaagaaacagtttcggttgaagctgtctgtacgtaatgccgaaggatgtcacccatgaagcttcggagttacaaaccgacttaaagatagaatgaccttttagtccataagagtttgagtcgatgttgtaaacttttatgaggggtatgattgtaattgttcacaggcagtgtcctgtgcctataaatactaaacagtattcctttactgttc

SEQ ID NO: 11311 - DNA, 584 bp, Zea mays
  Clone ID: LIB3279-186-Q1-K6-E6
actcaacacagcacaggcagttcgagtgggggtggagtagagagagagagataaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgccatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccggcgtcgtgctctgggagtggtgcaagggcgagaaccagagctggaagatcctgccggggggttccgaagccaac

SEQ ID NO: 11312 - DNA, 106 bp, Zea mays
  Clone ID: LIB3279-186-Q1-K6-E7
gtctgcatgcatccttaatcatatgcaggcactctgtacatatctgacttggctcagttaataggggactgtgcttgccccaaatggaggcagggccgtttgtgtc

SEQ ID NO: 11313 - DNA, 611 bp, Zea mays
  Clone ID: LIB3279-186-Q1-K6-E8
cggacgcgtgggccgtcatgaagtcgcagcgcaacgcgctcctcatcgccgccgcgctcctcctctactggatcctcttctccgtcacccagctcgtcgtcaggctcgaccagatgcagcagcgcgtcgacaagctcaagaagcgcgacgactgatggggctcgcgttcgcgccttccccgcgtccacccggtggtctcgttcttccctcttcctcgtatttctgttttttttttaatgttggagtgcggatgtcttagatctcgatcgtaatttgaggcatggtgcttcctttgcccttaccgtcttcagataaaaagaacaacgctctttgaaatgatgatatatttaggatgtttggacaaatggtatcgtaattgatgtgttcaccaatgagttgattggtttcactcgagatacaccgagatatgggtctagttgccatccttgagatattggttattagctactagtgctgttttgatgatgtgactgagcttatgttgtaatgagctagttcttgttcagaataagctgacattaggggccggattttatatcttttgtataaaaaagagctccacttggagctagtctgtagctgttctagtc

SEQ ID NO: 11314 - DNA, 638 bp, Zea mays
  unsure (1)..(638): unsure at all n locations; Clone ID: LIB3279-186-Q1-K6-E9
gccgccgccgctgcccgcatccaaaggggctcatccgctacctctacatcgtcatagacctctcccgggcggcttcagagatggattatcgtcctagtcgaatggctgttgttgcaaaacatgctgaggctttcataagagaattctttgaccagaatccattgagccatgttggcctagtgacaattaaagatggtattgcccatcgacttacagaaatcggagggagcccagagtcacagattaaggctttgatggggaagcttgagtgttctggtgattcatccctgcagaatgctctagacctcgtacatggttatttagatcaagtaccatcatatggtcacaaggaagttctgattttatactctgccctgaatacatttgatcctggtgatatcacggagacaatagcaaagtgtaagaagtcaaaaattagatgctctgttattggtcttgctgcagagatcttcatttgcaaacatctatgtgaagagactggtggatcttacacagttgcactggatgagtctcatttcaaagagttgttactggaacatgctcccncacctccctgcatagcagaatatgctgcagctaatttgattaagatgggctttccacagnaggggtgctga

SEQ ID NO: 11315 - DNA, 447 bp, Zea mays
  Clone ID: LIB3279-186-Q1-K6-F1
gggcctgttgaggaggcgcagaggctggaactgtctgtaagaaggccgattcattttagctgggctctgcatgacacgtctgaagatacgacgcgcaaggacactgcactgcactcttcaccaggattctgtttccattggctctatctgccttagtaggaagcctggcgagcttacctatgatctgggggtgttgtagtggccttcttgcaacccatagtatgttcctaacatcagtgatgagttcacactggactcatatggggaggagagcgttcctccatcatatgttatagctctgagattggtaagctatcacgatcattcggctaggttcacgtttgctctgtgttgttctggcatgtgatgactgacttcattcgcctgcgcgtcagatcttggcgacatgctcgtggaaaacacatagtggtcttagtgcatttttat

SEQ ID NO: 11316 - DNA, 458 bp, Zea mays
  Clone ID: LIB3279-186-Q1-K6-F10
atagtcggaatcgctcacgtagaggatctcgagtcaatcaaggatgccagcaagagagcagagtgcgagcgtgctgccctcaactgtgcgaagacgatcctcaagggaagacaccagtttgagacggtcgagcaagtcgtcgagcatatccagtcattcgatcaggactgagaagacgacagtctatttgtgcgctgaagcctgaaggagccatactctcgtcaattaacccacgcatgcccgagtatcgatgaatcgtctgttttgtagtgatgaagcgaccggttgtttgtgatttctgtattggttgctaggtgagaaaagtacccatttgtgtgtgtggtctcctggcttgaactgtgtgtacactttccgggccggcatagcgagcagctcaataatgaaatgcatattagtgcatataaacacgtgtattaccaataaattttgttctggtg

SEQ ID NO: 11317 - DNA, 287 bp, Zea mays
  Clone ID: LIB3279-186-Q1-K6-F11
ctggtaatatggaccattgagaggcccgccgtaagatgttggtggcaaggttctaggtttcttttattgaaaagtgtttttttgagccacagatgcgtccaagaactcgtctgatgttttgaggtttgttaagactgggtgtccgagcctttgtggtttgttaagacagcgatgtgtcatgtatttcagaaattgggatttttatgagatgtacctgcgagagccctgtctgtttcgattttcagatattggttttgatttatgcgatacaaacaggtcctttagtc

SEQ ID NO: 11318 - DNA, 640 bp, Zea mays
  unsure (1)..(640): unsure at all n locations; Clone ID: LIB3279-186-Q1-K6-F12
ggnaagattaatgaagggatggtggtttgtgcgggccaaaaatgatattggggtgtttgatgcccttaagaggaaatttcagtgtgcaaccctacagctggattttcagctgcccattcggttcaagctggcttattctgctgaggatgaagccaaaattgaaaggcctgtggggggggggggggcaatcctaggttcggttgaaaggatgcttgccattcttttggagcattacaatggtaaatggcccttatggctaagccctcgccaggccattgtttgctcggtatcttctggttcagtggaatatgcgaaacaggttcttgccactctacatgaagctggttttcatgttgatattgacgcgagtgacaggacaatacaaaagaaggtacgggaagctcaactggcccaattcaactacattcttgtcgtaggtgcacaagaggccgagactggaaatatatgcgttagggtaagagacaatgctgacctggtcacaacgagtgtagatggcttcatcacacgtttgagggaggaaatcgcagccttcaaatgattttgatgctgcataatttcctactactcgtttgtgattttgacgagtttttaatgaccagcatcgagttcctcgggttac

SEQ ID NO: 11319 - DNA, 642 bp, Zea mays
  Clone ID: LIB3279-186-Q1-K6-F2
cgaccagtctcctccgcacgcttcccaccgagctcacacactgcacactcccacactcccactcccacctgtaggttcacgggaggcgaggaccctgccccccctgcattcttcccgtatcgcggaccgatcctcgccgcgggaggcgagcggagcggggcgtttctgcgggggagaagcgcgtccctgcaatttctgagagaggggaggcggcgagtgggaaaagagcaggcgttgctatcctatcttgctgacacagcggcggtgtggcgaggcgcatggcgagggcgcgcggtggcgccgcgtggtgggtgctggcagcggcgtgggtgctgtgggcggctgcggctgcggcggaggcggaggccaggtcgccgtcggcgaggagggtgcaccggcacctcaagcgcctcaacaagccggccgtcaagagcatcgagagtccagatggagacatcatcgactgcgtgcatatctcccaccagccagcgtttgatcatcctctcctcaagaaccacacaatacagtttaggccggcgtacccaccctgaagtctatacgatgataccaagagcagcataggctcaaacaatgctggcgagaggccgatgctccagatgtggcatcgaatggcaggtgccc

SEQ ID NO: 11320 - DNA, 664 bp, Zea mays
  unsure (1)..(664): unsure at all n locations; Clone ID: LIB3279-186-Q1-K6-F3
aaaggctgagcagcacacactgtcatccgtctggtcaaggactgtacccattgttctttattttaatgagcctgtcaaaggattaaatcattcaagtgtgaacttaaagtctgatttggagttcggtaaggatatccaatggaggcccctcacaatggcagactctgggtactctaaatgttgggccacatatcttcaaattacaaatgaatgtagcagtttgcaggaatattctgttgaaatgagcataccctgctcggatgacattgtgtctagaagtggctctaactacaactgtcctgtgcattttacattttacattgaactgatcagcaacaacgcagcccagggtttagatacgtttgataagccagttgcctggaattgctcagactcattccagtctcatggaaaccgtgatcctatccctttggatctgctaaacattactagtgccttggtcgaacatgactcagattggcattttgaaaggctgtctgaggagatagatcttttcagagagttagctgatgacaataggttatgctctaaattcgttctgaatctccttttccatgattataacccanatgccataacatactcccttttccagcaagtttgggaagttgacattagncccgctattgcttgcttgtgctgc

SEQ ID NO: 11321 - DNA, 592 bp, Zea mays
  Clone ID: LIB3279-186-Q1-K6-F4
ctgctccccctcccccgaccagcctcaggcatcgccggcgccgcaacatcgctgaggaagcccgcacccctgcccggatccgatggccaacagcaacctcccgcggcggatcatcaaggagactcagcggctgctcagcgagccagcaccggggatcagcgcgtcgccctcggaggagaacatgcgctacttcaacgttatggtccttgggccggcgcagtcgccctatgaaggtgcaagcttctgattcggatttttttatgcgctgttcgtgctgtgtggtgtggtgactagagtggtaatattggagtgcttccagatatcgatagtcgagtcgaatcgaatcgattcttttcaaaagatgccactggaaatggcagaaatgctgaaatgtttgctctagtttatgcgcacataggtaagcttgtatagtttggtcggctggtgacttttggcttgtcaattttagtttttgggcggtattgtggctgatgagtcttagcttctatttgcagaattctgttagctatgttgaagggcaggtaatttgagtaatgttttgcactagtatagtatgtgatagttattacta

SEQ ID NO: 11322 - DNA, 671 bp, Zea mays
  unsure (1)..(671): unsure at all n locations; Clone ID: LIB3279-186-Q1-K6-F5
gcattcgttccaactcctgnacactttctcctcgtcccagacaagccaatcgaagccgagaaacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtaggctgcagatgggacgaatgtgcttgtatgtgtatgtgtcctgctgcagttgtcctttgc

SEQ ID NO: 11323 - DNA, 631 bp, Zea mays
  Clone ID: LIB3279-186-Q1-K6-F6
cggacgcgtgggcctgagcctctttgccaggtcatgcttcgtgttggtgaccttgagcgttctatcaagttttatgagaaggccctagggatgaagctcctaaggaagaaggatgtacctgattacaagtataccattgccatgttgggctatgctgatgaggacaagacaactgttctggagctgacgacaactatggagtcacagaatacagcaagggcaatgcatatgctcaggttgccattggcaccaatgatgtgtacaagagcgccgaggcggttgatctggccaccaaagaactaggtggcaagattttgcggcagccagggcctctacctgggatcaacactaagatcgcctcttttgttgatccagatggctggaaagtggttctggttgacaacaccgacttcctcaaggaactccactgaaggctcgggatacccaggtgctgtgctaggatgtagtaatgcttgtctgtggtgtaataagatgtgggtggtttgtttccgccctgatgaacttataatactgaatgttgctacagaggttgtgcttctgccaatgaggtttgggatttgctatgtaactgtgcctgcgggctccgattctggcgctgttcatacactgt

SEQ ID NO: 11324 - DNA, 634 bp, Zea mays
  unsure (1)..(634): unsure at all n locations; Clone ID: LIB3279-186-Q1-K6-F7
cccacgcgtccgcggccgcgtggngaaacaattgcctcgcacgagctcttttcgttgaacagtatagactgagaatggattggggaacaaggcataagatttgccttggaatagcgaaaggtctagcatatttgcatgaagagtctgcaataaggatcgtgcacagagatataaaggccagcaatatactgctcgacaaagatttgaatgccaagatctcagattttgggctagcaaagcttaatgaagatgatcacacccacataagcacaaaagtagctggaactatcggttacatggctcctgagtatgctatgcgtggttatttaacagataaagctgatgtatacagttttggtgttgttgttttggaaattgtcagtggaaaaagtaacacaaactacaggccgaaggaagactttgtttatcttttagattgggcttgtgttctacatgagagaggaactctactggaattggttgatccagatctaggatccaattactcgacagaagaggcgctcctcatgctgaatgttgccctgctatgcacaactgcagcgcctacactcagaccaaagatgtcaaaagtttgtagcctgcttgaaggcagtgccccattgcagcctttgct

SEQ ID NO: 11325 - DNA, 648 bp, Zea mays
  unsure (1)..(648): unsure at all n locations; Clone ID: LIB3279-186-Q1-K6-F8
cgcctcctcgcggctttacaggatgttcaagggctcgncagtggaagaatgtcaccatcaagaccgcgctgatgttccctggcatcgtgtttgcaattttcttggtcctgaatgcactcatctggggcgagaaatcttcaggcgccgtgccgttcaccaccatgtttgctctggtactcctctggttcggcatctccgtgccgttggtctttatcggcagctacctcggcttcaagaaacctgccatggaggacccagtgaggacaaacaagatagcacggccaataccggagcagccatggtacatgaacccggtcgtctcggtgctgatcggaggcatcctgcccttcggcgcagtgttcatcgagctcttcttcatcctgacatcgatctggctgcaccagttctactacatctttgggtttctgttcctggtctttgtcatccttatcctgacctgtgcggagatcgccatcgtgctctgctacttccagctctgcggtgaggactaccagtggtggtggagatcctacctgacgtctggctcgtcagcgctgtacctcttcctctacgccacgttctacttcttcaccaagctggaaataacgaagaccgtctccggcgtcctatactttggctacatgctca

SEQ ID NO: 11326 - DNA, 511 bp, Zea mays
  Clone ID: LIB3279-186-Q1-K6-F9
cccagctccccagcaccagtccccattatttggcctccgtcagagaggggagaaagacccgttcgaggcggcggcgatgtcggggcgcggcaagggcggcaagggtctaggcaagggtggagccaagcgccaccggaaggtgctccgcgacaacatccagggcatcaccaagccggcgatccggaggctggctcggaggggcggcgtgaagcgcatctcggggctcatctacgaggagacccgcggcgtgctcaagatcttcctcgagaacgtcatacgcgacgccgtcacctacaccgagcacgcgcgccgcaagaccgtcaccgccatggatgtcgtctacgcgctcaagcgccagggccgcaccctctacggcttcggaggctaggcgcctcttcgtagctggggaatgcttagggtgatacgtctctgtcgctgtgggtcgtagtgttgctgcgttcctggatgtaatccatttttttttctgcaatgaagagatgctggcaagcat

SEQ ID NO: 11327 - DNA, 628 bp, Zea mays
  unsure (1)..(628): unsure at all n locations; Clone ID: LIB3279-186-Q1-K6-G1
gcgaatcacagacgcgtctatctcagcttgctgcgctgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccgccgcgctgcccagcaagtgcggcgtcgccctgccgtacaagatcagcaccaacgttaactgcaacacgtacggctgactacacacacgctcctgcatgccgtgttctctcgttccaatactgctctgcagctagattattaccattgcgcttgcgccggccgttctgtgtttctggactacaccaacgtgctngaaacctgntnctctctctctctggctggttctctttgca

SEQ ID NO: 11328 - DNA, 598 bp, Zea mays
  unsure (1)..(598): unsure at all n locations; Clone ID: LIB3279-186-Q1-K6-G10
gccatggnaaaattaatgaaggggatggtgctttctacggcccaaaaatgatattggtgtgtttgatgcccttaagaggaaatttcagtgtgcaaccctacagctggattttcagctgcccattcggttcaagctggcttattctgctgaggatgaagccaaaattgaaaggcctgtgatgatacacagggcaatcctaggttcggttgaaaggatgcttgccattcttttggagcattacaatggtaaatggcccttatggctaagccctcgccaggccattgtttgctcggtatcttctggttcagtggaatatgcgaaacaggttcttgccactctacatgaagctggttttcatgttgatattgacgcgagtgacaggacaatacaaaagaaggtacgggaagctcaactggcccaattcaactacattcttgtcgtaggtgcacaagaggccgagactggaaatatatgcgttagggtaagagacaatgctgacctggtcacaacgagtgtagatggcttcatcacacgtttgagggaggaaatcgcagccttcaaatgattttgatgctgcataatttcctactactcgttt

SEQ ID NO: 11329 - DNA, 516 bp, Zea mays
  unsure (1)..(516): unsure at all n locations; Clone ID: LIB3279-186-Q1-K6-G11
ggggtaagcccgccgccgccccggcccccagcaaccagcagatcgggacctctgttctgcgcaatccatccatggcggaggaatcaggccgtcccttgccaaagtttggtgaatgggatgtcaacgatccggcttccgcagacggatttactgtcatattcaacaaagccagagatgagaagaagggtgggaatggtcaagacacagactcaccttccaaggaccccaggactgagagggtggagtcttatgctgcaaaaccaagcacgaagaaatggttttgttgtgtgacagccagccctacgcaatcctgaggaaggcaattgcatgcgctggaaatactgcccctttaattttctatacatactatccataagacactgtagaggtacccatggctctctgggctccaggatgggtgtctcataaaactctggcgtgcatgtatgtatggtgtgagagttgtcggcatacatttgcaaagtggacttctgcttgtaattctaaaaanaaaaa

SEQ ID NO: 11330 - DNA, 540 bp, Zea mays
  unsure (1)..(540): unsure at all n locations; Clone ID: LIB3279-186-Q1-K6-G12
gggggggggggtttcaaatgatatttgctcgcatttcatctaaacgatcgaccaggcaccaaattggccgggtacatcccccctcatcaggagttagcagacataaaaattctaggctctctaggtttttgttacaatagctacatcagggggggggggcgacacatacatcaaaaaaacacacaacgcacaccggggggagccataaataatacatggctgcagtggggggcgactctacatggccccccagcgggctgtgaaaacgcactggttgatgatgggtgttgtggttagataggaaacacctcatctcatctctgtcactttctcattcacctgtctctcacctagtgttagcctccggtttgtggcttcctttcccgttgctgttattactagatttcttgtggagctggccctcntcntcatgatgctgctgcgcctttggcggctcgatgctcattcccagtgtggttgtgacacttggtaccaatagacgtgaattttctgcttccatgtcttggcaagccttcctca

SEQ ID NO: 11331 - DNA, 641 bp, Zea mays
  Clone ID: LIB3279-186-Q1-K6-G2
cacgagaagtcgagaccacgccttccgtgggatcaatcggctagggtttcggagatgttcggccgcgcgccgaagaagagcgacaacacccggtactacgagatcctgggggtttccaaggacgcgtcacaggatgacctcaagaaggcctaccgcaaggccgccatcaagaaccaccccgacaagggcggcgaccccgagaagttcaaggagctagctcaggcttatgaggtcctcagcgaccctgaaaagagagagatctatgaccagtatggcgaggatgccctcaaggagggaatgggaggcggtggtgggatgcatgatccctttgacatattccagtcattctttggtggtggaagcccttttggaggtggcagcagtaggggcagaaggcaacgacggggagatgatgtggttcatcctctgaaggtttctctggaggatttgtacaatggcacatcaaagaagctctctctgtcccgcaatgtcctctgctccaagtgcaatggtaagggttccaagtctggagcttcgtcgaggtgtgctggttgtcaaggttctggcttcaagtccaaatccggcagttgggacctggaatgattcagcaaatgcagcatccttgcaatgagtgcaagggt

SEQ ID NO: 11332 - DNA, 463 bp, Zea mays
  Clone ID: LIB3279-186-Q1-K6-G3
tataaacgaatggtatgcgtggaggcggctgctattgaaaagatgtcactctgaagcctggtgaagagtggactggaaagttggaactttctgctgtgccatctagctattacagtggtcagctagaccctgaccgtgtgattcaggattccactgtcccggaggactccatcagctagtccttattctatttttgcaggtagagcattgtatcattatgcataagagatgctggcaacaagggctgtccacatgtttcttccattctgttcaaatcttcggtgtttttttattccgaatgcatatccgaaccaaggaatgtgaaattggtttccgctttttgaggatctatgtagcataatggataagtcggtgtttcgtaccctatttagggatgcttgaagcaagaaacatcttcatgggttgtaaaataaaagaaaaattctctttattatatttgatc

SEQ ID NO: 11333 - DNA, 451 bp, Zea mays
  Clone ID: LIB3279-186-Q1-K6-G4
gactccgccgccaccgaccacaccggcggtaagccggcggtggccaacggcggcggccacggcgcggcgaacggcacggtcaacggcaaggacgtcgcagtcgcgatcgcggtctgacgagagtacgtgctcgcgcacctccctgcttctaccgggctgcatcctgcagcatgcactgtgcgagcacagccgatcagcgccaataaactggaggataagaacgactggtagctgtgtgtgtgtgtgtcgtgcgtgcccaccggccatatcccggtgccgcagcacgtgctattgttacgtgttgtactgccaccagcgtacgtgtctgtgtgtctcgatcatatctgtacgtttttagatttagaaggggaaaaaaagtatgtccgtgtctgtatgtctggatcatatctgtacgttcttagatttagaagaaagaagaaaaacaatatat

SEQ ID NO: 11334 - DNA, 585 bp, Zea mays
  Clone ID: LIB3279-186-Q1-K6-G5
cggcgtgctcgtgactcaaccaggcgtgcctccgctccggtcacccgtcactccacgcaaccatgtcgaggaggaagaccagggagcccaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgcgccaccggaggcaacaagaccaagacccctggacctggtgcccagtctgccctcagggcgcttgctcgttccggaatgaaaatcggacgcattgaggacgttaccccggtccccactgacagcactcgcagaaagggcggtaggaggggaaggaggctgtaggctctgcgtgccatttgccggctcttggcgggtggccattatgaagttagccctctctgggtggtgttgct

SEQ ID NO: 11335 - DNA, 206 bp, Zea mays
  Clone ID: LIB3279-186-Q1-K6-G6
ccccgcgtccgaattggccaagctgcgtgtcaaggccgagaaggcagccgaggagaagttggggtctcagttggagattcttgcccctatcaagtactgaggagctgtgctttgtcatcagttttggggaacatctagtctttgttttaagtgttcggtaacagtttgtgacagtataatctggtaaaccgtgttatttttctgcc

SEQ ID NO: 11336 - DNA, 598 bp, Zea mays
  Clone ID: LIB3279-186-Q1-K6-G7
cggacgcgtgggggtttccgcgtcgggtagtttggacgcatggctgctgcaggagagtagagaccacagcgcgcgaggcgaggagaataagctatgggcgcgccgaagcagaaatggacgtcggaagaggaggatgcgctccgcgccggcgtgcgcaagcacggcgccggcaaatggcggaccatgcagaaggaccccgagttcagcccggtcctctcctcccgctccaacatcgacctcaaggacaaatggaggaatttaagtttcagtgcaagtggactgggatcaagtaaactgcgggttccaaagataactggaccctcatcttccccatcatctagctcgcagcctctgcttctcccagcggcaaacaaatttactgaagctacactgcctgcagatgctgagaaaaagccacaggatgggaaaactctgccaaagtatggtgccatgatcatggaagctcttttggaattgaatgagccgaatggttcagatattgctgcaatcttcggcttcatagagcaaaggtatgcggtacaaccgaccttcagaagatttctagcctcaaagttacggcgacttgcagactcaaaca

SEQ ID NO: 11337 - DNA, 619 bp, Zea mays
  Clone ID: LIB3279-186-Q1-K6-G8
tctgtggtctgatccagacgatagatgtggctggggcatatctccagtggtgctgatacacttttggccaagacatatcggagcagtttaatcacaccaacaatcttaaactcgtagctcgggctcaccagttggttatggagggatacaactgggcacatgaacaaaaggtggtgaccatgttcagcgcacctaactactgttaccggtgcggcaacatggcgtccatcctcgaggtcgatgactgcaggaatcacacatttattcagtttgagccagctcctaggagaggtgaaccagacgtgacgcggaggacacctgattatttcctttgagttatctgccaggccatttttggattttgcccaatgttggaatagtgatgctggccagtaacaatttttgttggatctatatggtaacttaaccgaccagcaacagtaagaaaatgtggaacttaaccgaccagcaacagtaagaaaatgtggaagctgcatttgtcattgcaagaggtgctcgctaacttaaccccaagctgtcaaaagatccgcttgtctacccaacccacccagtggtgcctcccttgggcttttggacgtcgagtttacgctttcagcgt

SEQ ID NO: 11338 - DNA, 450 bp, Zea mays
  unsure (1)..(450): unsure at all n locations; Clone ID: LIB3279-186-Q1-K6-G9
agcgtccgtttttttaatcagtatcaaaatggagagtgcccccccccccaaaatgttttgtaggcattggacggccacctgaggagctgggtgctatcaattttgttctgcggtcattcaccaagcaggnaaaaggaagagcttgaagtcacgttccaaaggagcttgcaagctgtaagaattatgggacgggaaggattcaacaaaagtgcacagtttgtgaatactccacagccaccagaatgctgaatagatgagagcccaacgacacatatataatattaggttccataatcaaaaaatataatattaggttcgtctagttgctggccgccaacatgtatgtgccctaattgattagtagaggttttcatttgatcacacatcaagtcatgtaaattggattcacatattggtttcagattattatggggattatttgggatttaa

SEQ ID NO: 11339 - DNA, 617 bp, Zea mays
  unsure (1)..(617): unsure at all n locations; Clone ID: LIB3279-186-Q1-K6-H1
gccggcggcgnntctcggaggcggcgcgggcgccttcaaggacctcaccttcttgcagtcgctgcagcagctgtgcacggggtcggctgggtccgcgctggcacacctggacctcgccaccccggcgaccttcgacaaccagtactacatcaacctgctctctggcgacggtctgctgccgtcagaccaggcactggcgtcgtcggctgccgtgcctggggtagaggcggacgtcgccagcctcgtcgccacctacgccttcgacgcctccgtattcttccaggacttcgcggagtccatgctgcggatggggaggcttgcaccgggcgtcggcaccagcggcgaggtccgccggaactgccgggtggtgaacagctccgaataaagtcatgcatgctcacgctcaactatctggtcgtccgtgcggcttgcattgctgatttgttatcagctaagtcaagccagtaagtttgtttgggttaaaaaataatcggctttggcatgggaattatgataatggccatcgtttaaatagctactagtaggtgtcttgatgtactaatgtactatctacgctacgtactctgctgttcccaaataaatatttttaagacatt

SEQ ID NO: 11340 - DNA, 575 bp, Zea mays
  Clone ID: LIB3279-186-Q1-K6-H10
ctttcgcgtgggctccaactctcctggcggggggggaagaaaacaaaagggtaccggaagcggcgaaagcctcgccccccgccgctctcgcatcgtctccggagcgcacgtcagatcaggtgtgccgcgcccccctcgcctaagctgcgacgaccatccatcgaacaggaaggatgacgggctccatggatctcccggccaagggcgggttcagcttcgacctgtgccgccggaacaacatgctggagaagaacggactcaaggtcccgggattcaggaagaccgggacaaccatcgtcggcctcgtctttcaggatggggttgttcttggggcagacacaagggcaactgagggccccatagttgctgataagaactgtgagaaaatccactttatggcaccgaatatatactgctgtggagcaggaactgctgcggacacggaggccgttacagatatggtgagctcccagctacagcttcaccgttatgcaacgggccgcgaatcaagaagtgtaactgctcttacactactgaagtcacacctcttcaagtatcaaggccatgtcagtgct

SEQ ID NO: 11341 - DNA, 629 bp, Zea mays
  unsure (1)..(629): unsure at all n locations; Clone ID: LIB3279-186-Q1-K6-H11
tttctcagnaactcctcaacgaactgagtgagcttgcggggttgaaacgggcaaggattgagcggatgaaggctttgaagaagatgaagaatgccaagcaagggtcctcgggtggcaatttgtgccccctgatcattaccattatcttctgcatcgtcatactgtggcaaggtttcttctgggggcacgagtcggcggtgagtttccatggatcgcccgagtcctcagtcagggcacacagcagtctgatctccatcaggttctacaagaagaaccattccaatgtgagaccacccagcgagaccaccgcagcccctgataacgtagagacagtttcaaggctcctggaaccgtaaccaagcgagaagaaggctagctcggtgaccgaacgctgcgggccgcggccaccaccacaggtacctgaacggaaaagctcgccacattctgaagcctctcaccttgacgaccggggctgtgtaaatcttccgagaccgccactggcgcttcctcctcgagcccctgctgtaaaaatgaacggactcctagcgttntgtgcgcctgggtcgcacgctgactagtgaatctgttggcagttgtgcgccgcagccccgcagccatggctctagtga

SEQ ID NO: 11342 - DNA, 610 bp, Zea mays
  unsure (1)..(610): unsure at all n locations; Clone ID: LIB3279-186-Q1-K6-H12
gcctccgtttttaggactagcgaactgagggcggagggggggggggaaggactggcgcatctgcctggagggtacaagggaaggagttaaggggccattaacaattggcgcggagatatttgaactcacacctccccttgtaatggtggaggtaaaaaagaaggcaggggataatgaagagtgcgggggcttgtgtgacaaggaattgaagccagggatgcagcaccttgtccaccatatggtccgagctccaagtatgctgcttactgatgccaagtagatcgaaaggctttgaacttaacaacagcacttcncacggagctactggtaacaggcgtgacattctgagcggcatgaggctagaggagacagttgagcacagcacagttgaccagaagagatagtcgccggaacaaaaaccttgaccagttccacagcgctgtantttcccagatgatgagcagctcggcatctcatgactgaataaacgcaatgccccccatggagggagactccggtgtctttcttgtacctgaggtggttaagttgttacttgaatgctttatcacgagtggtgtattcctgctattcgtaatttttcgattaacca

SEQ ID NO: 11343 - DNA, 678 bp, Zea mays
  unsure (1)..(678): unsure at all n locations; Clone ID: LIB3279-186-Q1-K6-H2
ccccgcgtccgcccagcgtccgcccacgcgtccggcagactagtgatgatgcaaatgttatgcttaatggttttggagctgtggttaatgcacttggacaaagagttaagccttaccttcctcagatttgtggtaccatcaagtggcgattgaacaataagagtgcaaaagttaggcagcaagctgctgatctgatctccaggatagccattgtcatgaagcagtgccaggaggagcagctcatgggacacttgggtgttgtgctgtatgagtacttaggagaggagtatcctgaggtgttgggttcaattcttggagccttgaaggctatcgtcaatgtcatcggtatgactaaaatgactcctccaatcaaggatcttcttcctcgtctaacccccatcttgaagaacaggcatgagaaggtccaagagaactgcattgatcttgttggtaggattgctgatcgtggagcagaatttgtgccagcaagggaatggatgaggatttgttttgagctgctcgagatgttgaaggctcataagaaaggtattaggagagccactgtgaatacatttggttatattgcaaaggctatagggccacagnatgtgcntgccaccctgttgaatatttgaaggtgcaggaagcgcagaaccgtgtctgcacaactgtagcaat

SEQ ID NO: 11344 - DNA, 620 bp, Zea mays
  Clone ID: LIB3279-186-Q1-K6-H3
agtagagaggaaaaattccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcg

SEQ ID NO: 11345 - DNA, 596 bp, Zea mays
  unsure (1)..(596): unsure at all n locations; Clone ID: LIB3279-186-Q1-K6-H5
tagnacggcgtcttcgtactcgcctgtctccgcgacccaagcgttcccccttctcccattcttctctcatttctcaccaccgccgccgctaccccctttcgacaacaccatgagggagtgcatctcgatccacatcggccaggccggtatccaggtcggtaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttgggggaggaacgggctctgggcttgggtctctcctcctgggacggctgtctgttgactatggc

SEQ ID NO: 11346 - DNA, 600 bp, Zea mays
  Clone ID: LIB3279-186-Q1-K6-H6
tcggtctctaccaaaaaacagcgacctgtgaacgcttagctagctctttgtgtcagcgcctgagcatcgagctattggcatggcgcactccaccaccttggccctggtgattgtcgttgtgctggcgctcacctttggtgccacggtcagtgtctccgctcccgtgaacaagtcgtgcgtcagcggtagcgccggcgccagcgtgagcattggctacggcggggcaagagccagcgccggcgctggcgtgtcccttggcgccgacgcgtaccggagcacgtgcccccgtgccgaggagatcatccgtgcggccgttgagagggccgtcgctgccgacccacgcatggcagcgtctctcctgcgcctccatttccatgactgcttcgtcaacggctgtgacggctccgttcttctggacgacaagccgttcttcatcggcgagaagacggctgtgcccaacgccaactcaatcaggggcttcgaggtcattgacgccatcaagaccgagctggagcgggagtgcccagatacagtttcctgtgccgacctccttgccatcgctggccgtgactccctcgttgtgtcttgcgggcccagctg

SEQ ID NO: 11347 - DNA, 586 bp, Zea mays
  Clone ID: LIB3279-186-Q1-K6-H7
ccccgcgtccggctcccttgacgttgggggggggggctgcaccaacctcaacaggcttgtgtcccaggtcatctcatccctgactgcttccctgaggttcgatggtgctctgaacgttgatgtgaacgagttccagaccaacctggtgccctaccctaggatccacttcatgctttgggtcgtggggtgccagtcatttctgctgagaaggcctaccacgagcagctgtccgtggccgaaatcaccaacagcgccttcgagccatcctccatgatggccaagtgcgacccccgccatggcaagtacatggcatgctgcctcatgtaccgtggtgatgtggttcccaaggacgtgaacgctgctgtggccacaatcaagaccaagcgcaccatccagttcgtggactggtgcccgactggcttcaagtgcggaatcaactaccagcctcccagcgtcgtccccggcggtgacctggccaaggtgcagcgtgccgtgtgcatgatctccaactccaccagtgttgtgggaggtcttctcccgcattgaccacaagttcgacctcatgtacgccaagcgcgccttcctg

SEQ ID NO: 11348 - DNA, 585 bp, Zea mays
  Clone ID: LIB3279-186-Q1-K6-H8
cccagcttccgcaagcctccgacacccagccgaccccgccttcttacaccccttctaccaagcctccgacgcccaagccgacccctccgacgtacactccaagccccaagcctaccacacacccgacgcccaagccgaccccaccgacgtacaccccttccccaaagactccgacgccgaaggcgaccccaccgacgtacaccccttccccaaagcctccgacacccaagccgaccccaccgacgtacactcccacaccgaagccgccggccaccaagccgcccacctacactgcgacgccgacggtgtgtcacacccccagatcgtcgtcaccatactactataaagcgatgcctaccataccacactggtgtcagtctctggagcatttatgtgggctggatcaatggaagggttgtgtgctaaccagacgggaaagatgagctgctgatggtaatgatgatgataagaggtcactgctaccctactacgtaccctcctctatgcgtgctggcatgcgtacccgttagacgatcgaggagagaataacgcagagctctctgctcccggcctgtcttctgccga

SEQ ID NO: 11349 - DNA, 607 bp, Zea mays
  Clone ID: LIB3279-186-Q1-K6-H9
gctgtccctccccttcccaccgctgcaggggcaaaggcttctccctgctccggccaccgcaaccacctcgcgaggacgacacggagatgatggagctgaggaagcgcccgaggccccggcgcctcgacccggacttcctctcgtccccgcctcctatgccgccgaggaagcgggcacggagagcgggcagcggcgccgaagccggtcgaggccgcgggcgctctgaagtggcagccgccgaggaagggctccaggcgcgccacggtgggcatcgggtgtcccgtcgctgggctccatcctgcgacgtgcggccggcagccgccgctgcgcatgtcgacgcgcgtcctcttccgcccgcgccatccattcaactggtacgagccggacctgtggacggaggtggctaagcacctgtgcggcttcgacctactccgcctctccttgacctgccgctggttccaccggctcctcgccgacgactccatctggcgctacgccttcttccgcgaccttaacctcaccgacgccaacccggacgttcatcggccggtctcccgctcctggcgctacctctactttgccgccttcgatggctcccacgccttct

SEQ ID NO: 11350 - DNA, 513 bp, Zea mays
  Clone ID: LIB3279-186-Q1-N6-A1
aaaacaacccctgatttttttgacttggctgtctctgtctctgatttttgacttgtgcttacagaattgagtgtaaaaatatcagaagaagacagaaagtcaggcaggcatcctattcattccctcctttcgtcaagataacttactacctacctttctttttatctacaaaagaatcatttccttagacatgtgaaaagagaagaagaaaaaagaaacagatggctctaaaagaagtaagaacaggaaaaagaaaacctcaaatgactaacagagagcaaaccactcttctacctatccttttcgtttacttgtttcttaattccctggctctctgtatgtatacccccatcatctaccatggaaggcttccagtggccgggtctgcgaacgccttctgcacgaaatccttaagcccggtgtcgtacactttggagaaccggggcgggcagtgcttcggctccaccgggctagtgcccagccccggcgccctgtccctggacccgacgttct

SEQ ID NO: 11351 - DNA, 436 bp, Zea mays
  Clone ID: LIB3279-186-Q1-N6-A2
gttttttttttttttttttttttttttttttttttttttttttttttttttttttttttttttttttttttttttttttttttttttttttttttttttaaccggccccccctaaaggggggggggggccccaaaccaaaattttaattattgcggggggaacggggtaaaaaagggggggttaactaaaaaaaaagaggggtttttgtttaaccagagaaatcacgtaaaaggaagggttaaaaaaaaaggggggggacttaaaagggaaaaaccacatttgggattaacggggccaaaaagaaaaaaaggggttgtttgaaaaaccaaaaaaggggggcctttgggccaaaaacctaaatgggaacccaaaattgggggccaagggggcccattttgggaagcccagtttgggagttcggaccacctttccgag

SEQ ID NO: 11352 - DNA, 587 bp, Zea mays
  Clone ID: LIB3279-186-Q1-N6-A3
ggggggggtgtggtgttacagacaaaaaaaaaagagattgctaaagttggagatcagaatttacataaatgaatcaacaagcccatgggcactttattacatcgagcatgggacggctctaattatttattatacatcggtctcagaaataaagtgagcggggggatataatggacaagaattttcaaggttttcttaacagccattttgaaaaatggccaggagttctctggatctaaatacaaaaaaggctcggtttctctcaggcccgaggaaaactggcatactttgcgccaaggaagagcctctgcacacagagcagcgcatttttctgcacttcagtgttttcatgattcatgagcttcatgactcggtccttggccttgaggtgtgccaccacgattcggccagatggatggtactggaggaactgtgagaggtcgtagcaggccacggcaagagcggtggggtcacttgatgtgtcaatgattgtgcatgagaactcgtagaatctggaaatcattcttttcaaaatgggaatgttctcacgccagaaacttggatctttgtgcatgggagaccagtca

SEQ ID NO: 11353 - DNA, 556 bp, Zea mays
  unsure (1)..(556): unsure at all n locations; Clone ID: LIB3279-186-Q1-N6-A4
aatacaaatttgtgaactattccaatccggaaccaatccagtaaagcattcaggaagaaccgaacgggcacttaagcgggtgctataccaacttaacatcatattattgcagtactagtgagtgagtgtgttattatcaggtcgagccggtttagcctctgtgtgatatgatatgaaatgacatccctgcccgtacgttttctctcgcgctctttcgtcacgggtggtcgtccggcaggctggccgcgtcgacgacgtacccgcggagcgacggcgtccgggcgggcaggtccggcttgcggtggcgacggttccgcacccggcgccgcgcgacgtaacggcgcagccagggggtgacgtcctcnctggccttgatcatgaggaagaagagcaggcggtagatgacgatcatgctgaagagcacggccaggtccagccacttggagcgggcgacgtcgatctggaacacggtctccaggatgaactcccccgggatcctgggcagctcgtcgtcctggttgtcgaacagcaggcccctgaggtcgttctggtactg

SEQ ID NO: 11354 - DNA, 574 bp, Zea mays
  Clone ID: LIB3279-186-Q1-N6-A5
ggtgtgggtgttgttttcacaaggattcaagccatactgctgcagaagagttttgggtacaacacagaggacacaacaggtccattaaaccaacgaagccacaaccacgattcatgacacacaaaccacagatgtttattagacgacgacgaggcgggtgcccagtttctttatcagcttaaatgaaccatggcttactgaccaccacggaggcggagcaccaggtggagagtgctctccttctggatgttgtagtctgctagggtgcgaccatcctccagctgcttgccagcgaagatcagacgctgctggtctggggggatgccctctttgtcctggatctttgccttcacgttgtcgatggggtcggagctctcaacctccagggttatggtcttgccagtcaaggtcttcacaaagatctggataccacctcgcaagcggagcaccaggtggagggtgctctccttctggatgttgtagtcggcgagggtacgggcatcctccagctggttgccgacaaagataagggctgctgggtcgggggaatgccctccttgtgctggatcttggg

SEQ ID NO: 11355 - DNA, 452 bp, Zea mays
  Clone ID: LIB3279-186-Q1-N6-A6
aaatgatgggagttggcacagcatcagcaaagccagctacccgattgtataataacccagagaggaaattcccctgccatccctgcaggcggggacaggcatggggggggggggggttttttttttttttattgccatagtacgcgaaccaccttgggtcacttcacatcatatacatacatacatgggcgagcgtcccaaagacctttttttttatgtctaccctgacagacgacaggtttgcctacccaacaccagaaaaactcaaaccggagaagaagaagagaccatccatccatccatggggctatgggtccatactgggggttaaaacctaaaaaaaatgccagcacaggggcggggcttccggccctttgttcctagtggcaggcccaagggagaacacttcctccctttgccgctgccgtacaaccggaaaaggttgaaccccc

SEQ ID NO: 11356 - DNA, 181 bp, Zea mays
  unsure (1)..(181): unsure at all n locations; Clone ID: LIB3279-186-Q1-N6-A7
tcgcgatgctagacggacgcgtaaaaaaaccacgcgtggtgatagatntagattgtgagaagtggagattgaggattaaagataaagtaagcgagaatgtggtgtaataggatagaaaaagagggaattaattttttttaaaaaaaatttaattggggggggggggggggttttttttttt

SEQ ID NO: 11357 - DNA, 271 bp, Zea mays
  unsure (1)..(271): unsure at all n locations; Clone ID: LIB3279-186-Q1-N6-A8
ggggggggggggggggggggggaagcaatagcagacaagaacacgttacatcaatgtaaacgtggtctttacatgtgcaattattaaccagccagatttcaagtacaacaaatacaggtcgtttaaacagctgatccttaatgaaaaatgaagtcggggccgtnggggggtttcttttttgggttcagtgcctgcgacaggcccttaccaaacctcaggggggagctcaccattagccgggggcatccatttgccggagttgtgcacgctc

SEQ ID NO: 11358 - DNA, 510 bp, Zea mays
  Clone ID: LIB3279-186-Q1-N6-A9
ggggggggtggtttttttttattttttttttttttttttttttttttttttttttttttttttaaaaagctcctttttctaaatctgaaaaatcgggcaatactacccctagcaagaggctaaaaaaaaatcccatcacaaaatttttgccgattgtagggggccccttttcttggcctttacaaaggttaaggtttggcttggaaccaatctttattcttctaaagccacctcctaccccgtatgtacactctaatcatttcaaacaatctcccccatcataatcccgttactttggacctttaaaccaaaaaaaaaaggggcaatctcctttcctttcttcgttttcttcttcccccccttaccacctgggccacagtcttcaaattcggaggcattttaccgcaacggaagcttcctctaactcttcaaccctctccttaaagacttaccacaagcattttaattgttggtggcttatggcattccatacccccccctctttttttt

SEQ ID NO: 11359 - DNA, 444 bp, Zea mays
  Clone ID: LIB3279-186-Q1-N6-B1
gggcaagctttaacggccttccattttttttaaaacgaacaaaaaaacgggggggcgtcccaaaggggcatagcccaaaaaccctagccgggttcacatttgaatcaacgatcttaggggaccaaaaagagggggttttggcattcccaaacacattgggctttaaaaggcatggggactaacggggggctaaacctaggaaacaaggcgggggcgaatgccttttttccagggggggggttcaggtggcatcggcatcgacggggggagccttggaccagcccccctttttggggggggggggcctggggattttgggcataaccccccccctcgcgagggggggcccaccaaacagcttgggcagctccttctctttgccccccgggagctggatgtgaccccgcaccatgcggggctttttggtatccctccgtggggtcc

SEQ ID NO: 11360 - DNA, 527 bp, Zea mays
  Clone ID: LIB3279-186-Q1-N6-B4
gggggaccaagatccaagacagcacaattaaaaataaaaattgctacaatgtttaataggtaacattactagtgtttcctgaataaaaaatttgtcagtctaaagcgcaccagatccatccaagagcataattgctcatcaggaattactaaaatatgtgaatttgagtgtctatggaaacacaatgtcaagctttgtctttatcgaaacatggatccgcaggaaacactagtaaaacacaatggcaaacttaaactttgtcgaaacactagtaaaacagtagcaagctttgtctttgtcgaaacatggatctacaagaaattcaaaaaccttgccggtcatcctatggttcaaccttcatcgcctcctcccactgcccatctgacccttccttccaaagggttatgttgttctcgccagcagctatgcataatatgttgccagtcaaggaccacgacaccctccagacaggggaaccgaagtcacgcatgagctttccctcccacttgtctccatcctttcccttg

SEQ ID NO: 11361 - DNA, 344 bp, Zea mays
  Clone ID: LIB3279-186-Q1-N6-B6
gcccaaacatacgaataggttttgataaataggtactcagggaaaaacagtgtgaaccatagctagaatgccttgagttctcttaacacaaaaatcctaatccaaagtgcaaataaagtgtagccatctcaacaatcaaacatggcatcatagaaaccaaatatgagattgctcaagcttcaacagcaacccttccagccacctaggtccagatcacgccttccctgggaggtgatgcgccgtccacccttgggatcgacatcaatgatgcccatctcctgcagctgctgggaggatgttgcgtgaaatggcaccactgctcttgcaaaagtgaggtgggcgtg

SEQ ID NO: 11362 - DNA, 559 bp, Zea mays
  Clone ID: LIB3279-186-Q1-N6-B7
aaaagcaaagcaaatctgcaattgaatgcaatccagtccaaaattgcaagtcatccagaagataaacgaacatattcttttgtacgggaatgtaacataaaattctcatctaatgcctggacttcttcttcctagatttgttgctagtttttggctgttcagcatttaccgccggtgtctttgatgaattggtggtttggcttccttttgaggaagcaccgacattggtggccgatgtttccctagacacagctccttgagcacctctgacctgagccctcttatccttcctctttggacggtaactggaccgctctttccttggcagccatctttcgggatctggtggcggccccgggtttgctggatcgaagcctttcgggtatctaggcttccgcttcctcttctttgccttttgcttcttcacttcctcgggaacatctaccttcatgtcttggggcccttccacatgccttgcaccagatgtcttctccaagctctcaacattaactcctttgaggcctggcaatggcttcagtttcttctcgtattggtctgc

SEQ ID NO: 11363 - DNA, 486 bp, Zea mays
  Clone ID: LIB3279-186-Q1-N6-B9
gatgtatgtactgtatccgagtatataccatgaagaaatctctggtctcccagcgaaaccaagaaagattcaatttacacacttgctatctggagtaccagataccaagctgctaagaacaagaagacgtgtaactacagtaactttgggggtggaggtctctgagaaagcaggttgagcgtatgacagcctctggatccagttgccagccttcttcttgttctggtcattgggttccagggcctgacagatcgagcttgggatcttgtcgagtgttccatctctttcaagaactgtcttgaggttttcaaggactgaaactatttgctggaactcaggcctcctttctggttgccaggaccaacattgctcgatcagaaacttcaacgctgctgggcagcacaatggaatagccggcctcaagttcttattaacaaccgcaaaagctgcctgaagcggagtcatatcttgataagggattgaacc

SEQ ID NO: 11364 - DNA, 563 bp, Zea mays
  Clone ID: LIB3279-186-Q1-N6-C1
aacaaatcacaccacctcataaaattctcacagactaatgcgtccgtgaaggaaataaatcccggcagaacaagcagtctagaacgggaagaaggaaagaaagaaataaagagaaaaaaaaacagttcagtgaccctcgggaggaacaaaaacgccttcctccagttgcagttgcagtgctctctggccaagccgccagcctgcctactggtacccgttctgaatcggggacgtcctgaacccgttggcggcggcgaggcccaggccggcgcaggatccggaggaggggggcttgttggccatcatcatccctcccagcgcgacgtaagcccttgcacgacgacttgaccttcttctgcttgtaggggctgtccttcttgcgcaggtcgtccaggcagcgcacctccgacatgcacgcgaacgactgggccttgccctcgtagtgccgcgacagccctttcttggctgggagctgcgacaccatggacgccatgtcgtagatgctgtccgagttcatcctccgcagcggctgcggcacggggcggcggcggtcctgctggtcg

SEQ ID NO: 11365 - DNA, 503 bp, Zea mays
  Clone ID: LIB3279-186-Q1-N6-C2
cgttgtgtgttttttaacaaatttcacggggtattccttcctttccttgtgccttactgcaccacaatcaatccaactcaaaagtaataggtgacggtagctactttattacatcctgccttggtctgtcggcaattatgtgaaaactggaaggggggggggaaaccttttttattatttagtcgctggttaattcaccccatagacccacttctccgcattgctggtataagagaccagctccttgggttcaaaccacaaggcgatctcatcctttgctgtgttcgggccatcacttccatgaatgatgtttctttccacagcaacgccaagatcgcccctgatggttcctggttcagatttctgtgggtctgtggcaccaattagttttgtgccatacttgatgactccctgttcttcccaaaccattgctagtacagggccagagctgtggaagttacacaacccgttgaaaaaaggcctttccttgtgatcatggtagt

SEQ ID NO: 11366 - DNA, 453 bp, Zea mays
  unsure (1)..(453): unsure at all n locations; Clone ID: LIB3279-186-Q1-N6-C3
ctgggtggtgtgtttttgaatgaattgttatctggaaatatattatgtgactataaaattgtttgcggatctgcatgaacatgaactgttaccacaatgagtgatgttttaataactaccagtacaatacttttacgttgcgacgatatatgagggggtgggggaaaatttttttttttaacantttcgttaaaacaaacacatctatatgggcatcgatcttaatgtcttgcaaattctttgctttgcccgagtcggttgctctcctgcttggtcatgcacgagaactgagcccgaatagcacctcagtgacctcgatctactcttgcgtgaaagacggcgactttaaaatcttcgtcggtgcgattgcgacgggattattgaaggtgctgggaacgtgcgttggtcctgtaccgtcgtggcttacattgccaccaagtggtttttgagagg

SEQ ID NO: 11367 - DNA, 74 bp, Zea mays
  Clone ID: LIB3279-186-Q1-N6-C4
ttgttttttttttttttttttttttttttttttttttttttttttttttttttttttttatcaaatcggtttct

SEQ ID NO: 11368 - DNA, 405 bp, Zea mays
  unsure (1)..(405): unsure at all n locations; Clone ID: LIB3279-186-Q1-N6-C5
ggggggggggggtggttttttttttttttttttttttttttttttttttgtttttttttttttttttttttttttttttttttttattttttttttttttttattttttttttttgtgggagaccaaacccaaattttggaccaaaagggggggggggggggggggtttttttgtttgaggggcaaaaaggggggaccaaaggggggtggaaaagaaaagaattaaaaaaggttggaggtttggggttttttttggggggggggttgaaggaaagggggggggaaaataaaggngcccctttaaaaacaccggggagaaaacacttatttatcaagggggaaaaaatatgagcaaaaggggggcccacaaatgaatttggaatatgggggccgggggaacagggg

SEQ ID NO: 11369 - DNA, 536 bp, Zea mays
  Clone ID: LIB3279-186-Q1-N6-C6
agagcaacaaatcaataagactatctttattttcctttctgatgtctgaaatcacaatgcacaaacattattctcacaatcatctactgctaaaattggggactaactaaaaacgaatcaactattcccagaaagagcgacccaaacaatgaatgctcaaggggactacacacacatcacctgatcacccgaaatcctagcaattgttagtataccctccaagtttccacaagctgatgcaagtacgagatgtacactaccaataactacggtcacgacgataaggacaagagatcctcaaacaccgtccggacctccggcctctccgatgctgaccggatacaccggagcgcgatgcgccgcatgccatccagtacctgtggggcgccttccgagctctcaacacccgtgatgtgcctgtcgtagcactccgagacacgctcctccagatccagcatcctcacccagtcggtcaggtcgaccacgccatcgttcatgcagatgatctcaccggcaatcttccctgtcagcaactc

SEQ ID NO: 11370 - DNA, 557 bp, Zea mays
  Clone ID: LIB3279-186-Q1-N6-C7
gaacaaacccttgtatattagcatatatccttttgaaactgccaccacctccaagcagtcgtcagaattgctcgttccagtgccttacatattacaacaaccaattattctcctgtcttaaaatccattccaggacaaaactacagtccataacacatactctgcttctgattttactgccgaacagatccaccgaatctcgtgtcatttgtgacaaatgtggggcatattacaaaaaaagaactggccaccgaccacaacctgaactcattatgcgtatttgtacgaactccctcataaaatacatgagagaaaactaatctagcacactatgttcattaggtttgggctaaatctacccactgccaaaccttgagctcaccagttccatccccggtaaaaaataaaccaccaggacccatctgtattgccctaatttcttttttggagaataatctgcctctgtcactgaacgatggcagatcatataagcggacagtgttgtcatttaatgaacacagtagcacaggttttgactgtgcgtcaggcataccact

SEQ ID NO: 11371 - DNA, 559 bp, Zea mays
  Clone ID: LIB3279-186-Q1-N6-C8
agggcaaattcaactaagccgtcttagttccagcatcttaagaaaatacaacatgctccgggcagttcaagtaccgtctttcaggaatctgcagcatctatcctacataaaccgattggggggctgagcgacattcatttcaacaatagtgccagacaagtccatcgaaagatgttacatgatataaaacgttcgcatgcaatcatttggttttatcctcatctgcacctttacaagaaccatcgtacgcagaggtaaagaaggtgatctgattcttctgaagaaacttgagaacgtccagcagtttcagctgtagcttgttcaacgcatcttcctccatattaacagaagcaagtagctctggcaatttcacaaaaaggcgcaatagatgctcagctccatatacagttgatggtgaaacatcacctttaacttcttcagcatactgatctcgctctttcttatataaaagctttgcaggcaatgctttatcaaagtagcagcgtaatcctttcagaatctcagcataggagtcatttatcttgccatccttctttgc

SEQ ID NO: 11372 - DNA, 572 bp, Zea mays
  Clone ID: LIB3279-186-Q1-N6-C9
aaaaaaaaaaggtccagatcgaaccatccaagatttattccatcaccatccatccgaattccgaaaccatagttcaactacggggacaagattaaccaaccaaaaaaagcagtgttcccctcgggcacaggccattctcttattagatcgactcacttcgtccaggcaagtgatcgatctatgggtcgacaccaagcagaaaaaacgccagaccagccatcacgttactatactgagatgcaacagaactacgatgacctagtggcactagctaccactggtgatgatactactactactgccaaagggggatcttgaaaacgagttgcactacgacttctgctgctgctacgggctctatccaggcaccggcgatggttggcggccggccgggccggcgccgtgaggctcattcgaggatggtgataacggcgatgacgaagatgacaatcgtggaggagacgacgacgcacccgttgtcggagccagagtgtggtggcgtgggagtcgtgggcgcggcggccggcgccagcgtgggagagttggcggccgaactggtggggatggccttg

SEQ ID NO: 11373 - DNA, 329 bp, Zea mays
  unsure (1)..(329): unsure at all n locations; Clone ID: LIB3279-186-Q1-N6-D1
ggggggggggggggggatcaaccatgacggtcgcacatgctacattatacagcaaaagaaagaacaaaatgtccaacctgtgatagagcgaggcaacagtggtatggagaggctacgcgtgcccgtgctcgacggggcggtgtggccgggcgcggggggggaagcctatgtgcttgcgtngggccacgcgaactcgttaggtgggcagagatcgtgagccgntggggcctggctgtcggggccaagtgcctgaactctggacggtggccgagcgccggtgtttacgctagaagggaaggtggaacgaggagtatgatagggaggtgggc

SEQ ID NO: 11374 - DNA, 535 bp, Zea mays
  Clone ID: LIB3279-186-Q1-N6-D4
gccgactccaactcagcatatagaattgtttttgccgatacatagccagcattacagcatagttgatagaacaaaaaagggggctgctcgattctccatcggcaggaccaacttacacgaaatttaacagcaaagagactaattaacatacaaatataaagataaccatcatcccacataggaagcatgttttttggatgtccgaaaataagctctaacgagcaaaccacactccgcaacctagctcgtaggcaggagttccaaaacgggcacgcaaagagaagcaactcagtacttgtagtccttgacgtggaggctctcggtgtcggcggcagcatcacccttgtaggtgccgagggtagcctcagagttggccttgcacctggcgaggaaggcagctctagccttctccaagttctccaccttgccagcccaggccttgagggtgctcgcctggagggcacggccgaaggagaaagacagggaccacggcttcttggtgctgagcttgttcatggcattgaggttgcgggtg

SEQ ID NO: 11375 - DNA, 550 bp, Zea mays
  Clone ID: LIB3279-186-Q1-N6-D7
gaaaaaactcgctctccaccattgatacaccgcctggatctatgtacagttacagcttgttgcaaggaaaggtgcgagggaacccctccgacagccatggcgatatggccgtttctcgcaaatggtttctgccagctccgctcttcgtcagacaggctcccgtcgtctcgttgctgaaccctgactcggaagcgcgcggttgtgctgccccggtcgtcgtctcacctcacctcactgattagttattgtccttccctaccctaatgtacagttagaaagagagagcgaaacatggtctcgcacacagcaattcacacataggtctcacaaaacttcccatccatcctgttctggactgccttgatcgccgccactcaagcggccgtggccgccctgttcgcggccatgaccgccctgtggacctgctcatcaactgtagggaagcgaaacgcgttctctgcagctcgctgtgcagcctgtacgggtcgctggacagaaagatcggccgggggcaagggggtctttgacgtaccaaaatcccaatcccccg

SEQ ID NO: 11376 - DNA, 361 bp, Zea mays
  Clone ID: LIB3279-186-Q1-N6-E1
aaaaaaaaaaaggggggggcccttttaaaaaaaaagggaaaaaagggggcaaagaaaaaagggccaatttaggaaaaaccccccccctttctttaaaaaaaaaaaaggtgggccgggaaaaaaggggccccaaaaaattggggcctgggttcccccggggagaaaaggaaaaataccataaaaaaaggcttaaaaaagggggaagcggaggggcccaaattaaaaccccaaaccggggcccaaaaaaaaaaaaaacccccccccaaaggggggggggggggaaaaaaaaaagggggggggggggggggcctttttaaaaggccccccaacggcccggggtttgggatttgggccccccaaa

SEQ ID NO: 11377 - DNA, 343 bp, Zea mays
  Clone ID: LIB3279-186-Q1-N6-E2
gttggggggggaggttggtgggggctctgggttttgggttttttagtttcgggtgggtgccggttctttttttggggattttggggggggggggggggggggttttttttttctttggctgggttcctggggcgggggggtttgtttcgggtggtttgttttggccgtgggggggggttgtttggggtggggggggcctttcggggggggggtgggggggccggtgcggggtttggggctttgttggcttttttttccccgtggtgggggggtgggggggggcctgtttggggcgggggggtggcgttggggggtgggggttgtccgctgggggggggggggg

SEQ ID NO: 11378 - DNA, 602 bp, Zea mays
  Clone ID: LIB3279-186-Q1-N6-E3
cagtagactactttattggatgatcatatccacactccctacaccgccacacatgggggatgaaattaaatcgaacgagagtggcagcagctagcgatcgagctaggctaatcgtccatgtcgggacgaacaaccagatgtgggctgtgtactcttttcttttttatttttatttgtggacgtacgtatactagcaagtagccgcgcgcgctgcgctacgctacttttagcaagtagctgagctgagctagttgctcgtactgatccatgtcctgcacttgggaccaggatagccgtggaagatgtctcggcattggaagcgaggagggtccgaatgatacagaaactcgcaccgttcgcagttgctcgagcacgactccaccttgtccaggcacatgcagttggggatgtagtcccttgtgcaggccacgctgtcgcagcagtcccacggcctcggtgtgcagaccgggggctcggtcaggcttaagataaagtcaccgcagacgaagccgtcgccggccggcgacgcctcgcagtcctggcagtcggcggagcagttgtccaccacgtcgttgcagcgccacgccggcagggagcgtcct

SEQ ID NO: 11379 - DNA, 406 bp, Zea mays
  Clone ID: LIB3279-186-Q1-N6-E4
gggggaaaaaaggggggggggggggggggtttttggggggggggggattttttaaaaaagctaagggggggatttgttgggaaaaaaaaaataaaaaggggggggcggggaaaaatttccccaaaggggggggaaaacaaaaaggggggggggggcaaaaaaaaaaaaaaaaccgcttttaaaaaaaaaaaggggggggaaggggttcctccaagggtattaaaaagggggaaaaaagggtttaagttctttaaaaagggagataagggaaaaattggcgttggttttaaaaaatggggaaaaaaaataaggtggaaagggaaaaaaaggggggggagaaaaaaaaaaggggggaggggaagcgggggctttttaaaaaaaaaaaaaaaaaagggggccccctttc

SEQ ID NO: 11380 - DNA, 270 bp, Zea mays
  Clone ID: LIB3279-186-Q1-N6-E5
gaacagtaaaggaatactgtttagtttttataggcacaggacactgcctgtgaacaattacaatcatacccctcataaaagtttacaacatcgactcaaacttttatggactaaaaggtcattctatctttaagtcggtttgtaactccgaagcttcatgggtgacatccttcggcattacgtacagacaggttcaaccgaaactgtttttttctttaggacctttggggacaaagcatggtcccaacagaaggcacttttggagacaaa

SEQ ID NO: 11381 - DNA, 574 bp, Zea mays
  Clone ID: LIB3279-186-Q1-N6-E6
accgtaatgattcattcattcagtaggagaaaggagagagatctcatacatagttgattcagagtacagacataagacatgatcagaaattcataatgcagcagcctatgaccaggcccttctgtggggggggggacccccatttttttgcgcaagcaggctgacaaatgttggaacactagccacacagtggctggctgtctaacgcaaacaccactcgagagtcgagaagaccgcgatgcatcgcaccctgcctcttttatttggggatcgccgcagccagcagaattattattagggtaccagctagtagtttctttcgttcgttcaccaagggaggatcttccagcgctggttgtcgccctcgcaccacttccagagcacgatctcggtaccgtcatggacgccgccgtgagccttgtcgccgtggaaggcgtcgaagttgaggtagatgttgttgaccatgcggacgcagcggaagccgttgccgacgtcgcggctttcggtccagagcacgactcgtcctggtagtccgggttgtagggcacgagcttgaacggggggccctgccccg

SEQ ID NO: 11382 - DNA, 107 bp, Zea mays
  Clone ID: LIB3279-186-Q1-N6-E7
ttgacacaaagggcctgcctccatttggggcaagcacagtcccctattaactgagccaagtcagatatgtacagagtggctgcatatgattaaggatgcatgcaggc

SEQ ID NO: 11383 - DNA, 545 bp, Zea mays
  Clone ID: LIB3279-186-Q1-N6-E8
ggtgttttttttttttttttttttttttttttgggcacgagcacacattcaagcgacttggatcacctatttaagcattccagtctagaagattgaacagttttacagcaaacgtgactttccattcattcatgtcacctggtcactgggggggggggtgagttttttttttgaacagctacacgactaggttccaagttggggctcatttttttttcaaaagatataaaatccggcccctaatggcagcttattctggacaagaactggcttattaaaacataagctcagtcacattattaaaacagcactaggagtttataaccaattttttaaggatggggactagacccatatttgggtgtttctctgggggaaccaattaacttattggggaacacattaattacgataccatttggccaaacctcctaaatatatcatcattttaaaaagcgttgttctttttatttgaagacgggttgggccaaggaagcctctgccttaaattacgatcgggacttaaaaagcggactccacattaa

SEQ ID NO: 11384 - DNA, 622 bp, Zea mays
  Clone ID: LIB3279-186-Q1-N6-E9
ggaaaacaaataaatatactgtcacgcttcagggaagaaaaaaaacagcaagagtcaagtctcggtcatgttatacactttcagcttctcttctcggcacaaattaaaactatcaacccattggcctctgatgggtagcaatagctcaacactagctagtaggtactcaatctaacaggaactatcaataaaaggatgccggaatgaccctgtttgtttgggcttttttttagcttctggccaccaaaagctgctgcggactgtcaaacatccagcttttcaacccgcttttataagaatcgttttggtagaaaccatccaaaatcaacataaacacagaatcggttgaatcatcgcgatggtagaaatccatcgctttctagatcctgaactatttggaccacttcatcttcctccgcacgtaattcccacgatacacagattcttctcacagccagattctctctacagctagattctcagaaaagctagccagaaaaaagctgatcatgaaacaactttgctggctgttacagtgtaggagaaagcttaaggtacaacctgaataatgcacgcagtaacacggtctctatgaagcgatgctgcgttggctctcacaacc

SEQ ID NO: 11385 - DNA, 466 bp, Zea mays
  Clone ID: LIB3279-186-Q1-N6-F1
gggttgtttttttaagagagataaataaactctagaaagcattatgacgatttataagagcatgttaccaagaatgtgtcaacatgctatatgatgaaaattatactcatgtacaacaacacaaaacaaacctgaagcttggctaatgatctgggggggggggaaatatcattttaattacatatgtagagagcaacgatgtcttacgaataggattccagtgtaaccggaacatgtaaatttagaaaaaatattatagggtttactaaggtagatcgagtattatatttataagattatagagtaaagatctaaaggtttctattaaggaagataaagacaatggttatagaatgctagtgaatagtgaaacaattgacctttatagttcattggtaatagcttggtgaatagactaaaacatgaatcgtaatctgaaagactgttgaattgctatggtacttct

SEQ ID NO: 11386 - DNA, 623 bp, Zea mays
  Clone ID: LIB3279-186-Q1-N6-F3
cagaactctgtaacatcatgatcatgtctcagattcgcataaacaaatacagcactgcatatgaagcaaatcaatggcttctagcaaaaaaagttcacatagtgagccttgacactaccaagattgcccaactcctaagtggaactccaccgattaactgacaccttcaccatcaaaccattttagacaaggaatgagcgtcacgacaagagttctgaagccgtccttgctggcaactgcatttcctctgatatcaagctgtgccagcttcaaagatctgaagaacaatatggcgtcccagtattccgtcacgttgatattatttacctcctggtactcttcaaaagcttcacttgcttcagttttgtgtgagaacggagacgggcagatataccgtgctgtgtcaattgagtgagctccaatctcgttgaacgacaaatccagaactttcagtgagattatcttcgtaaggggttcaagtgctgtgaaactactgatctggttgttgctgatgttcaagaacacaaggcgctgcaaagcctccaaaccttaaaaagacaaaaaaaattaccaacccaaagcctgtttctcaaatcttatccttcaggcatttgccaatgact

SEQ ID NO: 11387 - DNA, 420 bp, Zea mays
  Clone ID: LIB3279-186-Q1-N6-F4
ttttttttttttttttttttttttttttttttttttttttttttttttttttttttttttttttttttttttttttttttttttttttttttttttttttttttttttttttttttttttttttttttttttttttttttttttttggggtgggggggttttttttttttttttgggaaaaaaaaaaaggggggggggaaaaaattttttagaaaagaaaaaaaaaaaattaaaaaagaagagaaatataaaaaaaaaccaggtttaaaaaaaggggccccagaaagaagagaaacccccaaggaggaaaaaaaaaaaaaaataaggagaagaaggggagaaaaaataaacaggggaaaaagtagcccccttattttataaaaaagaggggggaaagaggggggggggggagaggggggg

SEQ ID NO: 11388 - DNA, 513 bp, Zea mays
  Clone ID: LIB3279-186-Q1-N6-F6
gtggttgttttttttttttttttttttttttttttttttttttgcctgtgaagctgggtttattgggattcactggcttttacagggtatgaacagcgccagaatcggagcccgcaggcccagttacatagcaaatcccaaacctcattggggggggggcaacctttttttcaacattcagtattataagttcatcagggcggaaacaaaccacccacattttattacaccacagacaagcgttactacatcctagcacagcacctgggtatcccgagccttcagtggagttccttgaggaagtcggggttgtcaaccagaaccactttccagccatctggatcaacaaaagaggcgatcttagtgttgatcccaggtagaggccctggctgccgcaaaatcttgccacctagttctttgggggccagatcaaccgcctcggcgctcttgtacacatcattggtgccaatggcaacctgagcatatgcattgcccttgctgtattctgggact

SEQ ID NO: 11389 - DNA, 518 bp, Zea mays
  Clone ID: LIB3279-186-Q1-N6-F7
aaaaagaataggggtttacctgtactagacattagtatgctttacattgcactggggtaaaatgcataggggtttacctgtactatacattaatatgctactggggggggcattgcactggtgaacttaatacaaacatgctggcctatgcttagtagttcctacatgtaaacctagtttatgatgcacaggaaactacatttaacttaccaggagaataccatttatatcaaggggggatgattaattagtatcggtgcatgaagcttgtgctgtaaggctttgactctaacctgggttttgccaaaagttcctgggtacaccacttgagctgaagctatttgctgcaagggtgaggtttgacagaaaaggctgaaatgggggactgtttttaagcagggtaacaacttttgacatttttggagtgaggtgtagggttgtaattgggcataggaggggaacattcatctatgaggggggcttttttgtggagtaattggatcctagattgggataaa

SEQ ID NO: 11390 - DNA, 526 bp, Zea mays
  unsure (1)..(526): unsure at all n locations; Clone ID: LIB3279-186-Q1-N6-F9
gtgttttttttttatgcttgccagcatctcttcattgcangaaaaaaaaatggattacatccaggaacgcagcaacactacgacccacagcgacagagacgtatcaccctaagcattccccagctacgaagaggcgcctagcctccgaagccggggagggggcggccctggcgcttgagcgcgtagacgacatccatggcggtgacggtcttgcggcgcgcgtgctcggtgtaggtgacggcgtcgcgtatgacgttctcgaggaagatcttgagcacgccgcgggtctcctcgtagatgagccccgagatgcgcttcacgccgcccctccgagccagcctccggatcgccggcttggtgatgccctggatgttgtcgcggagcaccttccggtggcgcttggctccacccttgcctagacccttgccgcccttgccgcgccccgacatcgccgccgcctcgaacgggtctttctcccctctctgacggaggccaaataattggggactggtgctggggagctggg

SEQ ID NO: 11391 - DNA, 517 bp, Zea mays
  Clone ID: LIB3279-186-Q1-N6-G1
agcttaaaataccagtagcattactttattactctccgccatgcatgcattcctcgcccggacgcgcacaggacgcctcatttaattaatcctgcaaagagaaacagacagagagagagagaaacaagggtacagcacgttggtgtagtccagaaacacagaacgggcggcgcaagcgcaatggtaataatctagctgcagagcagtattggaacgagagaacacggcatgcaggagcgtgtgtgtagtcagccgtacgtgttgcagttaacgttggtgctgatcttgtacgggagggcgacgccgcacttgctgggctgcgcggcggcgcggctgatgtaggtgccgctcccgttggcgccgttggcgacgttcttgaggcagccgcaaatggtgcggcggtcgggggtgttgttggcctgctgcagcaggctgcggatgccgccgcaacacggctggggcgggatggccccgcccatctggacgaacggcaggcacgggatcagcgtgctgtaca

SEQ ID NO: 11392 - DNA, 581 bp, Zea mays
  unsure (1)..(581): unsure at all n locations; Clone ID: LIB3279-186-Q1-N6-G2
agatcaaagaaattcatattccacaacacccttaagccttgttcggttacaagagaaagaggactaaaaccccttctaatcaattttgattagtgagggattcaatccatttcaatgcagacacaaccgaacacaaacaagccgtgagttgtcaacttcatgagaagctagcaaacgttttcagagcaccattaaggtgtcaccattgagatgtattcgagcgtagcttgccgaacaaatctaattctggtggatctaacaccccaaacgcagaacttgaactaacagaccgataactgcactcgtgtaaccgaagtatcatcaggccaatacaagcgggtagacttaccgcaagctgcctactgctgggcgcactgcaccctctgcccaccgcctggcacatcatcatcctcgtcgtaggcctcctggtgctgctgttgccgcctccgcatctcctcttcgatgttcacgtcgtacgacattgtctcctcgcactcgtccagctccatgtcagtagactgtgatactggcttgggcgggagaacagcctncaagccttgcactgctccgggctcaacgag

SEQ ID NO: 11393 - DNA, 464 bp, Zea mays
  Clone ID: LIB3279-186-Q1-N6-G3
gatcaaatataataaagagaatttttcttttattttacaacccatgaagatgtttcttgcttcaagcatccctaaatagggtacgaaacaccgacttatccattatgctacatagatcctcaaaaagcggaaaccaatttcacattccttggttcggatatgcattcggaataaaaaaacaccgaagatttgaacagaatggaagaaacatgtggacagcccttgttgccagcatctcttatgcataatgatacaatgctctacctgcaaaaatagaataaggactagctgatggagtcctccgggacagtggaatcctgaatcacacggtcagggtctagctgaccactgtaatagctagatggcacagcagaaagttccaactttccagtccactcttcaccaggcttcagagtgacagtcttttcaatagcagccgcctccacgcataccattcgtttata

SEQ ID NO: 11394 - DNA, 465 bp, Zea mays
  Clone ID: LIB3279-186-Q1-N6-G4
gtgttttttgttttatatattgtttttcttctttcttctaaatctaagaacgtacagatatgatccagacatacagacacggacatactttttttccccttctaaatctaaaaacgtacagatatgatcgagacacacagacacgtacgctgggggggggacaacacgtaacaatagcacgtgctgcggcaccgggatatggccggtgggcacgcacgacacacacacacacagctaccagtcgttcttatcctccagtttattggcgctgatcggctgtgctcgcacagtgcatgctgcaggatgcagcccggtagaagcagggaggtgcgcgagcacgtactctcgtcagaccgcgatcgcgactgcgacgtccttgccgttgaccgtgccgttcgccgcgccgtggccgccgccgttggccaccgccggcttaccgccggtgtggtcggtggcggcggagtc

SEQ ID NO: 11395 - DNA, 562 bp, Zea mays
  Clone ID: LIB3279-186-Q1-N6-G5
gtgtttgttttttttttttttttttacggaagattactctagtacactttatagatagagtgaaaatgcatacataaacatgacgagccaattcctcagccaaaaaacattatccatgcaacatcatataggttcgagtaacggtaaacgggggtgcacatagagcaaaattaaagctcgtcttgacaaacacaggaaaacagcaacaccacccagagagggctaacttcataatggccacccgccaagagccggcaaatgggacgcagagcctacagcctccttcccctcctaccgccctttctgcgagtgctgtcagtggggaccggggtaacgtcctcaatgcgtccgattttcattccggaacgagcaagcgccctgagggcagactgggcaccaggtccaggggtcttggtcttgttgcctccggtggcgcgaagcttaatgtgcagtgcagtaatgccaagctccttgcagcgctgtgcgacgtcttgagcagcaagcatagcagcgtaaggtgacgactcgttacggtcaggctttacctttatgccaccgggga

SEQ ID NO: 11396 - DNA, 207 bp, Zea mays
  Clone ID: LIB3279-186-Q1-N6-G6
ggcagaaaaataacacggtttaccagattatactgtcacaaactgttaccgaacacttaaaacaaagactagatgttccccaaaactgatgacaaagcacagctcctcagtacttgataggggcaagaatctccaactgaggccccaacttctcctcggctgccttctcggccttgacacgcagcttggccaattcggacgcgtggg

SEQ ID NO: 11397 - DNA, 524 bp, Zea mays
  Clone ID: LIB3279-186-Q1-N6-G7
ggggggttttttttgagaacggagatagtacaacgacaaacggttacatcatacaacaggagcaatccgggccactggattccagaacctatccatgtacaacaaacaacacaagagagactccaatagatctcaaatctccctttgtgccaggggggcgggcgtggttatttttccccttgaacatcgatcatagatctctgctgcaattatgaggagagactcggtatcctcggccatcttgaagatcctttctgcctccatcgtctgatcatgcgcatcatgtgcttttgcctccgcgtcagccaccttgacagcagctgccatcgcagcctctagtgcagggctggaggcagaaaacaatcctatggcctttgacaccttcgatggctttgatggatccttctgttttggagctgaagcattcattggagctggagtccttgttgcaagggagtctgggatcctataggacttatcgatcttttcaattttgtttgagtctgcaagtcgccgtaactttg

SEQ ID NO: 11398 - DNA, 553 bp, Zea mays
  Clone ID: LIB3279-186-Q1-N6-G8
ccgggctggggggggtgggtttttttttttttttttgtaggaggcgaacaggagttttaacatgacaaaaatagatgcgaacagcttgactgtaacgtggttggtgctacatgagaagggtggccaacacttgtgttccaagggcctggacaacgcggggatgttgggggctttttttttttcaattcttgcaacactcgggaccacagaagctacaacgggctacctcacaggacacaaacacaaaactagctgtcacacatgacagaactgaggcaactttacgctgaaagcgtaaactcgacgtcccaaagcccaagggaggcaccactgggtgggttgggttgacaagcggattttttgacaggttggggttaagttagtgagcaccttttgcagtgacaaatgcagcttccacattttcttactggtgctggacgggttagttccacatttttttactgttggtgggcgggtttagtttccatttagattcaacaaaaattgtttctggccaggtttattttttcaacattggggaaattcaaaaatg

SEQ ID NO: 11399 - DNA, 537 bp, Zea mays
  unsure (1)..(537): unsure at all n locations; Clone ID: LIB3279-186-Q1-N6-H1
cacgcgtcgtagtntggaccttanacggcgcctgggggggggggggaagtcttaaaaaatttatttgggaacagcagagtacgtagcgtagatagtacattagtacatnaagacacctactagtagctatttaaacgatggccattatcataattcccatgccaaagccgattattttttaggggggggggggttactttttttacttagctgataacaaattagcaatgcaaggcggacggacgaccagatagttgagcgtgagcatgcatgactttattcggagctgttcaccacccgggagttccgggggaccttggcgttggtgccgacgcccggtgcaaggctgcccatacgtagtatggactccgcagagtgctggaagaatacggaggcgtaaaaggcgtaagtggggacgaggctaggggacgtgcgtgtgtaccctaggcacgggaggtcgacgacgccagtgcctggtgtgacggtaggaaaccgtggtcagagagcaggatggatagtagtactggttgtgtaagg

SEQ ID NO: 11400 - DNA, 632 bp, Zea mays
  Clone ID: LIB3279-186-Q1-N6-H2
gtaactggatgcaataataaccactaagctcaataccattacagcattactatcattcatcatcaaacaagctatagcacactttcaaaataactggcgaaggtgaccaataagcagacttcgcaaaaatcagtagaggtcaccaccgaccagcccaaccacccaccgcagcctcaagccatgctccttctcttcagaaactttacatggcacaagaagaaaatacaatgaaaagaagaagaaaacattagagtctagagagcacatgcacatgttacacactacctagctaggactgaacaaggagatgcagattgacgctgtataagcgaacctgaacgcttgggttacattttgctagtggtgacggcacttcacactacacattagaagcaccagtcacgggcagttcgagttcttgccagggccgccgtagtagaagtaggtgccccagtccccattgttaccgttctgcacgtcgtagcagttggactgctcggtgaaggtgcctacgcccttgggggcgctgagctggttgctgctgtccaccacctgaacgttcttgaagtagctcgccttgctgaacccttcctccgggaagtgcccgctgcccatactggtcgatgtgtgcg

SEQ ID NO: 11401 - DNA, 508 bp, Zea mays
  Clone ID: LIB3279-186-Q1-N6-H3
aaacgggaatttcagttctcatagcattatcatgaatctcaaaacataacaggggaaacacgaatcaagcagaggccccatggggttcacagatccacacctaaaccgctaaattaaactgggggcgatccatgataaactaagaccacccctcagatcaccaccatcttattcagatccaaaggaacggacccagggggagtcgaccatgacggggggagggcggcccaaccgaccagatcagagagatctaggagagctgtccgcagtcagcgaccttgaccaccttggagggggagcccttgcgggtgcccaccttctcgatggccttgacgacgtccatgccctcgacaacctggccgaaaaaacgtgcttgccctcgagccaaggggtcccgacggtgcaaataaaaaactgggagcccttggtgttgggccccgcgttggccatggagagccaccgggggcggtgtgcttgcgcacgaacttttcgtgggggaacttctccc

SEQ ID NO: 11402 - DNA, 611 bp, Zea mays
  unsure (1)..(611): unsure at all n locations; Clone ID: LIB3279-186-Q1-N6-H5
gcatgcaccgcgnntacgtaagttcttgtgtatcctctagnagnncggcccgcccttgtggtttgttttttgtttttttttnntttttttttttttngttttttggcaaccctcagaagaaacaaggcatttcttcttccattctaaatagcaaaggacaacttgcagcaggacacatacacatacaagcacattcgtcccatctgcagcctacgcgtgagcggatactggtaacaaggtactgctaaacatcagatcactccggacaggcagtctatgccttcttaggggacttggcggccttcttgggcgactttgcctccttgctcccgccactggacgccttctccgccgtcttcttgggcagcagaacagggttgatattggggagcacaccgccgtgagcgatggtcacgccgcccaacagcttcccaagctcctcgtcgttccggatcgccagaagcacgtggcgcggaataatgcgagtcttcttgttgtccctggcagcattaccggggagctccagaacctcagcggcgaggtattcgaggacagcggcgaggtaaacgggggcgccggtgccgacacgctgcgcgtagcggccctttttt

SEQ ID NO: 11403 - DNA, 513 bp, Zea mays
  Clone ID: LIB3279-186-Q1-N6-H6
gggggggggggggatcataattcccatgccaaagccgattattttttaacccaaacaaacttactggcttgacttagctgataacaaatcagcaatgcaagccgcacggacgaccagatagttgagcgtgagcatgcatgactttattggggaggggggaccaccctttatttccggcggacctcgccgctggtgccgacgcccggtgcaagcctccccatccgcagcaatggactccgcgaagtcctggaagaatacggaggcgtcgaaggcgtaggtggcgacgaggctggcgacgtccgcctctaccccaggcacggcagccgacgacgccagtgcctggtctgacggcagcagaccgtcgccagagagcaggttgatgtagtactggttgtcgaaggtcgccggggtggcgaggtccaggtgtgccagcgcggacccagccgaccccgtgcccagctgctgcagcgactgcaagaaggtgaggtccttgaaggcgcccgcgccgccttc

SEQ ID NO: 11404 - DNA, 125 bp, Zea mays
  unsure (1)..(125): unsure at all n locations; Clone ID: LIB3279-186-Q1-N6-H7
tggggggggggggggagaaaaaacaanaacgcgcggagggaaaacccannagcaaagcgggggaaaaaagncnnacaacgnaagnngnaaaccacacaacgacagangngaaagaaccgacagaa

SEQ ID NO: 11405 - DNA, 522 bp, Zea mays
  Clone ID: LIB3279-186-Q1-N6-H8
gggggggggtggttttttttttttttttttttttttttttttgctgaatcaaactgctaataccataataatttcaccaaacataacatatggttaaattgttaagtagttgaattataccatccgacacctcttctgtaaggatacacggggggggggggggctttttttttaactgacttgagtgttccagaatcaaactgtaaataccctaaagcactgaataagcaccctacgtttgaagttccaccttgtaaaaataacgcacactaccctctcaaattctgatggttcgttacctagtattctttcttgatctctggtttcgaaaacccacggagcagtgttgcagctgttactctttagtcgatcttgaccgaagagtatatgagcctggtgaaccagaagcagctgtagaagccaatggtgccggtgagcacaaaaaaagcgtttgaggcaatgagcatgttgccaaagtataagacgccgggaaagggcttcgttatttccagctttggtgaa

SEQ ID NO: 11406 - DNA, 505 bp, Zea mays
  Clone ID: LIB3279-186-Q1-N6-H9
ggcggtgggtgggggggggggttttttttttttttttttttttttttttagggacaaaacccgttcgggggatagccattaagcaaacaagcagattccagtacgggggcaatatactactaataagggcataaattgaagccggaaatctgccccaggtgggggggggggggtccaatttagacagaaatgcatcaatagcagtaaaaaaagaacgaggggggccaggcctacttccatcataaatcacagcagccaagggagcattgggtacagatcaaaagagcacctgggagatgcgtatggacacgatctgcccgtccctgggcgggtcccgcatcgcctcaaacgttgatagtagtcctcccttgctctggagggtggtgtggatggcaacggcggttgcggaagcacagtgcctggtcatcgggtcgtcgtgctttccggtccaggccctgttgaggacagatgcagtggatggggaaacgaactgcttcgcgttgac

SEQ ID NO: 11407 - DNA, 679 bp, Zea mays
  unsure (1)..(679): unsure at all n locations; Clone ID: LIB3279-187-Q1-K6-A1
ccccgtgtccgaaccgccaccgtcgcggctccctgaaccatcagaccagcccagagcccagcccaccacaaacgctgctgctgctggagagaggggcgcgcgggcggacgggagcgatgggcaactgccaggcggcggaggcggcggcggtcatcatccagcaccccggcgggaaggtcgaccggctctactggtccaccaccgccgccgaggtcatgcggaacaacccgggacactacgttgccctcgtcatactccgtgttcctgcagataacaagcccgccgccgccggggacgccgcggcgtcctccggccccggcagtggtggtgccaagatcaccagggtcaagctgctgaagcccaaggacacgcttctccttggccaggtctaccgcctcatcaccgcgcaagaggtgacgaaggcggtgcgggcgaggaagaacgagaagatgcagcggtgcgaggccatcaggcagcagcacgagcagctccggcgcggcgacggggctcaccggagctcttccagccaggacgggaagcaggacaaggaccggcaccggnggaagaggccggcactggcggccggcgctgcagagcatctncgagtccgcgagccagagcagcagcagcatcgtctctgaattcgcaccagctaatgctactgaccggactgtgccat

SEQ ID NO: 11408 - DNA, 650 bp, Zea mays
  unsure (1)..(650): unsure at all n locations; Clone ID: LIB3279-187-Q1-K6-A10
gcaccatgaatgcctacaaagctgctcaggatattgctcttgctgatctggctccaacccaccccatcaggctcgggcttgctctcaacttctcagtgttctactacgagatcctcaactcccctgaccgtgcttgcaaccttgcaaagcaggcctttgatgaggcaatctccgagctagacagcctgggagaggagtcctacaaggacagcactctgatcatgcagctcctgcgtgacaacttgaccttatggacttccgacaccaacgaggacggcggggatgagatcaaggaagcagctgctgcccccaaagaatccgcccccgagggccagtaagacggatccgatctcccgacctgatgcgtgtctgctgatgtcggggagtttaccaggactgtgccgttcttgatttctgatagcttatcttctagtacacctcgtgttgttctcttcgncacggcgccggtgcgcgtgcgctgaagctgcctgccattgccattgcctttgccgctgtttttaattaagcacacactctagatgttatgcccgcatgctatgtttcgattctcaagttgataaatgatggctgtatgctggttctcgtcctcaagcctgctgcttcttccaggnaaaaaagcctgcccttgt

SEQ ID NO: 11409 - DNA, 635 bp, Zea mays
  Clone ID: LIB3279-187-Q1-K6-A11
gtcgtctctcgctccctcggtccttccttcacccatctcacccgcgacccgcccctttcccctaagccatctccttcctcctcacctcgccatggcgttcttctctcatcaccatctccagcagccacacgcgcagcagccagtgctcccttccttcaggaacgcgctaccggtgcctgtggatggccagatcccagcgcccctcaccttcttcaacccgccgcctgccttcccggagcaacccgcgcaggcacctctggtggatgcggtgggcttgacggcagctgcggggcttgggtggaggcagccgagggagcaggaactgcttggggaaaactcccagatgtcgtccattgattttctgcagacgggctcggcagtgtcgacggggttggcgctgtctctggaggaccggcgccacggcggcggcggggctgggaactcctctggcgattcaccgctgctcctgctgcccatgctggacgatgacatctcacgcgaggtccagcggcttgacgctgatatggatcgctttattaaagctcagagtgaaaggctgaggcaatctatactggaaaagttcaggcaaagcaatttgaggcactggcctcagttgaggacaagatactcagaaa

SEQ ID NO: 11410 - DNA, 653 bp, Zea mays
  Clone ID: LIB3279-187-Q1-K6-A12
cgcgcccccgctcgcttcacttctctaggtgcgcaccgatcagaaggtgcctgcctcctcctcgtcggcgaaaagaggcggtgccgctgctgacgaagaagatcgtgaagaagcgggtcaagcagttcaagaggccccacctcgaccgctacaagtgccttaagccaagctggcgcaggccaaagggtattgactcccgtgtcaggaggaagttcaagggatgcaccttgatgcccaacattggttatggttctgacaagtcgaccaggcactacctccccaacaagttcaagaagtttgtggtccacaacgtttctgagctggagttgctcatgatgcacaacaggacctactgcgctgaaattgctcacaacgtgtccactaagaagcgcaaggagatcgtggagcgtgctgcgcagctcgacattgtggtcacgaacaagcttgctaggctccgcagccaggaggacgagtagtctggtttcttgtcttaacgacgaactggatgttgccattcctttctgtaggaaactactttgcttgtgtcttgttagtactgaaaaccagagtcactcctacctttttgcaatcagtagctactaaaatgtggcagattccactatttccttgcatctatctaaattatatgcgtt

SEQ ID NO: 11411 - DNA, 593 bp, Zea mays
  Clone ID: LIB3279-187-Q1-K6-A2
cgattgggtgccgggttgccaaggacatggaggattcgagcggctgctcgtcgtctccagccgtcctacggaacaagtactgggtcctccgccacggccgcagcgtccccaacgagcgcggtctcatcgtgtcatctctggagaacggcacgaagccggagttcgggctggccccgcagggagtcgagcaggcgcgcgcggccggcgaaaagttccggaaggagcttgacgagattggtgtgccggtgggttccgtcaagattcgttactcgccgttctcacggaccaccgagacggctagagtggtcgccggtgtgctcggcatcccctttgaagctcctagttgcgaagcggtgctgggacttcgtgagcgctactttgggccatcatatgagttactttcacatgataaggtgggtttccttctttggattcagttatattgtttcagtagaaatgaaaggacattcttgtcatatgagcatctactgaggtatttgatacaggttcaattctataatatgaattggtcggtgaaatctaagtggtgcattttcatctataatctaagaaatcttagtccttctagcacc

SEQ ID NO: 11412 - DNA, 701 bp, Zea mays
  unsure (1)..(701): unsure at all n locations; Clone ID: LIB3279-187-Q1-K6-A3
tccagatttcccgtcgccgagcccgcgggtcgagtacccgtcgaactcgccgctgtcggatcgttctcgcttggggcgatcaagctaacgggatttgaggagatctaggccagccgcgggcagcagccatcagccatgagcgaggtgttcgagggctacgagcggcagtactgcgaggcctccgcctcgctctcccgcaagtgcaccgctgcatccgccctcgatggagagaggaagaagcagaagctctccgagatccagtccggcgttgaggaagctgaatcgctgattcggaagatggacctggaggcaaggagcctacagcctagcattaaggctggtttgcttgcaaagctgagggagtataaatctgacctcaacaacgtcaagagtgagctcaagaggatatctgcgcccaatgccaggcaggctacccgggaggagctcctggagtctggaatggctgatactctcgcggtgtctactgatcagaggggaagattgatgatgacaactgaaagactgaatcagtccactgacagaattaaagagagccgaagaactatgttggagacagaagaacttggtgtctcgattcttcaggaccttcaccaacagaggcagtcactactacatgctcatactactntgcacggnanttgatgatacattggcagagcaagaagaccctgctgcatgtc

SEQ ID NO: 11413 - DNA, 676 bp, Zea mays
  unsure (1)..(676): unsure at all n locations; Clone ID: LIB3279-187-Q1-K6-A4
gcaccactcacctcgtattcaatgatgatattcagggaacagcttctgtggttcttgctgggcttattgcagcacaaacattacttggtggttcattggcagatcacacttaccttttccttggtgctggagaggctgggacaggtatcgctgaacttatagctcttgagatctcacgtcagacgaaagctcctatagaggagtgccgcaagaaaatctggcttgttgattcaaagggcttgattgtcagtacacgaaaggagtcccttcaacacttcaagaaaccatgggctcatgagcataaaccactcagcaacctcttagatgctgttaatgctatcaaaccaacagtgttgattggcacatccgggaaggggcaaactttcacaaaagacgttgttgaagcaatctcctcatttaacgagagaccaatcattcttgccctatcgaacccaacatcacaatctgaatgcacagctgagcaagcttacacatggagcaagggacaagcagtgtttgcgactgggagtccatttgatcctgtggagtacaatggcaagatacatgttcccggacaggcaaacaatgcctatatcttcccaggggtttgccctcgcgtggtgatgtctggagctatncgcgttcatgacgacatgcttctggcagcatcgggagc

SEQ ID NO: 11414 - DNA, 583 bp, Zea mays
  Clone ID: LIB3279-187-Q1-K6-A5
actagaaactaggggattatttgtatatataatatatatatacttatatctggcgataatattgcatatgccgccgttttcttaatcaaggctaatggcatcttctcctcttgtggtttagtagaactatccactaaaaaggtagggactaaaagaacaaaagaaagtgggagctaacactatgctgacactcaactctctttttttttctcctatatatccaacatcacttttccttggcttctagtattctatgattaggctggggtatcactcgcttccaatgctgaactttacatccccatggctccgtgatcggaggacagcctgcgcatggggaagaagtaggagctgggcgaagggatttccagcgcaggggggcggagatggttactgccgccgtcgatcttgctcccaacacaggacgcggtgttctcaggctccgtggcggcgaaactgtcgtgcacgagcgcggcagacttggtaggggacgcaaatgggctgtccggcaaagttgtgatctccactttggtcgctatcagcggcgtcagggctcgcctcgcaagcagattcttccttgtcg

SEQ ID NO: 11415 - DNA, 679 bp, Zea mays
  unsure (1)..(679): unsure at all n locations; Clone ID: LIB3279-187-Q1-K6-A6
ctccactccccccttcacanatccgttcctccagctagggttagcgttcctctgcagcgatggcgatcaagcggaccaaggcggagaagaagatcgcgtacgacaagaagctgtgcagcctgctcgatgagtacaccaaggtgctcatcgccctcgccgacaacgtcggttccaagcagctccaggacatccgccggggcctcaggggcgactcggtggtgctcatggggaagaacacgctcatcaggcgctgcatcaaggtgtacgccgagaagaccggtaaccacacctttgacccgctcatggacctcctggtcggcaacgtaggcctcatcttcaccaagggagacctcaaggaggtgcgcgaggaggtcgccaagtacaaggtgggggctccggctcgtgttggtctggttgctccagttgatgttgttgtgccccctggcaacactggtctggatccgtcccagacctctttcttccaggtgcttaacatccccaccaagattaacaagggtaccgtggaaattatcacccctgtggagctgatcaagagggtgaaaagtgggctcgtccgagtctgccctgctcgccaagctgggtatccgccccttctcgtatggcctccaggtcaccagtgtctacgaggatgggntccgtgttcagcccttgagtgctc

SEQ ID NO: 11416 - DNA, 678 bp, Zea mays
  unsure (1)..(678): unsure at all n locations; Clone ID: LIB3279-187-Q1-K6-A7
cggacgcgtgggatctcaaccagttctcttgtatgctattcttctgatgatcctcctttctccttttgatatgttttacttatcatcacgcttttactttctgagaacagtctggcgtataatactgcctttacaagcaattacatttcctgacttctttttggctgatatttttacatccatgtcaaaggtgttctcagatctggagcgttcggtttgtcgtatggtgaatcgccaggttgcaacaatcgcttggtttgaagcagattctatttgtggcagtcattccgtagctattcctcttgttctcgtgtttccctacttgtggcgtttcttccaatgtctccgtcagtacaaggatacaaaggagaagacatgtcttttcaatgctctcaagtactcgacagcaattcctgtgattttcctttccgctctcaagtatcatgtatatcctgatcaatgggttggcttctaccgccccctctggcttatctctagtgttgtaaattcactgtattccttctactgggatataaagcgagattgggatttgagcatcctaaccaggattntcatgttcaaaaatccaagcatatggactaatcttctntacgggcagaactgggtattctactgggtacctggcagcaacttggttctgcgatgcacatggacata

SEQ ID NO: 11417 - DNA, 672 bp, Zea mays
  unsure (1)..(672): unsure at all n locations; Clone ID: LIB3279-187-Q1-K6-A8
cccgagtctccagccaaccgcatccagtccaccccatccccctcgaccccgacaaccccgagtcccgacccgatggcgcccaaggccgagaagaagccagcggagaagaagccggcggccgaggagaaggcggagaagacgaccgcaggtaagaagcccaagtccgagaagcgcctgcccgcctcgaagtcctccggcaaggagggcggcgagaagaaggggaagaagaaggccaagaagagcgtggagacctacaaaatctacatcttcaaggtcctgaagcaggtgcaccccgacatcggcatctcctccaaggccatgtccatcatgaactccttcatcaacgacatcttcgagaagctcgccggcgaggccgctaagctcgcccggtacaacaagaagcccaccatcacctcccgcgagatccagacctccgtgcgcctcgtcctcccaggagagctcgccaaacacgccgtctccgagggaaccaaggccgtcaccaagttcaccagcaattgagcagcctccagcgtccacggatttgttaggtctccccttcttacaagggttcttcggtcgtgtcctctacccctcccctccccgcctatgtatgtgctgtgaaatcgntgatgttctcgtcgggtgaacaaagccagtagctagcttgcctgc

SEQ ID NO: 11418 - DNA, 658 bp, Zea mays
  Clone ID: LIB3279-187-Q1-K6-A9
cacaaactcctcgcagcggcaatgatggatctttccagaaggctgctcggggtaacagcagctcaatatttatccggggctttgataaaaatctttcagaggatgagatccggagctctctcgaacaacattttagtgattgtggtgagatgacaagggtctctatcccgactgatcatgaatctggtgcaataaaaggaatggcttacatagacttcaaggatcaggactctgtgtctaaagcccttgagctcagtggctctgacattggtggtggctatgagctttatgttgatgaagccaaaccaagaggcgatggccagcgtggtggtggtagatctggtggccgttctggtgggagatttggtgaccgttctggtggccggcgtggtggtggtagatttggtgaaagatctgggggcagggatggtggcggcagattcggtggccgacgtggtggtagggatggcggccgaggacgtggtggccgtggctttggtaacaagcacagcgctggcactcccagtgcaggaaagaagatacttttggtgatgattgatgatgaacgcggaggatgcggcaaaaggatccaatgaaattgtgtttttttggtcttggtgtggtaccgtaactggaatttggtattttttgtctacta

SEQ ID NO: 11419 - DNA, 678 bp, Zea mays
  Clone ID: LIB3279-187-Q1-K6-B1
cggacgcgtggggggcggtgatgggcaccggcgcggcgtccacgaacaccaccgactcctcgggcggcggcgttgagttctggcgcgccccggagcgcgtgggttggctgaccaagcaaggcgagtatatcaagacatggcggcggcggtggttcgtgctcaagcaggggcggctcttctggttcaaggaatcgaccgtcacgcgcgcttccgtgccccgcggtgtcatccctgtcgcctcctgcctcaccgtcaagggcgccgaggacgtcctcaaccgaccctacgccttcgagctctccacgccgcgcgagaccatgtacttcattgctgacaccgagaaggagaaggaggagtggatcaactccatcgggcgctccatcgtccagcactcccgctccgtcaccgacgccgaggtcgtcgactacgacagccgccctggcgacaaatgattgatttgtgagccggtcacacctgttactctgcagcgtctctatgctactttatctctgcagcgtctctatgataattagtgcctgtttggtttgtgctaattatgtcatgctttgcctaatggtagtcgtttcaattaaataactaaccttagacagaaaagtagtcaaagtgtggtaagctaggacatgtttggtttgatgactaaatatcacatttgtctac

SEQ ID NO: 11420 - DNA, 686 bp, Zea mays
  unsure (1)..(686): unsure at all n locations; Clone ID: LIB3279-187-Q1-K6-B10
ccccgcgtccggttctagatcgcgagcggccgcctcagcccgccgcaaggagaggtaagttcaggagacatcttcgagaagctgaaatggctcctaaagctgctcctgccaagaagggtgatgccaagacccaggccttgaaggttgccaaggctgtgaagtctggggcagccaagaagaagaccaagaagatccgcacgtctgtgacatttcaccgccccacgaccctgaagaaggctagggaccccaagtacccacgaatcagcactaccggaaggaacaagcttgatcagtaccaaattctcaagtacccccttaccacagaatcagcgatgaagaagattgaagataacaacactctggtcttcattgttgacctcaaggcagacaagaagaagatcaaggctgccgtcaagaagatgtatgacatccaggcaaagaaggtcaacaccttgatcaggcctgatgggaagaagaaggcttacgtgaagctgactcccgactatgatgctcttgatgtggccaacaaaatcggcatcatctaagtgctgcattaggcatcctagttcatctgttgtgtcctagttctatgtgaaaccagagttntgtagctatggctctcaatcgttccattaccatgtgttatgcacacttctgaatttgtatcatccagtgaccttttgact

SEQ ID NO: 11421 - DNA, 675 bp, Zea mays
  Clone ID: LIB3279-187-Q1-K6-B11
cggatctgagacgagacgagttaccatctcatcccaactccggaacgaacaagttaccatctcatcccaactccgcctcgaccggatctcgtcggactcggatccgcccgaccaccccgcgccgccgcagatcaaagaagatggcagctgtcgacacattcctcttcacctcggagtctgtgaacgagggacaccctgacaagctctgtgaccaggtctcagatgccgttcttgacgcttgccttgctgaggaccctgacagcaaggttgcttgtgagacctgcaccaagaccaacatggtcatggtctttggtgagatcaccaccaaggccaatgttgactacgagaagattgtcagggagacctgccgcaacattggttttgtgtcaaacgatgttgggcttgacgccgaccactgcaaggtgctcgtgaacattgagcagcagtcccctgatattgctcagggtgtgcatggccacttcaccaagcgccccgaggagattggagctggtgaccagggacacatgttcgggtatgcgaccgatgagacccctgagttgatgcccctcagccatgtccttgccaccaagctaggtgctcgtctcaccgaggtccgcaagacggaacctgcccctggctcaggcctgatgggaagaacccagtgacagtcgagta

SEQ ID NO: 11422 - DNA, 633 bp, Zea mays
  Clone ID: LIB3279-187-Q1-K6-B2
ccctaacttcccggccgccgctttcctttccctcgatccacagctcgcgccgttcctgcaagtgcgcacccatcgtcccgcctacgcactgccgcccaacgatctacgagctgccatggctaactcggcaccgggaggaatgaggtcgttcctgcaggccgtgtctacggtcaccgaggaggcgccgacgccactccgcgtcgtccagatggagggcctggctgtactgaagatcatcaagcactgtgaggagtttgcgccagctttagttacaggtcaattgcttggtttggatgttggtagtgttctggaagtgaccaactgttttccgttccctatcagggaagaggatgatgaagcagatgcagatggtgccaattatcagcttgagatgatgaggtgtttgagggaagttaatgttgacaacaatactattggatggtatcagtcttgcttgcttggatcttttcaaactgtggaactgattgaaacatttatgaactatcaggagagcatcaggagatgtgtgtgcattgtctatgacccatctagatctagtcaaggcgtgctagctctcaaagccttaaagcttacagactcgtttatggatctttaccgtaacaatggtttaac

SEQ ID NO: 11423 - DNA, 647 bp, Zea mays
  unsure (1)..(647): unsure at all n locations; Clone ID: LIB3279-187-Q1-K6-B3
cccacgcgtccgctctgatgggcgttctgtaaaatcaattattgctcacgtggnnctccactgaaacttatcctggtgcatggatcagctgaagcaactgaacatttgaaaatgcactgcgcaaagaatttagatttgcatgtttatgctccacagattgaggaaactattgatgtaacatcagacttatgtgcttataaggtacaactttcggagaagttaatgagtaacatcatttctaagaagttgggtgagcatgaaattgcttgggtggatgcagaagttggaaaagaagatgagaagcttattttgcttcccccatcgtcaacaccaccaccccataagcctgttcttgtgggtgatctaaagttgtctgattttaaacaatttttggaaaacaaaggctggcaggttgaatttgccggaggtgctttacggtgtggcgaatacatcatggtgcgcaaagttggtgattctatcctaaagggcagcacagggtcccagcagatcgtcatcgagggccccctctgcgaggactattacaagatcagggagcttctgtactcgcagttctacttgctgtgaggcaacgcttgtgttgtccgaatttggcgtgggatgaccgtgacaattttggcatcagtttc

SEQ ID NO: 11424 - DNA, 486 bp, Zea mays
  Clone ID: LIB3279-187-Q1-K6-B4
gagagagaggggaagggatcgagagcgcggcggaggcgatggcgagcggagggaagggactcaacgcgactggggagttcttccggcggagggacgagtggaggaggcaccctatggcggggaaccagctgcgccacgccacacccgggctcggcatcgccatcgtcgccttcgggatctacctcgtcggcgaggccgcctacaaccgcctctaccgcccctccggcgacaaccaccactagatcgccggcaggatccgtgactcggtcaagaagctggagccaactttaccaagcactggtgctgttgatgtttttacagttttgagctcataaggtcagccatgaccatattgtaatctgtgaccaggtagacttgcccactggtccgtccaactattgtcttgggaccctgtgttaatccttgctatatggatctgacagtgctcatgtaattcaagaatcctggactatcttttatgtgctt

SEQ ID NO: 11425 - DNA, 661 bp, Zea mays
  Clone ID: LIB3279-187-Q1-K6-B5
cggacgcgtggggacggacacagtactgcaggaagtcttccaaagcattggtccagtagaagggtgcaagctcatcagaaaagaaagtcatcctttggtttcattgactactatgaccgcagatatgctgcactggcaattttatctctcaatggcagacaactgtatggtcagccgattaaagtcaattgggcatatacaagtactccgagggaggacacatcaggtcattttaatatttttgttggggatctttgcccggaagtcactgatgctactttgtttgcatttttctctggatactctacttgctcagatgctagggttatgtgggaccagaaaacaggacgatccagagggtttggttttgtttctttcaggaaccagcaggatgctcaaagtgcgataaatgacttgaatgggaagtggcttgggaaccgtcaaattcgttgcaattgggcaacgaaaggtgctaatgctggtgaagagaaacagattctggacactaaggttgacctgtcaaatggttcatcagaatctggaaaagagaatccaaatgatgatggtcctgaaaaaaccctcagttactactgtttatgttggcaatcttcctcagaggctccatgaatatgtgcacctgtttttccattcactggggctg

SEQ ID NO: 11426 - DNA, 674 bp, Zea mays
  Clone ID: LIB3279-187-Q1-K6-B6
cccacgcgtccggtctcgtctctctccgatccctctcctctccctccccctagccactacccacttgagcgagccctaggccctagcaggcgaaagccatggcgtccttgggtgttcgtgccgccgccgccgctcgtcttccctccctccgtcctcgccgcgacggcagcagggtgctcaccggcttgagggtcgggacagggcactacggcgtgcggctcgcgctttcttcgtccacatcagcttctcccagagagttcaaggtcgctggccttcctgtcgatgacagcagtttgggcccgggggatgaatatgagtttggactctatactcctaagctgcttgcagttactggagatgattatgtgtctaacccccgcatgccagacgaggatgagttcgaccatttctaccgtgttgtcgccaagaagactgacatgctgctcagctgccaccttccaaagccgcttgcagtttctgaagaggagaaggccgtgcaggagaagttcaaggagatggcgaacgaatgcatcgacctcctggttgatgcgatgcgccgcatcccagcggagaaaagcgcccactgttctcggtgtttggtgagctgtacccggtatttgagtcagtgaggtggactgccgagggggggtgtgccaagtggtggatggcgctgc

SEQ ID NO: 11427 - DNA, 637 bp, Zea mays
  unsure (1)..(637): unsure at all n locations; Clone ID: LIB3279-187-Q1-K6-B7
cggacgcgtgggtgcaagtaagtgataaaaaagagactacacatcctacagacttgaagagggaacacatgcaagctaatgcagtccctcacaaatctaaaactgctttatcaaaaacatacagcaagctagcatcaaatgggctattggccacctccatgaatgccaaagttgacacgaatgccaaattaggccttgagcctcctatctcggggaagtcgtctctactgaatgctcgaagcagcacaccacatagcgctggacataaagttgttgcaagtcatgtgcttctaaaagctagcaatacttctgattcattgcaaggtgttccttccaaagataataaatcgtcaacaatttctcaactgacaggagcaagaatcacaaaattaggaatcagaagtctgaaatctgacatggccctagagaaagaatcagtacaagtgagtgggacaaagtgttccccggtaacaacatccagaatccttgactccattcctgaaggaaaacctgcattgcctagcccatccataatgcagaaagttcctgaggaatcagctctaaatccaaaagctcctaaagtgctcaaacacantcatgagatctccagctgtaagaaaatcacctagaactgttc

SEQ ID NO: 11428 - DNA, 662 bp, Zea mays
  unsure (1)..(662): unsure at all n locations; Clone ID: LIB3279-187-Q1-K6-B8
cttcaagcgcaagctgcctcctcctcgtcgtccggtcgtgagaagggatggcgggccgtggcaaggctatcggcgctggncgccgcgaagaaggcaacgtcgaggagctccaaggccggactccagttccccgtcggcaggattgccaggttcctcaaggcgggcaagtacgcggagcgcgtcggcgccggcgcccccgtgtacctcgccgccgtcctcgagtacctcgcggctgaggttctcgaacttgccgggaacgccgcgagggacaacaagaagacccgcattgtgccgcgccacatccagcttgctgtgcgcaacgacgaggagctgaccaaactgttgggtggtgccaccatcgcgagcggaggtgttatgcctaacatccatcagcatctgctccccaagaaggctgcctcctccaaggccagtgtcgacgacgacgacaactgagactgcttcctgcagaaatgatccgaccaccgccttgttttgtaggaataggatgatgttgtcttcggggaggagtcgggtttgttgggaaggaaaattagattagtatcagtttttttgaatgggatgggaacgtggctgtgaatctcagggttgtatgctcgttgagaaagaaatggaagacttcgtgatgcacgatgttgatgccg

SEQ ID NO: 11429 - DNA, 517 bp, Zea mays
  Clone ID: LIB3279-187-Q1-K6-B9
gcggctgcaagatccactagactcatccacagcggcacagccgatggatccttccatgctcctccgtccgtccgccttgctacaagcaggcagccaccaataagctagctcttgttgttgttttgcatgtttgattgggtgtcccttcccagtcgagatggaataatgtcaggcgcacgtacagacgtgttattacgatatttctcccctacaaataaaaactcgatctgtggggttaacactgtcccctagtattacaattaaaaaaagatgttatcacgcatgttaagaaaacatctgaatccctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccttttaaaagaaccaaattttactacccggggattgaaaggaataatttttttttaggggccccaaaaataaa

SEQ ID NO: 11430 - DNA, 534 bp, Zea mays
  unsure (1)..(534): unsure at all n locations; Clone ID: LIB3279-187-Q1-K6-C1
gggtaaaataagctattttcccactcaatcttcagggnaaaccggaggggatttaagttttcaaactagcccagagtgtagttaaattcagtgcgtccttagtacaagcagcccggttatggtaatgataggatagtgaaaggtgtacttctatcctggttagagtaaaaaacgaatacggttttccgtgttaaaaaaaaaaaaaaaaaaaaaaaaaaaaaaaaaaaaaaaaaaaaaaaaaaaaaaaaaaaaaaaaaaaaaaaaaaaaaacccaaaaaaaaaaaaaaaaaaaaaaaaaaaaaaaaaaaaaaaaaaaaaagggggggccctttttaaggaaccaaattttactcccgggggttggaaagtttttattttttttttggggccccaaaattaaattcatgggcccggtttttaaaacggggggatgggaaaaacccgggggttccccaatttaaatgctttggaaaaaattccctttttcccaagtgggttaaaaacaaaaaggcccccaccaatccccctttcaaa

SEQ ID NO: 11431 - DNA, 232 bp, Zea mays
  Clone ID: LIB3279-187-Q1-K6-C10
cattactcatgcaattttttggtaatggctacgcaacatttaactcaagtggccaaggagtttttttcccgggaacatggttggcggtctagtcttcggattgatagccattagtgtgtgtttttagattttgttgggctgtgtgctcctatgggcagaggccggaagtgactttcaaggaattgtgtcatctctatgtactattcttgaatgaataaaaatccttcccttt

SEQ ID NO: 11432 - DNA, 317 bp, Zea mays
  Clone ID: LIB3279-187-Q1-K6-C11
ctgtcctcatctccgcgaagacaggctaccgccgccgccctacgccaggtgccgaggcctctctgtctcttcgccggcgacgatccagtagccagcagcagaaggaggacaccatgaagcttgacgtgaatgcccttcgctacctcgccaaggacgacttccgcgtcctcaccgccgtcgagatgggcatgcgcaaccacgagattgttccagcagaacttgttgacaggatcgccagactgaagcatggaggcacattacaaagtgctgaggaatcttttgaagaacaagctagtgcatcatgatgccactaaata

SEQ ID NO: 11433 - DNA, 713 bp, Zea mays
  unsure (1)..(713): unsure at all n locations; Clone ID: LIB3279-187-Q1-K6-C12
ataattaagcagttggtggtcattagcgtactgcacagagtgcctacagaaaagctagagaagtaaacaaaatggctgcgtcctcgtacttccttcttgctgcttttctagcggtggttgcttcccatgccaccgcttccgatcctagcccgctccaggatttctgtgttgcggacatgcactctcctgtgaaggtgaatggatttgtttgcaaggactccatggccgtgaccgcagatgacttcttcaaagcagccaatcttgataaggctagagacaccatgaagagcaaggtgggatccaatgtcactttgatcaacgtcatccagctccctggcctcaacactcttggcatctccctggcacgtatcgactacgcgccattgggcgagaacccgccgcacacccacccacgtgccacggagatcctcacggttcttgaggggacactctacgtcgggtttgtcacctccaacccaaacaagctatttgccaaggtgctcaacaagggtgatgtgttcgtattcccccaaggtctcatccatttccaattcaacccggtctataacaagccggccgttgctatcgcggcgctcagcagccagaaccctgnggttattaccatcgccaatgcggtcttcggatcaaaccaccgatttcgnatgatgtcttggcaaagctttccaggtggagaagggacaattgattggctc

SEQ ID NO: 11434 - DNA, 567 bp, Zea mays
  Clone ID: LIB3279-187-Q1-K6-C2
gcggatcatcggagagctggccaactgctggagaagcccacgtggattttgacagggttgacgcctttgtgcatcagctcaaaggaagcagtgcaagtattggtgctcagaaggttaagaacacttgcattcagttccgcgaatcctgtcagcagaagagcaaagatgggtgcctcaagacactggagacagtgaagattaacttctatgacctgcgtgacaagtttcagaccatgcttcagctgcagcgtcaggtcaatggctgtccccccagcaagtgaacaagatggtggagtggagcttcatgttgggatgatgcgtgcatctttcaagttccagaacattctgaataagctcctcaattggcttctaggaagtctgtaatagcttagcagcaagattagcgttgacaccaccgtagcagaagtcaatgtcgtcgtttttgtgtcaccgtcttagtcgtaagtgtccgtgctgggtgatggatctcctgcaagcagttgcaagtggtccatttactatgtagtagtggctctgaataatctatatcttagcaatgaatttggc

SEQ ID NO: 11435 - DNA, 646 bp, Zea mays
  unsure (1)..(646): unsure at all n locations; Clone ID: LIB3279-187-Q1-K6-C3
ccacaggccaccaccattccttccttgttccttccccagctccgcaggctgctcatcgccctccctccgcgcccccgatccagatccagatccaggggcttgtcatggcatccaaacgtatcctcaaggaattaaaggacttgcaaaaggaccctccaacatcatgcagtgcaggtcctgctggtgaggatatgttccactggcaggcaaccatcatgggtcctcctgatagtccatatgctggaggtgttttcttggtgaacattcatttcccgccagactaccccttcaagcctccaaaggtatcttttaagacgaaggtcttccatccaaacatcaatagtaatggaagcatatgtcttgacattcttaaggagcagtggagccctgctttgacaatctctaaggttttgctttctatctgctccctgcttactgatcccaacccagacgaccctcttgtccctgagattgctcacatgtacaagacggatcggcctaagtacgaggcgacagcccgcagctggacccagaagtacgccatggngatgaaatgttcggcgttactggctaaatgcagnacgattgtggtgttgcccatgaaactgttatcgnngacgtatgttcttctgttccttgtgcattc

SEQ ID NO: 11436 - DNA, 672 bp, Zea mays
  unsure (1)..(672): unsure at all n locations; Clone ID: LIB3279-187-Q1-K6-C4
ggagaacagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgctgnatacccaccgcagtacatctatggtggccatgttgctgactactgaagaacctgctg

SEQ ID NO: 11437 - DNA, 645 bp, Zea mays
  unsure (1)..(645): unsure at all n locations; Clone ID: LIB3279-187-Q1-K6-C5
gtgaccccgaggcccgagcccgagcggcggcgcgccgggcgtcttgacgtccccaatgacgccgcgcgtcgtggacggacctccgcagcttccctctcgtccgttccgcagtccgcacggggaggggagctacagcgacctaccgccgaggcgggccccaaccgcaccacgcctacttcaaaccctctcccacccccacctcctgccgttctcggaggggatcaagttcgcttctgcctgcgtgctctgctggagagctagatggcgatgccgtccgggtggaggggtatcctgggcttccactacggcatcgtgcaggcgccgttgggccccgacatctccggccccgagctcgtcgccgccgtggcgaacgccggcgccatcggcctcctccgcctccccgactggccggcgccggatcacgtcagagaactgatccggaagaccaggagcctcacgtccaagccgttcggggcggccatcgtgctggccttcccgcacgaggagaatctncagggtcgtcctggaggagaagctcgacgtgctgcaggtctactggggggacttccccaaccaccgggtccaagaggcgcatcgcgccggngttaaggtcttgcatcaggtcggcagccttgaggaggcagc

SEQ ID NO: 11438 - DNA, 612 bp, Zea mays
  unsure (1)..(612): unsure at all n locations; Clone ID: LIB3279-187-Q1-K6-C6
ggcgacaaacgcgtgcgtgagccgccgcttgcttgggaggtggtggtgagaccaggcgtgctccttcgcacttgtctctgtttgagttcgttgtcgtcaggtaaatatcacgagcaccatgctcgagttcttgtagctccgcagcttcctcgcttcttgcatcctttgcaacttgtctcctgttgttttcctctgatttccatggaggaaagatgctgggtgtgccagtgatgtgggcgtggagcaggcaacaattggctcgtcctggacattgatcgattctcccctattctcgtccaaggaattttattcgtttctcctagcaagtcgtgtatgcttgtttcgtggaggtaggagctaggatgacgagcaggaaccctaccaaaaccctgtcggtcctgaccactctcctgctgctgcttgagttcctcgcgctgtgcgcgcccgcctccgcccagccgctccactcggagcccatggctacgcagtccccgccgccgccgctgccgccggggtccacgattccccgggcgcaggccggcggcgccgcacgcctccgccgcattgcgctcggngtcctcttcggctccctctncggtttccttctcgcgc

SEQ ID NO: 11439 - DNA, 533 bp, Zea mays
  Clone ID: LIB3279-187-Q1-K6-C8
gtgtccgcccacgcgtccgcccacgcgtccgtccgcctccgcctccgcctccctagggttttgctctcggctcgtcggatccagttcgggggatcctccatggcgtcgcgtccgtcgctgaagtcgaagcccaagggcaagggcgggaagaaggccaccgctgacgacgaggacgccaccgcggcggcgaccacggtgaggctcatgaaggagtggaccacgtggacgatgaagaaggcgaaggtggtggcgcactacggcttcatccccctcgtcatcgtcatcggcatgaactccgagcccaagccctccgtcttccagctcctctcccccgtctgatcggatcatgacagggcccggatgaggtcggtccgtagtagtttgtagctggtacttcatttgcttacatatgtccgagatcgagttgaagaaggtggatcatgctttctgggcgaatttgaaggatttggtttaataattttgtagtggcggatgtcttctatacatcggatcaaaaatgtcttggttatgtg

SEQ ID NO: 11440 - DNA, 700 bp, Zea mays
  unsure (1)..(700): unsure at all n locations; Clone ID: LIB3279-187-Q1-K6-C9
cttgaggtcaggatttctggtctgtctggtggtcatcatagagggaaatctgttggatctgtgagtgacctgcgcgacacacctgtagtagttgatcaaagcaggtgggttggtcttcctcctgaattgcttcgagatgtaatgagaaggcttgaggaaggtgagagcaattggccatcccggaaaaatgttgttgcctgtgcagccgtctgtggaacatggagagagatatgcaaggatatagtgctgagcccggagttctgcgggaagctcacttttccagtatcacttaaacagccgggaccaagaaatggaataatccagtgtttcataaaaagggacaaatcaacatcaacttattatctttacctatgtcttagccctgttgtcctcagcgaggatgggaagtttctgctagcagctaagaggaatcgtcgtacaacatatactgagtacatcatttctgtggatcctaaaagtatatcacgatcaagtgatggctgtgttggaaaaatgaggtcaaattttcttggcactaaattcatcgtgcatgacactcgagcaccacacaatgctgggagccttgtctcctgtgagcgcggcagccgcagaatctcctctangnagggtttcccccaaggtacccactgccagctaccccattgccccgngtgaactatgagctaaacctgcttggcac

SEQ ID NO: 11441 - DNA, 535 bp, Zea mays
  unsure (1)..(535): unsure at all n locations; Clone ID: LIB3279-187-Q1-K6-D10
ttttttttctccaggtcggagacgagtcgtacgcctcttaccatgccgaaagacacggcgtcctgtcatctttcgctcgctgcgcagaggccatggtgcgctcattcaacgggctggaaggggtgacctgtagcgaggctgaaggagcagtgttcgtgttcccttcagtccgtctgccaaagaaggcggtcgcagctgccgaggcaagcaacacgcagccagatgcgttctacgcgctccgcctcctcgaaaccaccgggatcgtcgttgtgcctggctctgtttttggacagatgcatggaacgtggcatttcagatgcacggtcctgccacacgaagagaagaagacgatgacggtgatcatctccagctttgtggcgtttcatcgagccttcatggaagagtttcgcgactaacagatttcagctcctcttcttctatctctgnattgtaccacaacttaatgctgtacttcggagaaaacctagacctctccaaatgcatgattcctgtatgaaactgtttgagtttttct

SEQ ID NO: 11442 - DNA, 697 bp, Zea mays
  unsure (1)..(697): unsure at all n locations; Clone ID: LIB3279-187-Q1-K6-D11
ctttggagttgtcatgcttgaactattgacaggacgtagaccatttgacagctctagacccaggtcagaacagtcacttgtgcggtgggcaacaccccagctgcatgacatcgacgcattggacaggatggtcgatcctgcactcaagggtctatacccagctaaatctctatcccgatttgctgatgtccttgccctgtgtgtccagcctgaaccagaattcaggccaccaatgtcagaggtggtgcaagcattggttcgacttgtgcagagggccaacatgacgaagaggatgcttgatggggatacttctcggcgaccagatgacctgaaccaagatttcatatgacaagctgaactcttgtcagattgtatttatttcgttcgactagcggcccagcagagacataatcacacaagaggaagaaacagaactctgtcagcttcgccagtacataatcacaagtttttcttggtagcaaagttgtgctatatggttgtactgtgtctacaaaatagtaccttgatcttacgctaatggcatattgttataattctttggtaacttatatgcaaatgccccagataaacaaaactatnggtgaagtgtgnccgaatgttaaaataactgattagtccagtactgctgcatcaactgaaacaagtgcacagtggaaatatttatcttggtcccctc

SEQ ID NO: 11443 - DNA, 662 bp, Zea mays
  Clone ID: LIB3279-187-Q1-K6-D12
tttcgctctcactcccaggtcccttttttttctcgatctggaagcgccgcagtagcagccatggacgtgagcggagcaggcgggaaggcgaagaagggcgcggccgggcgcaaggccggcgggccgacgaagaagtcggtgtcgcggtcctccagggccgggctgcagttccccgtcagccgcgtcgggcggtacctcaaaaagggccggtacgcgcagcgtgtaggcacgggtgcccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgaggagctcggcaagctgctggccggcgtcaccatcgcccacggcggcgtcctccccaacatccacactgtgctcctccccaagaaggtggccgagaaggcggccaaggagcccaagaaggccgccaagtcccccaagaaggcgtagagtgatctcctgtcttagaacaatattaccattagcggccgtgcagttagactagatcatgtttagtgtagatccgcaatgttcttgtccctgctgccatctggaacggtttatctagtacatccatgcattttccttgctaattgcaa

SEQ ID NO: 11444 - DNA, 570 bp, Zea mays
  Clone ID: LIB3279-187-Q1-K6-D2
gcctagctgcagggcgccagcgcggtgggcacgcccaagaggctgacctacgacaagatccagaggataacctacatggaggtgaagggcacgggcaccagtgaaccagagcccgaccatcgcacggcagccaggagtcgatcccgtacaagggcgggaagtaccacatgaagaaggtgtgcctggagccgacgaacttcatcggcaaggaggagggcatcttcaagaacgacgcggccgagatccacaagaccaagctcatgacccgcctgacagtacacgctgaacaagatcgagggccacactctggacgagtccgacggcacgctcaaggtcgaggagaacgacacgctcaactacgccgacaacgacgggcagctctacgcgggcgagcgcgtgcagttcctcttcagcgagaaccagctcgtcctcaccagcaagcacgagagcttcggcagccccttgctcgagagcagctaccgtggcttcttcttgctcagatccagaggctgctgcttcttcaacggctacgacaacggcggctcgctcccctacgacagcaccaggtga

SEQ ID NO: 11445 - DNA, 690 bp, Zea mays
  unsure (1)..(690): unsure at all n locations; Clone ID: LIB3279-187-Q1-K6-D3
gtttcatatctagccactaggaagcttttggaagtgactggtaaacaggtggaaactagcccagaggcaaatgatcttggagaaatattttcttgtacaaacttgttgctggagcttcagatagaagctttggacttaatgttgccctgcttgcacagcttccatctagatgtatcaagagggcatccgtcatggcagccaaactgcaagaggagttaagtccgcgggaggaaatcaagcttcggaggacaacggatgcacaaactgtggacggaccatctgaaagttccgcagaagttggtttgttttgtgcacatccttatcaacgattggcagaaacatgtcgcaggatactgctgaacatcacgttggctcaaagcaataatgatgtaacgaacacacttccttctttgaaaaatgcacaggaaattgcacagaagacgatatgatgcagcggtccatttgacaactgacatattcttcatcagtgtgaagggaacttatcaggtatcatgtaccttttttttgctacggaggatccctaatggtggtaagcattttgctggagccgtttgtgtaacccatactctgccagnnatagcgtggttaagcattttggtcacaactcanacagtgccagtgtgtagttggagtgaactncgtgatattactggagtacttagtatgtac

SEQ ID NO: 11446 - DNA, 521 bp, Zea mays
  Clone ID: LIB3279-187-Q1-K6-D4
cccacgcgtccggttagcctccattatactgtaaggcgagacgatgccgacggttccaattccaaccagtggcaggtggagaagataattccgctggatcctggatttcggtattacatcaggggtgcgatggagaggtacacgctcctgctaaggtttcctgaacacctaagcttagcaggggtgcatgtaagctcatcggcagtgatagaagacttggaatgtttttccatggacaccaagactttgcagcttgagagggtgtgcgaattgaaccaccacattatgcgtgcctacgtatataccaacttcccaccatccctgtcgccacagagtatctaaatgggtaaactccttccacaaacatgtaatgtatccacatccttcttctttctcatgctattcctattgacatggtaaatttgttagtgacaaacggacaatcttgtctattcaaattttagtagtgttgttttattgtttatgtggtttgtagcttttcttaccacatagatggaacc

SEQ ID NO: 11447 - DNA, 653 bp, Zea mays
  Clone ID: LIB3279-187-Q1-K6-D5
gtggaatcgagtcaaatcgaccacttctctggcaagcccgcaggccgcagcccctcctctctccaagagccgccgcggctgctccccccctagcaaacccgccatggccgagcgcctcgcagcatccgccgccaccctccgcgcctcggccgccgccaccccattcgcccgccgcgcggcgccggccaaccgcgccttcttctcgccttcgctagctcgcgcgcgcgtcggcctccgcgccgcgccctcttcgctcccacagaaggcgagggcagtgaggtgcgcggctgtggcgatggcgtctgacgcggctcaggtgaaggccgcacgcgaggacatcagggagcttctcaggacgactcactcccaccccatcctggtccgtctaggatggcatgatgctggtacgtatgacaagaatattgaggagtggccacaacgaggtggagctaatggaagtttaagatttgatgttgagttgaaacatggagccaatgctggtctgataaatgctctaaagcttatccaaccaatcaaggacaagtaccctagtatcacttatgcagatttatttcagttggcaagtgctacagcaattgaggaagctggtggcccaaagattccaatgaaatacggacgaagttgatgttaca

SEQ ID NO: 11448 - DNA, 306 bp, Zea mays
  Clone ID: LIB3279-187-Q1-K6-D6
gtcgaggatagtaagaacggcgtcatggtggagatcggcgggctggcattgccgctcggagaaaagcttcaccatgacatggaacatgcggatcgaagcataggtcgagtgatgctgtgcttccgtctccatgaatttgcttaaagtcgtgttccgtttctgatttagatgagtagatcctgccatgctgatgtgcagtcagaatccatattctgaaaaatctgtcatcagggggtgctctgtgcaaggagcagagtacaacattgctgcaacaataaaagattgaatctttgacgtttgactagt

SEQ ID NO: 11449 - DNA, 698 bp, Zea mays
  Clone ID: LIB3279-187-Q1-K6-D7
cggacgcgtgggttccaccctcgcaccgcatccacctccacctccaccgcgccgccgcgagagaggggaggagggtttccgatggagaacggcgaggagacgttcgcctcccccaccgccgccgccgccgcggacttcgagatctccatcaacggcgaggacagcacgcccaagctccacaatttggcggacgagatggaggccctccgcgcggcgaagcgcgacctggaggagaagctcgatgccgtgggacacgagaaccggttcctgtcctctgagtcccggcgcctcgaggtcctcgtgtcccaggcccgcgaggaggtcgccgctgccgagcaagtcgccgccaccaacgagagcgaggccgccacgctccgcgccgaggtcgagcgtctccagggcctcctagccgcagagaaggccagccatgaggaggagatgcgcaggggcgcaaggctcggggaccagctgcagaccgcgtaccaggagaaggccgcccttgaggaggagatcgagaccctgaagggttccgccactgccgagggcaagggcgggaaggaggaagaggagggacgtgattccgtttctgccagggccgggacgcctaaggatgagggcgtggtgtctcccgctcttgtggttgccgcggctgctggagcagctgccacggctgccatcgccggtggtcttgctcacct

SEQ ID NO: 11450 - DNA, 635 bp, Zea mays
  Clone ID: LIB3279-187-Q1-K6-D8
caacgctctcgctgcagaggaaaggcgaagatggcgatgaccgtcgtagtgcttgctgcactcgcgttcatgttttccacgagtattctactgcagatactggcatgcgctttgtacaacaactggtggcccatgttagcagctctcatgtacgtccttgtaccaatgccatgcctgttttttggtggtggatccacacacttcttgaccagcagagaaggtggagggtggattaatgctgcaaaattcttgactggtgcgtcggccatgggaagccttgctattccagcaattctgaggcacgctggcttaatcgagaccggggccatgttcatcgagttcacgtccttcttcatccttgtatgcacagtgctgtgcttccatagggcgactctggatgaagactggtaaatgcgcatttcaccgtcaccctgaaccctagcggttcttggctgcttctgtccatgctaagaaaaattcctgttggaagctaacatggatctgtacaaagaagcgtatttcgagcgtagccgtagctgatgtcttatgtagacacttgtgaagattatgtggtcatgtggcaatgcagatgttattaccttcactttgactttgtcgtcacatgttctatggtg

SEQ ID NO: 11451 - DNA, 640 bp, Zea mays
  unsure (1)..(640): unsure at all n locations; Clone ID: LIB3279-187-Q1-K6-D9
cccacgcgtccgcgctattatcaaggccagggaactaattaagcttttgtccaggagcgtccctgcacctcaggcaatcaaaattcttgatgatgagatgaactgcgatattattaagattggtggtcttgtgagaaataaggagcggtttgttaaaaggagggaacggcttttaggccctaacttgtctacactcaaggctattgagattttgactggctgctacatcttagtgcagggaaatactgttgcagccatgggcaactataggggaaggggactgaaacaagtgagaaggattgtagaggattgcatgaagaatgtaaagcatccagtgtaccacatcaaggaactactaatcaaacgtgagctagcaaaaaatcctgctctagccaatgaaaattgggacagatttctcccgaagttcaagaagaagaatgtcaagcagaagaagcctcaaactaaggagaagaaaccgtacacaccctttccaccgcctcaacagcctagcagnattgatcttgaacttgagaacggtgagtatttcatgagtgacaaaaagaatcagcaaagaatggcaagagaagctggacaagcaatctgggagagctgaagaaataaaagaaaagaaggctgcatt

SEQ ID NO: 11452 - DNA, 690 bp, Zea mays
  Clone ID: LIB3279-187-Q1-K6-E1
cctataccaacttgaacaggctgatctcacagatcatatcatcacttaccacctccctgaggtttgatggggctatcaatgtggatgttactgagttccagaccaaccttgttccatacccacgtattcatttcatgctttcctcatatgcccctgtaatatctgctgagaaggcctaccatgagcagctctctgtgcctgaaatcaccaatgctgtatttgagccctcaagcatgatggccaagtgtgacccaaggcacggaaagtacatggcttgctgcttgatgtaccgcggtgatgttgttcctaaggatgtcaacgctgcagttgcaaccatcaagaccaagagaactgtccagtttgtggactggtgccccactggattcaagtgtggcatcaactatcagccaccctctgttgtccctggaggtgacctggcaaaggtccagcgtgccgtgtgcatgatcagcaacaacaccgccgttgccgaggtgttctcacgcatcgaccacaagtttgaccttatgtacgccaagcgcgcattcgttcactggtatgtcggtgagggtatggaagagggtgagttctcagaaagccgtgaggacttggctgctcttgagaaggctatgaggaaagtcgtgcagagggtgccgatgatgagggtgacgagggagagactattgagtagct

SEQ ID NO: 11453 - DNA, 555 bp, Zea mays
  unsure (1)..(555): unsure at all n locations; Clone ID: LIB3279-187-Q1-K6-E10
ctcgtaggtcatgattgggagcatattggcgtccctgttatggctcagcgccaggcatagttaatgcaaccggtcacttatgacaggttggtctcggaccgggtgagggatccactcgagtggatttccttcggctcatgagatcccctgtctagctccgtcaagcccgaccccaggctcggtgccgcggggctcatcctaggacgagtacttatagggcagacgctacctatctactctagctgacagatgggcccagatgccagaggcttttctctagcgcacttacttaccgatgggtctaggaaccggtgatcttatccccgataatacactatgtataaatgatgtgggtatgactggagctatgattttttttactttttccaataccaacagagtgagttgtccgtagaattttcactcgttgcttacttgcccttccctggnncnctcaancgcttccaattccagaggataggatttgttgtccgtttgtgcaagtttgttctccaagaattattcatctctttgntatctatttttttcaattgc

SEQ ID NO: 11454 - DNA, 478 bp, Zea mays
  Clone ID: LIB3279-187-Q1-K6-E11
cggtcgcgtgggctgaaccctcgccgtttcgtcgcacccaccaacacgagagatgagctccggcggcgcggacaagcccggcagtggcggcggcgcggtgaagacgccgtcggacttcctcaagtccatcaggggccgccccgtagtcgtaaagctcaactccggcgtcgactacagaggtatattggcttgtctggatggttatatgaacatcgcaatggagcagaccgaggagtacgtgaatggccagttgaagaacaagtatggcgatgccttcataaggggcaacaacgttctgtacatcagcacgacgaagcggacccttgccgatggcgcgtagccggattggattccctctgtcctcctcccgtgtgtgtgccgtgcaacttcgaagccgttagcttcggttgcgctctgactctgatgcatcccttcaaatctctgtacccccctgtctggaagggagttgggggggggg

SEQ ID NO: 11455 - DNA, 516 bp, Zea mays
  Clone ID: LIB3279-187-Q1-K6-E12
ccgtgtccgcctcccctaccatctagggtttctagggttttcgaggaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatacggcggcggcgaccgcggttacggcggcggcggtgaccgcggctacgggggaggaggcgaccgtggctacggcggcggcgaccgtggttacggtggaggtggcgaccgcggctacggcggcgaccgtggctacgggggaggcggcggctatggcggtgggtacggtggaggcggcggtgga

SEQ ID NO: 11456 - DNA, 687 bp, Zea mays
  Clone ID: LIB3279-187-Q1-K6-E2
ccccgcgtccggctcaaaaacccacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgggcggcggcgggcccacgcgcacctacgtccgcgacgcgcgcgccatggcggtcaccccggccgacgtcaaggagctcccgggcgcgtacgcgttcgtggtggacatgccggggctgggcacgggcgacatcaaggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacatggacaagatctcggcggtgtgcagggacggcgtgctcaccgtgaccgtcgagaagctgcccccgcccgagcccaagaagcccaagaccatcgaggtcaaggtcgcctgaggtgggactaggtcgaccgatcgtggctctgaagatgtgggagcagtccagcgagttgtgaggaacctctacctgtgtggatgtggcgaggaataatcgtagtctgtagtgggggtg

SEQ ID NO: 11457 - DNA, 594 bp, Zea mays
  Clone ID: LIB3279-187-Q1-K6-E3
gccctcgtacggccacgcctccgtaccgccgtcatgtcgatgcgaggcaggggaggttctgctgggaacaagttccgcatgtcactgggtctaccggtggcggacaccgctaactgcgcggacaacacggccgccaagaacctctacatcatctccgacaagggcatcaagggccacctcaaccggctgccgtccgcctgtactggctacatggtcatggccaccgtacagataggaaatcccaacctcaggaagaaagtgataccctgccggcatcgaccgacagcgcaagccgtgacatagaaaggactgcgtctacatgtccttcgtacataatgctagaatgattgtgaataccaacgctgacatgaaatgttctgcattcactgtacctatcgtgaatgagtgtgctgacctttggcctatgatcgccagagcaccatatgccatcgcttgacagcttgatgagatgagtatagactagagtatgatcatatcaattgtgtgttgcaagtgtgtgcagggagctattggacttgatggctccttttatgattggacactcaattctgtagtgaacaggaatttctggtt

SEQ ID NO: 11458 - DNA, 657 bp, Zea mays
  unsure (1)..(657): unsure at all n locations; Clone ID: LIB3279-187-Q1-K6-E4
agcaaaggctccaagattacaacagaagcttggagaagaaccaagcagatttacctgaaaatagaagatttggccaagaagtaccagtgcagcccagctcagctagctctagcctgggttctgcatcaaggggatgatgtggttcctataccaggtgtgaccttataaacctgtcctcgttcaatggtagcgcacaatgtgcactgctgatattcatactattcccaagataaacaagaatatcagatgaatggtaaaaagcttcatgtatatactttctgacaaaagtgaaatgtgcaaaatgattcataggtaacgtaacgaacgcaaatagctttgcctaatgttaaaattaccctctttgatcattgctgcttcactagaggagcagtgaggtaacagatcatttgcgtatatcctataataaagcggctttctctgaatatgtatacatagtattttgtacaacctgttgaggttttttgtgatatatttgttttttacttagctgtaatatagttcactttcaaacttatgtcaattgatctgtgcttgttattcactccaaagtttgaagcaagtcatcgcggacatgaattttnttttatagtcaaatcgtcctgcatttggttgctgagatgtgttcgttaattgctc

SEQ ID NO: 11459 - DNA, 634 bp, Zea mays
  unsure (1)..(634): unsure at all n locations; Clone ID: LIB3279-187-Q1-K6-E5
gatcgcgagcggcctccctttttttttttttttgacgttctcagagacagtattcaactttgcacagagtgccctcagtttaagaaggtcatcagtaaacccgatatcacttgaatcagtatccgccgggaagtatttatctttgaaagactttgcatggtcactaactgtgaaacgaaggctggtgtttggagcttctgaagcggttgctgttgagcacataacaccaaggttggaactatttgattcatccaatgaactattttctgctgcaacagcacccgcacgccggcgttgacgtctagaacgtgatggcatggcagaatctttatctttatcctgaggtggcacctgagaaggcattttgttggaagattctgaacatatgagtgactccacagcatgaacgacaccttccctcacaaataacatggaaaatgtctctggaagcttttccatcattatttctgctatctgaagagcaggaatcaacacttgaggatctttccatgcaagaatgcccgcaaggaagctggatatgtnttgttgtgccaaggagagactggattgtttcggcggagctgtagtacattaattntccaatgatagataaacacttgtgacgtattggtgc

SEQ ID NO: 11460 - DNA, 612 bp, Zea mays
  Clone ID: LIB3279-187-Q1-K6-E6
ccccgcgtccggtccctctccctctcctctctcctctccctacccagttgcgcgagccggcgagccctagcaggcaaaagccatggcgtccatggttcttcgtgccgctgccgccgctcgtcttccctccctccgtcctcgccgcaacggcagcggggtgctcaccggcttgaggatcgggacagggcactacggcgtgcggctcgcgctttcttcgtccgcggcagcttctcccaaagagttcgaggtcgcttgccttcctgtcgatgatagcagattgggcccgggggaagattatgtgtctgaccttcgcatggcagacgaggaggagttggaccatttctaccgtgttctcgccattaagactgacatgctgtttagagcctaccctgaacacaagccgtttgcagtttctgaagaggacaaggccgtgcaggagaggttgaaggaatttgcgaacgaatgcatcgacctcctggatgatgcgttgcgccgcatccccgcggagaaaagcgcccactgttctcggtgtttggtaatgtgtaccaggtatttgcgtcagtaaagtggtatgcggagggggggtgtgcccagtggtggatggcgctgcag

SEQ ID NO: 11461 - DNA, 670 bp, Zea mays
  Clone ID: LIB3279-187-Q1-K6-E7
cccacgcgtccgggataaactgcttgaactggaagcgaccctagtccaaaccaccgcaccgacaccgactccgagccccgccgcgccgcgctacctccgctcctctcttcgcccctgccggcgtcgaggccgaagcgaaggcgagcatgcatcacgaccccaaccccttcgacgagggcagcgccgaggacaaccccttctcaaatggaggagccggaggcggcaagcagcagtacggcttccggccgactgagcccgtcgggttcggcggcgctagcaggggcgacgccgtcgttgacgtcccgctcgagaccatgggggactctcggagcaaggtgaaggagctctcgtcgtgggaatcagatctgaagcggcgagaggcggatatcaagaggagggaagaggcgctgaagaatgctggcgtgccaatggaggagaagaactggccaccattcttccccatcatccaccatgatattgccaatgagataccagcaaatgtgcagaagttgcagtatcttgcatttgcaagctggcttggaattgtgctttgtttgtcctggaacctcgttgctgtcatagtctgctggatcaaggagggagattcaaagttgtttttccttgcaacaatctatgctttgcttggaattcctctgtcatatttgatatg

SEQ ID NO: 11462 - DNA, 493 bp, Zea mays
  Clone ID: LIB3279-187-Q1-K6-E8
ccccgcgtccgtagatcgcgagcggtcgccctttttttttttttttcactttaattcaccggatcatcaatatttcagcacatgttaccattgctaacaagctaagggcagtaatattctacaaatcaaagaatctgcaatcagtgattttcctggctaactgggatgccaattaggtgtcgaatgttctgaggcatgcaaattaagggatacttctgaatctttccagagttaagaagattgcgcttctgggatgttagaagcaagagcatccaaatgatcgtcacccatctttcaccattctagctctctcgaggatgtacttcccttccttgtatttctggctttgctcgtaggctttctcatatctccagccaagaatctgttggcagcagctacagtagatgtcattcacagtatggagcccggttacaagatatcgatcctcattagggcctaggcatatgttcacaacatggtcgaagaggtaggc

SEQ ID NO: 11463 - DNA, 654 bp, Zea mays
  Clone ID: LIB3279-187-Q1-K6-E9
cgccacgcaggcacgcacgcggaggggagcgccggccgtccgcggcggattgggatctccctcgcccgcccgtccactcgacgctcgacggcacccgccgcatttgagctgagctgaggaggcgtgggggacggcgcggggatgtggcgcctgcggatcgcggaggggggcggggacccctggctccgcacgaagaacgcccacgtcggccgccaggtctgggagttcgacgcctccgccgaccccgaccccgccgtcgacgccgcgcgccgcgccttcgccggcagcaggggccacctcaagcacagcgccgacctcctcatgcgcatccagttcgccaaagaaaatcctcttgagcttgaccttccagcgatcaagctcggtgagcacgaagacgtaaccgaggaagccgtgtctactactttgagaagggcaatcagccgtctttctactctccaggcacatgatggacactggcctggggattatggtggccctatgttccttatgccaggcttgatcataacattgtatgtgactggagcactaaacactgtcttgtcatcagaacaccagaaggagatcccgtcgtatctttataatcatcagaatgaagatggtggctggggcttgcacattgaggtccaagcacat

SEQ ID NO: 11464 - DNA, 661 bp, Zea mays
  unsure (1)..(661): unsure at all n locations; Clone ID: LIB3279-187-Q1-K6-F1
catttccccatctcccanatccaattcgcgagttcttcctcctctgccgccatggcgctctctgtggagaagacctcgtctggacgggagtacaaggtcaaggatctctcgcaggcggacttcggtcgcctcgagattgagctggccgaggtcgaaatgcccggcctcatggcgtgccgcgccgagttcggcccgtccaagcccttcgccggcgctaggatctcggggtctcttcacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgcctcgactggggcgaggcgggcggccccgacctcatcgtcgacgacggcggcgacgccacgctgctcatccacgagggtgtcaaggccgaggaggactacgagaagaccggcaagatccccgatccggagtccaccgacaacgctgagttcaagatcgtgctcaccatcatccgcgacgggctcaaggctgaccccaagaagtaccgcaagaatgaagagaggcttgtcggcgtctctg

SEQ ID NO: 11465 - DNA, 327 bp, Zea mays
  Clone ID: LIB3279-187-Q1-K6-F10
ccccgcgtccgctgaagcggaagcaagcccgcgtcagagccacgttcgtgcaggacctgctgctctctactctattcggcgactgatgacgaaccagagcgagcctaagctattatcactggaagggtggaggtccacgaagaccagcgcggcggtccagaacacctctagtaaggtgcagagttgatgtgggcgtaatgtatctttctaagttattgtaagccggtctcttgtcttcacaactgacgatctgtgtgtggtacgctacgcacgcaagtcgcggttgtgcgtgtacgtctgaactctggagcattggtttgttgtacc

SEQ ID NO: 11466 - DNA, 700 bp, Zea mays
  unsure (1)..(700): unsure at all n locations; Clone ID: LIB3279-187-Q1-K6-F11
gggttttgctgctctccgaccccgagctccgaaggccgcagcatcaggcgaggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggatctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtaccttgcaaggaagctggctgggtgatccgaaccttcactttgttgaagctgttgctcttaacctnncgaagttaccatcgacatggctatgcagcagcagcatgaagccgagcttgctgcagcagctgc

SEQ ID NO: 11467 - DNA, 652 bp, Zea mays
  Clone ID: LIB3279-187-Q1-K6-F12
gtcgaggaaaaactcgcattcgcaaaccaagcaaatggaggcatgagctccgccgcctccccgtctctcgccgatctcccccaaaccctagcctcgacctgaccgccagcgggcccgcaggccggagaaggagtcggagtcgcccccacccacccaccctctgccgcgggcggggagcgggcggcggacgagatgccgtcgcacggggatctggaccggcagatcgcgcagctgcgcgactgcaagtacctgcccgaggcggaggtcaaggcgctctgcgagcaggccaaggccatcctcatggaggaatggaacgtgcagcccgtgcgctgccccgtcaccgtctgcggcgacatccacggccagttctatgacctcatcgagctcttccgcatcggcggcgactctcccgacaccaactacctcttcatgggcgactacgtcgatcgtggctattattcagttgaaacggtttctctgttagtggctttgaaagtccgttacagagatagaattacaatacttcgaggaaatcatgagagcagacaaatcactcaagtgtacggcttctatgatgaatgcttaagaaatatggaaatgcaaagtatggaagtttttacagacttgtttgattatttgcctctcacagctc

SEQ ID NO: 11468 - DNA, 612 bp, Zea mays
  unsure (1)..(612): unsure at all n locations; Clone ID: LIB3279-187-Q1-K6-F2
cccagcgtccgcggacgcgtgggcggcgatcggcgtgcctccactctacaggcgacgacgaaaccagcagcctcagcgccgaccactccgggagcggggcctcacaacctcaggatccacgggagatgccggtcgccgccgcctcaccctcgcactcgtgaactggcttcctctgcgacgagccggggcgggctcggattcggcggatcttgtggggccctggcgtcgggctggtccggtgctagattgatcccgcattcgagctgcggcaagcgtctgggtagtcgcttctcccgagggaaaggaaaacaaagttgcttggccgactttgggatcaaggatcggcgaaaagaaagagaaaggagggatctttttgggaggttctgtttgagctttcagggtttatatcgtagcctcgggcaactccgtgctgatggatttcttcaagattaagaagttcgggaaggggaataagagcgcccggggcgggggagaggtaatagaatccgacgacgacgccagcgctgggaatgtgacccctcgnggcctggtggagcagaagcctggcatcggngaggggaacatgccgaggtggcggcagagggtggaggc

SEQ ID NO: 11469 - DNA, 529 bp, Zea mays
  Clone ID: LIB3279-187-Q1-K6-F3
gtccactttccccgtgcttctccgccgtcgaggccgcgtcccagtgcgaagagactccgactcagatggccagccgctgggtccggcccgaggtgtacccgctgttcgcggcgacgggcgtggccgtcggcatctgcgggtttcagctcttccggaacatcactggcaacccggaagtcagggtaaacaaggcagggagggcagctggtgtgcttgagaaccatgaggaggggagacgttacgccatgcatggcctaagaagctttgtgcacgacaagactcctgagatcatgcctgcagttaacaagttcttcactgaccctaagtgaagcatgttgattggcatactactactactacttgctactggggattattacactttgctggcaactcaatatgttggggacatccatgacctctaaaagtactttgagcgcttggtgatgacttggtatatgtatgatggtggatgagtttgatcgtccatgcttgatgttcatattcatctgtcatctggatttgccgc

SEQ ID NO: 11470 - DNA, 698 bp, Zea mays
  Clone ID: LIB3279-187-Q1-K6-F4
cccacgcgtccgggtagttgcagctaaccatgataacaaaagcacacagattaccaccctgcccaatgagccagaaatagattcatttaaggagagtgaagtgccaggtgtaccacctgcaggaaacattctcgtcaatgatggagttatcagcacctctgcaaatgttgtttctccagttaagaatgaccctgttgttgagacatatgtgaaagtggttaacgaggatgttgtgaagatacctgtagccgctccagcttcaactcctgttacagctgaggaagttgttaacaaggattttgtgaagattcctgagtctgctccggctctcccttcatcagttgagaaggctgctccagcacctcccgcatcagttgagaaggctgttgcagcacctcccgcatcagttgagaaagctgctccagctcctcgcgcaccagttgagaaggccgatccagctcctagtgcacctgttgagaaaggtgctccagctcttcgcgcaccagttgagaaggctgatccagctcctcgtgcaccagttgagaaggaagtaactaggaagacttatgcatcagttgttaaaatcccgagggaggacacacagcctgccccagctgccagaccctccaagccaacctaaattaaagaggttcaaatcggagaaaaagtgtctcaccatcgaaactgctatgctactg

SEQ ID NO: 11471 - DNA, 518 bp, Zea mays
  Clone ID: LIB3279-187-Q1-K6-F5
ctgagccctagggcacctctccgttcaggagcaaagccaaaaacacatccccctcgccaagaaagaaggcagacgaaggcaaaccctagccaacgcgtacgcctcgccccccgcgcctcctcccccagatccggccgatccgtcgttgccatggcgctgcgagctctcgccggcaagctgagggtcctccctttacgagcggcggcctctcgctccttcgcctcccagatggagaagaaatgcagcaagtgtgctcttgaagagcaggctggatccttctctcaatggttggatgaaaggaagaggcgtgatatggaagagcttgcaaggttcagaaggaagagctacgtgcacaatgtgctagttcttgctggtagtgttggctttgtggcattcacgttgtcatgcgttgctgatgttatagcagatgaaatgaactagggagaaggggaggggagcacggcggcagcaaatgctccatggttggttcttttggcacctatcaattacacaataaa

SEQ ID NO: 11472 - DNA, 652 bp, Zea mays
  unsure (1)..(652): unsure at all n locations; Clone ID: LIB3279-187-Q1-K6-F6
ggnaatttatgacatggctcttaaacacactgctgcgaactaaaagttcaaagaagaaaaacagaagcataatacacgattgttttcagggagaacttgaagttgttaaggaggttcataggaagcatataatnggaaaaaagagaggatggcggtgagctgaatggtgaggcaggttcagtggtgggaactgcagatggaattgttactgaaacatccaaggtcccattcctgatgctcggtcttgacctgccacctccacctcttttcaaagacgccatggagaaaaatatcattccacaggtaccattgtttaacatactgaagaagttcgatggtgagacagttacagaggttgtccgaccttccattgcccgaatgaggtaccgagtcactagactgccgaagtatctgatccttcatatgcgaaggtttaccaaaaataacttttttgtcgagaaaaaccctactctagttaattttcctgtgaagaacttggagttgaaggactacattccattacctaagccgaaagagatcataagctacgttcaaagtatgacctcatagcaaacattgtccatgatggcaaacctggcgagggatgctacagagtatttgtacagcggaaatcagaagaggcctggtatga

SEQ ID NO: 11473 - DNA, 711 bp, Zea mays
  unsure (1)..(711): unsure at all n locations; Clone ID: LIB3279-187-Q1-K6-F7
gccgttgcccgtcggccgccgcccctccctccgcgccctcccgaccaccgctccttccccgccttccacctgcgctgtccgccagtcctcctccacctcgctccggcacgcagggcccacaagaagcgccccttccagaagttaatccgccccggtttgactagggtttgtcccgtctcctaatcgatcagattggcaggtaactgccgttgccgccgcgatgaagaggtacggactgcagctccgcacgaagccgccatcgtcctcgtcgtcacgcgcgccgccacctcccgcccggcccctggcggccttcgccgacgacgatgacgatgatgtggaggcagaaatcctccgccaggcggccaagaagcgctccctccagaaggttgaggagcagcaaaagaaggccatggaggaggatccctcggtgtacgcctacgacgagctgtacgacgaaatgaaagagaaggaagcccgccctaagatgcaggataaggtcgtccgcgagtcaaagtatattgcacaacttaaggaaaaagcagagctacgcaaacgagaacaagatataatatacgagaggaagcttcagaaagagagaagcaaggaggaccacctttttggggacagggataaatttgtaacatcagcctacaggaagaaacttgaggagcagcanaagtggcttgaagaaaaaagaggaggcagcttcga

SEQ ID NO: 11474 - DNA, 669 bp, Zea mays
  unsure (1)..(669): unsure at all n locations; Clone ID: LIB3279-187-Q1-K6-F8
aggggcccaagnagaggcagccatcatctgctcctcgtgatgcgcgccgctcattgctgcagagcgctgccgctttcgccccacttgaagcttcaactccacttccccagtctcgccgccgtttcggcctaaaactcccgcaaatcctcgcccgccgcacccagattctccaggtgggagcagcgcgcgccgccgccgccgccgacgacgaccgaacgcgggccgcaccagctccccgctgccgccgccgtccgggctccgtgatgccggcggctctcgacccaggacagcggcttctctgttggcccaagtgcacgcgactgactgccggtgctggtgccttgaaatgcggcagccgttctacggccggcctcccgtccagatgaaggtgcagctggtggaacaggaaggctccaaggggatgggttcttccgggtgcgcggagatagtcgagctggcggacgacccgaaagctgctcgtcctgctgcgcatctgagagtgagggtcaagcccgtggggcaggaggatggggcgcggtcgtgctcgctggaggatgaccttgaccagctcatcaggtcggtcaacgtgcgcacgtcggcgagggcttctgggcagaggagcaccgatagatggcttattgggctcggggagtcgnncgtgtcgggctc

SEQ ID NO: 11475 - DNA, 488 bp, Zea mays
  Clone ID: LIB3279-187-Q1-K6-F9
gaaagggcaaaaactggagcacaggtcagcgtcaacttgtgtgtctgggaagggtgattctgaaacggaggaagatcttggttttggatgaggcaacttcatccgtggatccaattacagacagcttgattcaaaaaaccttaaaacaacaatttctcaaatgcacaatgattacaatagctcaccgtatcacatcagttcttgatagcgacaaagtcttgcttctggataatggtgaaattgcagagcatgacgccccagcaaaactgctagaggacagttcatccctattctccaaacttgtatctgagtataccatgggatctgataagtggcgaatgcaagaaagcagctaaatcaatactctacagataatacaggacaaacgccctaggaagtgtgagtatctacgtgtcaccaattttatagcttaataaaaagcaaatttttaaaaaacaaaaaaaaaaaaaaaaaaatctagatcgcga

SEQ ID NO: 11476 - DNA, 650 bp, Zea mays
  Clone ID: LIB3279-187-Q1-K6-G1
aagagtgcgccctgctgacagatggtagattttcaggaggctcacatggatttgttgtcggccacatatgccctgaagcacaggaaggtggcccaattggtcttgtccatagtggtgatgtaatcactatcgatgtaagtaagagggtaatcgacgttgaccttaccgagcagcagctcgaagaaagacggaggaaatggaccccaccgccatacaagtccacctgtggagctctttggaagtacatcaagcttgtggctccagcgtctagaggatgcgtcactgatgagtaggacgtgttacattctgttaggttgtgcacatgatgtgtttgtcaatcaaaagctgttgccaggaacaatttccctgttagagtgattcattgtagttcggttttgcatgtggcaggtatgacaataaattgccggtttctaagagcttagcaatgctgcagaaactgctgaataatcgagtgtaatcggggtccgtgagcaatcacatctttgtcagtctcccttgttttgtttgtctcattgtttgtagtaccttgttcactgagatgatagtgttgattattctttggtccacctgtaaccacttagcgtctggtgtgtttaaggtagtgttcggttccggagtatagtgggctg

SEQ ID NO: 11477 - DNA, 636 bp, Zea mays
  unsure (1)..(636): unsure at all n locations; Clone ID: LIB3279-187-Q1-K6-G10
tttagtcgcgccgccgccgccgccngaacagcacatcgctctctcgatctcagccatggcggaggtggagcagccccaggacgcggtgaagctcttcaaccgctggaccttcgacgatgtccaggtgaacgatatctcgctgaacgactacctggctgtgactgcggcgaagcacgcgacattcctgccgcactccgcggggcgctactccaagaagcggttccgcaaggcgcagtgcgccatcgtcgagcgcctcaccaactcgctcatgatgcacgggcgcaacaacggcaagaaggtcatggccgtccgcatcatgaagcacaccctggagatcatccacctgctcactgacgccaatcccatccaggtggtcgtggacgccattatcaacagtggaccacgtgaggatgccacccgtattggttcagctggtgttgtgagaaggcaggctgtggatatctcacccctgagaagggtgaaccaggccatctacctcctcaccactggtgccagggagagcgctttcaggaacatcaaaaccattgctgagtgccttgcagatgagttgatcaacgctgccaagggctcttccaacagctacgccatcaagaagatggacgagnattgagcgtg

SEQ ID NO: 11478 - DNA, 695 bp, Zea mays
  unsure (1)..(695): unsure at all n locations; Clone ID: LIB3279-187-Q1-K6-G11
atttgaaagtgaagattctgttgaaagggtcatatcagaggggagaatgcgtgatcttggtgggaagcaggttgaaataaagaaggctgaaccaaagaacatggatctgaccacagcagtaatgggagatcaaaccacggaggtggagcttaccgcaattcttaccgtagtggtggtggagctggtagtggcagcagtggaggcggcggtggttatgggtatggtggtgcttatcgatctgctgcagcaggttatggatatgatggtggcgcaggagcaggatatggctatggtagagggtatggctatggaggcaatgctggctttgggtctagttttggtggtggttatggtggatccatgtatggaggtgctgcctatggtgcatatggtgcctatggtggtggcgcctatggaggaggtgcctacggagggggtgcctatggaggtggtgctgcctatggtggcgccccaggtggttatggcactggcggatacggcagttatggcggagcaggtagtactggtggtgggagcacaggtgctcggngttctagcaggtatcatccatacggaaaataagcgacgagtttaaactatttttctgggtctcaggtgttcctcttctcctagaagntcagatttcatggcatgtccatctaaacagtgggcattggaacgtnagttggtctaat

SEQ ID NO: 11479 - DNA, 669 bp, Zea mays
  Clone ID: LIB3279-187-Q1-K6-G12
gcatatctgggttgtccaaggtggtttcacttggttaagtgacagtagcagctctggtttccctgggtttcctgcatctggcgacaggagcaattcaggatggatggatggttatgattcttttaatgatggcttaaatgatacgattgctaatgcggcacgcaacatccaaatggaggaggacgaggacgtcgacggtgactgggaagatgactttgagttcaggcctgatgtgcggtttaggcaaggttcaacgtattctgttcgggaccttgaccttagaaaacctgcagccgcaaagaaccctcctagacgacagtttgaaacaactacagcggaggtactgaagaaggctgattttaggaatgttagattcctctccaactttcttacggaagctggaattatcatcaagagaagccagacccgtataagtgcaaaagctcagcgtaagattgcaagagagatcaaaaccgcacgtgcgtttgggttaatgccttttacaacaatgggtagaagaccattcatttttggcagaagtgcggaggagcattattgggatgatggatatttcggctatgtgaagcagaaggatggtgagcctgttgagaatgaggatgctgagccaaatgtggaggctgtgtaaacattctgaagcatccttttgca

SEQ ID NO: 11480 - DNA, 668 bp, Zea mays
  unsure (1)..(668): unsure at all n locations; Clone ID: LIB3279-187-Q1-K6-G2
cggacgcgtgggcggacgcgtgggcggacgcgtgggccgcctaccaggagtttaatgaattcggtgctgatggtggaccagcagctaaggcccttcggcccaaattcaacgtgtttgtcaaaatgtatctgctcatctgggagtagctgtgccacacattgagttgaagcatgtgattgctgctacaattggtcttaagggtcttggaagcctcctttttattttgagcagctctctcggtgcttatctcctgctgctgtaccttgctttgatcactcctatcatccatgacttctacaactacgatatggagaaggcagaatttgcaggcctctttgcgaagttcacccaggatttggcgctgatcggagctctgctcttctttctgggcatgaagaactccatcccgaagcggcagggcggcaagaagaaggcccccaaggcgaagacgaactagggctgcttagatagctgcacgcctcaggtggnggtgtatcaggagacaggtctatttcgaagcaggctcagcgcgatgcagcgaatgccatcgagctgcgcttttacatgtttatcatcagattccattttgcggcccgaaaaaaggtgtgaccggnngtgggttaggcgactagattgcacgattatgtacttgagatttgtttgttgaa

SEQ ID NO: 11481 - DNA, 612 bp, Zea mays
  Clone ID: LIB3279-187-Q1-K6-G3
ctcgcctctctttcggttctcacggcgacgactgggcgagcgccgcctcccctccctcgctccgtgaggtcctcgccggcgacgagtgccgccgcccgtttccatgtattttccgccgattagtgtccaccagatctagtgaaggctggtaacttgacgcaaggggaatatagacacagaattttttgaacattgatctgtagccagtgctgcaatggctacaaagcttgtggttctcggtatcccctgggatgttgacactgaagggttacgagagtacatggccaagtttggacccctagatgattgtgtcgtcatgaaggagcggtcttctgggcgatctcgtgggtttggctatgtaacattcgcatcagccgacgatgcaaagaatgttcttgattgcgagcatgttcttgggagccgtacattagaagtgaagatagctactccaaaggaagaaatgaaatcacaaggaacaaagaaagctacgaggatatttgttgctcgaattccacagtcagtggacgagtcgatgtttcgtaggcattttgaagcttttggagaaattcttgatctttacatgccaaaggaacatggttcaaaggggcatcg

SEQ ID NO: 11482 - DNA, 656 bp, Zea mays
  Clone ID: LIB3279-187-Q1-K6-G4
cactgatccaaaggaagttgccgagtccgcaagtttaggtgtgaccgagacttctgcaatccaggctcaggagtcttctccacggtctgcattgccaacatcgccacattttgctgattctagattccttgaggaacctgttgcttttgaagtatactctccagaccggctggctggagaattgatcttcatggacagcactttggttttcacagctgaggatctgtcacgtgcaccggcggaagttcttggaaggagcagccatggaacaacgtataaagctgttctacaaagcgggcatgtcctaatagtgaaatggctgcgtgtcggtcttgtgaagcataaaaaggagttcacaaaggagataaagaggattggcactatcaggaatccaaatataatttcatggagagccttctattggggccctaaggagcaagagagattaattatttctgactatgtcaatggtgatagcttggcactttacctttatgagtcgactccaagaagatactcccgcctatcagtttctcagcgtctcaggatcgccatcgacctagcccgctgcctccagttcttacaccaggagaagggcttgccgcacggcaacttgaagccaactaacatattcttggctggtcctggcctctctc

SEQ ID NO: 11483 - DNA, 650 bp, Zea mays
  unsure (1)..(650): unsure at all n locations; Clone ID: LIB3279-187-Q1-K6-G5
gttcagtgattcttcccaggtgttgctaatagcacagtaatttctctggaccatccctattctaagaaacatgttgctggggatgatgttattaacagctgggtgccaggaaaagggcaaggaataatgaagccagatattatggtgccagaagctcctcgggtggttttgccacttgttacttcctccaatattaagcttgaacttgacaaaaagaaagaattggtgactacacagttgcggaatacagtcagtgatctgtcacttgctgcggatgatttgatcattccatggaatgagttgattttaaaggagaagattggtgcaggttctttcggaacagttcatcgtgctgattggcatggatctgatgttgcagtcaaaatacttatggagcaagattttcacccagagcgtttcagggaatttatgagagaggttgcaatcatgaaaagtctgagacatccaaatattgtcctattcatgggtgctgttactgaaccaccaaatctatctatagttacagaatacttgtctaggggtagtttgtataaacttttgcacagnagtggtgcanaggaagttctagatgaaagacgccgattaaacatggcatnntgatgtggccaaaggaatgaattaccttcatc

SEQ ID NO: 11484 - DNA, 630 bp, Zea mays
  Clone ID: LIB3279-187-Q1-K6-G6
ccccgcgtccgagccgtcacagcttgccattgacctgaatgctcagggtctggctcgctacgccatcatctgccaggagaacggtctggtgccaattgttgagcctgagatccttgttgatggccctcatgacattgatcgctgcgcttacgtcactgagacagtccttgctgcctgctacaaggctctcaacgagcaccatgtcctcctggagggtaccctcctgaagcccaacatggtgactcctggctccgactctaagaaggtgacacctgaggtgatcgcccagtacaccgtccgtaccctccagaggaccgtccctgctgctgtgcctgctgttgtcttcctctccggtggacagagcgaggaggaggccaccctgaatctcaatgccatgaacaagctcagcaccaagaagccatgggccctgtccttctccttcggccgtgccctccaggcgagcaccctcaaggcctgggctggcaaggtggagaacgtggagaaggctagagcggccttcctcgccaggtgcaaggccaactccgaggctaccctcggcacctacaagggtgatgctgccgccgacaccgagagccttcacgtcaaggactacaagtactgagttgcttc

SEQ ID NO: 11485 - DNA, 679 bp, Zea mays
  unsure (1)..(679): unsure at all n locations; Clone ID: LIB3279-187-Q1-K6-G7
cccacgcgtccgcggacgcgtgggttctcaagatatggaacctgaacgaacactccagcgtcgttggcgccttcaactgccaaggcgccggttggtgccgggtagccaagaagaacctcatccacgaccaccagcccagaacggtgagcggcgtcatccgggcgtaagacgtggagcaccttgcaaaggtggctggtcacggctggaacgacgatgtggtcgtgtattcgcacgtgggaggggaggtggtgtacctgccgaagaacgccttgctgcctgtgacgttgagatcgcgcgagtacgaggtgttcaccgtcgtccctctcaagcacctgccaaacggtgtcgcctttgtggtgatcgaccttctcagcatgttcaactttggtggcgcggtgagagagctgagattcggtggtgaggatgccgacgtcgagctcagagtgtggggctcgggcacggtcggagcttattcctcgaccaagccaacgtgtgtcgtcgtcgattccaaggcggttggtttctcctacgatggcacctatggcctcatcagcttcgagctcaacatccccgaccaagaaatgtacttgtggacggttacagtagggtactgaagttagaactgagaattgtgatagattntctaatgcgtcagagaacgccggtggtgtaggtattc

SEQ ID NO: 11486 - DNA, 687 bp, Zea mays
  unsure (1)..(687): unsure at all n locations; Clone ID: LIB3279-187-Q1-K6-G8
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtntgttggtgcccatctgtgtttttgattgaagtcgctctgtgtca

SEQ ID NO: 11487 - DNA, 650 bp, Zea mays
  Clone ID: LIB3279-187-Q1-K6-G9
cccacgcgtccggccgccgcctctcctactgcatctccctcgctctcgtcgcctcgttcgcttcgcctcctccccgccccgccccgagccgagcagagcgcagccctagccggagctgggatggcggacgcgaagcagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccagttgggtgagggctctgctggtcaggtcacaaggaacatgcttgcaaatgagggtgtccgttctttctacaagggtttgtccgccggattgctgaggcaagcgacgtacacgactgctcgtcttggatcctttagggttctaactaacaaagcagttgaaaagaatgaagggaagccattgcctctaattcagaaagcttttattggtctgactgctggagcaattggtgcttgtgttggtagtcctgctgacctggcactcattagaatgcaagccgattcgaccctgccagttgcacaacgacgcaactataagaatgctttccatgcactctaccgtatcagtgctgatgaggggagtcctcgcgc

SEQ ID NO: 11488 - DNA, 681 bp, Zea mays
  unsure (1)..(681): unsure at all n locations; Clone ID: LIB3279-187-Q1-K6-H1
ccggcttcggctccggcgccgagtccgacgccgacgccgacctccccgaggagctcgcgggcgcgtgctacctcgacggcgcggaccacgagggccacccggtgtgctacaacgcgctgggcgtgttcgcggacgacgccgtgtacaagaaggcgctgggcaccgaggaaggcaaggccaggttcctccggtggcgggtgcgcgccatggagcgccacgtcgccgagctggacctgaggcccggcggcgtcgcgtcgctgctgcaggtgatcgacctcaggaactcgccggggccggccaagaaggacttccgagtcgccgtcaagcaggtgctcgacctgttccaggacaactaccccgagctcgtcgcgagaaacatcttggtcaacgtgccgttctggtactacgcgttcagcaccctgttctacccgttcctgacgcagaggacgaagagcaagttcgtcgttgctcgcccgtccaaggtcagcgagaccctcctcaagtacattnccgatcgaggccatcccggtgaagtacggcggcctgaagcgcgacggcgacaccgagttctccgcggacgacggcgaggtcgcggaggtcaccgtcaagggaagctncacggagaccatcgagatcgaagccactgagctgatgccacgctgacatgggaccttactgtgc

SEQ ID NO: 11489 - DNA, 477 bp, Zea mays
  Clone ID: LIB3279-187-Q1-K6-H10
tttcacggtggtggatgcggcgacgatggcgtagccgagcagcttagagatgagcgggagcaggcagcccttgtcggggatcttggcgtcggacagagccgcgaggaccgcacccgaaattcatgcctaggatctcgagctccatcgctgccaccatggccgtctcctccgtcgccacggaggttcagtcgcagcttgcgtcggcaatggtgagtggtgacgagacgacgaacagcgaagaagcccacggcccacaagccacgcgcccacaagccgaccagcgtatctcttcagtgagatgggccttttgtgacgggctggacgtctagctggcatgtctcggctgtcggctcgttaaaaagcgggaaacttggctagggaagatattagtgcacctctaagactctctatattgttcttaattgatataatagtttatttaaatggctatctaaatataaacatcttcgacttcgg

SEQ ID NO: 11490 - DNA, 630 bp, Zea mays
  unsure (1)..(630): unsure at all n locations; Clone ID: LIB3279-187-Q1-K6-H11
gttttcttctcccgtccaccttgcgtgctcgcgcgcgagctctcgtggcgcagccacaactaggcgaccgccgccgcccctacgccacgtgctcgagtctagcctcgtcgattgcttccccagtttaattgatctacaagcttcagaacatgttcaagaatacatttcagtctgggttcctgtccattctttatagcctcgggaccaagccattgcagatatgggataaggaagttgtgaatgggcacattaaacgaccccaagatgaagatatccaatctaatgtacttgaaattgttggaacaaatgtacagtcaacttacatcacatgcccagctgatccttctgctactcttgggattaagcttccatttctggctattattgtgaaaaatcttaagaaatacttcacgtttgagatccaagttctggatgacaagaatgtccgacgtcgatttcgagcatcaaattttcaatctgtcacaagggtgaagccatatatctgcacgatgccgttgaaactcgacgatggctggaacaacatccagttgaaccttgctgatctgacaaaagggcgtacggcacanattacgtcgagacgctgcgggtgcaagttcatgcgaactgccg

SEQ ID NO: 11491 - DNA, 699 bp, Zea mays
  Clone ID: LIB3279-187-Q1-K6-H12
cccacgcgtccggcatctaacaggttggggaggggtgggggggacgcaattgccaagggaacgtgaaaatgattccaaagttgatcctattagaggaaggagagtgggtgagacgaggtctagattacctaaacctacgaagtctcagagcgttcgagctagcagtgctcctggaaatgattgcttccccatgcatgttcagaatacttgtgtttctcaaaggagttttggttttgcgggaagttcgacaagcacttccaacaatgaaaagtccacttcagaaaaaaataatcctgcgcttggtgtgggctttagaactgaagttccttctgtttctgaactgcaaactgcatctactgttcctactaatcgagctaaaaagaaatacattcccactgttagcaacataaacagaagtatactcaatacctctgaaaaggcaaattctgattctggtgaaccccgaaggactacttctgattctaccgaacccagacggtctaacaggcgaattcaaccaacttcaaggttgctagagggattgcaaagttccctcataatctctaaagttcctggcgagaaggttcctaggagcaattacaaaagtgcatcgtcaagagggagagctcaatctcatggttgagtgaaggcaccacatagctaccttttgtgggatacctctcgttgtacatagctgca

SEQ ID NO: 11492 - DNA, 645 bp, Zea mays
  unsure (1)..(645): unsure at all n locations; Clone ID: LIB3279-187-Q1-K6-H2
cggacgcgtgggtgactactaaatttggaaaagagaggattctgtagccatatgtattgtctctgcaggaggttatgagaatgaggatgatgacacagatgtgctcgtgtacagtggtcaaggtggaaataataggaatactgaggagaggcatgaccagaagcttgagaggggtaacctagctcttgagaggagtttgcataggaagaatgagataagggttgtacgtggcttcaaggatccattttgcctaactggngaaaatttacatatatgatggtctctacaagattcatgagtcctggaaggagagaacaaagtacggtgtcaattgcttcaagtacaagctgctgcgggaacctggacagcgtgatggagctgcattatggaagatgactcagagatggatagataatcctgctaccagaggcagggtcctactagctgatctgtcatctaaggctgaaattttgcctgtttgtcttgtcaatgaggtagaccatgagaaaggacctgtacatttcacttatactaatcaggtcaaatacttgaggcctctcagttctatgaaaaagttgcagggctgtggatgccagagcgtttgcttgcctggcgacgccagttgtgcttgtggacacataatgg

SEQ ID NO: 11493 - DNA, 658 bp, Zea mays
  Clone ID: LIB3279-187-Q1-K6-H3
cggacgcgtgggggggccgtcgccgtcgcaagggagcgcggcattttcgtcgtctgggttgtcagagagcatgacccttctggaagagatgttgaacttttccgtaggcaccattattctgggggaaagggtccaacagtgaaaggtctgaaaggagcggagctggctgatgggcttgttatcaaagaaggggagtacaagttggtgaagactagatttagtgctttcttcgcaacacatcttgattctgtcctgaaaactgcaggaataaagaacttggttattgttggagttcagacaccaaattgcattcggcagactgtgttcgatgctatagcactggactatgagaaagttacggttctaattgatgcaacagctgctgcaagaccagaaatccatttgtccaatatcagggatatgaagaacatcggagtggacacgccaaccctggaagaatggcgccgctagggttactctgtctcttggcagcaccagcaaacggagatgacctgttgtatgagatgcatgcagcacctccctgcatctacttctttgcttctaatctgcgtctactgcgcgtacgttgttgtattgtttacccagtgcggtagaacattgcagatggtggtatatggtatatgcaaacttgtaatcc

SEQ ID NO: 11494 - DNA, 658 bp, Zea mays
  unsure (1)..(658): unsure at all n locations; Clone ID: LIB3279-187-Q1-K6-H4
gttgcatggngnagaggggtttgcataatattattagattttttgggtgcccttatccaatttccagagttctgttgcgatactcgaatgctggcaagttgcaggataattcagggtcaaaacttctctagaggtttcagtgatacactcttactgttccagcaactgaggcagtgtatggaattagttgttccgagtcaagatggttctgttacctggaatcatgatttgtgaacctcagttgaccatcaacagattagtttgagtaactgaagttgttcagggacgcaacactcatgacagtccatgttctggactctggagaggagttgttcatgtcactcacattgatttggtagaacagctctggcagatgctgaagtaccatgtggcctgcgcattcattgcctgcagacaatcataaggtgctgatggcattgcaataaattgcagtatctgaaatcccgcaccatgcatcatcactgcctttttcgatagggctgaagatggaagcttcacgcttttggttgctgcagaagaaacggacatcaggattaaatctgacagcggctttgagtggtgctaggatgtttggaaaaatgtgtgcctccttgatgctaatacacggacatgtatatagngaaaatgatacacccag

SEQ ID NO: 11495 - DNA, 495 bp, Zea mays
  unsure (1)..(495): unsure at all n locations; Clone ID: LIB3279-187-Q1-K6-H7
aggggagaaggtgctatcaacttaattgtgttgtcctattgtggatctttacaagagccttgataggtgaccaacattaccccatacgtatttccatgccaaaaattagtttcttgggattttttgtggagatatttcttcnatgaaaaattcataggtgttaagccttcattattgtcgaaaatgattgtatatggccatttttagcaaaaaaatacaggacgtatacccatgaatctttggtgagagactttattacttatcacatacatctttacttctagaaattagttttttatttttggtggagtatactacatcatgaaaaaattgtatgtgttagccttcaatagtgttgaaaatggtcatccatgcccattttccgctgaaaatactggttgtatacccatggatatttagtgagaggctcctacttatttggacttttgtggatgctatttattcatgaaaaattcataggtggtagccttcaat

SEQ ID NO: 11496 - DNA, 657 bp, Zea mays
  unsure (1)..(657): unsure at all n locations; Clone ID: LIB3279-187-Q1-K6-H8
cgcctccatttcgttttcctcactctctcctccagctcagggtccggcggcgaagggaaggcaagatgtacaccgcgaggaagaagatccagaaggagaagggtcttgagccctccgagttcgaggactccgttgcccaggctttctttgatctggagaacgggaaccaggagctcaagagcgacctcaaggacctgtacatcaacaatgctatccagatggatgttaccgggagtaggaaggctgttgtcattcacgtcccataccgcctgcgcaaggccttcaggaagatccatgtcagactcgtcagggagctggagaagaaattcagcggcaaggatgtggtaattgttgctacacggaggattgtgaggccacccaagaagggttcagctgttctgcgccctcgcaccaggactctgactgctgttcacgatggcatcttggaggatgttgtctacccagctgagattgtggggaagcgtgtcagataccgtctggatggttccaagattatcaagattttcttggacccaaaggagaggaacaacactgaatacaagctggagacctgcactgcggtctaccgcagnctgtgtgggaaagatgtggtctttgagtaccctatgaccgaaatgcataaatatgatgccctct

SEQ ID NO: 11497 - DNA, 537 bp, Zea mays
  Clone ID: LIB3279-187-Q1-N6-A10
gttgggggtggtgggtttttttttttaacagaataccagtcaaatataggtcattctaaacaacaacgctgcaacaagggcaggtctttttttccctggaagaagcagcaggcttggagcacgaaaaccagcatccagccatcatttatcaactggggaatcgaaacatagcatgcgggcataacatctagagtgtgtgcttaattaaaaacagcggcaaaggcaatggcaatggcaggcagcttcagcgcacgcgcaccggcgccgtgacgaaaagaacaacacgaggtgtactagaagataagctatcagaaatcaagaacggcacagtcctggtaaactccccgacatcagcagacacgcatcaggtcgggagatcggatccgtcttactggccctcgggggcggattctttgggggcagcagctgcttccttgatctcatccccgccgtcctcgttggtgtcggaagtccataaggtcaagttgtcacgcaggagctgcatgatcagagtgctgtccttttaggacttctttt

SEQ ID NO: 11498 - DNA, 611 bp, Zea mays
  unsure (1)..(611): unsure at all n locations; Clone ID: LIB3279-187-Q1-N6-A11
gttgtggggggtttttgcggtaaatctaccatcaacggcagtgtcttttgatccagtggcaagtcatagtggtactggtacataggttctaaagtttggcaatagattaatcgtattaacatagcagtatctcgtacgatactcatgtgagggggggggctattctacgcataatatatctccatgccaagtatcttggaggactggcacagggggcagaagctcagcttgctctcgcactccttgcatagacaaagatgccgacaaggcagcaagagcatggatgcctcacttgatttgcagaccctgcaagccgtcaaatccttcggttgtctgttctccttcggagtcagttgaaaattgatagcaccaccattgcgacaggacgccgtgtcatctacctcgctatcgccgcagccttccttgaaatccttgctctggtgagcacaaacctgttccaagttgtacttgagtgcattgatcatgctntcattgtacttagccctatgctgccaagcaccaacttccactcccaaatgcttaatctggtcctttagttcagagttccttttgtttatgggctccacttccgcctctttgtcccgtatttt

SEQ ID NO: 11499 - DNA, 512 bp, Zea mays
  Clone ID: LIB3279-187-Q1-N6-B10
tttggttttttgggttcaaaagtcacttggatgatatcaaattcagaagtgtgcataacacatggtaatggaacgattgagagccatagctacaaaactctggtttcacatagaactaggacacaacagatgaactaggatgcctaatgcgggacttagatgatgccgattttgttggccacatcaagagcatcatagtcgggagtcagcttcacgtaagccttcttcttcccatcaggcctgatcaaggtgttgaccttctttgcctggatgtcatacatcttcttgacggcagccttgatcttcttcttgtctggcttgaggtcaacaatgaagaccagagtgttgttatcttcaatcttcttcatcgctgattctgtggtaagggggtacttgagaatttggtactgatcaagcttgttccttccggtagtgctgattcgtgggtacttggggtccctagccttcttcaaggtcgtggggcggtgaaatgtcacagacgtgcgggatct

SEQ ID NO: 11500 - DNA, 659 bp, Zea mays
  unsure (1)..(659): unsure at all n locations; Clone ID: LIB3279-187-Q1-N6-B11
cacgcgtcgtaacttgttcctctanacggacccctttgtgggttgttggcaaaacgcacgaggttccattacttctcaaaaagctgtggcctgtagcttctttcattgtttcaaagcattacaacataagcagcaaaaccagaaacagtcctcataagcaccacttattagggcagtacaacacaggcggtaagcgcggtgcagatcaagaaagaaccacaacatgtagaagccatataaaagcatgattaagcacagcagaccaccaaaagcttcttactgaaaaaaagccgccttaggcagaaggtttctccgacttgagtggcttcaccacctcccaggtgaagtcagggtcgtcccttccaaagtggccgtaggccgccgtcttgaggtagcgcccgttgccgcctttcttgaggtcaaggttgatgatgatcatgccaggcctgaaatcgaagttctccttgacaatcttgaggatctccttgtcggggatcgcgccggtgccgtacgtgtcgacgaacacggagagaggctcgggcacgccgatggcgtaagacacctggacgatggcgcggcgagcaaggccgctggcgacgatgctcttggcagcctgccttggcgacatagctccgctgccgtcaaccttggttgggtcc

SEQ ID NO: 11501 - DNA, 235 bp, Zea mays
  Clone ID: LIB3279-187-Q1-N6-C10
ggaggggggggggttttttttaattaaaaaagggggggggggggggaaacaattccttgaaaggaatttccggcctttgcccaagggggcccccaccccaacaaaatttaaaaacccccccttgggggtataaatccaaaaacaaaacccccaaccattttcccggaaaaaaaactccttggccacttgagaaaaaggggggggggccttaaccaaaaaattgcataagtcctgg

SEQ ID NO: 11502 - DNA, 630 bp, Zea mays
  unsure (1)..(630): unsure at all n locations; Clone ID: LIB3279-187-Q1-N6-C11
ggtataaacagaagcataacccaaatgatctcaccataaccgtgtacaaaaaggtatacgacatgtgataaaagaataaaaccagagttgattctagtacagggaaccctcggttctacactcatgngaaaatcctattcatgggctactttacgattgtcgaaagaggcactgcagacattcgagtgaccatcaccactggcacgcctgcctctggattttggagttcatggtgcccttacccttgtaggcgttcctggacgacactggccttctccgaccactggcagctgctattgcctttttcctttgcttgttcaattgtttcgtgagctcggcatcttcttcttcttcatcagcatcctctgatgagtcatcatcattattgtcgtctttctgggaaagcgtcttgccctcagattcaagcggtttcatagcctctccattgccacccgagggactttccaatctcttctcactgctacaactcgtttcatgctcttcagaaaagttccaggcacatctgaatcccttgaggcaagattacaatcaggctcagcagaatcatcctggtctatcttcaaggaaaccaaagacacagcatcaccaaccttgtcattgtcgtcgtcg

SEQ ID NO: 11503 - DNA, 633 bp, Zea mays
  unsure (1)..(633): unsure at all n locations; Clone ID: LIB3279-187-Q1-N6-C12
gtgggttgttggggttttttagtgaaatctaacccaacgacaagnaacaaagattattatttcgaacttccatagaggtcattgcaccaagaagcatgcgatacaaaatagcacccaaaacactcgaaattctaccttcttattttagggggggtggtaccatgaaaactcaaatcatgtagttgtattactcaaagggcatatttaaaagcattctttgatacgataagctatatgtgatttatttagtagtggttgttctcccagaattgagcctggagccaatcaattgtccccttctccacctggaaagcctttgccaagacatcatccgaaatcggtggctttgatccgaagaccgcattggcgatggtaataaccccagggttctggctgctgagcgccgcgatagcaacggccggcttgttatagaccgggttgaattggaaatggatgagaccttgggggaatacgaacacatcacccttgttgagcaccttggcaaatagcttgtttgggttggaggtgacaaacccgacgtagagtgtcccctcaagaaccgtgaggatctccgtggcacgtgggtgggtgtgcggcgggttctcgcccatggcgcgtagtcgatacgtgcca

SEQ ID NO: 11504 - DNA, 541 bp, Zea mays
  Clone ID: LIB3279-187-Q1-N6-D10
tttttttttttttagaaaaactcaaacagtttcatacaggaatcatgcatttggagaggtctaggttttctccgaagtacagcattaagttgtggtacaatacagagatagaagaagaggagctgaaatctgttagtcgcgaaactcttccatgaaggctcgatgaaacgccacaaagctggagatgatcaccgtcatcgtcttcttctcttcgtgtggcaggaccgtgcatctgaaatgccacgttccatgcatctgtccaaaaacagagccaggcacaacgacgatcccggtggtttcgaggaggcggagcgcgtagaacgcatctggctgcgtgttgcttgcctcggcagctgcgaccgccttagtttggcagacggactgaagggaacacgaacactgctccttcagcctcgctacaggtcaccccttccagcccgttgaatgagcgcaccatggcctctgcgcagcgagcgaaagatgacaggacgccgtgtctttcggcatggtaagaggcgtacgactcgtctccgacctggag

SEQ ID NO: 11505 - DNA, 595 bp, Zea mays
  Clone ID: LIB3279-187-Q1-N6-D11
gggtgttttttttttttttttttttttgagggaccaagataaatatttccactgtgcaacttgtttcagttgatgcagcagtactgggactaatcagttattttaacattcggcacacttcaccatagttttgtttatctggggcatttgcgtatggggtgccaaagaattataacaatatgccattagcgtaagatcaaggtactattttgtagacacagtacaaccataagagcacaactttgctaccaagaaaaacttgtgattatgtactggcgaagctgacagagttctgtttcttcctcttgtgtgattatgtctctgctgggccgctagtcgaacgaaataaatacaatctgacaagagttcagcttgtcatatgaaatcttggttcaggtcatctggtcgccgagaagtatccccatcaagcatcctcttcgtcatgttggccctctgcacaagtcgaaccaatgcttgcaccacctctgacattggtggcctgaattctggttcaggctggacacacagggcaaggacatcagcaaatcgggatagagatttagctgggtatagacccttgagtgcagatcgacca

SEQ ID NO: 11506 - DNA, 615 bp, Zea mays
  Clone ID: LIB3279-187-Q1-N6-D12
gtggtgcaattagcaaggaaaatgcatggatgtactagataaaccgttccagatggcagcagggacaagaacattgcggatctacactaaacatgatctagtctaactgcacgggcgctaatggtaatattgttctaagacaggagaggactctacgccttcttgggggacttggcggccttcttgggctccttggccgccttctcggccaccttcttggggaggagcacagtgtggatgttggggaggacgccgccgtgggcgatggtgacgccggccagcagcttgccgagctcctcgtcgttgcggatggcgaggagcacgtggcgcgggatgatgcgcgtcttcttgttgtcccttgccgcgttgccggcgagctcgagcacctcggccgcgaggtactccaggacggcggcgaggtagacgggggcacccgtgcctacacgctgcgcgtaccggccctttttgaggtaccgcccgacgcggctgacggggaactgcagcccggccctggaggaccgcgacaccgacttcttcgtcggcccgccggccttgcgcccgggcgcgcccttcttcgccttcccgcctgctccggtcacgtgcatggctgctact

SEQ ID NO: 11507 - DNA, 554 bp, Zea mays
  Clone ID: LIB3279-187-Q1-N6-E10
gcaattgaaaaaaaagataacaaagagatgaataattcttggagaacaaacttgcacaaacggacaacaaatcctatcctctggaattggaagcgattgagagaaccagggaagggcaagtaagcaacgagtgaaaattctgcgggcaactcactctgttggtattggaaaaagtaaaaaaaatcatagctccagtcatacccacatcatttatacatagtgtattatcggggataagatcaccggttcctagacccatcggtaagtaagtgcgctagagaaaagcctctggcatctgggcccatctgtcagctagagtagataggtagcgtctgccctataagtactcgtcctaggatgagccccgcggcaccgagcctggggtcgggcttgacggagctagacaggggatctcatgagccgaaggaaatccactcgagtggatccctcacccggtccgagaccaacctgtcataagtgaccggttgcattaactatgcctggcgctgagccataacagggacgccaatatgctcccaatcatgacctacgag

SEQ ID NO: 11508 - DNA, 413 bp, Zea mays
  Clone ID: LIB3279-187-Q1-N6-E11
atccccaaagcaacaccacatataacataacatgggaagctgaataaatgtcagttacatcaaaatagcatttgacaaagcccaaaaaaccgtgcgatacagtgggggtgccccccccccccccccccccaacttccttccaaacaggggggtccagagatttgaaggggtgcatcagagtcagagcggaaccgaagctaacggtttcaaagttggacgggacacacacgggaggaggacagagggaatccaatccggtttccccccatggggaaggggccccttcgttgggctgatgtacaaaaccttgttgccccttatggaaggatgggcatacttgtttttgaactggccattcacgtactcctcggtctgctccattggggtgttcttataaccattcaaacaagcca

SEQ ID NO: 11509 - DNA, 516 bp, Zea mays
  unsure (1)..(516): unsure at all n locations; Clone ID: LIB3279-187-Q1-N6-E12
tccaccgggggcggcggggtacccaccgccatagccgccgcctcccccgtagccacggtcgccgccgtagccgcggtcgccacctccaccgtaaccacggtcgccgccgccgtagccacggtcgcctcctcccccgtagccgcggtcaccgcgggggcggtaaccgcggtcgccgccgccgtatccgcctcgcccaccgccgttgccgccgtcgggacgttccccgccggcaagcgggccgccgccgggcgcggtgacatcgagggccttggcgcggccgtcgttgccgctgccgacggtgtattcgacggcatcgccgtcgttaagactgcggtagccgtcggacttgatggaggactggtggacgaataggtcctcgctaccgtcgtcgggggtgatgaaaccgaagcccttggttccgttgaaccacttcacagtcccgagcaccctatcagacgccatttcctcctcctcgaaaaccctagaaaccctanatggtaggggaggcggacgcgg

SEQ ID NO: 11510 - DNA, 328 bp, Zea mays
  Clone ID: LIB3279-187-Q1-N6-F10
ggggcaacaaaccaatgctccagagttcaaacgtacacccacaacccggacttgggtgcgtagcgtaccacacacagggggggagttgtgaaaacaaaaaaccggtttacaataacttaaaaagatacattacgcccacataaactttgcaccttactaaaggggttttggaccgccgcgctggtcttcggggacctccacccttccagggaaaatagcttaggctcgctttggttcgtcataagtccgcgaataaagtaaaaaggaaaaggtcctgcacaaacgtgggtttgacgcgggcttgttttcgtttaaaaggacccgtggg

SEQ ID NO: 11511 - DNA, 466 bp, Zea mays
  Clone ID: LIB3279-187-Q1-N6-F11
gacaatagaacattatattagcactaagaggattgccacaacttcatcttaaaacaagggttatgaacaaagacatgtttaaagtaaccagcaaagggggggggactattccaatccatttccacactcaaaagttgcaacaaggccaaggagaaaaagatgatccagacaatgataactcaagaaagagtccaccctaaaacaacttaaatcgggcaagggacaactcctgctcaagtccaaaactcatgatcctttctactcaatcagatcatcatcgtcatcaggaaaaggttgtgcagctgctgcagcaagctcggcttcatgctgctgctgcatagccatgtcgatggtaacttccggaggcttaaaagcaacagcttcaacaaagtgaaggttcggatcaccagccagcttccttgcaaggtacaggaaaggtttctcaaagttgtagttgctcttggca

SEQ ID NO: 11512 - DNA, 624 bp, Zea mays
  unsure (1)..(624): unsure at all n locations; Clone ID: LIB3279-187-Q1-N6-F12
aggcacatcagatggggaagctgcaaaccaaaaccttcccatctggacgcaatttattcagccacgcggatgatgtgatgagcaaaagcatagcaggggcgttcctactgcgtcctccattccctgtctacaaataatacggaggcgacgtacagcaggaagaaaaaaatacactggcattcaacttctaacatcttgtatcaagatcgagaagcagaaacaaaatctccaaacaaaagaatagggagacgttaaggccgggcacatgggacccatatctaaggacaagatctacataccctgatgctgcggaagagaggagcatcaaacaccagaaaggtaaggtcaccaccacaattacagaaagtagtctggggttttgcgagttgtgtctggctcaatttgccgaggtgcggggttgaattgaaggaagttctggtccatgttttccccgatttcaagaatagcagccatgttaccacagcggtaacagtaattaggcgcactgaagactgtgactacattcttatcctggcaccaattaaatccttccattacaagttgatgggcccttngaaagagagagagaccatttgtatggttgaactgctgtgcaatgtcttg

SEQ ID NO: 11513 - DNA, 615 bp, Zea mays
  unsure (1)..(615): unsure at all n locations; Clone ID: LIB3279-187-Q1-N6-G10
cattgttcactgagaaccaaaaccttagatataggtctcaaagtctaaacatgggtaaaaacacagaaaaaaatcgactgccagaaaacgtagttctagtgcaagtgcaccaggatacaagctccactcaacgggggggcttggcaacacgctcaatctcgtccttcttcttgatggcgtagctgttggaagagcccttggcagcgttgatcaactcatctgcaaggcactcagcaatggttttgatgttcctgaaagcgctctccctggcaccagtggtgaggaggtagatggcctggttcacccttctcaggggtgagatatccacagcctgccttctcacaacaccagctgaaccaatacgggtggcatcctcacgtggtccactgttgataatggcgtccacgaccacctggatgggattggcgtcagtgagcaggtggatgatctccagggtgtgcttcatgatgcggacggccatgaccttcttgccgttgttgcgcccgtgcatcatgagcgagttggtgaggcgctcgacgatggcgcactgcgccttgcggaaccgcttcttgnagtagcgccccgcggagtgcggcaggaatgtcgcgtgcttcg

SEQ ID NO: 11514 - DNA, 597 bp, Zea mays
  Clone ID: LIB3279-187-Q1-N6-G11
acgccatagcccaggtcgcatccctgagttcatttccatttgtagaatgtaaatcaagtcataaaatgtaaccaaatcctctaatgggtccctagttgtaatcaccacatgtggcaacagttaatctggcggtggcaatgttagagcacggaatatagttctaccgcaccaaatactgttcctaccataaaatgctcgatctcagggttctaaactctgcatataccaaactaaagaatacaacacaggttttatgtgtagcttgtactgcaaacaaggcaggcagggaggctcagctgcagcaattacacagttctcacggtgacttaattagacccaactacgttccaatgcccactgtttagatggacatgccatgaaatctgaacttctaggagaagaggaacacctgagacccagaaaaatagtttaaactcgtcgcttattttccgtatggatgatacctgctagaaccccgagcacctgtgctcccaccaccagtactacctgctccgccataactgccgtatccgccagtgccataaccacctggggcgccaccataggcagcaccaccttcataggcaccccctccgt

SEQ ID NO: 11515 - DNA, 551 bp, Zea mays
  Clone ID: LIB3279-187-Q1-N6-G12
gagcgtcaactaaaactctgatcccacgttccatttcatatctgcatatgatctccagccaggatgaggtgagctggggatgtctgctaaagtggcacaattgagcaaggcacgagtttcacaaaacttgcgtgatgggacaggtttattcaagctgagctacgctatgatctgaagacgcaaaacaagcattgtgtgacttgtgtcatgaaggcaccagaagaaactgaacggagcgcttgcaaaaggatgcttcagaatgtttacacagcctccacatttggctcagcatcctcattctcaacaggctcaccatccttctgcttcacatagccgaaatatccatcatcccaataatgctcctccgcacttctgccaaaaatgaatggtcttctacccattgttgtaaaaggcattaacccaaacgcacgtgcggttttgatctctcttgcaatcttacgctgagcttttgcacttatacgggtctggcttctcttgatgataattccagcttccgtaagaaagttggagaggaatctaacattcctaaa

SEQ ID NO: 11516 - DNA, 491 bp, Zea mays
  Clone ID: LIB3279-187-Q1-N6-H10
tgtgtgtggggttttccgaagtcgaagatgtttatatttagatagccatttaaataaactattatatcaattaagaacaatatagagagtcttagaggtgcactaatatcttccctagccaagtttcccgctttttaacgagccgacaggcgagggatgccagctagacgtccagcccgtcacaaaaggcccatctcactgaagagatacgctggtcggcttgtgggcgcgtggcttgtgggccgtgggcttcttcgctgttcgtcgtctcgtcaccactcaccattgccgacgcaagctgcgactgaacctccgtggcgacggaggagacggccatggtggcagcgatggagctcgagatcctaggcatgaatttcgggtgcgtcctcgcggctctgtccgacgccaagatccccgacaagggctgcctgctccggctcatctctaagctgctcggctacgccatcgtcgccgcatccaccaccgtgaag

SEQ ID NO: 11517 - DNA, 344 bp, Zea mays
  unsure (1)..(344): unsure at all n locations; Clone ID: LIB3279-187-Q1-N6-H11
gggggggggggggggtttnaaaaaaaaanataaaaaaaaaaaattaagaaaaaaaaataataatttttttttcccaaaaattcttcttcaaaaatacccaaactaaaaaaaaaattttttttctttaaaaaaaggggtttttggaaaaaacaaaaaaaaaaaatattttgcctttttttaaaaaaaaaaaatttttttttttttttttgtaattttaaaaaaaaaaaaaaaaaaatttttttaattttttttttttgttttaaaaaagggcgaaatttccccttggggttcccccaaaaggggaaaaatattatggcggggagaaaaaatattttaaccccccc

SEQ ID NO: 11518 - DNA, 534 bp, Zea mays
  Clone ID: LIB3279-187-Q1-N6-H12
gaaaaggaatgaatgatcaaacgacgctggcaaaccaaattgtctttcacaggctacagcacatgttaaattatcggataaatttaaaccacacccaatttctttcccggtgtacccacacatactaaggaggaggtttctacgatattaatgactattctacaacacgggaaaagtctgattcaggcaagtaaaagaaaaggttaacagaattcacttaagctagtttataatacatccgaatccttgtgctccaatgaagacttcctactccaatcctatcctgcttccgtactagaaggctgcagctatgtacaacgagaggtatcccacaaaaggtagctatgtggtgccttcactcaaccatgagattgagctctccctcttgacgatgcacttttgtaattgctcctaggaaccttctcgccaggaactttagagattatgagggaactttgcaatccctctagcaaccttgaagttggttgaattcgcctgttagaccgtctgggttcggtagaatcagaagtagtc

SEQ ID NO: 11519 - DNA, 635 bp, Zea mays
  Clone ID: LIB3279-188-Q1-K6-A1
ggacgctgcatctgccagccatagctcactaagagcacagatagcggactacctgctggatgaagatgatggaaactgactttattctctggtttcgtgacataatttcatggagtcaaatgtttaactcacatggaattcccgaatgcctgtctgtactgacatgttttgtttgttgtactataagacatcgcattctaattgggcctcacacaggcatatgccaaacttatggataacagtgtttcttctttttttgtttctgacaaaaccagtatcactagcatgacactgctactggtattcttcaactcatctgggatctgtatagtggtgaggcaaaccatcactagccagcaagtttccactgattttacagagacagcacgggttggagagctgaacgtttcccacttaaaatgtgatttcatatgaactggtctcatctcctgtgctgtgcgagctattctgccagcaaacattgtaacaagatgaatttatccggtggtttggacaattcgttttctctacaaattctgtacgaactgtggttacactcagttaccctgttgtattcgactcgaagatctttggggatgttgtgcagacaagcgctgcatctttcagcctgttcg

SEQ ID NO: 11520 - DNA, 678 bp, Zea mays
  unsure (1)..(678): unsure at all n locations; Clone ID: LIB3279-188-Q1-K6-A10
gcgagaggcgaggagagagaagttctcgagctagacgagcgccgtgcgaggagagaagcgagatgagcggtgaggcggcggccgtgggcggaggcgaaggagaggcgaatggcatcccgccgaacgtcaccatctatatcaacaacctcaacgagaagatcaagctcgaagaacttaagaagtccctaacagccgttttttcccagtttgggaaaattcttgatgtgcttgctttcaagactttgaagcataaaggtcaagcttgggttgtcttcgaagatgtcgcatcagctactgaggctctgaagaggatgcagggctttcccttctatgacaaaactatgagaattcaatatgccaagaccaaatcagatattatagcaaaggctgatggcacctttgtacctcgagaaagaagaaagaggactgatgaaaaatctgaaaagaagcagaagcgcgagcatcaccatgatgctggtgctagtcaaattggcatgggtgtaactgcttaccctggtgtttatggggctccacagctcacccagatacctatagcaggaggacaaagggtcatgatgccagagattatcgtaccaaacaacatcttgtttgtccaaaacttgccacacgagacgacgcccatgatgctncagatgctcttctgccagtaccctggct

SEQ ID NO: 11521 - DNA, 55 bp, Zea mays
  unsure (1)..(55): unsure at all n locations; Clone ID: LIB3279-188-Q1-K6-A11
ccctctgcgccccgcagcctttcgccgccctnctcagtgaccgggaagagatgcc

SEQ ID NO: 11522 - DNA, 688 bp, Zea mays
  unsure (1)..(688): unsure at all n locations; Clone ID: LIB3279-188-Q1-K6-A12
cccacgcgtccgcggacgcgtgggcgggtctgagctccgcggcgtcctacgccggtgagcggggatcgttgccgcgcgcaatgtcagccatcgtaccaccaaaacccctcccgttcctcaccacgctcaccacccgcttctcacttgcctgcttacccacgcggcgtttcacccaaacccgctgttccagtgccgggcaccgcggtcccgcggtcgcggccactcctcgtcccggtggagtttgcagggtccattccccccttaggtctcttcttcttgccagcgcggcagcttcggcccgaaccgcggcagcggcggaagacatgtctgacccggagctgaggctggtgctcgagcttgctactgacgaggagctgatggaggtcgaggagatcctctacggcaccagctattttagcccattgctaaaatcaattgcaagaagaccgaactcagatggtgttgttattttggatgatatcgaggagagagatcatttcatctcaaaattagagtcaaggttcctgtatcttgctgcagatgctcgttttgttataagggggtggagaccatcgtacagagatgtcttgctcagagtaagaaaaaaaattggtgttcagtgctctagcanattgtgtactgcagaccttgaggcagaaatatttcttcaccttgntaatgaatatta

SEQ ID NO: 11523 - DNA, 680 bp, Zea mays
  unsure (1)..(680): unsure at all n locations; Clone ID: LIB3279-188-Q1-K6-A2
gcggcagcagccaccagcgagccctgctccacgcgccccagccatggcgcccttcttccccagcgcagggagctcggctcccttcctcccagggcgctggcctctctcccatggtcggccctctgctccggcgctcggcatccctgcagcaggcgcccttcttcctccctggctcccacggcagcaagcagccagcagggagcaaggccagcccccatggcgcccttcctcctcggctcaatggtgtggccgagcagcagcctcttctctctgtttcctatgcgtgcgcaggggcagaaactccatggccgccgagctccattcccccaaggagcagctccctccatggcgccatttctcccagccgacgccctcattcctccctgcgcagcgccccttttcttctacctcttgccggcgcccagaaattccagcagcgagcagcgcacgtcctgctgtccatggcgtgcagcaaacgtggagctcagctccacctctccccatggctgcgagctcccttccctagctgctcggctccccctcccatggaaaccagcagcctcatctcctctccccaaccgatgcccttttttttccacctccggcagcaagctgcgaactccatttctccatggccgcgagcttttccttgctgcgactgtctnccaagacagcgcgca

SEQ ID NO: 11524 - DNA, 522 bp, Zea mays
  Clone ID: LIB3279-188-Q1-K6-A3
cccacgcgtccggcctggacgaccctgtcatcaagagcttgactgagaagtacggcaagacgccggcgcagctcgtcctccgctggggtctgtagcgggacacggtggtgatccccaagacctctaaggtggagaggctgcaggagaactttgacgtcttcggtttcgacatctccggcgaggacatggagaggatgaaggccgtcgaccggaagtaccggactaaccagcctgccaagctctggggcatcgacctctatgcttagcttttagttgggtcgcgtcgcgtgctgcgtctctcggctccccccagacaagacaacatcaataatgaggattccctcagacgacatcagtcaaagtcatgaggatctcagacaacatcttccatcacatgtgacagtgtgaggttgatggtagggtttggtatccccacgtgtccctctctctttcagctcagcttcatcaccatgtagactacgcagtggttgcacccgattatttactgtttttcttccttac

SEQ ID NO: 11525 - DNA, 615 bp, Zea mays
  Clone ID: LIB3279-188-Q1-K6-A4
ccccgcgtccggaggagttgaagcttaccggtaaccatctgaaaggtcacgcccacttcttacattttctacaaattttgatgagcaacctcattggaagcttgtgaaggaaatgataactcagatatttgctagtcctaaagatcaccgtaaagcaaaacctttccatgaccatgtgtttgtcttctccattgtggatggccatgtttggtttcgaaactaccagatttcggttccccacaatgagattgataaagttgataaaggtggtctggataaaatgacacttattgaggttggccccaggttctgtttgaatccaatcaagatatttggtggtagttttggtggtcctacatggtatgagaacccatactacatttcccccaatcagatccgtgcactagagaagaggcagaaggcaggcaaatatgccaagaaggtgaaggccaaggtgaggcggaagatgcacgagatggagaacacgctggagcctgatgagtttgctgagctctggaaaggggagtaactggtctttgatcgaccctgtcaaagtcgtgaagcaccagcaactccttccaccaagcgcggattttgtttaccagtgtggcagtg

SEQ ID NO: 11526 - DNA, 443 bp, Zea mays
  Clone ID: LIB3279-188-Q1-K6-A5
cagcggaccaagcatgtggagattgatctacacttcgtgcgtgaccgtgtcgcccttggagaggtccgtgttctgcatgtgcccacaacatctcagtacgccgacatattcaccaagggccttccgacttcggtcttcatcgagtttaggaacagtctgaatgttcgcagtgctccaagttccaactgagggggagtgttagaatgtaaacatatcacggacgatgggcttaccatacgaggttccccatcttcctatatgtacacgattgtggtgtctgagtaatatacaatttacattctctaatactatatgttttaagtgaatcactagtgttaactgtagagtatagtgtagacattagtcattttttttcgtttagtgaggtaataagcatatgtaaacttttcattctattaagatctatataccacttttttcct

SEQ ID NO: 11527 - DNA, 310 bp, Zea mays
  Clone ID: LIB3279-188-Q1-K6-A6
gaaagtgaacacagcgcactccttacaaggtatcgtttcgggctgctgtgacattgctcagtggctcgcacgtgcagatgtggactccaccattggatattgctctagccggaagttgtgacaccacctggtactatttgccccgttaattgatgcccttgcacaccgagactttgtcaagaacctgatctctggtgcctcccaggttgactgtgctgtccgtttttttgcctgcgccactggtgggtttgaagctgttatcttcatggatgccccaacacttgagcatgctgctcttgagatcacactt

SEQ ID NO: 11528 - DNA, 629 bp, Zea mays
  unsure (1)..(629): unsure at all n locations; Clone ID: LIB3279-188-Q1-K6-A7
cccacgcgtccggcaagatctcgtcgctggtgccccacggcaaggacagcccgccgaggtcatcgtcggcgaggaaggcggcggcgccggtgttcccgctcgccctgaccaagggccaggtggtggaggtgccggccgtgcctgtgccggccaaggacccggggaaggagcagctgctggtgatcgagggcatcgagtacgacccccaggcgaacaataagttcgacgtcgccatcaacctgcccgcggacaaagcgttgcaggtaggcccacagtacaaggagtacgccggaagcttcgccgtcgtgccgggctccggcgccgggaagacgcggaaagtgaagctctccctgtgcatcaccgaagtgctgttcgatatcgacgctgacggcgataaaaccgtcgacgtcgttatcgtgccgcgcacaaatgctaagatcacgctcaacgctcgccccaccatcaagaatcggaactaggagctagctgctactagtgctcatcaagcacactgtacgtacgtacgtatgtactcgatcgcgtggtcattcatcgaccatcatcgtttatatgctgtcacgcacagtgcgggacggccagtgttgcattatntgtgtgttttatttcgc

SEQ ID NO: 11529 - DNA, 149 bp, Zea mays
  Clone ID: LIB3279-188-Q1-K6-A8
cggtaagctagcacgcaaaacaagaaagggacatggtgtacatccttgagtggatgattttttgttgtcatatagagcgcgaagtcttcttcctgcgagacaaaaagctatatgacgttcagacaagatggtggtgcaggatataacat

SEQ ID NO: 11530 - DNA, 620 bp, Zea mays
  unsure (1)..(620): unsure at all n locations; Clone ID: LIB3279-188-Q1-K6-A9
gcggcatcaacgggaacggcaacgcgtcccatttggaggatgccatctgcatccaagataagaggatgatgagcagccttgcaatgagtgctcctcctgctgctgctgatgcggaaggcgagcacgaggagcagcagggagagggcggtggtggctgtgatggcagcagcagcagcagccccaagcaggcagtcaaccctggggaagaggaggtggtggaatctggtcctgtgacagcgacgcccaacgctgcttgtggattccaagaaagctatggcgtggtggaggtggagctcgtcttgcctgacagccccttcgcgccccccaccaaggaggaggcctcatacgctgatgctgtcactgctgcagccgctcggaacggtagcaccagcagcagcagccctcgccatgtggcccttttcgcacccgcgtcttccaccaccctcgagctgcccccctacagctcctcctgcttctttcaggtgcccaggttttctcctgggcatgaagccattgggctgtgatgtgaggtgcacagaacaaaaaaggggagggggcccnctccattcctctaatctgggaggactaatggctatgattggccccatcacncaggcgta

SEQ ID NO: 11531 - DNA, 557 bp, Zea mays
  Clone ID: LIB3279-188-Q1-K6-B1
gcccccccccccccccacccccaccccccggactgagtccagtccaacctcgcaggcaaagatggcggacgtcacccgcaacggcttcgggggccggaacccgccggggctgctgcagaacgcggccaagaacaagcatgcgttcgtgcagctgttcctcatgacgggcgtcctcttggtgagcctgcggaccttgggccagaagcacctcctgcacgacctcgccgccgacaacgccgacctccgccgccagcgcgacgggctctcccaccgcatgcgggacctccaggacgcgctccgcacggaggcgggcgccgactggtacggcgctctcgcgacccacctccgccgtatcttcaccgtccaccctgcgcctgccgtcgccgccgaggaccagtagcgcgctctctcgaggaatcttcttctgcgcagcttgggtctacgctcctgcggtcctacgggtagaggtgaggtagacacctgttacattgccgctgtctgacggtccatggcatcgcacgctgcgtgttcgtggaaatgtcgcactgcaagaagac

SEQ ID NO: 11532 - DNA, 657 bp, Zea mays
  unsure (1)..(657): unsure at all n locations; Clone ID: LIB3279-188-Q1-K6-B10
cggacgcgtgggcagctcttgatttgacacatcattgggaaatgttggatcaagagatcgaagccacgatcatgcctcttgtgtatcgctacaagatttgggtgctttgcaacgattgcaacaaggtctcagaggtgaactttcacgtgattggccacaagtgcagccactgcagatcgtacaacacccgaacaacatcgcgccctgcagatttatccggaagcagctcaccttcaacagactcatccgacaacaacatatagagaagaaaccattgacagagccaatatgattgaagaaccggaggaggaaacattgtttcggggcgtgcgtgcttgccaaacttgaagactcccagccgtttattggccctcatcttgtctagattcagttcattccatgagtctttgctgttgtggcaacttccagcttgcgcatcgctgggtcaacaacccacatggccggcgtagccctttgaatcttgttcgcagccgtgattttatcactgtgggtgaaacgtaatcacatacttactgtaatctactatggctgaagatgtgtgccccctgactcatgccttgtgtgcttgtgctgaactgtttatgaattcccatgctgttccgtaacacttattgncatttgtgtttccttatctgt

SEQ ID NO: 11533 - DNA, 674 bp, Zea mays
  Clone ID: LIB3279-188-Q1-K6-B11
cccacgcgtccgcggccgcgtgggctggaactctaaaatgttgttcaactggcttcttaccagcagtgcacttttatacttagattctttatggccgtgggctggtgttatccttaacaatatggtgtaaactttgtcgtctttgtgcttgtcaatgctcctttttcttgcttggtggttactagagttgtggtttagacttactgagaatcttctcaatgatgtatggttcaaaaaacttactaaagaaagaccatgtttctgtcaagctggtatgcccagcagatctgtttgtacaaaaaagccaggccaagcctttggcctgaagcactaaaaatatctcacatattttcttagcatacacaaagctgctgttaagaaccaatatatctgcagctaatattccctatttgggattatcgggtttcaatcattgatgtccacttgtcgtcaattaacatgaaaatattcaactcataaaatcacccttcacaatgaagtcacacgaggagattacaacaaatggaaaatctgccagctttattcagcaagttttccttggtatacatgctttaataagcatccattcagcatatgcaatgccagtgaaatagcaatgcattcagtgtggtataagctgtaactaagataaaagtgccatggttttttaagtt

SEQ ID NO: 11534 - DNA, 646 bp, Zea mays
  unsure (1)..(646): unsure at all n locations; Clone ID: LIB3279-188-Q1-K6-B12
gcttcctcccctctcctctctgcctcttttctccctcctcggtgctcctccaccagaaccctagctgccgtctcccactctcgtcgggcagctctctcagcagcacctgaggccgttgtctctccttgcgcggtctgccccagccctgacccccggagatccggggctgttctcggttctttacgcggaggcggaggttggtttctgatctggggatcggttcgtgcggggatgaatacgaggccggtggtgctcgtcttcctcctgctcgtgctcgtcatcacgtcgcagttcgagtggaagcagcagatcggggaggccgcggacgccgacccggccgctgcccgccgccggcagcagctgcacgccagggaggatgccgtcaaggaaaagatcatattatcccaggagaaaaatatacaacagcttaaccagcttatcgagagccttcagcgccagctactgcactgccgtggtagcaataacactgttcatgctgctgccgccgttgccacagaagcgagtgaagtcgatggacatgaggtcattgaagatgagaatagacgatgatccttggcgtacatggttctacgatgccggtacagctgctaaagagcagacagncgtctgaatgcttgaattcact

SEQ ID NO: 11535 - DNA, 564 bp, Zea mays
  unsure (1)..(564): unsure at all n locations; Clone ID: LIB3279-188-Q1-K6-B2
ctggncgagtttttgaacaggttaggagaggtgaacgggtctccaatgacgaaatcttgagctttgcgaagcttttcaatgatgaacttactttggataacatgagcagatcacgcttggtaaatatgtgcaaatatatgggtatccggccttttggtacagatcactacttgaggttcatgcttcgcaaaaaactgcaagacattaagaatgatgataagatgattcaagctgagggtgttgaatctctttctgaagaggagcttcggcaagcctgtcgggaacgtggtcacctaggtctactgtcaactgaagagatgagacagcagctccgagactggttggatctctcattaaatcatgcagtgccatcttcacttctcatactttcaagagcttttactgtatctgggaaagtgaaacctgaggaagctgttgtagcaacactatcttcactaccggatgaagttgtggatacagttggaacagtactgccatctgaagattcagtttctgagaggaggagaaaacttgaatttcttgagatgcaagaagaacttacca

SEQ ID NO: 11536 - DNA, 691 bp, Zea mays
  unsure (1)..(691): unsure at all n locations; Clone ID: LIB3279-188-Q1-K6-B4
gaagaagtcgcggtgaaggatatcaagcgtggttatgtggcctccaactccaaggatgaccctgccaaggaggctgccagcttcacctcccaggtcatcatcatgaaccaccctggccagatcggtaacggctatgccccagtgctggactgccatacctcccatattgctgtcaagtttgctgagctgattaccaagatcgacaggcgttctggcaaggagcttgagaaagagcccaagttcttgaagaacggtgatgctggtatggtgaagatgattcccaccaagcccatggtggtggagacattctcgcagtatcctcccctgggtaggtttgctgtccgtgacatgagacagacggttgctgttggagtcatcaagagtgtggagaagaaggacccgaccggtgccaaggtgaccaaggctgctgccaagaagaaatgatgcgacctgtcgttgatgcagcgtctgcttttccaatacgtagctgagatgttccattttggcataagttttgtatcctgtggttgctgacttgctgttaccttgtgaactgttgagctctactattgngtgcccgtttatctgtttatgtagcatcttgttatttcacctattgcatacaagatgcttatatgacatatgttagacatttgggcatgntaaatggatttttaccagtcgtctagtt

SEQ ID NO: 11537 - DNA, 614 bp, Zea mays
  unsure (1)..(614): unsure at all n locations; Clone ID: LIB3279-188-Q1-K6-B5
cccacgcgtccgcacgaaacctcgcgccgccaccaaatctccagcgagcgaaggcggctccggcgagtgcgcggcaacgacgaaggcgtcggggccagtggcgagaggaagagcatgctgaagttcctgtccaaggtggtggtggagtactgccctctggacccgcggaaggcggcggcagtggagctcctcgcgcagtgcaacggccgcaaggccaaggactccaacccggcctgctcggtcgagctccgccgcctcccgtccccagctccgtccacggacctcaagtcgcagccgactctcccgcctccgagggtcctcgtgacctacttcaccggagctgaagaggccatcgtctttgctgagggagctacggcgcagggcatccgggaccagatcgtcgcacggggccggctcatcgatacggagaagatgttccgcgacggcggggnagaaagtggcccgtcgtcatccccgaggaggagcttggcatgtcgttccctggcatcaagccaaagaaagccgaggataagccccaggccgagtgaccaagcaggagttttctactttatatatcatggttaactatggacatttgtacactcagatgctgg

SEQ ID NO: 11538 - DNA, 507 bp, Zea mays; identical to SEQ ID NO: 10603
  Clone ID: LIB3279-188-Q1-K6-B6

SEQ ID NO: 11539 - DNA, 692 bp, Zea mays
  unsure (1)..(692): unsure at all n locations; Clone ID: LIB3279-188-Q1-K6-B7
gttcctgttccccactggcaacgctaccgaagaggagctgagacggggcgtcgccgcctgcgacatgatggtcgcgagcgcggcgacgttcccgtacgtcgagcggcggatgagcgccggcatgtgggacagcaacggcgtggccaacgacccgagcctgcgggggctccaggcgcgctggccgtggctctccgccgccgtccagcagtccttccagggcgccttcgccgccccggtccctgtccagcggagcaacggcaagtggatgcgggtggacaacgtgcgtagcgcggtccccctcgtgtccttcctggagcacggaagctgcaacaggacgcggggggcgccggccttgctcataaggtccgtcgtgcaagagccggtcgaggacgaggacatgcagccgggcggcggcgctcgggccacggccacggccacgacggcggcgtgcggcctgccggccgagccgacggtgcgcctcgtcggcccggaagggaggtgcgtggacgtgccttacggctactactacaacggcaaccaggtgcagctgtggagctgcaagtccaccagcgccgtgaaccagctctggacgctcaagagggacggcaccatccggtccaacggcanatgcctgaccagcagcggcgacgcggccggcgcccgcgtgggtggtcgacgactgcccgcgcttc

SEQ ID NO: 11540 - DNA, 673 bp, Zea mays
  unsure (1)..(673): unsure at all n locations; Clone ID: LIB3279-188-Q1-K6-B8
ctccggcccaaaccccccgcacccaacccccagccccggcaaccgatggcggggtccgcggccgacgcggagcaggagcaaaagcgggcagcggcggcggcgtacgactacgagggcgacgcgcgctgggccgagtactggtccaacgtactcgtcccgccgaacctcgcctcccgccccgacgtcgtcgaccacttgaagcgcaagttctaccagcgctacatcgaccatgatctggtcgttgagccaaggtcattcaccagttccactcaggccagcaggccagatgtaaggtcttcgtcttcgtcatccaccgagaacgtcagggagcgtaattcaggatctactgcaaggtcagcgcctccaccaccgccaccaacacatacagacagtgccgtcaaccctttacggttcgacgcacgcactatacatttctccatcaacgcatggatacttgtggttgctggtctgggaatgcttcctattttgccaaaacaccttgccgacagagcttgcaaactttcacttctgggaacaatattgtcatcagggtattctctatacagtacttatgggaaaccaagagcatggaacatgccagcaattcaagcttggttgcagtctatacttgcaacaaagattntatccatntaatggtctcttctatgctctt

SEQ ID NO: 11541 - DNA, 615 bp, Zea mays
  unsure (1)..(615): unsure at all n locations; Clone ID: LIB3279-188-Q1-K6-B9
ggggaacccaacgnaactcctcctccccagcagacagccgagagtacataggagacgagaagatcccatccactaccgcccggtcgcggtcctccgccctccgccctccccgccgctcgttcggtgcaggtcgccctcgcgtggatcggaatgggcgcctgcgtgtccaaggccgcctgctgctgccgccagccgcacaacggggttaccaacgagaggactgatactgtgacggaggacgaggaggcatacgacctgcctgcgttccaggagttcaccttcgagcagttgcggctagctacatcggggtttgcggtggagaacatcgtgtccgagcaaggtgagaaggcgcccaatgtggtatacaaggggaagctcgatgcccagcgccgcattgctgtcaagcgctttaaccgctctgcctggcccgacccgcgccagttcctggaagaagctagatcagttggcctgctccgaagcaaaaggttggcaaatttgctntggttggttgctgtgaaggcgatgagagattgcttgttgcagaatacatgcccaatgatacgctagcgaagcaccttttccattggngagtcacaatcaatgaaatggaccatg

SEQ ID NO: 11542 - DNA, 664 bp, Zea mays
  Clone ID: LIB3279-188-Q1-K6-C1
ggaccggggtcgatctcactcccaagtcccttttttttctcgatctggaagcgccgcagtagcagccatggacgtgagcggagcaggcgggaaggcgaagaagggcgcggccgggcgcaaggccggcgggccgacgaagaagtcggtgtcgcggtcctccagggccgggctgcagttccccgtcagccgcgtcgggcggtacctcaaaagggccggtacgcgcagcgtgtaggcacgggtgcccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgaggagctcggcaagctgctggccggcgtcaccatcgcccacggcggcgtcctccccaacatccacactgtgctcctccccaagaaggtggccgagaaggcggccaatgagcccaagaaggccgccaagtcccccaagaaggcgtagagtgatctcctgtcttagaacaatattaccattagcggccgtgcagttagactagatcatgtttagtgtagatccgcaatgttcttgtccctgctgccatctggaacggctcatctagtacatccatgcattttccttgctaatt

SEQ ID NO: 11543 - DNA, 606 bp, Zea mays
  unsure (1)..(606): unsure at all n locations; Clone ID: LIB3279-188-Q1-K6-C10
tctgaagccaaaatacttncatgagaaaatccataagaaggcttacagtgatgaggagatcattagaattctcaccacacggagcaaagctcagctacttgcaacattcaatagctacaaggatcagttcactcatgcaatcaacaaggatctgaaagctgaccccaaggatgagtttctttcaacactgcgggcgatcatccggtgcttcacctgccctgacagatacttcgagaaagtcattcgactggctcttggaggcatgggcacagatgaggatgacctcaccagggtcgtaactactcgcgccgaggtcgacctgaagctgataaaggaggcttaccagaagaggaacagtgtgccgctggagcgtgctgtggccaaagatacaactagagattatgaggatattatgcttgccctcacgaggggcggagtgaggaggcgtgcctcaactcgatctcatctgctgctacttgtttgatggggccaaaaatctgcatcgatgtggtatcccatgngccgtgtttttgaataataatattgtaacacgtagcctgcattagcagcgcgtattaaataaaggaacttcctgatatacttgtt

SEQ ID NO: 11544 - DNA, 684 bp, Zea mays
  unsure (1)..(684): unsure at all n locations; Clone ID: LIB3279-188-Q1-K6-C11
tgtgtggctgccgtgtagggaccgtaggctcagcgactgcgaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctcaacaccaagcgcctcgacgacgacaccgaaaacctcgcccatgagcgagttccaagtgatctgaagaagaatctcatgcaagcaaggctcgataagaagctgacacaggcacaacttgctcagatgataaatgagaagccacaggtgattcaggagtatgaatcaggcaaggcaatccccaaccagcagatcattagcaagctcgagagggccctgggaaccaagttgcgtggcaagaaatagctttcctacgagtttgtgtcccggagcatcataatagggggaagacaaggcaagctgtctgcttatttgtctatgtttggtatctcaagtcctgcggactgtttctgttggcacaagaggganataaatgtgtcacgngacctgtatgcttgctccttgtcatatgaccttgctctaaacatttgtgatgaagctgtc

SEQ ID NO: 11545 - DNA, 511 bp, Zea mays
  Clone ID: LIB3279-188-Q1-K6-C12
gttacaccaaacacgcacgcgcccaccccccgaacggagagaactgaccccgcagagaagatggccggcgagatgagctgggtgggcaagaagatccacctctacaacgtcaccatgggcctctacatgctcgattggtgggagcggtgcctattcaacatattggtgctgatcctgctctggttcgtttgcttcaatggctcccgcttcgcttccgacgtcttcgaaagccacctgaaggcgcggattttccaaggctcaaattacggcctggcaattggcacgccctcctcataggccttcagcgcaacacacagaagcagcgaaatctgctggttctggaatgttaactagttcccacaaactttagcgctgtcgtgatgtgtatgatgtggttccaatatgtaagatttttttacagttattctcttctctttattttcttgttttgtgtttgattacacgatatcacaccctgaattctactgtaattgaaaaccattttcttggt

SEQ ID NO: 11546 - DNA, 661 bp, Zea mays
  Clone ID: LIB3279-188-Q1-K6-C2
cccagtccccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtccggcctgctccttatctctgggcctttcaagatcaatggagtaccgatccgccgtgtgaaccagacctatgtcattgctacatcaaccaaagttgacatctctggtgttgatgtcgccaagtttgatgacaagtactttgccagggagaagaagcaaaaggtgaagaagaccgagggcgagctttttgagacagaaaagaggcatccaagtcactgcctgacttcaagaaggatgaccagaaggctgtggattctgctctgatcaaggctatcgaggctgtcccggagctgaaaactatcttggcgcccggttct

SEQ ID NO: 11547 - DNA, 666 bp, Zea mays
  unsure (1)..(666): unsure at all n locations; Clone ID: LIB3279-188-Q1-K6-C3
ggatagcatcgtcatcgcaaaagcaggctctcctgctccccgcgcgggccgcgccgccgacgccggcgatgcttcggcagcgtgcggtttctgcctccgcgtgtgcgtcgcaggtctgccgccccctattcggtgccgccagttgcatctcctgtggggtccacggaagcgttcggcggcacctcacagtggcggtggcggcggccccgccctcgccttcgtcctcaccttcgtcgggaccgctctacccgacgcctccacccaccgagcaggaggtggagagggtcaagctcgagcaggttatgaggagactagagaaaacagcaaggtatttcaagaatttgggtaccctggggttctggtcccaattggtgtgcacaattatttctgctggaattttggcattctctacagttgtaacggggaaggtgacatcaccctttacattctatgcaactgctgctggtattgctgctgcttttatttcagtcttctggtcatttggttacatccgtctctctgaaaggcttagaaaacatccaaagaacctgctaaggctcctccacgtgctgatgttgttaagagccttaaaaaggcatcgtggttaatattcttgggatgggcgctgctgntctcgcatgcaagctactgttgtgctttggtagc

SEQ ID NO: 11548 - DNA, 663 bp, Zea mays
  unsure (1)..(663): unsure at all n locations; Clone ID: LIB3279-188-Q1-K6-C4
ctctattcgttccccgcctcaccccgagccagccgtctcgctagggtttcgccgccgccgccgccgccgccgccgctatgcctcgccgcagctcaggaaggtctgccccacgcccagctccccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgacgcttgcagcatccattctaaggctttctaagattgtctcaacaactatggcagcgagatcagcaagtgccagttctacctagacatgctgaacgagtgccgccgtggtggtgtgtctgcctaagctgcttctggggttattcgtggattttctttcggtgatgctatctcattaataagataccgtgaaacttttgtctccacagcttgaagctaaacttcctgggattaatacattntgttatcctatgctgntggagcagactnttgtctcttgatcaaaatattta

SEQ ID NO: 11549 - DNA, 607 bp, Zea mays
  unsure (1)..(607): unsure at all n locations; Clone ID: LIB3279-188-Q1-K6-C5
aggagcctcgaatccagcctggccaggctcctcccattcctcctctcccacgagctctcaccgctcctcgcggcggcaaaacccccccttgaattccccacgcgcccgcctccaatcccgccagtccggcggcgacccagggatccatggagaggtacgaactgctcaaggacatcggttccggcaacttcggggtggcgcggctgatgcggaacaaggacaccaaggagctcgtcgctatgaagtacatcccgagggggctcaagattgacgagaatgtggcgagggagatcataaaccaccgctcgttgcggcaccccaacatcatccgcttcaaggaggtcgtgctcacgcccacgcacctcgctatcgtcatggagtacgccgccggcggcgagcttttcgacaggatctgcagcgccgggaggttcagcgaggacgaggcgaggtatttcttccagcagcttatctgcggtgtcagctactgccacttcatgcaaatttgtcaccgggacttgaagctggagaacacgctgttggatggcagcccggcgccgcgcctaaagatctgcgactntggctactctaagtcatcgctgctgcactc

SEQ ID NO: 11550 - DNA, 644 bp, Zea mays
  Clone ID: LIB3279-188-Q1-K6-C7
gactgctccccctcccccgcccagcctcaagcatcgccggcgccgcaacatcgctgaggaagcccgcacccctgcccggatccgatggccaacagcaacctcccgcggcggatcatcaaggagactcagcggctgctcagcgagccagcaccggggatcagcgcgtcgccctcggaggagaacatgcgctacttcaacgttatggtccttgggccggcgcagtcgccctatgaaggtggagtttttaagcttgaactctttttacctgaggaatatccaatggctgccccaaaggtaactaccaattttgcttaatgtctaacagtattatgctctgtactttgtaagctaatcttgtttgtatgttaactttgagtaaaacttctcttttccaagatgacttctgctttcttttgcatagttatttgaatcatcaaattgctttgatatgatgtttgatattagtgtaaccacttgtctgtcttttcttctgtttgtacaatacaaacatatcttggctgacttggatttgtagtatgtatttggattaataatgtcttctgttagaagggctagctagtttctgtcccttccactgttttcaagtcatccgattaatcgcgattaatcgtccaagtcgtttt

SEQ ID NO: 11551 - DNA, 531 bp, Zea mays
  Clone ID: LIB3279-188-Q1-K6-C8
gtacaatgatgagaacaccgtctcctttgtgaccctgaacaggttggtggattcctgcagcggatggacctgtgccgcaagtacgcctttgggaagatgctcgtgataggctctgagccacccttcaagctgaagggcctttggctcttccgtggccaggatgttcccaagtttgtaatggatgaggtctatgacatggagctctacgagtggaccaaggtggacatctctgatgaggcccagaaggagcgtgtcaatgcgatgattgaggaccaggagccctttgagggcgaggccttgcttgacgcgaaatgcttcaagtgagtgtgcttgcctggagacagaactgtttagcccttgaatttgtctatggaagagtttgcccttttactagtgtcgatgttgatctggtataccttgctatgaactggttaaagtttgtgctggtttgggattttttgtgcatcttgtgatacctcaagtcttcatcatttaaatgtttagccgtaataatctggttattttttcttc

SEQ ID NO: 11552 - DNA, 657 bp, Zea mays
  unsure (1)..(657): unsure at all n locations; Clone ID: LIB3279-188-Q1-K6-C9
gtcccgtaagaacgaagnagctgtgaaccttatcaaggaataccgtgcgaagatcgaggctgaactgagcaatatctgtgatggcatcctgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaggacattgcgctggctgagctggcacctacccatccgataaggcttgggcttgctcttaacttctcagtgttctattatgagattctgaactccccagacaaagcttgcaaccttgcaaagcaggcgtttgatgaagctatctcccagttagacacccttggggaggagtcatacaaagatagcactctgatcatgcagctccttagggacaacttgaccctttggacctctgacctcacggaggatggtgctgatgagggcaaagaagccccgaaggtgagngctggtgacggacagtaatcttgggagagcgcatattgttcgagcccattgttttagatgctctatgctgtcgaagctgaactgtgccgtgctattattgtagctgatntcctgttcct

SEQ ID NO: 11553 - DNA, 679 bp, Zea mays
  unsure (1)..(679): unsure at all n locations; Clone ID: LIB3279-188-Q1-K6-D11
caggaattcagccacaaggggacgccaccgccttcaccaacgccgacctcggcgccaaggaaggtggacatgagcctggttggcgtgaggttccagtagaggatcctgtggtcaaagatgctgcacaccatgctgtgaaatcgatccaagagaggtccaactccctgtttccctacgaacttctcgagatccttcgtgcccatgcacaggttgtggaagactttgcaaaatttgacattctgatgaaactgaagagaggcagcaaggaggagaagatcaaagctgaggtccataagagcctggaaggggcctttgtgctaaaccagcatcagccggcggagcatgctgagtcgagcagccagtgaactgacgtaactgtgtgagctgtagtagtaacgtacttcgtgttacgtagaagaataaggagaaaacgaccaatccggttttatctggatgtcatgtatggtcgacggtcgttgctggcttggcttccgaacgcagcaggcttactggtgctggaagacggtacctgctgtcgcacttgccgttataataggcattggaacttgtcgatttcgggagctgatctgtttgtaccgtattgtttatttataantatgatggatcgtatgntgatatatggtatcccacactaccctttcgttgcttatgatcatag

SEQ ID NO: 11554 - DNA, 651 bp, Zea mays
  Clone ID: LIB3279-188-Q1-K6-D12
cccagacaagccaatcgaagccgagttacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtaggctgcagatgggacgaatgtgcttgtatgtgtatgtgtcctgctgcaagttgtcctttgctatttagaatggaa

SEQ ID NO: 11555 - DNA, 339 bp, Zea mays
  Clone ID: LIB3279-188-Q1-K6-D2
gcttgccatgctcgacctcgtacaagtgtttgttgaaacattggacatgtgcttcaagaatgtatgcgagcttgacatcgtatttaacttcaacaagctgcacacgattttggatgagatgatatcggggggacaggtgatcgaaacaagttcagaacagataatgaaatctgtggaagagattgaaaggctggagaaacaatcgagcacaaccagcttcatacccaagtcgattacagagcgttttacccgttgagcttccactcgtttccagaacaatgtgacatttaaggtgtgaacagaactgagacatactattcagtctcattttagttctcc

SEQ ID NO: 11556 - DNA, 575 bp, Zea mays
  unsure (1)..(575): unsure at all n locations; Clone ID: LIB3279-188-Q1-K6-D3
tatgaatactagctagaagttagagcctagatgatggttgcttccgttggcgtgcaagctcgagtgctcctaaatggtcgtcgtattagcttatacgacaacgacccggtgcaagagataatattgtttacacgtgcgagtccaaaattgttggctttgggccggagcagttaacacgagaagtgtattttatcacttccgcctcttgcatatgttgtagattctcgccgagaagggagtagtagtattacctgatacctatgctaattcaggtggcgtggtcgttagctacttcgagtgggtacagaacattcaaggtttcatgtgggctgaggagaaagtgaacgatgaactagaaaanacatgagcagtgcttttcaacacatgaaggccatgtgcaaatctttggtgctgccgaagtgtgccatgacattggaattgcgggtctagaaaaacaagctcattagatttctaaaaaaatattgggagttattagattggtagcatttttttaagatttaaagttttatagaagtcatcattttcgtttattggaagaatatttttggaagttg

SEQ ID NO: 11557 - DNA, 676 bp, Zea mays
  Clone ID: LIB3279-188-Q1-K6-D5
cggacgcgtgggcaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggaggagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagctcgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgtggagagcaccatgaatgcctacaaagctgctcaggatattgctcttgctgatctggcttcaacccaccccatcaggctcgggcttgctct

SEQ ID NO: 11558 - DNA, 538 bp, Zea mays
  unsure (1)..(538): unsure at all n locations; Clone ID: LIB3279-188-Q1-K6-D6
gcggctgcaagatccactagactcatccacagcggcacagccgatggatccttccatgctcctccgtccgtccgccttgctacaagcaggcagccaccaataagctagctcttgttgttgttttgcatgtttgattgggtgtcccttcccagtcgagatggaataatgtcaggcgcacgtacagacgtgttattacgatatttctcccctacaaataaaaactcgatctgtggggttaacactgtcccctagtattacaattaaaaaaagatgttatcacgcatgttaagaaaacatctgaatccctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaangggggggcccttttaaaaagaaccaaattttactacccggggctgggaaggaaaaattttttttatggggcccccaaaataaaataaatgggccggtttttaa

SEQ ID NO: 11559 - DNA, 650 bp, Zea mays
  unsure (1)..(650): unsure at all n locations; Clone ID: LIB3279-188-Q1-K6-D8
gcggcgccggcctacaaccgttttcgtgctcacacacccaaaccttagtcgcgatcaggccccaaggactcgagatgaagtcgagggcacggtccaccgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgaggtgaacgacgaggacgaggagggtgacgagtgatgtatgacggatgaaactctgtccaagtgtttgcagtcagggaaaaaatctcgtcgttgtcggcctaaccgggttttctcgaaggactttctagatgcagtagattagtgccgtcttctgagtagtttcttgcaagtgtcgtcccgtccctggagtgaggcagnttagttngtagtttcttcgcttcatcgcact

SEQ ID NO: 11560 - DNA, 468 bp, Zea mays
  Clone ID: LIB3279-188-Q1-K6-D9
ctcttcctctgggtctacgtcacggggatggtcgcgcaccccgaccagggcaccatcgagttccaggccggcttcgtctcggagtcgctatcagcctccatgtttgacgaggtgcgcacctgcggttccagcgctggcgcgcagctgcgcggcgcggctggggtcatcggagagcttgggctgctccccgttgcgcaggcatgaacctcgagtttgagaatccacgctaccggagaaacgcaggagcttcctgtctgctgtcgcctcgagccctagagtgcaggacgttcagctgtggggtgtgttccagtatctggttgttgcttcccggtctcaatggacatggatgctctgtagaaatgtatatcccatatgctgttgctgaacctgcgtaggatgtaggcagggtctcttctctcttgttttcctggatcatcgtatattcatgtcatcatcatgtgtggaacc

SEQ ID NO: 11561 - DNA, 678 bp, Zea mays
  unsure (1)..(678): unsure at all n locations; Clone ID: LIB3279-188-Q1-K6-E1
gccgaaccgacattgttttctccccccttctcgccttctccttctcccccctagtctagaggcgtttgctccccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgccaagggtttctttgaggtcactcatgatgtctctcaccttacatgtgctgattttctccgtgctcctggggtccagacacctgttattgtccgtttctctacagttgtgcatgagcgtggaagccctgagaccttgagggatccacgtggttttgctgtcaagttctacaccagagagggtaactttgacctcgtgggtaacaacatgcctgtgtttttcatacgagatgggatgaaattccctgacatggtccacgctttcaagccgaatccaaagaccaatttgcaggagaactggagaatagtagatttcttctctcaccacccagangcctacacatgttcacct

SEQ ID NO: 11562 - DNA, 643 bp, Zea mays
  unsure (1)..(643): unsure at all n locations; Clone ID: LIB3279-188-Q1-K6-E10
tgcactgcagagtcgggcgtgngagaagacgcgggtgacggcgtacgcgcacaagacgctgcgggagggccactacgaggcggagttcaaggtgccggcgtcgttcgggctggtgggcgcggtgctggtggagaacgagcaccacaaggaggtcttcatcaaggagatcaagctcgtcaccggcggcgacagcagcaccgccgtcaccttcgactgcaactcctgggtgcactccaagttcgacaacccggagaagcgcatcttcttcaccctcaagtcatacctgccgtccgacacgcccaaggggctggaggacctgaggaagaaggacctgcaggcgctgcgcggcgacgggcacggcgagcgcaaggtgttcgagcgcgtctacgactacgacgtgtacaacgacctgggcgacccggacaagaacccggcccaccagcggcccgtgctgggcggcaacaagcagtacccatacccgcgccgctgccgcaccggccgccccaggaccaagaaggaccccgagacggagatgcgcgagggccacagctacgtgccccgcgacgagcagttctcggaggtgaagcagctcacgttcggngccaccacgctgcgctccggcctgcacgcgctgctgccggcg

SEQ ID NO: 11563 - DNA, 584 bp, Zea mays
  Clone ID: LIB3279-188-Q1-K6-E11
ggggcgcgctggtgtggtaacaatacggaccactaactaccaccggatccgacggtgcacacacatgtttcctcacttacagcccgtccttggaccaacgagccgataataacagatgaccgctcaaaagctggcgctaggctgagtgaggttggcaggctggaaagcaccgcggctggctgacggtaaccgaagaccatcctcccttgatcgaggatgactgcgccgacaacggaacacctgttgctaacgtaaactccaacatcctatacagcgttatccagcatctgcagacaagcactgacatgcactcgccgcctgcgtcggcgtctaaagaggcgtctacatacgacgggggggccggctccggcaacagcatcgtcagctgcggtgaggacctcaagaactgggatgcggacttcgtcaaggtcgaccaggccacgcttttcgacctcatcttggctgcaaactatctgaacatcaagggtctgctcgacctgacctgtcagactggtgctgacatgatcaagggcaagacaccagaagagattcgcaagaccttcaatatcaagaatgacttcacc

SEQ ID NO: 11564 - DNA, 639 bp, Zea mays
  unsure (1)..(639): unsure at all n locations; Clone ID: LIB3279-188-Q1-K6-E12
ngacactgctaagggtaaggtctgtgtcactggggcgtctggtttcatcgcctcctggctcgtcaagcggcttcttgagtctgggtaccatgtcctgggaacagtcagagacccagggaatggcaagaaagtagggcacctctggggcctggaaggcgcaaaggaaaggctgcagctcgtgagagctgatctcttggaggaagggagcttcgacgacgctgtgatggcttgcgagggcgtcttccacaccgcatcgcccgtcgtcaccggatctaattccaaggaggagatgcttgattcagcaataaacggcacgatgaacgtgctacgctcgtgcaagaagaacccatcgctcaagagggttgtcctgacatcctcgtcgtcgacagtgaggatcaaggacgaagccgacctgccccctaacgtgctgctggacgaatcgtcgtggagctccatcgagttctgcgaaagtctccagatatggtacgccgtcgcaaagatcctcgccgagaaggcagcctgggagttcgccggagagcacaggatcgacctcgtcaccgttcttccgaccttcgttgtcggacctactctgtctcctgagctcggcccaccgcttctgatgtcctcggcctgttccaa

SEQ ID NO: 11565 - DNA, 662 bp, Zea mays
  unsure (1)..(662): unsure at all n locations; Clone ID: LIB3279-188-Q1-K6-E2
accaaacttttcaatgtctcctgtgagctatttggagtattggaggttagacgttagtgtgtgactttggaattcaagacaaaattctacatcttccattcacctccctctagtcaacctatttgatccttgagcatcatccgatgtcgaggctatatattaacgggccgaggagaaactttagctgcgtatgttggatgggacatcagtgcaaaaacagatgattttgtcggtcgtgaattccattttgcctccctttcccatgctacaactataacacagaaaaagcccaagcctgcctagtagcttttaacgtcgtatgcagctacatttgcagtagagatttgggaaaggaccacatagctttcaaagtatggccccttgtcaatgaatcggaaatgccaaaggaggttgatgccggttcaagccaaagtgccagaaaaggtggtttagtatatctaaaatatacatatcgatatagaaaaatcagtatggtgaacctgatgacgaatgccttgaagcttttgaggcaacttgtgatgaaatgttgggggcttatacgaaggctanaagatgaagctatgactactgcttttggtgtccgagaaagnaaaagttaaacagggtgttcgacgttatcaattttatttatcctgactact

SEQ ID NO: 11566 - DNA, 645 bp, Zea mays
  unsure (1)..(645): unsure at all n locations; Clone ID: LIB3279-188-Q1-K6-E3
agcaactctacaaatttgctttagtataatatccttatatttattgtttggtttttactatgttttttcctggtttttgcagtatgtcatttagaatttcctggagttgttcttcgaacattcatagaccttgtagtcttgatgtgaaattatggcagtaacatgatgtaccgactactgtctgcatttttcaggagcatttgttatctctattctctcatcaccgactaacattgagttgtgttactttgacgagtttgagacttctcagagctcagatactctaaggaggagcaaattcccgttgaagaatttgagagaaggaatttcacctatctactgaagtgaaagaacccaaggtgtttgcacctgggaacttgagagaccctgacattctttcactgaattggcctggttgtccttgaggacaggacagcgagacacccaggttcctgtcgcaagcaggaccacaaaccgccaacggtgaagatgtgcagtcgtctgtgtgatacggagtagtatgggtcttgccatgaagctacctgcaanatctaggatgggngttcggttctcccccagatctcaacgcagaaaccaaaccacagcttttaagagattgccttttttagttgaaaattatgtacc

SEQ ID NO: 11567 - DNA, 694 bp, Zea mays
  Clone ID: LIB3279-188-Q1-K6-E4
gtatttatttccatgcgcctgcgaatgaataatcatcagcaacaacttcaggcttggagaaagaagaaaggcatagcagcgggcagcggcatgggcaccagccccgtcatccctgcgacgatgctcttcgtcgctcttcttgtcgctgtctgcttcggcgccaccgccgccaggtccagccacgcccgccacaccgacgccgacgacgcgattcgtctccccagcagctttggcgctggtggtcgaccgtggaattgctgcgactccgctatcaaggacgcctccctgccggcgtggcgctgcaacgacgtggtggacaagtgctccgccgactgccaggactgcgaggcgtcgccggccggcgacggcttcgtctgcggtgactttatcttaagcctgaccgagcccccggtctgcacaccgaggccgtgggactgctgcgacagcgtggcctgcacaagggactacatccccaactgcatgtgcctggacaaggtggagtcgtgctcgagcaactgcgaacggtgcgagtttctgtatcattcggaccctcctcgcttccaatgccgagacatcttccacggctatcctggtcccaagtgcaggacatggatcagtacgagcaactagctcagctcagctacttgctaaaagtagcgtagcgcagcgcgcgcggctacttgctagtatacgt

SEQ ID NO: 11568 - DNA, 632 bp, Zea mays
  unsure (1)..(632): unsure at all n locations; Clone ID: LIB3279-188-Q1-K6-E5
gnaagganaagcgaacgcggttcgtggcgctgccggatgagataatcgcgtgacttcttcttcgtctctcccgcgcgcgcgcgcgccgggatgaaacgatcgaggcctgcggttgcttgatttggaggagcgtggcaagcaaaagcatgatgtgctggggtgacgatcagagagcccagaagatgtactagactgattgatggtccgcagcagggtcccagacgctctgtcccgtggttggtcgttttcctcggttgcgagcgagccggggaagagcgcctgctgtgctgccggccggcccacgacggtagcggcggcagctccctgtcttgcctccgacgacgacagggactcaagtgtgtcgtcttcttttttttcttcttcttctactgtggtctgtggtctatgtatcttctacatatttaaggctatcttgctcgtcctctctagatgttgtaggttgctgaagaagcttaggatataaatacttctacatgtatatgaaaacacttgcggaggccatgacagtagccaacagcttcgcgtgtcatcgtctgcgtcgtttaattntactctagcattcgtctcaatcacatgcatcaatatggattgaagtgaatactaagtattca

SEQ ID NO: 11569 - DNA, 596 bp, Zea mays
  unsure (1)..(596): unsure at all n locations; Clone ID: LIB3279-188-Q1-K6-E6
catatttgttggttttcacgagggctccgagagaaatcaaactggtgcagaatcatgatcaaagacttgtggtccttgaagtgaatcggctcgttttttctgcctacaccttcagacatggtgcttgatgcctatgcgcactataagctgtctacgaatatgagcagatcacattggctgtaaaagccggcatgtgtctttacatatagcatgtggattattagaggaaaccgaaaccacatcacatccatacagtggcgaaagacacagtagggctaagtattgcggctttggtagttgtcatatctaaacttttgatagtcttatatgttagagtactcgttagggttttgattgtctcctgtgtatttaccctctcgcacttattgtaatgggcctggcccaactatcgagtgtatcaatacaacgccgcccaaccccactcaagggttagggtttcccaaannaaaaaaaannanaaaaaaaaaaaaaaaaaaaaaaaaananaananaaaaaaaaaaaaaaaaaaaannnnnnnnnnnnnnaaaaaaaaaaaaaaaaaaaaaaaaaaaaaaaaaagggggggccgttttaa

SEQ ID NO: 11570 - DNA, 691 bp, Zea mays
  Clone ID: LIB3279-188-Q1-K6-E7
cggacgcgtgggcggacgcgtgggttaccatctctacctgtgccttagcaatgttgttacttcagaaagtgggaaattcctcttatcagctaaacgacaccgcaaaaccacatgcaccgagtacactatatcaatggattctggcaacatctcaagaatcaaaaagaacctacattggaaaaataaggtctaacttccttggcacaagatttttaatttatgatacacaaccgccctataatggggctgtagttcctcctgccggaaggacaagcaggaggttcaactccacaaaagtctctccaaagctgccttcagtcagttacaacatcgcacaggtatcgtatgagttaaatgtccttggcacgagaggtcctaggcggatgcgttgcatcatgcactccatacctgcatcatcagtggagccaggtggcacagtgcctggacagccagagcagattgtacctcgagccctggaggattcattccgcagcacggcttccttctcgcagtcgttccgtagcactgcctcattctccaagtccatcatggactcatccatggatttcaatagcgctcgcttctctgacatcgctggcagcagcgctcgcttcacgggcgttcctggtagcagcgctcgcttcgcgggcgttcctggcagcagcgctcgcttctcgggcattgctggcgc

SEQ ID NO: 11571 - DNA, 612 bp, Zea mays
  unsure (1)..(612): unsure at all n locations; Clone ID: LIB3279-188-Q1-K6-E8
tcctgccgcgcgggggcgggctcatatttggagtagggatggcgttcgtgatatggtccgccagggtctgcaccaggctgctagcagagcttgcatccagtggagacgagcacagggggctcatcgcttatgcgtgctggctcgtctacatgctcttctcgttgcttgtcatcttctgataccatttatggtctggaagattatgtgcctaatttgtttaggggatgctgtggacagtggactgccttttaccagtcacggagtgtttttgttgtgttgtcacagaactacatacgatctggccagttgatctcttagttccattgggcatggttggtgttcggtaaaaagaaaaggaaatcaaggtccagaaacagcaaatgtgcagtaattaggttttaccgaagtattggtggaaatctaattactttctaaaggtcgtggtatgtgcaaatctgtttattatgattacttaccacgactttattttaggatcaccgtggtagtttcttttcttttaatgcattttggcagagataattgttctatctttaggtatcatgttagatacttaatcatcataaatcaaagggacgttagttntctttttat

SEQ ID NO: 11572 - DNA, 556 bp, Zea mays
  Clone ID: LIB3279-188-Q1-K6-E9
actaaagcgagactacttatcatcaaactttgaaacgacaactgagtcgcttaatgcaagcacacaagattgcgctactcataattctgctgaaggttctggatctggcactgcacttgcatgggttcctgacactactgctgctgctaccttgagattgttagacttggatgcttacatgtcatacacccttcattcaaagctgggttcaaataaggagcaagaatctggacattacatgaaacttccaacgaaatatccttctatgaataagggcatacatgaaatagaacagtacatgcctattggttttgatcaacaggatggaacgcagctacctaacagcattggtaacagaggtcggcgaaggggacgtagaagaggcagcagaggaggcagatctcgaggtcgaggtggtagggttcccagaggtattggcagatctttcaggattcatttcagggatgacaatagtatgctctatgggagagccccacgaaagactgcacgtaatgatcgcggtcgtggacgtggacgtggacgtggacttcgaact

SEQ ID NO: 11573 - DNA, 656 bp, Zea mays
  Clone ID: LIB3279-188-Q1-K6-F1
cgccttccacctctcgcactacagctcaagcacagcgcggcaccctacgtccccgcgactccccccttcttccactccactactcgccgcgctccccatgccctccccgtgacgccgaaaccaaatccttttcgctcttccatattactgtcgcggcggcggaggaggtccgcggcattgcgagatatggagaaggagaggaagcaggggttcttcgccgcgctcaaggaggaggtcgtacgggggctgtcgccggcaaggaccagagggaagtccccggcgccgcggagcgcgtcgcccgcgaggatgctgatcccgcgccggcggaaggcgcccgcggctccgccgccgccgccgccgccgccggagaaggtgctgcagcagtacctgggggagcagctcgtcgcgcgctccggcagcctgttgcgccccggcggggaggctctggcgccgctcatcgaagggcccgacgccgagcgcctcgccgccggcgaccccgacggcgaggactcagggcgccgcgaggggttcgggcactgggtccgcggccacctgacgcgcgcgccatccatggccgccgcaggtggtcccgacggctcgttccggcggtccgacctccgcctgctcctcggcgtcatgggcgcgccgctcgcgcc

SEQ ID NO: 11574 - DNA, 629 bp, Zea mays
  unsure (1)..(629): unsure at all n locations; Clone ID: LIB3279-188-Q1-K6-F10
attggattcaatgttgaaactgttgagtacaagaacattagcttcaccgtttgggatgttggtggccaggacaagatcaggcccctgtggaggcactactttcagaacacgcagggacttatttttgttgtagacagcaatgatagggaacgtgttgttgaggctagagatgagctccacaggatgctgaatgaggatgagctgcgtgatgccgtgctgcttgtatttgcaaacaaacaagatcttcccaatgctatgaatgctgctgaaattactgacaagcttggtctgcattctcttcgccagcggcactggtacatccagagcacttgtgctacatctggtgaagggttgtatgaggggcttgattggctttccaacaacatcgccaacaagtcttgaagcttttcagcagggctcctagcaagaggaagacgtctgaacaacttatggatgcttttttacattttattacaaagatactccctctgtctcgatttactattccttttgggatagtggttgattcatataatatttgatgtatgtgtttaatagatgtgtctagattcaccatcatctattttaatatggacatagatataaagagctaaaacaatactatnttg

SEQ ID NO: 11575 - DNA, 632 bp, Zea mays
  unsure (1)..(632): unsure at all n locations; Clone ID: LIB3279-188-Q1-K6-F2
cccggnngtcnaccccacgcccgtccggctagtttgacagtatgcagcctatattgaggctcagcgtcctagaaaagtccaagaaagtcaaaaaacgcagcagcaatgctttacgaaactccagtgaaacgacgagactacttatcgttgtctcccataccagttgattccgggaagatcataggaaggcaattagaaaggaagaacaaagcagtataggtagcccaactacaaggcaagaagaaaggaaacgctgcgatgataggggagcgcatgtaccaaatcattgtcctgaggcatcgtctgtttggctccgtcaatatggggatgctgctcgattgctccgcatggattttttttttcctttgtccgcattgaaaatggtcgtatttggatttctgttgtctcagttgaccgtgctagagtacctgatgcgtattacgaaatgaggcattggtagtggcaactcgaggagaatacttagacacatctactggcgtattaatggcgttcagtgtaaatagataacttagtatgttttgggcactgttaaccatacaggttcatgtaaatatatagtggctaaatggttctagagtactgaactgagcatacctttgtatagtactgaa

SEQ ID NO: 11576 - DNA, 673 bp, Zea mays
  Clone ID: LIB3279-188-Q1-K6-F3
ccccgcgtccgcggacgcgtgggcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtggttgttggtgcccatctgtgtttttgattgaagtcgctct

SEQ ID NO: 11577 - DNA, 699 bp, Zea mays
  Clone ID: LIB3279-188-Q1-K6-F4
cattcagcaagcacaatctggtaccaggaaaaacagcaaccttctgttctgggatcttgcagcagcttgactatggtctggttgaatgccaggccctggttcttgctcccacccgtgagcttgcacagcaaattgagaaagttatgcgcgcacttggtgactaccttggtgttaaagtccatgcatgcgttggaggaacatctgttcgtgaggaccaaaggattctcgccagtggtgtgcatgttgttgttggtacacctggtcgtgtgtttgacatgctgcgtagacagtccctccgccctgataacatcaagatgtttgttcttgacgaagctgatgaaatgctttctcgtggtttcaaggatcagatttatgacatcttccagcttctgccatccaagattcaggttggagtcttctctgctaccatgccacctgaggcccttgagattacccgcaagttcatgaacaaaccagtgagaattcttgtgaagagagatgagctgacccttgagggtatcaagcagttctatgtgaatgtggacaaggaagactggaagctggacacactgtgtgacctgtatgagaccctggccattacccagagtgtcatctttgtcaacacccgccgcaaggtggactggctcactgacaagatgaggagcagggaccacaccgtttctgccactcatggtgaca

SEQ ID NO: 11578 - DNA, 667 bp, Zea mays
  unsure (1)..(667): unsure at all n locations; Clone ID: LIB3279-188-Q1-K6-F5
gcgtgaggcgtgagtccgtgaccattcccgtcggccgtcccaaaagaagcgcaaatttacaacccagtccaccacgggccacacaatcccaaatctaaccctccgacggcgatggggatctcgagcatgccggagccgcgggacagcctgctggggtacctggtgtacaacacggtgatctcgatcgcggcgctggcggggctggtgcgggcggcgctggtgttcctggacctgcaggccgcgctgccgcccggggacgacggcggggaccgactggcggcgtcgggcccgggactggcggagcggttcctcagggccttccggccggcgctgtacgaggtgctggcgtcgacggcgacgacgtgcgaggcggacggcggcgccgacggcgacgactgcagcgtgtgcctggccgggttccgggcgagggccgtggtgaaccgcctcccctgcggccacctcttccaccgcgcctgcctcgagacctggctccggtacgagcgcgccacgtgcccgctctgccgcgcccacgtgcccctccccgccgacgagacgccgctgctccgctacccggagttcgagtgacggnnaaaaaaccaaccccggccccncacccccggcgagcggtgaccgnccccgtcgcgcgcgcctcggctgtgtgctgcaa

SEQ ID NO: 11579 - DNA, 631 bp, Zea mays
  unsure (1)..(631): unsure at all n locations; Clone ID: LIB3279-188-Q1-K6-F6
gtcaactccaggagacaagatagtgagaactgaagagaaggatgggcttcgagaagcagatcctgagatccggcaccggccccaagccgataaagggccagaaggtcaccgttcactgcaccggctacgggaaggatcgtgatctgtccaagaaattttggagcaccaaggaccctgggcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaaccaaactcagtgcttgtgttcgagattgaagtcctcagtgcccagtaattcgcatctgtcagctatggaaacgttggccatgcttctcaagtaatgaaataattccgttgtcacctcatgctacatacagcagattggtgttacgagttaaatcctgtgaaactttagcattctgtaaccgtggatgtcgagtttatggagttccttgtgtggcgcctcaagtcaagttctcgtcaaagattgtaatctgatggcttccattgtgacttgtangcggctgcaataaacttacttgatgc

SEQ ID NO: 11580 - DNA, 656 bp, Zea mays
  Clone ID: LIB3279-188-Q1-K6-F7
cggacgcgtggggatttatacaggtcaatacgtgattcacaacttattggcctgtcaggatacacaaaggagggtctcccaatttttggcattggtgttggacatagcacatatgacaaagcttcggtccactactatgtgcaatctcatatccagattaacgagtaccgtgatcgtataattttgcctaggctgacacaacagtttgggcggcctgttaccagctgtataaaagtgctggatatgactggtttgaagctatcagcactaagccaaataaagatgttgacttccatatcgacagttgatgatctaaattaccctgaaaagacagagacctattatgtagtcaacgttccatacatattttctgcttgttggaaggttgtgaagcccttattgcaggagaggacaaaaaagaaggtcaaagttttgactggctgcgggagagatgaacttctgaagatcatggactactcatcactcccccatttctgccgccgggagggctctggatcatcgaagcattcgtctaccgacgtcgacaactgcttctcccttgaccatccattccacaaagaactgtacggtcacatcagagagcaagcgtcgcgcagggagctcataagaatgggatcgttgcatgtcagcatccc

SEQ ID NO: 11581 - DNA, 390 bp, Zea mays
  Clone ID: LIB3279-188-Q1-K6-F8
catgttgatattgatgtgagtgacaggacaatacaaaagaagtacgggaagcccaggtagctcaattcaactacattcttgtcgtaggcgcacaggaggccgagactggaaatgtctgcgttagggtaagagataatgccgacctggccacaatgagcgttgatggcctcatcacacgtttgagggaggaaatcgtagccttcaaatgattttgatgctgcataatttcctagcacttcgcaatcattgactgttcatttgtgattttgattgagttttcagggaacagtactgagttcctccaaggctccaagtgtattcttgttggtacggttggaagctactaagggcatatttagaagcacctagtttttaataaactggtttatt

SEQ ID NO: 11582 - DNA, 416 bp, Zea mays
  Clone ID: LIB3279-188-Q1-K6-F9
ctgtaccgtaccgtcttcatctaccatcggctccgcgcgcgtgcccctccaacgcaagatccggctcgcaacagcgccagacctgcgtctcgcgggctcattcatggtcaaggactcagactccaggctctgatagatgagagctgccttgtacgctgcggtacggccactacctacgcatgatggtcagcagaggcgtccggtgccctgcggttctggttggtctgctgtctttacaaacacacataaaacacactaggcttaagcaagctgtgaaggactcccttgcgcacggtggacttgcaggaaagcctaaacgtatggcccggacacatgacaagaatatgaccgtagcgcaacacgggtaacactgataaagaaaaagattggatgactaacgaccataatgtccacac

SEQ ID NO: 11583 - DNA, 448 bp, Zea mays
  Clone ID: LIB3279-188-Q1-K6-G1
gtgtagagatggataagttctacccccttgctggagggaatggtaagtagctcaactcacaagtttccttctggacacagattcgcaattacgggggtttctatgatgatggatgatgggagattatcggatatcatgtcttgcacaacggcatggcaaaaaaaaaacgacgaagaagattttgtggaaggccatggtcgaatgtcatgtcttgctggtacactctagatgagcatgaaccttaagttttcgttttttttaacttgttgagcagctgactcttgtgtatgaactgagctgcagcgggcttccctgagttgacttgtttgggtctgagatgcttctgccatgttctaggtctagaatagaactagatgcggtggtgtgttctctaccctaagtccccttttgtgccctttccttctgtaatataagatctttgactgtt

SEQ ID NO: 11584 - DNA, 597 bp, Zea mays
  Clone ID: LIB3279-188-Q1-K6-G10
gctactcccagcgtgtcggcaccggcgcccccgtctacctcgctgccgtcctcgagtacctcgccgccgagctcctcgagttggcggggaacgcagcgcgggacaacaagaagaaccggatcatcccgcgacacgtactgctggcgatccgcaacgatgaggagctcgggaagctactggccggcgtcaccatcgcacacggcggggttctgcccaacatcaaccctgtgctgctccccaagaaaaccgctgtcgctgctgccaaggaaggcaaagagaagaagtcacccaagaaggccgccgccgccaagtcgcccaaaaaggtggccgcctcgtaggtccctggcaatgctgatgcactgtctctctctgtcctctctgaactgaaacgctcctaactgtcgttgtcggtcatggtcgttgttgtttgatgcgcttttattgtggttgttcgtgtgtaattgcttgcctttcgcccatttggcatgcactgtgtagggtcacactggtctaggttttcaatctgggaaacaccggtttagattcaaggagcgtgaactgtgaaggcaggtgagagggtgggatctgtgaatcact

SEQ ID NO: 11585 - DNA, 653 bp, Zea mays
  unsure (1)..(653): unsure at all n locations; Clone ID: LIB3279-188-Q1-K6-G11
gagagaagaaaaattccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactcncctgcgtccgttcttttggatctgaataagatgtggtgatct

SEQ ID NO: 11586 - DNA, 652 bp, Zea mays
  Clone ID: LIB3279-188-Q1-K6-G12
cccacgcgtccggatggaacgtctaggtgccaattttaatcgtgaccagaatggcatgcatgctcagctacttgcattatccaagcttgtggaacttcttgatccttcattgcacaactattttaggcaaaatgactgcttgaactatttcttctgtttccgctgggttcttatacaattcaaaagggagttcagtttcgaccagatcatgcttttatgggaagttctgtggtcccattatttgtcagaacatttccacttgtacttgtgcgtagcaatcttgaaaaagtatcgtcagcggataattggggagcagatggacttcgataccctccttaagttcatcaatgagctcagtggtcagatcaatcttgaccgggctatccaggacgcggaggcattgtgtactattgcaggagaaaatggggcttcctgcattccacctggaaccccaccttcaatgcccgtcgagaccgatggtggcatgtacgtgcaagaagacgaggtcttgtgagatatcggtcaccctagaaaaaattgcatagaagcatcgcaagtttttatccagtagtgctttcgtcgacgtcataaatgtgatccgttgtaagtttggaagatcatgaaacctagagtgtgtgtatatactaccttg

SEQ ID NO: 11587 - DNA, 544 bp, Zea mays
  Clone ID: LIB3279-188-Q1-K6-G2
cactagaccggcaatatgtccgccagcatccttacattctgtttgtgctactacttaccatagttgcatctcaggaacttgtaccaggatgattgactggagttccctgcatactatagcattaagtggcacagccctgagctattgagctaggcccatacctgcaccactactagtaaaatctacttctcgagcacttgactgagtatcctgaagcatgacatggctgctcttaggactatgattgcaaccattttctgagagcataatatgagtaaccagctgattgatctgtcggacctctgaaggggatgaattataccacgtctctatcactgacacagagggctaatgaaacaaactataattcatcgattataggaactacgcactgaccatatgatgcatgtctcgatatacatgtatctatccataatggagtcagtgatcatgttgctgcaccatctaaaagaccatgcagtgtgaatgtcaggtgaactacgctatctaagaataaagatgttgaggaacaactagcatgttg

SEQ ID NO: 11588 - DNA, 545 bp, Zea mays
  Clone ID: LIB3279-188-Q1-K6-G3
gcattacaaaaactgttgtgcagagcatgatgccacctagctactgggcgcaacaagaaacccttgtttgataagaagactggatcaaatttggggaacccccacatcattccggctctcattgcctgctagctagctagctagctgttgatcaactcgtgatcaaagaaaagatatttacaatgatgcagtgaaagcgacagatgtacttcactatcaatttgcgtgtgtggtgcctttttttttctctccttaatctactaaccgtaaaagtttgctaacagtgccacggcttctatatgccctgatggccaactttatataactaacggtaccattagttgagtcgtcaaagaaatctacagggtagctagtgttgattgttaacgatcattataaatgtgtgtcaattcaacgagaccacatacatatatagatgataaattaaggcaattgtggccatactttttggggtaaggtagggcacggatatgtctatatagatcttttctttttgttcaagcaaagaaagttgaaagctccaa

SEQ ID NO: 11589 - DNA, 693 bp, Zea mays
  unsure (1)..(693): unsure at all n locations; Clone ID: LIB3279-188-Q1-K6-G4
cggacgcgtgggcagcggaccaagctgggatggaaatcttcaaaactagataaaacaaacatcatcccacaaagtagtgattgccttggtgctgagaatctaattagattgctcaagaattattccagaagccacgagctcaaactggcaattacggtgggtattgttggactccctaatgttggcaagagcagtctgatcaacagcctgaagaggtcccgagtggttaatgtcggttccactccaggggttactagatcaatgcaagaagttcaattagacaagaaggtaaagttgttggattgtcctggtgttgttatgctcaaatcttccaacagcggtgtgtctgtagctcttcgaaactgcaaaagagttgagaaaatggaagatccagtcactcctgttaaggagatccttggtatttgcccacatgagaagttgctgtctatgtataaggttccaagcttcagttcagttgatgatttccttcagaaagtatcaactgtacgggggaaattgaaaaaggtggtgtggtggatgttgaagctgctgcgagaattgtgcttcatgactggaatgaaggtaaaataccatattntacactgccacctaaaagagatgctgtggaggactcagatgtagtgattatatcagaagatgggaaagaattaatattgatgaaattacaagctg

SEQ ID NO: 11590 - DNA, 556 bp, Zea mays
  Clone ID: LIB3279-188-Q1-K6-G5
gccttgggacagctgaaaagagctgaagctcaaaaaggcaataaagaggaaaattgaacaagcagcaacatctgattttcaggcgcgtagcttgccggccaaacttcgtatcgaaccaagtgaccctgaggatgttaaagctgcaaagcgtaagaaaatacatgctttcaaatcaaaatcccgctttgagcagcttgaatttgcccaaaacaaaaggcagaatgcatggcagcagtttcaaaccaaggggaaagccaaaaaggtggggttcttctccggtcgcaagaaggagagcatcttcaagtcaccggacgaccacagaggtaaggtgggtgtcactgggagtggcaagggcctgaccgacttccagaggagggagaagcatctgcaccttaaaggtgggtccggggatgcagcggatgatgacgaggagtaaactgaagaaccgagcctctgtttgtatcccgccgaacagacatttccatacctgttctttagcgccgacatggcctcgaggggactcttgacttaaaccagaaaatttcaatgtttgtcc

SEQ ID NO: 11591 - DNA, 690 bp, Zea mays
  unsure (1)..(690): unsure at all n locations; Clone ID: LIB3279-188-Q1-K6-G6
cccacgcgtccgcggacgcgtgggcctgtacacgcctccgccaccctaccaactactcaataaccctagctaaaccccacgccgccgcggcgacctcctccgccggcaggatggacagcctcaggggagccaagttgccgggcgtgccgaagggcgggagtgcgctcgtgaaggtggcgctgctcggcggcgcggggctctacgccgtcctcaacagcttctacaacgtcgagggcggacaccgcgccatcgtcttcaaccgcctcgaggggatcaaggacaaggtgtaccccgaaggaactcacctgatgatcccgtggatcgaaaggccgatcatctacgacgtccgcgcccgacccaacctcgtcgagagcacctccggaagccgcgacctccagatggtgagaattggtcttcgtgtccttactcgacccatgccagatcagctacctaaaatctacaggaacttgggggagaacttcaatgagagagttctgccttcaatcattcatgaaacactcaaagctgtggttgctcaatacaatgccagccagctgatcacccagagagaggctgtgagcagggagattaggaagattctgactgagagggccaacaacttcaatattgctctggatgatgtgtccatcacaagcctcagctntgggaaagnagttactcatgccattg

SEQ ID NO: 11592 - DNA, 669 bp, Zea mays
  unsure (1)..(669): unsure at all n locations; Clone ID: LIB3279-188-Q1-K6-G7
ccccgcgtccgctccgccgccgctccgcctcagcgcgtcgcccgccgccacatcctacagcgacctcatcgatcaccttcaactttcaatcatggcggacgtcgatgtcgaaccggaggttgccgccggcgctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcactcatcaagaagctgcgcaaggcgaaaaaggatgctcctgctggtgagaagccagagccagtcaagacacatctccgtaacatgatcattgtccctgagatgattggaagcattgttggggtctacaacggcaagacgttcaaccaggttgagatcaagcctgagatgatcggccactaccttgctgagttctccatctcctataagccggtcaagcatggcaggcccggtatcggtgccacccactcctcgcggtttattcctctgaaatgagctgttacccgtctctgtagtctcccaaaagtccgttggcaatgtccattcagctnttctacttgttttgaacaagttaaatgcccaagacattntgttttgttccattccagctc

SEQ ID NO: 11593 - DNA, 667 bp, Zea mays
  unsure (1)..(667): unsure at all n locations; Clone ID: LIB3279-188-Q1-K6-G8
cggacgcgtgggcggacgcgtgggcggacgcgtgggccgtcctgtccttccacccggcggcttaaaccctagttctcactcccatcgccgcttcagctccgccgctgcagatggagttctggggtctcgaggtcaagcctggttccactgttaagtgtgagcctggatatggctttgtgctgcacctttcccaggctgctcttggggaatcgaagaagagtgataatgccttgatgtatgtcaaaattgatgatcagaaacttgccattggaaccctctctgttgacaagaacccacacatacaatttgatctgattttcgataaagagtttgagctgtcgcacacatcaaaaactaccagcgttttcttcactggctacaaggttgagcagccattcgaggaagatgaaatggatcttgattctgaagatgaagacgaggagctgaatgttccagtagtcaaggaaaatggcaaagctgatgagaagaaacagaaaagtcaagaaaaggcagttgctgcaccttcaaaatcaagtccggattccaagaagagcaaggatgacgacgattctgatgaggacgagactgatgattctgatgaggatgagacggacgattctgatgagggntttgtctcctgaagaagcgatgatgattcaagtgatga

SEQ ID NO: 11594 - DNA, 619 bp, Zea mays
  Clone ID: LIB3279-188-Q1-K6-G9
accgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctctaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagtcgagttgcaaacaatgaacgtgcagcagcccgctgatgttgccggacccagcgagggggtggcggcgatctccaaaggggggaaggtagggccgaaccggtgcagcgcctgcaggaagagggttgggctcacgggattcaactgccggtgtgggaacttgtactgcgcgctccaccgctactccgacagcacgactgcaagttcgactaccggactgctgccagggacgccattgccaaggctaatccgggtggtgaaggcagacaagctcga

SEQ ID NO: 11595 - DNA, 638 bp, Zea mays
  unsure (1)..(638): unsure at all n locations; Clone ID: LIB3279-188-Q1-K6-H1
tatttagttaacctaggcccgtgcacaagacagtgcagcctgttcggctgaacagggcccccatttctttggggccccaactttccatgtatgacctattagtaatgctaattagactattaggaactagaaagtaaatcctgctgggtgcggcctgctagacggatacaatgtgtctttttttaatcgtttctcataccgttcgacgtgaccttgtttcgcctgctgccaagcgcccagtgtgctgctgcctgatgggcgacgatcacggacatttgtttcgcctgccaccagcgcacaacgtgattctgtcgtctacactacactcgttcgtcgtctagcggtaggcagccaacgcggcaacaacgatccccctccgtcgcttgctttgtgtcttgatatttaggaaacaaagggcatgtttgattcgtggctaactgtgttacactttgcctaaagttagtcgttcgaattgaagaactaaccttagccagaaaagttaggcaaagtgtggcaagttaggtagcgaaccaaacaagcccaaaaagttcaaatcataaggtacctctaacatcctattgtatacatgtatatttatttgctaactntgttaatgaaataatttattgattattcta

SEQ ID NO: 11596 - DNA, 672 bp, Zea mays
  unsure (1)..(672): unsure at all n locations; Clone ID: LIB3279-188-Q1-K6-H10
gggattttcaatgtgcgctggggactttgtagaggtctacagcgaggaaagccaagaatctgcatgggatgctgttgtaacttgctttttcctggatacggcacacaatatcgttgaatacatcgagatcatatcaaaagttctcaaggatggtggggtctggattaatttgggtccccttctgtatcactttgctgattcatatgggccagatgatgatatgtctattgaattaagtttggaagatgtgaaaaaggttgcttaccattatggatttacaatggaggtggagaaaatgatcgagactacttacactgcaaacatgaaagcaatgatgcagaatcggtaccgtgcagcattctggacaatgaggaaagatgcatctcggtcaaaagcttgtaagcctcgttgaagtgaagatcatccatggcggacgatcaatttgtgccatcattattcactgttgtattcaaactccacacaggccgtgccagactaagttagatagatatatcagatgagctgcctgattcacagaatataattggcttaacataggaaaggaggtgctgagccacgctagctagctcatccttttctcctatattacagatattcaaactgtactatggactctgtnagaaatgagcatanactaagcagacagaagtt

SEQ ID NO: 11597 - DNA, 677 bp, Zea mays
  unsure (1)..(677): unsure at all n locations; Clone ID: LIB3279-188-Q1-K6-H11
cggtcgcgtgggcggacgcgtgggttcacccagttccttatcgacgacgaggatgattatccggatgccttggaaccatcagctttctgcaagtttggtagcatgaaggcaagttctaggaatccactgtccaagctagatgagtgtgacgaggaagacggagacgggaccgaggaggacgacgacgacgatgacatcctgaccggtgcattgcctcagaggatctcgtctatctccaagctgtcgtcatccatgaagggtctcggcttcattgggaaacccaagccctaccgtacgtgccttcggaagggtaaagcgacaggcagaactaactacaccggcaaagccagcgagcatcagtccgggagcaggagcgccaacgagctgctcccgcccagcgccagtttcgtgaagctgtcggacatgagccctaaacagtggagcgcattcctcgacaagttccaggagctgctcccaggtgccctgagcgcccggaagcacgctgccggtgtcgtcggccagcgctcgatgccgaggctgggcacgtcttgccagttttgagagtagcagaagagaagccaccgaacccaaggtatgacgaacgcgcttctgttcgagctctggtgtgcagcagccaagcaggtacggagtattatatatgcttgtagtangtgtct

SEQ ID NO: 11598 - DNA, 592 bp, Zea mays
  unsure (1)..(592): unsure at all n locations; Clone ID: LIB3279-188-Q1-K6-H3
gaggttgtcatatcagttgacatcttcatcacaaattttttagagctagatcatatactcatatgacaagcagcaagcattcaggagaacacagttaattcactcttgtaccaacacaaacagtccgcatgacttgagataccaaacatagcaaataataagcagacagtttgccttgtcttccctatgctgctcctggttatttcttgccacgcagcttcgttcccagggccctctcgagcttgccaatgatctgctggttgggaattgccttacctgactcatactcctggatcacctgtggcttctcattgatcatctgagcaagctgtgcctgggtcaacttcttatctagccttgcttgcatgagatttttcttcaggtcacttggaactcgctcatgggcgaggttctctgtgtcgtcgtcgaggcgcttggtgttgagggatgtgccgctggacgccgccttgttcataccagcgttgtacttcttcatggtctcgatctccgcgccggagcggcgcgcggcgttgacggccttctcatccttcttggcagcgngcggtgggtgccttcttccgcacaaccaccg

SEQ ID NO: 11599 - DNA, 559 bp, Zea mays
  Clone ID: LIB3279-188-Q1-K6-H4
cccacgcgtccgcttcaacagctcagaataaagagtggtcttatagatcatattggaatcgaacctttgatgatggaagctcttgagaagattgagaaggatattaagaaaccacttttaaggagtgacaagaagaacatggccacccttatggcagagtttgacaagattaacacaaagcttggcattcggaaggaggatcttcctaagatcgagaaagaacttgaattggagattgccaaaagtgagctgactgaacttaagaaggaatgtgttgaggcaatggagactcaactcaagagggaggagttccaagatgaggagatgcctgatgtcaggaaactggacatccgaaacttcctgtaggcctgatcgacgataacctttgaggcattgcaaatcacccagcccacctgtgattttttttcttttggttttggtttcaagttgatcggtgctgtaagctacacctatgaatgctgctccttcctttttttgtaataaaaaaaactgcaccgaggtacacaaacacagtcaaccgttgagttgagttgaattt

SEQ ID NO: 11600 - DNA, 654 bp, Zea mays
  Clone ID: LIB3279-188-Q1-K6-H5
gctgtggcggcaagcaaccacgggcggagctcggagcgtcctcctcctcccgtctataaattcccctccttttcttcctccatatataggggccatcatatccaagaagagggaagagcaccaaggaccttcggcgcccgctcaggatccacatcttcccgagcgagttcttggttgacctcttgctcttccgaccaccttcaaggctcttggcgtagcttgccactctcaccaatcaagttttcatgtctgatctcagacattcagatcccaactgccttccatcccttcgctgaggccaatgctggggactctggtgcggaatcagggtcaaaggactacgtacacgtgcgcatccaccagcgtaatggtcgcaagagcctgaccaccgtccagggattgaagaaggagttcagctacagcaagatcctcaaagatctcaagaaagagttctgctgcaatggtacagtggtccaggacccagaacttggacaggtcattcaactccagggtgatcagaggaagaacgtctcgaatttcctcgtccatgccggcattgtgaacaagtacacacaagattcatcgtttctgagcagcgccggatccatagcagaccactctgcatgcaaggccagcttatttatataatatctg

SEQ ID NO: 11601 - DNA, 497 bp, Zea mays
  unsure (1)..(497): unsure at all n locations; Clone ID: LIB3279-188-Q1-K6-H6
gtttagccgggccccggcgggagcgcgacggcggcggcggggaaggagcgccggcccgacccgtcatcctgctcccagtcccagacgccgaggaggagggtcgcccgccgcgccacccgcagcgtggacctcggcagaaggagcggcggcgacgacgacgagaaggagctgctgcggctgaacctgcagagaatgcagagccgggtggtggagctggagcgggcgtgcaaggagatgaagggccagatgtccaggatggccaagggcaagtccttgtccttgtccttcggctccggcgccgcctcctgccaccagaccggcggcaggggcttgcctaggctctgctgacgtgaggcatgtgcctgtaactttttgatcctttttagtttttcctccccctctctctctctctttttcatggcttgcgattttcctcttgatccctttgtaaagctaattacttggttggtggagtggagcattgcttggtcgtcnna

SEQ ID NO: 11602 - DNA, 618 bp, Zea mays
  unsure (1)..(618): unsure at all n locations; Clone ID: LIB3279-188-Q1-K6-H7
ggaggatcacaagtgccttggnaaaaccacaagtatgaaattgctgactcggaccttggtgccggaatatacatagacttctacattctgaagaactcaatgcaagaaagaaatgccatggatgattcgggttcactcgaggagatgagtgaatcatgcaaaagtttctttggccgattaaacgagtcgttgttagtctggggaagcaaattacctgttgagtcaagggcatgctactcgaagatggcagaggagctatgcgcgcttctggtggacaccccaagcgagatgctgaacctacccatggggtgtcttctaacgatgctcaatgctccggttccggacgagagcaggtcgtcgtacctgcaggacgcactctccatcttcaccgaaatcctttgcagcgatccgtagcacaagggtccacggtgttgccgtaatctgggtgaagggaagtgaagcctacaggcaacacgccgaagagtttgtacgtctcatgtttggtacttgtagaaaaaataggaatgtataactatgacctgatgttgctccggtgaatttgtaactccgtctgaagacatgtgtcaggattttcgttgtttgtgagtacccagtctt

SEQ ID NO: 11603 - DNA, 684 bp, Zea mays
  unsure (1)..(684): unsure at all n locations; Clone ID: LIB3279-188-Q1-K6-H8
tgattatgttgcaaatgatacggttcaatccctgcataagcaagatagtaagatagtgatanaaaaagaccataaaattgttggacggtccaccttatccaaaaaggccaaagcttgagccagcacaaactggtagagatgctgaggctaagggacatgaattcatatcacagaagaatgtgcctgatttaacaccatgcacaacatctggagaactgcgtgtcattatattaagaagaaaaagactaaggtcctagatgaccagtacaaacatcaaagggcctccttacggcggctaccaacaagcataaacgaaaccatccatgactaaaaaataataataacggccaatcatcaaaaggaacctgtcaccccttttcagaaggactaaggccacattcttcgcagtcatgcagccccagccagacaccatatcctagcatcattcttgatgtcctgagtaatagtattgatgctcggagtattgattcatagtttcgtacaattacaaggcaaatgcccaaagctggaatggaagctaagtttgtgcaggacatattctcaatcttggcagcaatggaactatgtttaccaggcagatttgcagggatggtctaatcttgtattactgtgacaagatcaaataaatttangactaaattntgtaaatggagtgagtcagta

SEQ ID NO: 11604 - DNA, 551 bp, Zea mays
  Clone ID: LIB3279-188-Q1-N6-A10
agaccaaataataacagtttgcatttcatctccgttcctgaagtgcacatagctgcagcccagtgggtacaattaacaggttgttcaggatgctgtctacctaacacatgaaggaaatttaccaggtggggggggctcggaatacaacatctcacacatcaggtaaacattgctcgggagctcattacttcttcgcatatgtgatgaccatctggttttcttttgtaattttgaagctttgaaggttgttcatggcagcagtggcctgggtctcgtctccatactccacgaaagcaatcccaggcttcgcctcgatcatccgaacctccttgaagccagggtactggcagaagagcatctggagcatcatgggcgtcgtctcgtgtggcaagttttggacaaacaagatgttgtttggtacgataatctctggcatcatgaccctttgtcctcctgctataggtatctgggtgagctgtggagccccataaacaccagggtaagcagttacacccatgccaatttgactagcaccagcattatggggatgc

SEQ ID NO: 11605 - DNA, 594 bp, Zea mays
  Clone ID: LIB3279-188-Q1-N6-A11
ggggggggttgtgggttttttgactgcctctacatcttccttttcttggctcagtcattaagttgacacgagatacaaatcaactagttgatacaagatataaatgtttccataaaccaaccatgcatttcatgacacaacatgacattgggggggggggggttagtacaagtgatacttagtcctctgccatttccagcaggctggccttcaaatcggttaagttgccttgtagtggaattcatcaattgttgagtaaagacgccccgagtccatattgtaatcaatagcatccgtgatctgcttcttcggcaaaaggttgaaccgcttgagtacttcatcaacgtgcaccccatgctcactctcgaggttcgctgggtcattaaaaaaattcaggacctgcgtgtgcagatcagtatcggatgacccgctggtcaccggtgctggactggatttcaaagatgtcggtgtgcttgattcactgaatccatttgagaatgacactcccatagaagaactgattcgtgcaggactgccagcctttaattcaatggtctctatatgcatcccgacacactgaatgaaatgcagcgt

SEQ ID NO: 11606 - DNA, 612 bp, Zea mays
  Clone ID: LIB3279-188-Q1-N6-A12
gttggggggggggggtgttaaacattactgtgtcatattttcattgtcacgggtaggttacttttgctaagctttacatcgatcaggggagtagccggttgtgttgtgctctatgactgtccctgcgacccaacgtcttgtaacaccgcgggggggggacttatacgcactcacattagcagtacagtactccgaagtctgaagctataacctcgttgtcccgtggagtatttgcactggaacccgcagaatcagatggtggtcttcatggctagaatgtacaatacggttgcttttagatcagaatgccaattaggctagtccagtagcgatctcactctggtccttcaccatcagattctacgtaacttgtccgagtcaaacgaatctgagcaaatgcatagactgcctggacgatcctagcataatcggtgcccaacatttgagtcacaatatcagccaagagcgtcccccacaatattggtccaagaaatgtcacgacactcctgagtccaacgtatctcgatgcagcacgaaccaaaccctgcctagctgcaagcaaaccagctctagactccaggttaacagcagccaatcgcccaccctgcttaa

SEQ ID NO: 11607 - DNA, 589 bp, Zea mays
  Clone ID: LIB3279-188-Q1-N6-B10
gtgtgggtttgttggtaaaaatgttgagtctttattattaggtatagatataagattctattcattgcaaataattacaatttcaccgcacacttggcggtacttgacagataaggaaacacaaatggcaatatagtgttacggaacagcggggggaggtcataaacagttcagcacaagcacacaaggcatgagtcagggggcacacatcttcagccatagtagattacagtaagtatgtgattacgtttcacccacagtgataaaatcacggctgcgaacaagattcaaagggctacgccggccatgtgggttgttgacccagcgatgcgcaagctggaagttgccacaacagcaaagactcatggaatgaactgaatctagacaagatgagggccaataaacggctgggagtcttcaagtttggcaagcacgcacgccccgaaacaatgtttcctcctccggttcttcaatcatattggctctgtcaatgggttcttctctataatgttgttgccggatgagtctgttgaaggtgagctgcttccggataaatctgcagggcgcgatgttgttcgggtgttgtacg

SEQ ID NO: 11608 - DNA, 609 bp, Zea mays
  Clone ID: LIB3279-188-Q1-N6-B11
tttgggggggggttttttttttttttattggaactcgtacagtttccaatttgtggcatatatgaaacttctaacgtaattcataaaagttttgctgtcacaactcgctcgtaactgaatccagctcctgaaaccataagctaacatatggggtgggggcctacaacagtacagtgggggaaaaaaacacacaaataaaagtcacaacaacccacgtctgttctacaggactgacaacaaaggtggaatgatcatcatccatgcgaagatcacggccactcaccattaaagggcacaggaatgatcctctcttcgtcgtcggtagtatacatgcatatttcgcgacctaaaaggctagctcgtaaaattatcaggacttcttggcctagtcgcttccaccatcgtcaccacccgtgctcctgtggctctcagtgcccgagggctcagaggcgaccccgccagtatcctgtttgttcacacccggtggtagctgagcttgcatggactgagccatgccgttgaccatgcctggtctagcaaccatttggccactgaagtttagcaactgagcctgctgctgctgaagctgctgctcctgcatctgctggg

SEQ ID NO: 11609 - DNA, 595 bp, Zea mays
  Clone ID: LIB3279-188-Q1-N6-B12
tttgtttgtttgggagcgccatcatcagaagaaagaatggcaaggtaactttccaggggaattagtagccgcgacctaaataaatcacattataaaaaatacaattctctacaggcttacaggaacgggggaatccactagtcgggggggggtgggggtatacaatacagtgaattcaagcattcagacgactgttctgctctttagcagctgtaccggcatcgtagaaccatgtacgccaaggatcatcgtctattctcatcttcaatgacctcatgtccatcgacttcactcgcttctgtggcaacggcggcagcagcatgaacagtgttattgctaccacggcagtgcagtagctggcgctgaaggctctcgataagctggttaagctgttgtatatttttctcctgggataatatgatcttttccttgacggcatcctccctggcgtgcagctgctgccggcggcgggcagcggccgggtcggcgtccgcggcctccccgatctgctgcttccactcgaactgcgacgtgatgacgagcacgagcaggaggaagacgagcaccaccggcctcgtattcatccccgcacgaa

SEQ ID NO: 11610 - DNA, 599 bp, Zea mays
  Clone ID: LIB3279-188-Q1-N6-C10
aacaagtatatcaggaagttcctttatttaatacgcgctgctaatgcaggctacgtgttacaatattattattcaaaaacacggccatgtggataccacatcgatgcagatttttggccccatcaaacaagtagcagcagatgagatcgagttgaggcacgcctcctcactccgcccctaggagggcaagcataatatcctcataatctctagttgtatctttggccacagcacgctccagcggcacactgttcctcttctggtaagcctcctttatcagcttcaggtcgacctcggcgcgagtagttacgaccctggtgaggtcatcctcatctgtgcccatgcctccaagagccagtcgaatgactttctcgaagtatctgtcagggcaggtgaagcaccggatgatcgcccgcagtgttgaaagaaactcatccttggggtcagctttcagatccttgttgattgcatgagtgaactgatccttgtagctattgaatgttgcaagtagctgagctttgctccgtgtggtgagaattctaatgatctcctcatcactgtaagccttcttatggatcttctcatgaagtattttggct

SEQ ID NO: 11611 - DNA, 484 bp, Zea mays
  Clone ID: LIB3279-188-Q1-N6-C11
gtgggggggggggggttttttttttttttttttttttttttttttttttttttttttttttttttttttttttttagaaaaaaatattaccttgacagcttcatcaaaaatgtttaaagcaaggtcattttacaaggaacaaacattaggggggggggggcaaatttattcccttttttgccaacaaaaacagtccccaggacttgagataccaaacatagacaaataaacaaacaacttgccttgtcttccccctattataatgctccgggacaaaaactcttaaaaaaactattttttgccacccacctttgttcccagggccctttcaaacttgctaaaaatcttctgattggggattgccttgcctgattcatactcctgaaacacctggggcttctcatttataatctaaaaaaattgggcctggttaaattttttatcaaaccttgcttgaataaaatttttttttaaaacacttgga

SEQ ID NO: 11612 - DNA, 521 bp, Zea mays
  Clone ID: LIB3279-188-Q1-N6-C12
tggtttgtttgcaaaaaaatggttttcaattacagtagaattcagggtgtgatatcgtgtaatcaaacacaaaacaagaaaataaagagaagagaataactgtgaaaaaaatcttacatattggaaccacatcatacacatcacgacgggggggggggtgtgggaactagttaacattccagaaccagcagatttcgctgcttctgtgtgttgcgctgaaggcctatgaggagggcgtgccaattgccaggccgtaatttgagccttggaaaatccgcgccttcaggtggctttcgaagacgtcggaagcgaagcgggagccattgaagcaaacgaaccagagcaggatcagcaccaatatgttgaataggcaccgctcccaccaatcgagcatgtagaggcccatggtgacgttgtagaggtggatcttcttgcccacccagctcatctcgccggccatcttctctgcggggtcagttctctccgtttcggggggtgggcgcgtgcgtgtttggtgttcc

SEQ ID NO: 11613 - DNA, 583 bp, Zea mays
  Clone ID: LIB3279-188-Q1-N6-D10
ctctgcaaatggttgtctggaaggtcttcatgtggctccaccactggatttttgcatcctttttcaatgtggccatactggaagcacctcttgcattgatatggccctctcttacctggctctccagcactcttgattcttttctttcttggtctgccagcaggcctgccctcaagttttggtggcctcatttcgaatcctgggtccaatttcggccactgtaacctgtctcccattggatacacctcaaattggtatgcatctttaaacctttgaaccgaataacattctccaacatagtcctcgattctcaaatttcgttgagaagttatgaatgctatggcatgagtgcatggttttccagttacatcccactgtccacatgaacaagcctgagtaacaaggtttactccatatctccaagcaacaccatctctactagcaccagaaacctcacccttcatgtacccacttttagtgatggtatatcgaagattcctactcttctcatgcagatcattaactacactaggtagggatgtggccttgcattttattggctatggactgtcttgtagcaatc

SEQ ID NO: 11614 - DNA, 581 bp, Zea mays
  Clone ID: LIB3279-188-Q1-N6-D11
aagctaacttggcatactatgatcataagcaaccgaagggtagtgtgggataccatatatcaacatacgatccatcatattataaataaacaatacggtacaaacagatcagctcccgaaatcgacaagttccaatgcctatgtataacggcaagtgcgacagcaggtaccgtcttccagcaccagtatgcctgctgcgttcggaagccaagccagcaacgaccgtcgaccatacatgacatccagataaaaccggattggtcgttttctccttattcttctacgtaacacgaagtacgttactactacagctcacacagttacgtcagttcactggctgctcgactcagcatgctccgccggctgatgctggtttagcacaaaggccccttccaggctcttatggacctcagctttgatcttctcctccttgctgcctctcttcagtttcatcagaatgtcaaattttgcaaagtcttccacaacctgtgcatgggcacgaaggatctcgagaagttcgtagggaaacagggagttggacctctcttggatcgatttcacagcatggtgtgcagcatctt

SEQ ID NO: 11615 - DNA, 599 bp, Zea mays
  unsure (1)..(599): unsure at all n locations; Clone ID: LIB3279-188-Q1-N6-D12
cgtcgtaacttggacctctanacggcccccttgggggtttgtntggtttttttttttttttttttttgcaacctcaaaaaacaggcatttcttcttccattctaaatagcaaagacaacttgcagcaggacacatacacatacaagcacattcttcccatctgcagcctacgcatgagggggggcggggaacaaggtactgctaaacatcaaatcactccggacaggcagtctatgccttcttaggggacttggcggccttcttgggcgactttgcctccttgctcccgccactggacgccttctccgccgtcttcttgggcagcaaaacagggttgatattggggagcacaccgccgtgagcgatggtcaccccgcccaacagcttcccaagctcctcgtcgttccggatcgccaaaagcacgtggcgcggaataatgcgagtcttcttgttgtccctggcagcattaccggcgagctccagaacctcagcggcgaggtattcnaggacagcggcgaggtaaacgggggcgccggtgccgacacgctgcgcgtagcggcccttcttcaagtagcgcccgatgcggccgacggggaact

SEQ ID NO: 11616 - DNA, 653 bp, Zea mays
  Clone ID: LIB3279-188-Q1-N6-E10
gtcggcgactgggggcgggtcagctcgatggccagcggcatcagcgtgcccaggtccgtcaggaagaagaggtgcgcgaggcgtagagcgtcgcgtcctgcagctcccgcaccttgtgcacgtagggcaggaacacgtcgtggtagtccaggatgaacagccgcttcgccgccagcgcctgctccacggtcagcgcgccgttcatctgcttctccaggatctccttggtgatggcggactccgctggcccgtacacctccgggtccagcttgctcttgatggggaactcggtcagcagctggatgcacagcgggttgagccccgcgatcgtctgcctcgcgaactcctcgtccttgaaccacgagaaccggtccctctctatcatctccggcacctcgaagcggaggacgtggtcggtggtgtcctccaccagcttgaccatgcgcgggacgacggtgcggatggcgtcgaacccggtctgcgccggcagcgggatgccgtcgctgtagagttcgtcgatggcggggaagtgcgggaagcgcagatccttcttgttgatgagcagcgggcggagcgccggcagcagcgcgtgcaggccggagcgcagcgtggtggccccgaacgtgagctgcttaccttcgagactgctcgtc

SEQ ID NO: 11617 - DNA, 576 bp, Zea mays
  Clone ID: LIB3279-188-Q1-N6-E11
gtgggggtgggtgggaaatattttaccatggtgattcacgtaggtaatcacacagaatcatccacaaggtattgaatgtgggtataatgccaaatgggtactaaacctaattaaggcgagccagacaaaacgcttttcatggtaaatagaggtaataacacggcgatgggcgcgcataacgtcttacgcgtagacattgcggaagcaacagtgacatcccaaaatacttacaaccattaagacaacataaagtagacataggggtagacaccaccaaacttaggcatcaatagatccagcacctccttactacaaggcccactggttatacctgcggatctgctcttcctgctcatgggtgaagtgattcttcatattgaaggtcttgcgaatctcttctggtgtcttgcccttgatcatgttagcaacagtctcgacaggtcaagtctagcagacccttgatgttcacatagttatcacccaacatgaggtcgaaaagcgtcgcctgttccaccttgacgaagtccgcatcccagttcttgaggtcctcaccggaggcggctgtgctaatggcgg

SEQ ID NO: 11618 - DNA, 556 bp, Zea mays
  Clone ID: LIB3279-188-Q1-N6-E12
tttggtggtgtgggtattaaaatttaaatataatataactataaataaaacacactgataaagactaaacggcatgattagatgctagttaaaagtattaaataatttaattagtacatgatacgttcattcatgtagtttcagaccaaggaggctacgcgtgccggcgttcctcggcggcggggagatggccatggcctatgaacgaggcgacggcgtcgtcgaacatctcctcgacgcccttgaattccgccagccccagcgcgcgggccttggacgtgtcgaagccgtacgactgctcgccgtaggcgcggggcaggctcctcgggacggggtacgctgggaaccgccgcgcgagcagggcggcgaggtcgccgcagtccagcaccgccgcgctgcagatgtacctccctcgggcgcccgcggcctcgtacgccagcatgtggcacctcgccacgtcgtcgatgtggacgtaccccatcctcccgtacgtcgtgaacttccccgtctctccttggaacaggccgaggacatcagaagcggtggggccgagctc

SEQ ID NO: 11619 - DNA, 553 bp, Zea mays
  Clone ID: LIB3279-188-Q1-N6-F10
gtgggtggggggggggtgttttttttttttttcaaaatagtatttgttttagctctttatatctatgtccatattaaaatagatgatggggaatctagacacatctattaaacacatacatcaaatattatatgaatcaaccactatcccaagaggggggaggggggtcgagacagagggagtatctttgtaataaaatgtaaaaaagcatccataagttgttcagacgtcttcctcttgctaggagccctgctgaaaagcttcaagacttgttggcgatgtagttggaaagccaatcaagcccctcatacaacccttcaccagatgtagcacaagtgctctggatgtaccagtgccgctggcgaagagaatgcaaaccaagcttgtcagtaatttcagcagcattcatagcattgggaagatcttgtttgtttgcaaatacaagcagcacgggatcacgcagctcatcctcattcagcatcctgtggagctcatctttagcctcaacaacacgttccctatcattggtggctacaacaaaaataagtccctg

SEQ ID NO: 11620 - DNA, 619 bp, Zea mays
  unsure (1)..(619): unsure at all n locations; Clone ID: LIB3279-188-Q1-N6-F12
ggggggggtgtgggtgttatttttttatagtatttttacaacaattatgagataatgatcgacagttgtatggtctcaacattcaaaagncaaacagcaatataaaacacagcctaaaccagcggggaacgtctaacagaatacacgcgcgggcaggtcccaacaatacggcaactaagcatacggaatggtacgtacggctatgtgcctagcttgtgtgaacaaagaatcctattgtgcttcctcgggtgcaggctcaccaccttcagtagtagcttcttcggacggcttggatgggtcctcgttgatcccatcgttgatgcccagaacttcatccatcacctcgtcttccgcagccatgtcctctgcgtcttcgtcgtcatcattaccgccctcctcaggaactcgccgagtcttcggaccatgctccgccctgtgtgtgtccagctccttgtccatttcttgcatgttagcatgcccgttcgcctttcgagcgttccgggcattctggatcctctccagctgcctctccacatttgagagatattgctcctcaacttgcttttggaaccgagtcagctcatccctgcgcatagatttccattcttcgaataccttt

SEQ ID NO: 11621 - DNA, 563 bp, Zea mays
  Clone ID: LIB3279-188-Q1-N6-G10
gaatggaagcacaaaacaaattttacacatctttgcaatcttattacaaacaacacctagtgattcacagatcccaccctctcacctgccttcacagttcacgctccttgaatctaaaccggtgtttcccagagtgggaaacctagaccagtgtgaccctacacagtgcatgccaaatgggcgaaaggcaagcaattacacacgaacaaccacaataaaagcgcatcaaacaacaacgaccatgaccgacaacgacagttaggagcgtttcagttcagagaggacagagagagacagtgcatcagcattgccagggacctacgaggcggccacctttttgggcgacttggcggcggcggccttcttgggggacttcttctctttgccttccttggcagcagcgacagcggttttcttggggagcagcacagggttgatgttgggcagaacccctccgtgtgcgatggggacgcccggccagtaacttcccgagctcctcatcgttgcggatcgccagcagtacctgtcgcgggatgatcccggtcttctttgtgtcccgcgct

SEQ ID NO: 11622 - DNA, 557 bp, Zea mays
  Clone ID: LIB3279-188-Q1-N6-G11
aagaagcatgaaacgggaatttcagttctcatagcattatcatgaatctcagaacataacaggggaaacacgaatcaagcagaggcgccatggggttcacagatccacacctaaaccggtaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagccaaggggtcgcgacggtgcagatgaagaactgggagccgttggtgttgggcccggcgttggccatggagagcacaccgggggcggtgtgcttgcgcacgaacttctcgtgcgggaacttctcgccgtagatggactcgccgccggtgccgttgccgcgggt

SEQ ID NO: 11623 - DNA, 610 bp, Zea mays
  Clone ID: LIB3279-188-Q1-N6-G12
agctgaggtaaaacctggggttccatacagaatagtgaaagtatcaattacaggtttatcaaggtagtatatacacacaactctaggttttcatgattcttccaaacttacaacggatcacatttatgacgtcgacgaaaggctgactggataaaaacttgcgatgcttctatgcaattattttctagggtgaccgatatctcacaagacctcgtcttcttgcacgtacatgccaccatcggtctcgacgggcattgaaggtggggttccaggtggaatgcaggaagccccattttctcctgcaatagtacacaatgcctccgcgtcctggatagcccggtcaagattgatctgaccactgagctcattgatgaacttaaggagggtatcgaagtccatctgctccccaattatccgctgacgatactttttcaagattgctacgcacaagtacaagtggaaatgttctgacaaataatgggaccacagaacttcccataaaagcatgaagtggtcgaaactgaactcccttttgaattgtataagaacccagcggaaacagaaaaaatagttcaagcagtcattttgcctaaaatagttgtgcaatgaa

SEQ ID NO: 11624 - DNA, 646 bp, Zea mays
  Clone ID: LIB3279-188-Q1-N6-H10
tgtgtgtgtgggggtatttttaacttctgtctgcttagtttattgctcattcttacagagtccatagtacagtttgaatatctgtaatataggagaaaaggatgagctagctagcgtggctcagcacctcctttcctatgttaagccaattgtggtgtgggaatcaggcagctcatctgatatatctatctaacttagtctggcacggcctgtgtggagtttgaatacaacagtgaataatgatggcacaaattgatcgtccgccatggatgatcttcacttcaacgaggcttacaagcttttgaccgagatgcatctttcctcattgtccagaatgctgcacggtaccgattctgcatcattgctttcatgtttgcagtgtaagtagtctcgatcattttctccacctccattgtaaatccataatggtaagcaacctttttcacatcttccaaacttaattcaatagacatatcatcatctggcccatatgaatcagcaaagtgatacagaaggggacccaaattaatccagaccccaccatccttgagaacttttgatatgatctcgatgtattcaacgatattgtgtgccgtatccaggaaaaagcagttacaacagcatcccatgcagattttgggctttc

SEQ ID NO: 11625 - DNA, 616 bp, Zea mays
  unsure (1)..(616): unsure at all n locations; Clone ID: LIB3279-188-Q1-N6-H11
atgcgaacatcatatcatagttcaaagttcataatatggtaagcgcctccaaaatggtacagcggcaaagacagagcagagagcaggcgacgccagcacactcaccaccatcgttcaggtaacaacggccgagatcccagggggggcccggtgctgcgatgcagtaagcagtaggagtacttaactatatacagagaagaagaaaaagaacaacggatctcttttgcgaaacactatgcacaaacacacacaacccccttccttctcccgcaacctcatctcacatgccatggatgatcttattctcggaccctctctaccaccaccggctccagacacctactacaagcatatataatactccgtacctgcttggctgctgcacaccagagctcgaacagaagcgcgttcgtcataccttgggttcggtggcttctcttctgctactctcaaaactggcaagacgtgcccagcctcggcatcgagcgctggccgacgacaccggcagcgtgcttccgggcgctcagggcacctgggagcagctcctggaacttgtcgaggaatgcgctncactgtttagggctcatgtccgacagcttcacaaaactggcgctgg

SEQ ID NO: 11626 - DNA, 538 bp, Zea mays
  Clone ID: LIB3279-188-Q1-N6-H12
gggtggtggggggggggtttttttttttttttttttttatttttttttttttttttttttttttttttttttttttttttttttttttgggggggaaaaaaaaaaattttaaggccccgggccttcccttttgtttttttttcccttccgcgggggggggggggaccctttcctaaacctttcaaaaagctgctaccccgaccccccgaaaaaaaaaaaaaatcgggaaacggggctggtaaaaccgaacgggggattttgattttaaaacctatgacccccgcccccattaattgcccggcccaagccggccggaagcccaattaaggggggggcaactcccccaggggggcaagcgaccgggggggggggccccgccccgggggggggctggggcgggcccccccccccggggggaccaacaacatccacggggcggggggggccccccccacatgcttccgggggggggagcccccccccctaccgcatttttagaacccccggggggggggcgaccccttgagggggttttggc

SEQ ID NO: 11627 - DNA, 282 bp, Zea mays
  unsure (1)..(282): unsure at all n locations; Clone ID: LIB3279-189-Q1-K6-A1
ctgcggactccgcctccagtttggtctgtttcttgcaagttgctcttgcggtagttcccccaactgtcaccatgcagnaacgaggagggtaagactgtggacctctatgttcccaggaagtgctcggccacaaacaggatcatcactgnccaaggaccatgcctctgtccagatcaacattgagccacttggatgcgaatggcctgtatgatggtcacnttcacaacatttgctctctcttggttgtccgtgctcaggcgatgcagacactccttgacagct

SEQ ID NO: 11628 - DNA, 665 bp, Zea mays
  unsure (1)..(665): unsure at all n locations; Clone ID: LIB3279-189-Q1-K6-A10
gttgctacctatgctcatgattactttattcaatggatcaagaaaccaacatcggtgtgcatgttcctcaaacacatttaggctaaaaactttgatgcacaaaactttggttttttgatttgagctattggtgttcaatttggataagtaagtcacacatttgtgtacaccttaggtcttctatctttgatgtctgaggaagtcacatggaacatggtggctatgaccacctttaaagagacatgggacattttgaagaacatcctgatctcttttgccacacccatacttgtgtagtgcagatatgggtcgacctcgccgtcactgcttacttcagtaagatcaaaggttatgcctatgaccttgctattattgacacttctcctcaagatgatggggtgatcacctaccttttggctagtcttagtccatattatgacttgtttgccacctcaatgatcaccaaaagtgaggcacccactctcgatgatgtttatgctcatctactgtcctatgaggcctagcaacttcaacatcaatctaaattgcacctcaacatcggngcttctgccaattntgctaagcatggtggttattttgggcatgactgttctcatggtcgttgtggtcatgcctaggcacactcatgtatggaaggggacact

SEQ ID NO: 11629 - DNA, 675 bp, Zea mays
  unsure (1)..(675): unsure at all n locations; Clone ID: LIB3279-189-Q1-K6-A11
gttcctatatgactactangctagagttagagcctagatgatggctgcttctgttggcgtgaaagctcgagtgctcctaaatggtcgtcgtattagctgatacgacatcgacccgatgcaatagataatattgtttacacgcgcgagtccaaaattgttggctttgggtcggagcagttaacgcgagaagtgtattttatcacttctgagtgcaaccttttttttattatttttccgagcttctgcctcttgcatatgttgtagattctcgtcgagaagggagtagtagtattacctgatatctatgctaattcaggtggtgtggtcgttagctactttaattgagtgagttcaggtaaaatgcctgttcgtcgctgcttcattgctcgattggttccttgctctaatctgctttcttgtgccatgttgattgatcgtgcagaacattcaaggtttcatgtgggccgaggagaaagtggacgatgaactagaaaaggacatgagcagtgcttttcaacacatgaaggccatgtgcaaatctttggtgctgccgaagtgtgccgtgacattggaattgcgggtctagnaaagcaagctcattagatttctaaaaaaacttaggagttattagattggtagcatttttttaagatttaaaatttatagaagtcatca

SEQ ID NO: 11630 - DNA, 659 bp, Zea mays
  unsure (1)..(659): unsure at all n locations; Clone ID: LIB3279-189-Q1-K6-A12
cttattcgtccgcggacgcgtgggcggacgcgtgggcgcggggagctctagttccgccaagcgtgcgtaccggcgtccggatccgggaccgaagatgacggagtccctggtgcggaacaagccggggatggccagcatcaaggagatgccggtggtgcaggacgggccgccgccgggcggtttcgcgcccgtgcgcttcgcccgccggatccccacctcggggcccagcgccaccgccatcttcctcaccaccttcggtgctttcgcatatggcatgtaccaggtcggtcaggggaacaaggtccgccgggcgctcaaagaagagaaaattgctgctcgcagtgctatactgccgatgctccaagcagaagaggatgaaagatttgtcaaagagtggaagaagtatcttgaggaggaggcgaggatcatgaaagatgttccagggtggaagggcggcgagagcgtgtacaactccgggaaatggatgcccccggctactggtgagctccgccctgaggtttggtaagggcctgttgcaggcactgaatgccatcatgtcacggnggcacggataaggcttcatttttcattaaggatcagctgtntaaagacctgtatttgttgtacttgaaatctggctggttaataattggacatgt

SEQ ID NO: 11631 - DNA, 552 bp, Zea mays
  Clone ID: LIB3279-189-Q1-K6-A2
gaacgcccaaggcgctagcgtctccaagaggtgctgcaaaacgacattgacttactcaatccaccggcagagcttgagaagctaaagcacaagaagaagcggctagtccagtcccccaactccttcttcatggatgtcaagtgccagggctgtttcagcataaccactgtgttcagccactcccagactgtggttgtgtgcccaggctgccaaactgttctgtgccaacctaccggtgggaaggccaggctcaccgaggggtgctccttccgtcgcaagggcgattaggtcctgcttctcttaacgtgagaagagataaatttggtgttttgcaactttctcaggatatgtactcggtgaggattttgttaattattatggctgttagcgtggcctgacaatgcttgtgtaaacctgcactttgtttgagcgtagtgacagctaatatggtgctgtttggcttttgctgagggagtggcaatgcaaatgaaatcaactggtggcgttatttgtcagggtttaactgaaagtgccatttgtttggttagcttg

SEQ ID NO: 11632 - DNA, 613 bp, Zea mays
  Clone ID: LIB3279-189-Q1-K6-A3
cggtcgcgtgggccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacattgctgagaacgagggcgaggaagaagattagattgcactacgcttatattttagtattgaactcgttgcattttgatacctgtacccgtagtttcgcaaatgtcccatgttatggtgtggtatggttaatttgaagaatccttatgtactgaatctctgcaaaagctatgttgtggacagaagtgt

SEQ ID NO: 11633 - DNA, 647 bp, Zea mays
  unsure (1)..(647): unsure at all n locations; Clone ID: LIB3279-189-Q1-K6-A4
ggccaaagaacgcaagcctgtggtctactaaagacgggggcatcgccatcgagggcaaacggaggccacaggattagcagcttctccgaactcccctctcgtgctgctgcgtctcctcctcatcgtcctctccagtgtccagctcggccatggcgttcaccgtctccttctcccccgccaacgttcagatgctccaggctaggagtggccacggccacgccacctttggaagctgttccgccgtgccaagagccgggccaaggcagcgagcagggcgccgtccgggaggaccatcgaggagtgcgaggccgacgccgtcgctgggaagttccctgctcccccgccgctggttaggccgaaggcccctgaaggaacgccggagatcaggccccttgacatggcaaagcgcccccgtcgcaaccgcaaatcacctgctcttagggctgcattccaggagacgagcatctcgcctgctaactttgtgcttccattgtttatccatgaaggagaagaagatgctcctatcggagctatgccagggtgctataggcttgggtggaggcacgggctgcttgacgaggtttacaaggcccgcgatgttggtgttaatagttttgttctctttcctaaagntcccgatgcattga

SEQ ID NO: 11634 - DNA, 315 bp, Zea mays
  Clone ID: LIB3279-189-Q1-K6-A5
cattcttttgaactgctttcgtgagcatgtggtgttgtatgctgtgaccatgcttcttcgtttgcattccaaacctttttacgaactgtttaacaaaaatgatcttgtcggatgaataatgattctggtgcgagtttaccagtaacggcgaggagtgtttctcaagtaatggtcatgtctgtgcagcatatttttttatgaataaaaaaaaaataataaaaccaaaatatagataaaaaaaaaaaaaaaaaaaaaaaatgcttaataaaaataatacaaaaaaaaaaaaaaaaaggggggggccggttttaaaga

SEQ ID NO: 11635 - DNA, 666 bp, Zea mays
  Clone ID: LIB3279-189-Q1-K6-A6
gccaagtacctgggccccgtctccgcccagacgccctcgtacctcacgggcgagttccccggcgactacggctgggacaccgcggggctgtccgcggacccggaggcgttcgccgttcgcgtcgcgcggaacaggacgctggatctggaggtgatccactggcggtgagcgatgctgagggcgctgggctgcgtcaccccggaggtgctccagagctgggtgcgcgtggacttcagggagcccgtgtggtaagttcaaggcccgcgcgcagatcttctccgagggcgggctggattacctgggcaaccccaacccggtgcacgcgcagagcatcctcgccgtgctcggctcccaggtcgtcctcatgggcctcgtcgagggcttccgcgtcaacggccacgacggcgtcggcgacggcgacggcctctaccccggcggccagtacttcgacccctcggcctcgccgacgaccccgtcaccttcgccgagctcaaggtcaaggagatcaagaacggccgcctcgtcatgttctctatgttcggcttcttcgtccaggccatcgtcaccggcaagggacccctcgagaacctgctcgacgaccccgtggccaacaacgcctgggtctacgccaccaagttcgcgccaggggtcttgtgagctagcggg

SEQ ID NO: 11636 - DNA, 656 bp, Zea mays
  unsure (1)..(656): unsure at all n locations; Clone ID: LIB3279-189-Q1-K6-A7
cattatgctgctgactgttgggatgctgagatagagtgctcgtatgggtggatagagtgtgtgggtattgctgatagatctgcatatgatttgaaagctcacactgacaaaagcggtgtcccacttgttgctcatngaaaaattctccaagcctagagaggttgagaaacttgtcatagttccctcgaagaaagacctggggctggcttttaagggcaaccaaaagatggtcctggaagcattggaggctatgagtgagaaggaagcatttgagatgaaagctgaactagagaccaagggggagacaaattttaaagtctgcacacttggaaaagatgtggtgattacaaagaagatggtatcaatcagcatggagaagaagctggaacaccagcgagtcttcaccccttcggtcgtcgagccgtcattcggcataggacggatcatctactgcttgtttgagcactcgttttacacaaggcctagcaaatcagaagaggaacagctgaatgtcttccggttccctcctcttgtggcccctatcaagtgcaccgtgttcccccttgttaagaatcaagagtttgacgatgctgccaaagtaatcgccaaggcattaacaactgctggtatctnccacattattgacactanctgca

SEQ ID NO: 11637 - DNA, 646 bp, Zea mays
  Clone ID: LIB3279-189-Q1-K6-A8
ctctcaacgacgccgcgatccagatccagccaggtatcaagtcatccttccgccgccgcgtactgcgcctatcttgcttctccggcggacgggcgtacccatcgtcctcgatcatcccccggactggatcggaacggagatccagccggacctgcggtgatcccttccttttctcggatagtatagtgagctagccaatgaagaggtaaattcgtcaggcttgtatcaagttagtagttcatggtgcctggatgagcagtagagatgctactggccgtggaaggaggagggttcttctcgtcttcagcttcggggtacagccatggccttgctctcttgctactcggacggaaagctgaggagaagcccgtcaaggcttcgccgtggaaccagtaccggctagtcgaccgggaggccgagcaggtgtaccacctgccctccgccaaggatcaggcgcctgggaaatgtgctccctttgtctgtttcggatgcacgactaatggcctcgaggtggcgtctccttccaaagcggtctccagcaatgcgctcggtaggggtacctcacaggaagaagcatcttgttcagcaacaaaggcgttgacaactagtgcttccatcagtggcagtgagagacgtggctgtctta

SEQ ID NO: 11638 - DNA, 697 bp, Zea mays
  unsure (1)..(697): unsure at all n locations; Clone ID: LIB3279-189-Q1-K6-A9
aatttcttgaagcatttctgggagggtgatgaggacgaagtgaaggccaagaagactcggctgttcggcgccaacccaccgatcctctacgttctccactacttggggcggaagccatggctgtgcttccgggactacgattgcaactggaacgtcgagatcttgcgggaattcgcgagtgacgttgcgcatgcccgctggtggaaggtgcacaacaagatgccgaagaagcttcagagctattgcctcctgaggtcaaggctgaaggctgggctggagtgggagcggcggcaggccgagaaggcgaacttcaccgacgggcattggaaacggaacataaccgatccgaggctgaagacttgcttcgagaagttctgcttctgggagagcatgctatggcactggggcgagaacaagaacaactcgacgcagagcagcgcggtgccggcaacacctgccgcgacgagcctgtcgagctcgtgaggcctgttgtgtagatacagctttgttgagagtagtagtataccagatacgaaacttctgaagctcctccatacatacatagcaacagctctgtaaaggtagctatgtaggccttttcccccccgaatgactatactcttgctcgccgtcacggctgcagcgcccnctcctgctgcttnctgatggctgacaaattctttgggttttgccaata

SEQ ID NO: 11639 - DNA, 672 bp, Zea mays
  unsure (1)..(672): unsure at all n locations; Clone ID: LIB3279-189-Q1-K6-B1
cccacgcgtccgcacgccggcatccgtcgaagctgctcgacctcgactcaagccttccttgctccttgccgccgtcgagtcgtcgcaggaacgatgacccggcggaacggctgtacgatctacgtgggcaacctccccggcgacatccgcgagagggaagtggatgatctcttctacaagtatggacgtatagtggaaattgacttgaaaattccaccaaggcctcctggttttgcttttgttgagtttgaggacgcacgtgatgctgaagatgcaatatatggccgtgatggatacaactttgatggccataggttgcgggtggaattagcccatggtggacgaggcacatcttcttttgatcgatctagcagctatagcagtgctggacaacgcggtgcctcaaaacgttctgattaccgtgttatggttactggattaccttcttcagcatcatggcaagatctcaaggaccatatgcggcgagctggtgatgtctgtttcactgatgtgtatcgtgaggctggagcaactattggaatagctgattatactaactatgaagatatgaaacacgcgataaggaagctagatgattctgagttccgtaatgctntttcaaggacatatgtccgggtgagggagtatgatgctaggcgcagccgttctcgc

SEQ ID NO: 11640 - DNA, 656 bp, Zea mays
  Clone ID: LIB3279-189-Q1-K6-B10
ctctgcacaagaaaggggaggaaggacgagccggagccactcagccgccacctcacccccccatcgcccgcctgcgtcccaccacccgctcctgctgccgggcctgccgcctgcgtcccaccacccgctcctgctgccgggcctgccgcccgttgctctcgccactgaagccctcgccgcctccgcccgcttgcttgccctcctgccggctgccttccggatgagaagcggcgcaacctgggcagcggaagcgtggtcggcctgagccttcgccggggtttctgccgagaaggatcctggagattaagcgcatgggttccttggaggcccggtacaggccggccggggcagctgaggacacagctaagagaaggacccaaaaaagcaaaagtttcaaagaggttgaaaaatttgatgtttttgtgctggagaaaagttctggttgcaagttccgatcgatgcaacttttgctcttcgctatcatgtctgctgcatttctaacaatcctatacacaccttctgtgtatgagcatcagttgcagtcaagctctcggcttgtcaatgggtggatatgggaaaagaggagttctgatccccgatatgtatcttctgctagcattcaatgggaggatgtatataaaagtatccaaaatctg

SEQ ID NO: 11641 - DNA, 652 bp, Zea mays
  Clone ID: LIB3279-189-Q1-K6-B11
cccacgcgtccggtgttcgtacttcgctcggcagaaacctcttgctccagggggcgaacgcgccgccgcctccgacagccccctccagccgcgtcaaatcagcgccctcctctgctgcgccggcggtctcccgccgcaaagacgaagccccgcactcccttatcgcagatccgtgcccgccgccatgacggagtattgggtgagccaaggaaacaaatggtgcgacttctgtaagatttatatagcaaacaattccttcagcatcaggacacatgaacttggtaagcgccacaaggacaatgtcaccaaacgactgtcaacaatgcaaaaagagagtgagacaaaggaaaaggaacagcagcaagctgcacgagccctacagcagatagaagcaaaagctaaaaagagttatcaaaaagatttagagaataaccagaggaatgttgatggagacacttctgcagcacctggagatggatgggtgcttgactcggcgtcaggatattaccatgacaaatctactggactttactacgattcaaactctggcttctattattctgacagtttaggcaagtgggttacccaagaagaggcgtacaagtccgtgcaagcttcgaaatcagacgctggccaatcctcagcttcacaa

SEQ ID NO: 11642 - DNA, 176 bp, Zea mays
  Clone ID: LIB3279-189-Q1-K6-B12
gtttgaggccaccagcagcatcagcgaggcctccgaaattgaagcggaacccagcagtaatgggcaatagcggccccgattattaggaagaccacagttgatttgaatccactcaagtgtatgtaaccctgatgttgacgtatgccactgcgaatcacgcgaaaccattggatatc

SEQ ID NO: 11643 - DNA, 647 bp, Zea mays
  unsure (1)..(647): unsure at all n locations; Clone ID: LIB3279-189-Q1-K6-B2
gcgagtcgcgagcacagatcgaacaggcaggcggcctctgtcctctgatctgtcgccattgtctcgttgtgttgtcccggaggagcaggagcaggagcgatcaggccaacgctttggactcctggacctaccccgatggcgccagcctcctctccgatgagacagtaatccagcgagcgcgagtgagaggcaaccagcaaccatgaggccagacacggcggcctccgcctctccgactccgaagaagaaacccgacagtaaagccgcgctggacctcgcgtcgtggagcttcaacgtcaccacgtccgtcgggctcatcatggtcaacaaggctctaatggcgacgtacgggttcacgttcgccacgacgttaacggggctgcatttcgcgaccaccaccgtgatgaccctcgtgttccggtgggtcggcctgagccagccgtcgcagcttccgttaccggacctagccaagttcgtggtgttctccaacctgtccatcgtggggatgaacgtcagcctgatgtggaactccgtcggcttctaccaggtagccaagctgtgcatgatcccggcgtcgtgcctcctgggagtggtcttggaccgcgtgcactacttcccggacaccaggctcagcatcngcggtcgtg

SEQ ID NO: 11644 - DNA, 654 bp, Zea mays
  Clone ID: LIB3279-189-Q1-K6-B3
ctggatacactggcaaggttgtcatcggaatggatgttgctgcttcggagttttacagtgacaaggaccaaacatatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgc

SEQ ID NO: 11645 - DNA, 643 bp, Zea mays
  unsure (1)..(643): unsure at all n locations; Clone ID: LIB3279-189-Q1-K6-B4
aagcagctgggagcaacatgttacaggcagcacctgctgtcaaagctattagtgcagtgtctcagacgaaaccacgtagggctaagcacaggcaagtaaatgctgcagacaaatctccacgtcatatgaaggtaaatcgggggaacagcaaagccgctagtaaggagtctctatcttgtggagaaatgctacggcagatctcattagcagcatgtggtcttaagcagagagaggaaattgctccttcaagtgttaatttctttaccgattttaggaagaactccattttttctagttctgatgtcgatgagaggatgcctgagaaggcaaccaacgccgagtccactccttcagaacagcccattgttgatcatatgcaggatgactattggtccgacattctcattaatgtggaggagccgttatctagcctcaaaaagaagatatataagagtaagaaaagagcaaacaagaaggcacctcaggttaagaaacctcctgttaattcattggcgactgcagaaaatgcggatgagccaaggagtgaaggcaaccaagatacagaaaatggggaacaacttaggaacaaaacgaagctgttttctgcanatggatctcaacagaatgggacaaaatctggtga

SEQ ID NO: 11646 - DNA, 646 bp, Zea mays
  unsure (1)..(646): unsure at all n locations; Clone ID: LIB3279-189-Q1-K6-B5
gccaactgcaaagcccctgtggnaaacctagcattggcattcttgaactgggtatattgacagcacagggcctgttgccaatgaagaccaaggatgggcgtggcacaactgatgcatattgtgttgcaaagtacggacaaaaatgggtgcgtaccaggactataatcgacagtttcactcccaaatggaatgaacagtacacctgggaggtgtatgatccatgcactgtggtcacaattggtgtattcgacaattgccacctgaatggcggggaaaaggccaatggtgcgagggacaccagaattgggaaggtccgcatccgcctctcgacactcgaaactgatcgggtgtatacccactcataccctcttattgttctgacacctggtggtgttaagaagatgggtgaggtgcagctcgctgtccgtttcacgtgttcatcactgctgaacatgatgcatctgtactcacagcccttgctgcccaagatgcactatgtgcacccgctgtctgtgatacaggtggacaacctgaggcgccaagccacaagcattgtctccacaagggctgggccgtgcagagccaccgctgcggaaggaaatcgtggaatacatgccttgacgtggactcgcacatgtggagcatg

SEQ ID NO: 11647 - DNA, 606 bp, Zea mays
  unsure (1)..(606): unsure at all n locations; Clone ID: LIB3279-189-Q1-K6-B6
atccatgtcgaacagcgccgctagcgagaagcaatcgcagcaggcaggccacaggcagcggcccccggcggcgtcggccgcggacgcggagatgcagagggtgttctgccgcatcgacgcggacggcgacggccggatctccgcctcggagctggccgcggtgacgcgcgccatctccccgccagcgagctcctcgcacgggcgccgcgaggtggccgccatgatggacgagctggacacggaccgcgacggcttcgtggacctcggcgagttcagggcgttccacgcgcgcggcggcggcggcgtggacgacgacgccgagctccgcgccgccttcgacgtctacgacgtcgacggcgacggccgcgtcacggcggccgagctgggcaaggtgctcgcgcgcatcggcgagggcggatgcagcgccgaggagtgcgagcggatggtcgccggcgtcgacgccgacggctgcgtcgggttcgaggacttcaagaagatgatgtgcccccagccgcaagccgaagccggcgccgccgggcgggacatggcagaggccgaggccgaggacatggaggagtgacnnggtgtagtcaggggggaacggga

SEQ ID NO: 11648 - DNA, 423 bp, Zea mays
  Clone ID: LIB3279-189-Q1-K6-B7
gtctgtccatccatccatccatcccgctgccagtcctcgcgccggcctccccgaaatatcggaaattgcaacccggtccacgggtcggatcccccaaaccgaaccctcccgagctcgcccggcgatggggatctcgagcatgccggagccgcgggacagcctgctggggtacctggtgtacaacgcggtggtgtcgatcgcggcgctggcggggctggtgcgggcggcgctggtgttcctggacctgcaggccgcgcagctgcccgggggcgcgggagcgggcgcggacgacgacggcggggaccgtctcgcggcgtcgggccccggcccgggcccgggcctgggcctggcggagcggttcctgagggccttccggccggcgctgtacggggtgctggtgtccacggcgtgcggcgcggcgga

SEQ ID NO: 11649 - DNA, 640 bp, Zea mays
  unsure (1)..(640): unsure at all n locations; Clone ID: LIB3279-189-Q1-K6-B8
acgacaccgcgttcagccgctctagaaccctagctccccgccccgcgagatggccactgccgacggcgagccccagcccgtggccaccgaccccgcccaggtccaggctccggctccggcaccggcaccctacccctccccggccaagcgcaagcccgaggcggatgcggaagccgacgccaacctcgcgccccctaaagccgcgcgtcccgacgtcgacgaggaggccgccgctatggccgaggctgccagggccagtgctcgcgcggctgacaagggtaagggcaagatggtagtcgaggaggaggaggaggaggaggaagacgacagcgaggagagcagcgacgacgacgagggcggcggcggcggcagcagcagcgatgacgacgagctcgttgaagacccgatggccgaggtagacctcagcaacatcctcccctcgcggacccgccgccgcgcccccccgcagcccggggcgtacctcgtcactccggaggaggctgccgcggaggaggacgacgacgacgctgacgtggttcctgaggaggatgagggagcggagggagaggagagcgattaaggctacctcggcacggactcactaggaatgatgaatggtggctnttggtgctgggtatct

SEQ ID NO: 11650 - DNA, 651 bp, Zea mays
  unsure (1)..(651): unsure at all n locations; Clone ID: LIB3279-189-Q1-K6-B9
ccgcatccccggctgaggcagcagcggcggcgccggcaccggcaccggctcaccagcgataccgggaagaatggggaggtacagtcccgcgtacagccccccgaggagaggacatggcggcaggggaaggagcccacctcccaggagaggatatggcggtggccgtggtgaccatggctctgtcagcctcctggtccgcaacattccattgagatgcaggcctgaggaactacgtgtccctttcgaacggttcggccctgttcgggatgtttacctgccaagagattatcacactggggagccaagaggatttgggttcgtggagttcgttgatgcttatgacgcttctgaggcacagtaccacatgaatcgccagatgtttgctgggcgtgaaataactgttgtacttgctgcggatacacggaaaaggcctgaggacatgcgtagacgaactggaccaagaggttattctggtcatgaagggcgtcgtccgaatcgtcatggtgcaggacggtcccgatctcgttatactcgcgttcccgctcaccgcgccctcgtggtcgtggtagatcacagtcatactcccctgccccgaaaaggcgtgatgactactctgcttcnccacctcggcaaagaagacacccgagtcat

SEQ ID NO: 11651 - DNA, 634 bp, Zea mays
  Clone ID: LIB3279-189-Q1-K6-C1
gcaaaatctagccagacagctgaggaagggtgaaagcctccttgttcctgtagactgcagtgcgaggaggaggccgccgcatcctccccttccaaaccactccactccggtccccatcccacctgcgccagcttcgtcttgctttgagctttcgcccgccggcgatctgctagctatctcgctcgcacgtggtgcctgactgcctggtggcggtggccatggctgccccgctgggctttttctgcatgctgctgcttcttcttcttcagctgggccactcttcttgtaacaatgtgtacattgtgtacatgggggcgaggaatcccgagctgcacccggcgctggtccgggacgcgcaccacggcatgctcgccggccttctcggcagcgagcaggcggccaaggacgccatcctttacagctacaggcacggcttctccgggttcgccgccgtgctgacggacagccaggcggcgcggctcgccggttcgcctggggttgtgcgagtggtgcggaaccgtgttcttgacctgcacaccaccaggagctgggacttcatgcgagtggatccatcgcattcggctggaatcctcccagagagtaggttcggtgaggattccttatcggtgtgcta

SEQ ID NO: 11652 - DNA, 682 bp, Zea mays
  Clone ID: LIB3279-189-Q1-K6-C10
cggacgcgtgggttgctgctgcaacaagatggatgcaaccactccgaaatactccaaggcacgttatgatgagattgtgaaggaagtctcatcctacctcaagaaagttgggtacaaccctgataagattgccttcgttcccatttctggttttgagggcgacaacatgattgagaggtccaccaaccttgactggtacaaaggcccaaccctgcttgaggctcttgaccagatcaccgagcccaagaggccttcggacaagcccctgcgtctgcccctccaggatgtgtacaagattggtggtattggaactgtaccggttggtcgtgtggagactggtgtcatcaagcctggtatggtagtcacctttggtccaactggcctgactactgaggtgaagtctgttgagatgcaccatgaggcgcttcaggaggctcttccgggcgacaatgttggcttcaacgtgaagaacgttgctgtcaaggatctcaagcgtgggttcgtggcctccaactccaaggatgaccctgccaaggaggctgccagcttcacctcccaggtcatcatcatgaaccaccctgggcagattggcaacggctatgccccagtgctggactgccacacctcccacatcgccgtcaagtttgctgagctcattaccaagatcgacaggcgatctggc

SEQ ID NO: 11653 - DNA, 313 bp, Zea mays
  Clone ID: LIB3279-189-Q1-K6-C11
aaatacaagagacgaactttctgcaagggaccgtctttacacggctttctatacatattggctcttaactgtatttaagattctagaggctcagagttgtatcatgtagtcttttagctctctcttttttctataaaagagatccagtgtctcaaggttgtacatgtctttagactctctctaggagctcacccatcctatcctccatctcatctcttatttcaaactccactttacgaacagtacaatctacagtgcaaaacaatgttttgggtgactatatgaataatctgttgcatacggtcttagaccg

SEQ ID NO: 11654 - DNA, 652 bp, Zea mays
  unsure (1)..(652): unsure at all n locations; Clone ID: LIB3279-189-Q1-K6-C12
cggcagccaagcagaaaaatacgagtatcgcacgcgcaaggcgattccgtccccattctccacccaatagggagctagagctacgagacggggaaaggggggacgggaataggcgtcgtcggccatgtcgtcgtcgtggaactcggtgggtctggcgatcctgtaccaggtgctgggctgggtcgccttcgccgcgtggtccttcagcttctacccgcaggtcctcctcaactacaagcgcaagagtgttgtgggcctgaatttcgattttctggtgttgaacttgacaaagcactcgtcctacctcatatacaatgctgctctcttcttcagcccattcatccagcaacagtatcatgacaaatatggtgataaagagatgattcctgttgctgcaaatgatgttgctttttcactgcatgctgtagcattgacagcctttaccgtttttcaaggatncatatatgagcgaggaacacagaaagtctccaaagtttgcatatcaatttctgctattgtctggatcgccgctcttgtttgcctcattattgcttggccaaaaagtgactggctttggcttattgatgtattcaattcaatacaagttggcatgacagcgatcaagtacatccctcaggccatcatgaacttc

SEQ ID NO: 11655 - DNA, 652 bp, Zea mays
  unsure (1)..(652): unsure at all n locations; Clone ID: LIB3279-189-Q1-K6-C2
atagatgcagcaattgtcactgttttacagatacatgttacccaatcccctggcgatatcctggtgtttctcacaggtcaggaggaaattgaaacagttgatgaaatccttaaacacagaacaaggggcttaggcaccaaaatctcagaattaattatatgtcctatttatgcaaatctgcctaccgagcttcaagctaagatatttgagccaacccctgagggtgcccgtaaggtggttctggccactaatatagcagagacttcattaaccattgatggtataaaatatgttattgatcctggcttttgtaagatcaaatcatacaatccccgcacaggaatggaatctctacttattaatcccatctcaaaagcttcggcaaaccagagggctggaagatctggacgcactggacccggaaaatgcttccgtctatacacgagttacaactacatgcacgacctagaagataatactgttccagagatccaacgaaccaatcttgcgaatgttgtgcttacactcaagagtcttggtattcatgacttggttaactntgacttcatggatccacccccatcagaagccctattaagggctctggaacaactttttgctctcagtgcactcaacagtcgtgggggagttg

SEQ ID NO: 11656 - DNA, 530 bp, Zea mays
  Clone ID: LIB3279-189-Q1-K6-C3
ccccgcgtccgctcgcatttcttcccatccgatccccccttcgcaaccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctgaggccgccaagctcgcgcgctataacaagaagcctaccatcacctcccgtgagatccagacctccgtgcgcctcgtccttcccggggagctcgccaagcacgccgtctccgagggcaccaaggccgtcaccaagttcacctcggcctaggctgc

SEQ ID NO: 11657 - DNA, 670 bp, Zea mays
  Clone ID: LIB3279-189-Q1-K6-C4
ccccgcgtccggatcatcccgatgatggatatgatacagatagatatcctatgccagaatggaccttgccatcttcatttgattctgatgatcctgtgtaccgctatcggtgccttgtgtctacaccaaacctcatggtgcgtgctgttaacaatcctgatggatgggatcatgattgtggatttgacggtgtgagtgtccaacacaaccataatgttgctaacaaatatccagcttctctgtgggttcaagttaacaaggacaagaggcagttcaccattcatttggattcctcaatgtcagttaagcatggtgactatgcctcgagcctggctggctttgacatccaaacaatgatgaatcagcttgcttacaccctcagaggtgagaccaaattcaaaggcttcaagaaaaacatcactactggtggtttatccatgacttttttgggaaataacatggtagctggagcaaagcttgaagacaagcttttaattggtaacaggctaacactgtcaggcaacactggtgctgtatccatgagaagtgatgctgcatatggagtgaatgtggaggcaactcttcatgaaaaaactatcctgtaggtcaaggccttgccactttgggtgcatccttagtgaaatggcgaaagagtggaccatgactgcaa

SEQ ID NO: 11658 - DNA, 660 bp, Zea mays
  unsure (1)..(660): unsure at all n locations; Clone ID: LIB3279-189-Q1-K6-C5
cggacgcgtgggttcagataaggactatacatataggattttgaattttcaggatggacagataacgggaaatatccgttacgttttcatccctcatgtcaccagatctgtaaaccatttggtgttatcctgtagtcagcgtatctggtttggacaaattagacgttgcgtttttgtgttttattatatgattattataggattcttgtctcatgcttttcagcagtccaagctgaagcaacctgcaaatagcaatgcggtatctgccgactctgggatgtcgaaccctggagtgaaaggtgattccagtgtttgtacccctttgaggcaggctaggtctagtctgtctctttcctttgctggtttgactggtgagagtagtgcgggagaccaccaagattgtgtggtatcatcattgcttcttatgggtgagcctccttggcagcctcctggccccgagggctcaattgctggaggtagtagagacagtgcactcacacgatacaagngagaagaaaatgagaagaaagttcgacaagaaaatcaggtacgctttctcgtaaggctagagcagatgtgcgaaagagggtaaagggtcggntttgttaaggctggtgaagcatatgactatgatcctctctgccaacgaggagtactgag

SEQ ID NO: 11659 - DNA, 624 bp, Zea mays
  unsure (1)..(624): unsure at all n locations; Clone ID: LIB3279-189-Q1-K6-C6
atttgcccagtcatctttcactgtggcaaacatttttgatggaatattctggttcatcctcccagcttcgttaattgctatcaatgatgttgctgcatatttctttgggttcttctttgggaaaacaccactgatcaagctctctccaaagaaaacatgggaaggctttataggtgcatcagtgacaacattgctttctgcatttgtggttgctaatttcatgggccatttccagtggttaacatgcccaagaaaggatctatcaactggatggctttattgtgacccaggtcccatgtttacaccagaaggttatgatctaccgggatggataccacaatggtttccatggcgagaaattgcaattatgcccgttcaatggcatgcattagctcttggcttgtttgcttcaataatagcaccatttggtggcttttttgcaagtggattcaagagggcattcaaatttaaggattttggggacagcatacctggtcatggtggatttacagataggatggactgccaaatggtcatggctgttnntgcgtacatctattaccaatcatttgtaatggtacaggacttatctgttgagacatcctggagcgatactacgtaatc

SEQ ID NO: 11660 - DNA, 683 bp, Zea mays
  unsure (1)..(683): unsure at all n locations; Clone ID: LIB3279-189-Q1-K6-C7
cccacgcgtccngaacaaaatttcagtcacgtaaaatattaggagacccgtttgttctctcctcttttctgaaggctccaacgtgctcgtcgcctcgcctgggacgggaacaaacccgccacctcgccgtctccggctccgaagaccaaaagccagtcgttgcctccttggttccgcttccgcccgctcgactcttgcttctgcttccgtcgcaggcgggggccatcgaccgataagggttccgggatggacttgcaagcggcgaggctcgacgccgcgcgccagcgggtgtatacgggggcgccgacctcctccgcgctggggcagccccagccccagccccagcatctcggcgccggcgaccgccgccgctgccttcctcctcgccctccgacttctagaggcgagacgcgcagcggcggtgtggggaaggcggacgaggtgcgcggtactcgggatcgggacacgcggcacggcagcggcgtgatgacgtgctactcggtggctgttgtaacgggcgacggggcgcctggggtggcgcggaaggacaagggagtcgccgagttgggcggcaagaggtgtctcgacttggcagaggagaagggagtcagcgacgcggggagggaagatgggcctggcttggcggcgtacccactgcgccctgcctaagcgagctagtgtcg

SEQ ID NO: 11661 - DNA, 586 bp, Zea mays
  Clone ID: LIB3279-189-Q1-K6-C8
ttcggctcccacctcgtctactacgagaggaccataaccggcaagctctccagggcgccatctcggacctctccggcgtccaggccaagaagctcttcctctgggtctacgtcacggggatggtcgcgcaccctgaccagggcaccatcgagttccaggccggcttcatctcggagtcgctatcggcctcgatgtttgacgaggtgcccacctgcggttccagcgttggcgcgcagctgcgcggcgcggctggggtgatcggcgagcttgggctgctccccgttgcacaggcctgaatgtgggttggagaagtccacatacagtcccagagaaccgcaggaccttaccgtctgctgtcgcgtgagccctagagtgcaggaggcgttcagccgtggtgtgttctgcttctgcctgtacgtaccagtgtctggttgttgctcccggtgtcaaatggacatggatgatatgtagaaatgtatgtctataatatgctgttacggaacatgcgtaggatgtaggcaaattaagccttcctcagtctcttgtagtcccggactatcgtgtgtggaaccatgaacttcccaac

SEQ ID NO: 11662 - DNA, 632 bp, Zea mays
  Clone ID: LIB3279-189-Q1-K6-C9
caatatcctgccgtgccctcgctgcaacagcatggacacgaagttctgctactacaacaactacaacatcaagcagccaaggcatttctgcaagagctgtcagaggtactggaccgcaggcggaagcatgagaaacatccccgttggtgctgggaggcgcaagagcaagagctccagcgcgagttgccgcagcgtgttgattcccgttccaggcagcagtagtgtagctaatcctggcggagaggcttccctgtttccgttgtccgtaaaagcaaaccaagcagcagttagcttcgggcctgattcccccctctgcacctccatggcctccgtgctgaagatcggaggaggaggagagcaggttaagagctgcagccctgcctcagcagcagcacagcccaggaacggagaaacccagacccagacgtgcgcaccttcttctgctgctacaacaccatcagatggtccagggaatggattgcagaaaggagcagagagcgcacaccaaaaccaaaaccaaaaccaaaacggaatcattgggcacagcaacggagtcactccagtgcatcctataccgttcttccccggaccgcctttcgtgtacccctggagtccagcatggaacggcattc

SEQ ID NO: 11663 - DNA, 548 bp, Zea mays
  unsure (1)..(548): unsure at all n locations; Clone ID: LIB3279-189-Q1-K6-D1
ggtagcagccaagagcgcgccgagatcgcgaggctgcgggagctcaacaccctcaaggccacgtggagtcggtggtcaagctcaagggcctggacatcgacaccatccagcagaactacacggtgtgagatgtgtgctgtgatgtcgacgaaaacacctttgccatgccacccttgttgttcttgcgacgacggagtcatgtgattgttacangaaaaaaagaagaaaattttccggtgatgtgattggagacaatagaagcgtgtacgtacgtacgtgtggctgatcctgaccccgagcatgcagagcagccctaggtgaggtgaccattgccaccagatatatacccgtctttctagcttagctagggagcttcttcttcttttttttccctcttgttattgtcaagtgtgtgcgcgtgttgtaatggttttactcgcctaactagccggtggtctcgcgaggcgaagaaataatgcaaccgaaagcattattgcnnnaanaaaaaaaaaaaaaaaaaaaaaaaaaaanannnannannnnnnggg

SEQ ID NO: 11664 - DNA, 668 bp, Zea mays
  Clone ID: LIB3279-189-Q1-K6-D10
gggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgct

SEQ ID NO: 11665 - DNA, 695 bp, Zea mays
  unsure (1)..(695): unsure at all n locations; Clone ID: LIB3279-189-Q1-K6-D11
cggtcgcgtgggcggacgcgtgggaccacggttacttccatttttggttggttagaagcttttgaatgttgccttacctaagtttgggtttggtttggagaccaaacaggatggggtggacctgtctctgattttgaggatgggaccatcccaacttagcgtttggttgaggggatagagtcatcctagttttgtggttggaatgttggatggattgaaggggagggatggtactgcttcttaacaccgttaaacagcagccaactatggccccacttgcctttagttgacctcacaagtcatcctcaagttttttttttcatgcacaccttatcttcatcctggtgccgctcttggcctcacgacccctcctcagagaacccctgctcgccagccccctgccctcctccaccagtagatacatgtttggtataagacttcaacatgtgtacttaatttgcttgcaaatggccagattgactgaaaccttaaatagtataaacagcaaatcaaagttctatcatttctggtaatttttctgaaggtaagacctaactgtaggatgctattgaactattggacaaaaaagtctattcctgttttgtctttttgaggggaaataatgtaangttatgtttntgtcgcttaccaaatgtaaagctagatcagcctatactgctgttaatttatgcata

SEQ ID NO: 11666 - DNA, 643 bp, Zea mays
  unsure (1)..(643): unsure at all n locations; Clone ID: LIB3279-189-Q1-K6-D2
atctttggagatggagcgccaccagaagccatcaacggagggagatggagtccagttcgcaaccgtggcagcacccccgcattacccagcagatggagatggagcgccaccaccagcggagtcatcaacagagggagatggagtccagttcgcaaccgtggcagcacccccgcagtacccagcagatggagatggagcgccaccaccagcggagtcatcaacagagggagatggagtccagttcgcaaccgtggcagcacccccgcagtacccagcagatggagatggagcgccaccaccagcggaaccatcggcaaagggagacggagtccagctcgcaacaatggcaccaccaccaccaccacccgaatgaccagatgatggggctggagagctaccggagtaatcagcaaaggcagacggagtccagttcgcagcggtggccgcagcacaggagctaccagcaaatggagatggatcccagttcgcagcaacggtgggcgcagcaccagaggagcaaccagcagcagcagatggagatgatggagcggcaccacctgagtaaccagcaaatccggagtacccagcanatggagaggagggcgatggtatccgggggtggtctggcccttggtctcgcata

SEQ ID NO: 11667 - DNA, 610 bp, Zea mays
  unsure (1)..(610): unsure at all n locations; Clone ID: LIB3279-189-Q1-K6-D3
gttttcctttataggatgttgtgttctagccatctcacttcagctcaagtgttctttcttggctaaggtctgcaactctttggtagagtatatcatattattcactttgctagccgcttttatggtaaggtagaacaagtaggaaacaatgacatgtgcagttccatttaccttgtttactcaattcttgcaggcggagacttgcaacagttatggtgaagctcaagtttgcagagcaccttaaggaggctgtgacgtacatcgaacaggggcatgtgcgtgtcggtccagatgcagtcacggacccagcctttcttgtgaccagaaacatggaggacttcatcacctgggtggattcctcaaagatcaagaggaaggtcatggagtacaatgatgcattagatgattatgatgccatgttctgagaaaatcattctgcagaaatttatgtgcccgtcagtagtgtaatcttaagcctgccacatatgggtcttttctgaagaaactgtgggagttgtcttctgcaggctacttgcatttgtattgcacctgcagatgtgatgcaattntgtggttggttgaaggcacattataaattcatatctgatgt

SEQ ID NO: 11668 - DNA, 666 bp, Zea mays
  unsure (1)..(666): unsure at all n locations; Clone ID: LIB3279-189-Q1-K6-D4
cccacgcgtccgcagttatgaagtttcttcccaccaattgccaccaaattatttgttctgggcaaaggcatggatgcttgttggtgacgtctatgcagaatatcacagattgaatagtcatcaagcaaagttggcaccagaacagaagtctcatggcgaagttagaatgtcaaatgaagttgcattggaggtcaaacgccttaagagaaaactgggaaaggataagcagaattgtgacacatgctctttgataaactgtagctgccaaagtgacagggcaagtagtggcagcagtgcaagcagcagtagttctgaggcctctaaactttacagccgaaagaaaaacaaaaaatcacttggtaagaaccttcaacttcaatcacaatatagagaagccagcaagaaccccaatgcacaagaagctacacaaggttctgaaaataaacagcatgatgtgaatgatacttgtattgagaacaactcagtattaaatgatgatattggtcactacngtcaggccagggaaaatcagtcaagaaatgttgatggtgttcctgataaatctcaagcaagtgttcctactgtgagggatggtggtatcttcaagttccttggtggtccaaaccaggagatgttgagtacaacttgtcttctgctattcactgc

SEQ ID NO: 11669 - DNA, 655 bp, Zea mays
  unsure (1)..(655): unsure at all n locations; Clone ID: LIB3279-189-Q1-K6-D5
ttctactctctgtgtctcgtttacacttattccaacacgttatcagcacgactcgcgagatcagagaagaagcgagagataaaatgagtcgtagacatcggcaagaagatgtccgttgctcgttggatcaaacaaaaatgtccttcgtcatgttctaggattgcgccgatgcttgaccacgcttgatccgcgctggtggccgcccgggccgccgcaggacagcgaaccagggccaccacgcccgggccgccatgccgagcacgcctcactgcggctggccgcgcaccgaggccggggccgcgtccccgtgccgccagagggccacgcccacgccgggccgtggggccagcgccgctgtgcccgcacgccgtggctgggcagccgctcccgcgctggcagccgccgctcctggccaggccgccgggggacgtgcccgcaccagacagcacgcgcaaccgggggcgccgcgcgtccgagcagccggggaggccccgctgcgagccgtgacccgcgctgctgtggctgggccaccgcgccccgggccgcagggagccgcccccgcaccgccgaggctgaggccgccggggcaaggcagcacgccgaggggctgccggngccgcactcccgtggagccgcgccctagagccgcgctgca

SEQ ID NO: 11670 - DNA, 583 bp, Zea mays
  Clone ID: LIB3279-189-Q1-K6-D6
aaatctccaaacgcacagacccctagcgccgccggtctcttcagcctcgcagcacaccgccgccagcccgagtgaccgctgcagcctagggtttccggcggcgatggcgggtaagggagggaagggtctgctggcggccaagacgacggcggccaagagcaccgacaaggacaaggacaggaagaaggcccccgtgtcgcgctcctcccgcgccggcctccagttcccggtgggtcgcatccaccgccagctcaagtcgcgtgcctccgcgcacggccgcgtcggcgccaccgccgccgtctattccgccgccatcctcgagtacctcaccgccgaggtcctcgagctggccggcaacgccagcaaggacctcaaggtcaagcgcatcaccccgcgccacctgcagctcgccatccgcggggacgaggagctcgacaccctcatcaagggcaccatcgccggtggcggcgtcatcccgcacatccacaagtcgctcatcaacaagaccgccaaggagtgaatccaggccgtgctgctgcttctgcctgactacagtcccatctcgttctgtacttgtgctatc

SEQ ID NO: 11671 - DNA, 569 bp, Zea mays
  Clone ID: LIB3279-189-Q1-K6-D7
cacagacgagggttctatgaggggttccatacagcgtattattagaagcaagggttagcctaaggatgagcttgggacaggacaggttacatgagttaggtctttgggaaatgggagaggatgtggctctgggtatggactgttgaagaggataatctataccaaagagttgttctattaaatgctgtcttcttgggcaagaacttgtgggaccaccttccggatgcatttcctaataaatctagtcatgaacttggtagctactatgttaacgtttatatgctcaggaaaatggctaagaaaaacacgtatgacatgatggctgaggacagtgatgatgataaactgcatggtgaacctctagctgaacctgtggaaggggatcctgcaggtgattcctctacacatgaacattctgataaccattctgtgaccatggatgatgaccatgatgagttcgaaggagcacaggttggtgaatatttgggtgaaaagtcaggatacaatgcagtctactgcacacatctaccaaatcatatgcctgctgatttaactgcggagaacactgc

SEQ ID NO: 11672 - DNA, 593 bp, Zea mays
  Clone ID: LIB3279-189-Q1-K6-D8
cggacgcgtgggtcctagtagccgtccgcgcaaaaccctccctgctcagactcgtctgctgcagctcctcctccgccgccgtatcaaacgcactctcctccgccgccgcccgaggcaagatggttctccagaacgacatcgaccttctcaacccgccggcagagctcgagaagctcaagcacaagaagaagcgcctcgtccagtcccccaactccttcttcatggatgtcaagtgccagggatgcttcagcataaccacggttttcagccactcccagactgttgttgtgtgcccaggctgccaaactgttctctgccagcccacgggaggaaaggcgaggctcacggagggatgctctttccgccggaagggagactagagctgagtctgttattagtactggatcggttgtcaatctccagtatgtggtcttcaagttttgctctgtgccccagacgttagggtcatgaacttccttagctaaggctttccgcatgttgttctgtgctgctatgtatcgcacgttggttcttgctgaacttatagcttgtttggttcggattatgataaaccaaatggatatttgaattat

SEQ ID NO: 11673 - DNA, 672 bp, Zea mays
  unsure (1)..(672): unsure at all n locations; Clone ID: LIB3279-189-Q1-K6-E11
cccacgcgtccggtcgcctccactcccagtcatctcccatcaccgacgacgtgtcgaggcgagagaagagggcgagtccaagtctagggttcccgccgcatcgacacgggcatcgcaccgcaccgcgaggggcgggcacggaggaagatggcaccgcgcgggcgcgtggagctgcggcggatcgaggacaaggcgagccggcaggtgcgcttctccaagcgccgcgcggggctgttcaagaaggccttcgagctggccctgctctgcgacgccgaggtcgcgctcctcgtcttttcccccggcggcaagctctatgagtactcctcctccagcatagaagatacatatgaccgctatcatcaatttgcgggagcaggaagaaaagtgaacggacataacaacgataaccgggatgtagctgcttcagatttacagtcgagacttaaggagatcgcaacatggtctaaacaaaacaacgctgaggagtcggatgccaatgaacttgagaaacttgaggaactcctgacaaatgctttgaggaatacgaaagccaaaaagatgttggcaaaagaaaaccatggtggtgccggtgcaagtacaagcagccagatgttgctttactcggcagagcgtgcaaccgacaanatgaacggggcgtgcatctgttgctac

SEQ ID NO: 11674 - DNA, 629 bp, Zea mays
  unsure (1)..(629): unsure at all n locations; Clone ID: LIB3279-189-Q1-K6-E12
gtcgggcgggcaggccacgggcaccttcgggctgacgggcgtgtcggtgtgggaggcgctggtgctggagatcgtgatgaccttcgggctggtgtacacggtgtacgccacggcggtggacccgaagaagggcagcctgggcaccatcgcccccattgccatcggcttcatcgtgggggccaacatcctggtgggcggcgccttcgacggcgcgtccatgaaccccgccgtgtccttcggccccgccctcgtcagctgggagtggggctaccagtgggtgtactgggtcgggcccctcatcggcggcggcctcgccggcgtcatctacgagctgctcttcatctcccacacccacgagcagctcccctccaccgactactaaaagccgaagccgaccgacccaggggtgcgcagctagcatccagctctctctccccgctcgccgncgatcgtttagtttctctcgtgcacgtgcatgcatcgtcgactgtctcaggccgccgctgcgccggcgccgctcgcatcgtttgcttttccttggaccagcagtcgtcgccgtcaggctgagctgcttgtaaccgtgaatccggacccgtttgcttctgtaagatttgtgcatttgcctgagt

SEQ ID NO: 11675 - DNA, 524 bp, Zea mays
  unsure (1)..(524): unsure at all n locations; Clone ID: LIB3279-189-Q1-K6-E2
ccggcccgcccctcgcgcccgccgctcacgccggcgctcgacaagcccaactccgccgccgcgcggaggaactcgcgctccaacaagcccgtgtcctcgaggtacctgcccgccgccgcgtccccggcctcgtccacctcgtcgtcttcctcgtcctcgtcctcgtcccgccgctccctctccgcgcagcgcgcccggtcgtccaccccgcctccgcagcactccacgtcgcccaccaccaccgcgtcggcagcggcaaccgccaccgcgaccacgatgcggagcctctccgtgtcgttccagggggagtccttcttctacaagacgtcgcgcgcgccgcgggcctcgtcgccgtcctcaccggcagcgcgccgcgggcccacgccggagcgccggaagagcgtctcctccgtgccggaggccgagaacgccgcgggggaccaggcgggggcgccccnnctacggccgcgccggcgtggccccgcggcgcgccgccggagtggacggtgacgaggcccgcggcg

SEQ ID NO: 11676 - DNA, 662 bp, Zea mays
  unsure (1)..(662): unsure at all n locations; Clone ID: LIB3279-189-Q1-K6-E3
gtgaaagaggccagtcaggnggaagaagaaggagggcagcaagcacagagggttcccaacgatgaaaattcgcctccaaatttgttcgctaggatttcgggaggatttcttgagctatggaagcacgttgcggggcttgttctcaagatgatcacagcgatacgagatgtggtccgatctttgtgtcttaaagctgtcgttgcttttcttcggtcatcgttgggtgtggtgctggtaagatgggtgatggataaatttggtatactgggcgtccggaatgcatggtatgacccgagcaaagtaactgatcatgtcatacaaggctacacaaagcctctaaaatccaagggttgggagacagctctgctggaacacaccgtatccatgatcatagattctgtgtctgcatcaagagtaccagtttcaaagaggctttctgagatctcatgcccagtgctagtggtgacaggtgacaccgatcgcattgttcctgcttggaatgccgagcgtgtggcacgcgctatacctggagcaacttttgaggcgatcaagagttgtggtcacttgccccacgaagaaagcctgaggaattctgtccgtcgttgaaaatntctacgnacacgtttgcaatccaaagaacagtatttcagcagctgatatga

SEQ ID NO: 11677 - DNA, 618 bp, Zea mays
  unsure (1)..(618): unsure at all n locations; Clone ID: LIB3279-189-Q1-K6-E4
cccagcgtccggngggaaaaccagnaaaagnaggagnaaaaaagaagaaaaaaagggggaaagagaaagacaaccaagaccccaatttagccttagcacgtgccatctcccaaagcctggcatcctcctggatctgttgcagaactgtattcgtgtttggggagacaccatcaaaaatacaaacatttctgtgcttccagatccaccaagccacgagaataaccaatgtgttgaacccttccccatgcaaaaatggcacaagaccttcagccatactccaccaaccgaataagacccgagggatattattaaagcttctagaccaagatttgggctgccaaggaagactattaatttggaatgtattgtacaaatttatttgtagtagtaggaggaggtagtgagaagaaggggaaccatagattaccatnacaagtgatcaaaatattgcttaggactagcatttcatagctttatttgcggcaggaagtagttcgtggtgacgagcatatctggggtctgttaagatggagattataactataagttagcttctatatatatttgttatgacaatagaaactatgtttttaatgaatggtttctttatttttagct

SEQ ID NO: 11678 - DNA, 593 bp, Zea mays
  Clone ID: LIB3279-189-Q1-K6-E5
gttcgccaagcgtgccttcgtgcactggtatgtcggtgagggtatggaggagggcgagttctctgaggcccgtgaggatctggcagcgctcgagaaggactacgaggaggttggtgctgagtttgatgagggtgaggaaggtgatgatggtgatgagtactagaagtatcctgatgcggtcatcgtcaggcttgtgtgctgctcttgtccccgttgtggtttgcaacacctgatgttgtaagactttctggttatgtccgccccgctttgccactgggttattaagaacgtcgttatggatggttgtctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcggcccgttttaaaggatcaaattttacttccccgtgcttgcaaagtaatagtttttttttagggcccccaaaataaaattcccgggccggcgttttaaaacgtggggattggaaaaaccttggggttcccaaattaaatcgctttgaagaaaatcccctt

SEQ ID NO: 11679 - DNA, 605 bp, Zea mays
  unsure (1)..(605): unsure at all n locations; Clone ID: LIB3279-189-Q1-K6-E6
cttctatgagacaaaattgattgtgttgatggtcagatagttggtctttttggagtttttgatggtcatggtggtgctaaggtagcagagtatgttaaagaaaacctgttcaacaatcttgttagtcatccaaagttcatcagtgatactaaagtcgctatagatgatgcttataaaagcaccgacagtgaattcttagaatctgacagtagtcaaaatcaatgcgggtcaactgcatcaactgctgtacttgttggtgatcgtctcttcgtcgcaaatgttggtgactctagggctatcatatgcagggaaggaaatgctattgctgtttcaaaggatcacaagcctgatcaaactgatgagcggcagcgtattgaagatgctggaggttttgtgatgtgggcaggaacatggcgcgttggtggtgtacttgctgtttcgcgtgcttttggtgacaaactcttaaagcaatatgtnggttgtggatcccggagatccgagnaggaagttgnttgatgacancactcgagtttcttatccttgcaagtgatgggctgtgggatgtggtctctaagaggaagctgntgcgatgactagatccatta

SEQ ID NO: 11680 - DNA, 667 bp, Zea mays
  unsure (1)..(667): unsure at all n locations; Clone ID: LIB3279-189-Q1-K6-E7
caaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgccagctcttccaccctgagcagctcatcagtggcaaggaggatgccgctaacaatttcgcccgtggccactacacaattggcaaggagattgttgatctgtgccttgaccgtatccgcaagcttgctgacaactgcaccggcctccagggcttcctggtcttcaatgccgttggtggtggcaccggctctggccttggttctctcctccttgagcgcctgtctgtggagtacggcaagaaatccaagctgngcttcactgtgtacccatcttcccaggtgtc

SEQ ID NO: 11681 - DNA, 655 bp, Zea mays
  unsure (1)..(655): unsure at all n locations; Clone ID: LIB3279-189-Q1-K6-E8
caccaacccagctcgctcgtcccagctgatcaggtcgagcacctagtagcgacctgctcgatcatcagtgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgggttccagtcccggcacgagtacctgttcggcaagatcgacatgcagctgcggctggtgccgggcaactccgccggcaccgtcaccgcctactacctgtcgtcgcagggcggcgcgcacgacgagatcgacttcgagttcctgggcaacgtgtccggcgagccctacacgctgcacaccaacgtgttcacgcgggggcaggggcagcgggagcagcagttccgcctctggttcgaccccaccgccgacttccacacctactccatcctctggaaccccaagcacgtcatcttcatggtggacgacatgcccatcanggacttccgcaacctgnaagcaggggggtggcgttcccc

SEQ ID NO: 11682 - DNA, 668 bp, Zea mays
  unsure (1)..(668): unsure at all n locations; Clone ID: LIB3279-189-Q1-K6-E9
caaattctcaaggagctcagtctgagaatgatcctaacaataccactatatttgttggtgggcttgaccccaatgtcactgaagataccctaaaacaagttttttctccttacggtgaagtcgtccatgttaagatccctgttgggaagagatgtggttttgttcagttcgttaccagaccttctgctgaacaagcgctgctaatgctgcaaggggccttgattggtgcacagaatgttcgactttcatggggtagaagcctgtcgaacaagcaggctcagcctcagcaggaatccaatcaatggggtgcggctgctggtgctggtggctactatgggggctatggacaaggttatgaggcttatggcagtgggtatgcacaaccccaggatcctaacatgtatggttatggcgcttatggcggttatcccaattaccaacagcaaccagctgcacagcagcaacagcaacaacagtgatgcctgtttgctcgggtaggtcattgngttgtcgcgacggaattaattaaatattatttcaggacactctcatattgcattcttgtcaattgaggtggttttgaaaggctcctgattntgatggccccatggcacggtttcatctatttattagtatatgacatatatgcgctgtgaacaagtggcgct

SEQ ID NO: 11683 - DNA, 647 bp, Zea mays
  unsure (1)..(647): unsure at all n locations; Clone ID: LIB3279-189-Q1-K6-F1
cccacgcgtccgccccgcgtccgagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgccaagtcccccaagaaggcatagggtttggaggcggatccgatgttgtcatgtgtaggttgtaagcgggcaatgtgattggctgtgtatctgcttcgctcaagttgctntatgtcattcctaatggaatagg

SEQ ID NO: 11684 - DNA, 564 bp, Zea mays
  Clone ID: LIB3279-189-Q1-K6-F10
gctacacagtccgccgtggctctctgcaattaatggctgcctccacagcgtcgtcgtcatactctgccggtgtaagcgccgcctgctgtgtgtctccgcgccatggcagcagcttcgtcaagccgcagcgctctggacggccggcggcggcggcggcgaccctacctgcgtcaggcggcgaccagccgaacctatcgttagactgctgtcgtacgtgcatgcgtgcgtgcgtgccttgcattgccatctcacatatattttccgatgaacgtaacgagcggaacaactcaccattgatctgtaggtaggagtaagagtagggctagaagaggcgagcgaatcagggcttcagatgatgctgcgaccatcatggacgcgggcggctgggcagcacggcttgaagccccgccgccggtagccgtcgtcactggagcgtctagagggattggcagagccatagctgtagcacttggcggagcagggtgcaaggtatctttttgttattgctgcgctagctgccatatatactgtattgattacgataagcaagaacactcgtttaca

SEQ ID NO: 11685 - DNA, 670 bp, Zea mays
  unsure (1)..(670): unsure at all n locations; Clone ID: LIB3279-189-Q1-K6-F11
gattgatcctcctctatcttctttcctgaatgaagtcttcataaagttggatggtgtttggggtctccttgggactgctgctttcgcattcttttgcttctatctccttattgcagtgattgctggggagatgatgcttggtttgaaacttgttttcatcacaattcacccaatgaaatggggaggcactttaatgaactcctttctgtttaatgttgggctcatactactttgctccatcagtgtgattcagttctgtgccacggcttttgcctattatgcacaagcaactgctgctcaagagatctttggccacacattgcaatcccttcgtggaattaagtatctttacaagtacaatgttttccagtatggctttgttgctcttgccatcctcacactcttctactatgctatatttgggtggagaaaaaagaagccaacagggaggttccagctctcaaaatgattcatcacatttcccccctgagtgatagttcagttagcgtcgtacggatgtatatgaacgaaaccaaatcttttcaaagagctgaggagctgcaaatggtgtatattatcaactacgtgacctcaaagccgagatgttggttaccacggacatggatgttagaagtagaaaccagttaactntgcagcgtttggtggtttt

SEQ ID NO: 11686 - DNA, 635 bp, Zea mays
  unsure (1)..(635): unsure at all n locations; Clone ID: LIB3279-189-Q1-K6-F12
ctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggnggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgngttaccgttcgcttctgtcaccgtgttagtgtccgttctaccttt

SEQ ID NO: 11687 - DNA, 652 bp, Zea mays
  unsure (1)..(652): unsure at all n locations; Clone ID: LIB3279-189-Q1-K6-F3
gcctgaaatcgttgaccccagactctattttgaaggaaaatctacacttcaccactatattaaggtcttccatgagtactatgtggagtacggacacaaggtgttcattgaactcaaggagcatgcggactatttgaagacagaaatggaagataaacagaaacgcttggaagcagtgaagaaatcacttatatccgtagaagccaaagatggagacatcaacaagaggatagatcgggccttcaaggtgtatgaactgttggagaagcgaatagatagcttcaagatgcttcctgctgcaaacaagaaaccattaacccaggcagagcaggagttcaaatcacagcttgatcggttcgcagatgtggagctggatgctttgcgttcctccattgccgccctgagtgctaggatgaaacgttttgctcagcaatccacgggcagtgcggctagcacaggaatggtgccatggcaggcacaaagggctggacggagccatatctcagaatcccagatgtcacttctgaaatcttcgcttgagaagctctccctcctcaacgaagagaacagtctgaagctccggcttattgatcatgaactcaagaccaggacgataggttggcangtccatgtgcgacttattgcatattgg

SEQ ID NO: 11688 - DNA, 646 bp, Zea mays
  unsure (1)..(646): unsure at all n locations; Clone ID: LIB3279-189-Q1-K6-F4
cagctattgtggtcgtccctcagccgcgtcgcaccgcatcgcattctacgattcgaagctctctctgctcgcagccatggcgaagaattacccaaccgtgagcgccgagtacagcgaggccgtcgagaaggccaggcgcaagctccgcgccctcatcgccgagaagagctgcgcgcccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgatttctaccagcttgccggagttgtggccgtcgaggtcaccggtgggcctgagatccccttccaccccggcagggaggacaagcctcagccgccacctgagggccgtcttcctgatgccaccaagggttctgaccacctgaggcaagtctttggcaagcagatgggtttgagtgatcaggacattgttgccctctctggtggccacaccttgngaaggtgccacaaagagcggtctggttntgagggggcctggactacgaaccctntggtctntgacaactcttac

SEQ ID NO: 11689 - DNA, 503 bp, Zea mays
  Clone ID: LIB3279-189-Q1-K6-F5
ccaccaccagaattcattctcgttcacaattggccgacacaaacttcagggaggctagctgatgtctattccagttgttctgatttcagatccaactttgggtcacagattcacgcaatcgttctcgtttggggtccaactctacgtcacggatttacgttgcactcgtccataaatcgatctcctcggacaagaaacctcttccagtacttcttgtactccggtatacctaattcaagccaaggtttcatgttgccattgtagggcaatgatgcaaatctccgcgcaaccttttcatcgattccgtaatcatatccaagtccagccagcgtcaatttttcatctagggggtatattagatgttggaaggatagcaagcttagaggaaatgctgctgctcgcagggacagctcatccttgacttcgaactttttcatgagccgcagatagttctctgtgacattatgctccctccatttatccagattaatcaaattcacccc

SEQ ID NO: 11690 - DNA, 489 bp, Zea mays
  Clone ID: LIB3279-189-Q1-K6-F6
aaaaaaaaaaaaaaaaaaaaaaaaaaaaaaaaaaaaaaaaaaaaaaaaaaaaaaaaaaaaaaaaaaaaagaaaacaaaaaataaaaaaaaaagggggtccgttcttggggaaccaaacttccttccccctggcctggggcctacctaacgtttttttctggggccccccttttacaacccattgcccggggcttccaacgcattacccctttgaaaaccctggggtaacccctcctagttccgctgggggcgctcttcccttcggcggcggggcctatatgcattagggcccgccccctgccccttttcattaatggcgcccgctttgttgggtacggtcaacccccccgttacggttgtttacgccctggggggcggttgttttgctccatgccctcccttcctttccacgcgcccctgctcccccctctttgctctttttccccgcctttctccgcgagtcccaaggagtgcccctccctacctgga

SEQ ID NO: 11691 - DNA, 443 bp, Zea mays
  Clone ID: LIB3279-189-Q1-K6-F7
gcctaaacgcagtccgccgccaaacccaaccccgcccgacgtcgatctactctcccacgcgagccgccaaagcctcacgcttgtggtgtacaacaaatcaatgtagcagcgggtgctaccggcctctgcagcggcgtccatcgccatatgtgaagaagatccggtcggtgatgtcgccatcgcacttgcctgtgagagcgtggacttcgacgacatcgccgccgttgaaaccgctctgaggcggaatggtgaccagtgaatggcgacttgaaagatgaggacgagagaagcatggtatagaacctggtgattctgacgtcgccatgaacctagtacaggctactgactgaagacatgaacttcaatcgggcctctcataaatcactttttatgtactacacagaaacattttatgctagtttatacgaaatatatgattctac

SEQ ID NO: 11692 - DNA, 649 bp, Zea mays
  unsure (1)..(649): unsure at all n locations; Clone ID: LIB3279-189-Q1-K6-F8
gcgactagtcngaggcggcggcggcggcggcgatggggagcgacctggagacggagaagaagaagaccccggtggcgctgatgcccatcgcgaagcccctcgctggaaagaagctctgcaagcggaccctcaagctcgtgcgacgagcctctgaggccaagtgcctcaagcgcggagtcaaagaggtagtcaagagcattcgccgcgggaacaaagggttgtgtgtgattgctggaaatatttctcctattgatgtgattacacacgttccaatactatgtgaggaatctaatgttccttacatatatgttccatcaaaagaggatcttgcgaccgcaggaaccactaagaggccaacttgttgcgtcctggttctgaccaaaccaaacaagggggagctcagtgacgaggtgaaggataaactgaagtcagactatgaccaagttgtaacggaagttgctgaggctacatctgcaatgttctaaggaccattcagggaccacatcatctgagaatatgcagctacattcttggcgtactatgtaacctgatccctgtcagtctgccctgcttgcgtgaaccgcaccagtatgctttgcatggtggctggagggatatgactatnntgagttacctatatattatggac

SEQ ID NO: 11693 - DNA, 351 bp, Zea mays
  unsure (1)..(351): unsure at all n locations; Clone ID: LIB3279-189-Q1-K6-G1
cagggtcatggaccaaaagntaatgcaatgtccaccgagtgttttctggagttgactaacacacccacctggcgcgccgcaactgaatcagagataggaagtcaatcagtgcaagtttgtaagataagctagcttgcccgttattctggtttggaagtcaaaatagttcgttcaacttagcctaggcagttgacggttttgttgtgtttctgagggactctgatacgaaaatcaaattccctttgttctgtgtttggcgctgcaacctgtaaatggagtgctttttttttgcgtaccgtgatatctgcgttttggaatactataatatcagaatttggagcgtgtttcgcc

SEQ ID NO: 11694 - DNA, 692 bp, Zea mays
  unsure (1)..(692): unsure at all n locations; Clone ID: LIB3279-189-Q1-K6-G10
ggcgcaagcaacggcacccaagcccgcgctngaaaagctcactcaagcggagcaagccctccccctcctcagacgctactccctcttccactcctgcccccgcggctgccgcgcccgaatcccatgttcctgagaaacgtcttcggttcagaacaaccgttgatgcttcagaaacacaagtgattgaggctatgcagaagatagcttcacacatagggaacgcttcaaaattcagcaaggcatcaaaactagctttgcaactcatcgaggctggaagcgtcaagcctggaacaatcggtcatttctttgctatactagaagctgcgatgtcttcaccgggagtgtgcaacgagccttctgtacgagcagactaccacaaattgttcgatgctgctcagggtgtaacagagttactcaaccaagagcagaaaaatcgattcaacatatgggtgctgcatgcagtggtggctaacgatcttttcactgatgacagctttgtgttctcaaaggctgtaggaaagatcaaagatgccatctcagccctgccagtggcaacggtggatgacgacaacgatgaagctgcggcccttgctgctgcgagcaaaactgatgtggcgacggacaacgaagcaggtcatgggcgtcccagccgcagcttctgactnctgtggtgggatgatggcgcgcatgcc

SEQ ID NO: 11695 - DNA, 623 bp, Zea mays
  unsure (1)..(623): unsure at all n locations; Clone ID: LIB3279-189-Q1-K6-G11
aagaagaagttgcaagacttattgccgcacaggattcattagtggacgctgctaaagaggaagtcagctccataagtaacatcattgctcaagctacaaaataaagttcttcaccagtctaatgctcgacatcttgacgttgttgtacaagcaactgtaatgcactggacttctagtgcatttgctctgcccatgttttatgtggaatacgggtttcaagacgtttcaagacttagaaagagcgtgatgtgtaaatttcttgatgttgtaggtgtgtgcagccttatgttggagcacaagcatgggatggattcgttctattctttttcttcccttgaacttttccttgcactgctagtctttacaccttacactatcgagagatcggttctggaagtttgcttacactgctaggctctacaccatcgtccatcgaaaagattggtacgtcttgccgggcttagcaatgagctgcttctgttaacaatggctgttatataggnttgaggtcttgaggatggnaggaggtcattgnngagaacaaaccctgtagcacgccgcgcaggtaaagtcgccgtccagactccagagcactagatgccagctgntcagtcgcacggaca

SEQ ID NO: 11696 - DNA, 491 bp, Zea mays
  Clone ID: LIB3279-189-Q1-K6-G12
ctgtgcgatcctggtcgaagcagacctgggccagctcgatcgggacctcagagactactacggcgacatggctaccaacttcgtcacggtaccgtttgagagcacagtaacgaggaaccagcaggtgcctcgacttgggctgcggaaccatgaggcgccgtgggctctgagcaaattgctggaacacctgcagacgcactacgggaaccctccggtgatgatccacgagaacggagctgggcacgagcccgacccgtccggcgggttcctgtacgacgacgagttcagggcccatttcctgcgggtctacgtcgaggcggcgctcgcttccgtccggaacggctccgacctgcgcggctacttcgtctggtccttcatggacgtgttcgagtttctcttctcctacaggttccgcttcggtctctacggcgtggacttcgccgccgacaaccggacgaggtacgctcggcgctccgcgcgatggtacgccg

SEQ ID NO: 11697 - DNA, 642 bp, Zea mays
  unsure (1)..(642): unsure at all n locations; Clone ID: LIB3279-189-Q1-K6-G2
attccttcgcgcacgccaacgcaaaaacaagcacaaacacgcgcgatccgatctgggccggccaagcagccacccatccatggcgactagggtttggctcaccgccctcctgcttggtttcctcgtcgccgcctcccccttcaccggccgagttgctagagctgaatccgaggaagatgctgctgcagctgaggttgttgaaggggctgatctaggtattgtgggtgatgatacacaggtttccagtgatggacctttaagtcctgctcctggtgtagagacagtagttgtcttcccaaaaaatgctggcaaaattgtactagcaggtgaagaaactgaattactagttggtctgcaaaatgacggtgaatcaattttgaatgttgttgctgttcattcaactctccatcttccttttgaccacaatatgtatggccagaaccttactgttcagaatttcttcaattcatcagttcctgtttctgtgcaagcaaccttcccctacaagttcgttgtgagcaagttcttgcagcctggagcatatgatctggttggttacatagtgtatgagatcgaccagcacccttaccagaatgtattctacaatggcactatnncgagttgttgaggctggaggcttac

SEQ ID NO: 11698 - DNA, 651 bp, Zea mays
  Clone ID: LIB3279-189-Q1-K6-G3
cccacgcgtccgggctagcttggttgcattgcgaaacacagtttccgtatgttcagcaacgaggacgttacaattggatcgtggatgcttgctatgaacgtcaaccatgagaacacacatgcactttgtgaacctgactgcacggagtcttcaattgctgtttgggacatcccaaaatgctcaggtctatgccacccagaggtaaaaatgctagagctccatgaaagaaaagaatgcacaggtggtccaactgtggcagctgaggtgtccgagtctgaggattgatgatttcttggttggggaacaaactacggatccgatagttgacctgtgtcctcacccaatagatgtgtttggagtattcatttgattcatcaggcgcaatcattgcgggagcactgctcaaggaacctataattggctggcgtcgtaacctagcgctgtagcaaaggcattctcattcagcattcttgtcacagcagccttcattgcttctcttgcaattggaaccgtggtcgacgtctggaacgttcaatcctgtatcgtagcagaaaggagttctgttgtatagaaattagaaggaaagaatgcattggcaattaattgataagaccgatgctgtggctgattgagattaggggatattctttg

SEQ ID NO: 11699 - DNA, 636 bp, Zea mays
  Clone ID: LIB3279-189-Q1-K6-G4
tgatttttcaggcatgtggacctctctggttctttttatacgtcgttagagatttacagttgtttattttttgtttaccgaccgcagcaaataattatgatcataaatacatggacttattgattagtttctagcagtctggcaaattatgttcaatgtttggaacggacgacggttcctctgctacagtacagatgagacaatgtcctatgagtttaattgtaaaaaattcttacttaaatatttcctttcccatttgagatgacctacagagtttactcaaagatgcttacaatatttatcccactttgtgggtgaggttgctcctttcttttcattaaatgtagctatgtgactacctttgtttttatgcgatagacaaactaatagctattacatttgcagagttccttttttgcatattttatgtgccttgaagtacaggcacttgttccagctggttctcctaatgctaataagagtaaatccagaggaaatgacccggatgatgatctgtgtcttatggatccagatggcaacaatctgaaacctgatccaccctcccgctcgctttctagccccgtcgccatggcgtcctggctgacgtcgtggatgccaagcccatgcctgcgttga

SEQ ID NO: 11700 - DNA, 591 bp, Zea mays
  Clone ID: LIB3279-189-Q1-K6-G5
gaccgggatcacggtcggcggccaggaggtggagtccacgggcttctcggccagggcgatcgtcgactcgggcaccgtgatcaccagcctcgtgccgtcggtctacaacgccgtcagggccgagttcatgagccagctcgcggagtacccgcaggcgccagggttctccatcctcgacacctgcttcaacatgaccgggctcaaggaagtccaggtgcccagcctgactctcgtgttcgacggcggcgcggaggtggaggtggactccggcggcgtgctctacttcgtcagcagcgactcctcacaggtgtgcctggccgtggcctccctgaaatccgaggacgagacctccatcatcggcaactaccagcagaagaacctgagggtcgtcttcgacacctcggcgtctcaggttggtttcgcgcaggagacgtgtggttatatttgactttgactcggattgggattgggattgggatgcagcgggcggccatgggctctatatatgtgaatacctttatacttacttgcagatttgtttcgagattcccctggtgattggcaaatggtaacaaggtgttcagttgttgg

SEQ ID NO: 11701 - DNA, 640 bp, Zea mays
  Clone ID: LIB3279-189-Q1-K6-G6
cacggctcacctacagctccgtccgccagcgtcagccaggctgccccgggaggccgggaggaagcagatcggagaaggcaagccacggatttccttctcgccttctggaccccatgtgatctgttgtaatggctcgattgtacatcggcaacctggatccccgggtgaccgctcgggagctggaggacgagttccgcacgttcggggttcttcgcagtgtctgggttgctcggaaaccacctggctttgcgtttattgattttgatgataagagggacgcagaggatgcaatccgtgacctagatggcaagaatggatggagagttgagttatctcgtaatgccagcggtggtcgtggaggtcgtgaccggcatggtgggtctgagtccaagtgttacgagtgtggtgagactggccactttgctcgtgagtgccgtttgaggattggttctggaggtctaggcagcggaaggcgccgaagccgtagccgtagccgcagtcgcagtcccagatatcgccggagtccaagttacggtagaaggagttacagtcctgcagcacgctctccaaggcgtcgtagcgtctcaccagctcgtggacgcagctatagcaggtcaccacagcacaagggtgcacgtga

SEQ ID NO: 11702 - DNA, 653 bp, Zea mays
  unsure (1)..(653): unsure at all n locations; Clone ID: LIB3279-189-Q1-K6-G7
gtggccgccacctcatcacaggcgcccaccactaccaggccaccacaaaacgcaacgcatcgcgacggctccccaaccccaacaagtctctcggccaggtctccctctccccggctctccgccttcctcttccagtccccgcgcgcgagatcgccgccccgtgtgggccctagatcccgatggcctcgcgccgccgcaccctgctcaaggtcatcatcctcggcgatagtggggttgggaagacttccttgatgaaccaatatgtgaacaagaagttcagcaatcagtacaaggctacgatcggcgcggatttcctcaccaaggaggtgcagttcgaggacaggctcttcactctgcaaatatgggacactgctggccaggaaaggtttcagagtctcggcgttgcattctaccggggagcagattgttgtgtcctagtctatgatgttaattctatgaaatcatttgacaacctgaacaactggcgagaagagtttctaattcaggctagcccatcagatcctgataatttcccttttgttctgttgggtaacaaagttgatgtagatggtggcaacagccgcgtggtatctgagaaaaagcanagcatggtgtgcttccaaggggacatccccgtacttgagacgtctgct

SEQ ID NO: 11703 - DNA, 671 bp, Zea mays
  Clone ID: LIB3279-189-Q1-K6-G8
acgccgatggcttcggcggcggcgtgggagggtccgacggccgcggagctgaagacagcgggggcggaggtgattcccggcggcgtgcgagtgaaggggtgggtcatccagtcccacaaaggccctatcctcaacgccgcctctctgcaacgctttgaagatgaacttcaaacaacacatttacctgagatggtttttggagagagtttcttgtcacttcaacatacacaaactggcatcaaatttcattttaatgcgcttgatgcactcaaggcatggaagaaagaggcactgccacctgttgaggttcctgctgcagcaaaatggaagttcagaagtaagccttctgaccaggttatacttgactacgactatacatttacgacaccatattgtgggagtgatgctgtggttgtgaactctggcactccacaaacaagtttagatggatgcggcactttgtgttgggaggatactaatgatcggattgacattgttgccctttcagcaaaagaacccattcttttctacgacgaggttatcttgtatgaagatgagttagctgacaatggtatctcatttcttactgtgcgagtgagggtaatgccaactgggttggtttctggcttttgcgtttttggcttaaagttgatggtgtactgatgaggttg

SEQ ID NO: 11704 - DNA, 651 bp, Zea mays
  unsure (1)..(651): unsure at all n locations; Clone ID: LIB3279-189-Q1-K6-G9
cggccgcgtggggaccgcgaccctaccctcccatgtcctcgccgccgccggcttcgcccatggccgccgagaacgaggcctgcgactgggcggagatgccgtcggacgcgctcgcggccgtgttcgcgaagctggacgtggccgagatcctgtccggcgccgggctggtctgccgctcgtggcgccgtctcgcggcctcggaccctacgctgtggcgccgcgtcgacatgtgctaccagggggaccagctgcagaccgaggaggtcgaggccatggcgcgcgccgcggtcgaccgctccgcgggcaccatggaggcgttctgtgccgagaccttcgtcaacgacgacctgctccgctacatctctcagagggccccctcattgaagagcctccatctctgcctgtgccattacgtcactaatcaaggttttgcagaggcagttaattgcttccctcagctcgaggagctagacattacattctgctcattgtatggcatcgtgtgtgagactgctgggagagcctgcccgcagcttaaatgcttcaggttgaatgagcgctggtctattcttcaaagcgagtttgcaccctacgagggcatggatgatgacacggaagcattanggatcgctagcaccatgcctgggctcc

SEQ ID NO: 11705 - DNA, 593 bp, Zea mays
  unsure (1)..(593): unsure at all n locations; Clone ID: LIB3279-189-Q1-K6-H1
cggtgctatatctgagtcaaccacagctctgaatgtcgacaagtcaagtactgcctctagcaagaacacaccatcgatgccaccggcggtatctacctccagtgcatccagagcatttggtacgagtttgcaggatcagaaccccactgtttctgatcctgctgtaggagctgcggcggcacgaaagaaggatggcccaatggcttccaaagttcctgtggataagaaaaagctggatgcgcggaagaagagcttgaagagattataggcggaacgtcctgggaagaagagagagggtttagagttcagaatttttatcggaaactcagcagatgcttatttaagctgggagacaaacaattaggggaggagaggcatctgatgacctggctttcgggagaagaaggggtccggggcggggccaaaggtgaataatgtgaagtgagaactgggtccttcgggacaactgtatgtgcaatgcccaatggaagaacacttgcctatttctttttgttgtcaannaaaaaaaaanaaaaaaaaaaaaaaaaaaaaaanaaaaaaaaaaaaaatttttaaaaaaaaaaaaagggcgg

SEQ ID NO: 11706 - DNA, 600 bp, Zea mays
  Clone ID: LIB3279-189-Q1-K6-H10
gttagtggtcattgtggcagtagcccatcatctcatcaataatgctgtaagtcatgaatacttgaatagatatgtgtgctctgatgagggctatgaggatggccacctaaagaagagccagacgcttgtaaacatgcttgaaaaggatcatggtcaggattctagcgaaagctctgacgttgatgttacaaaccatgaacacaaatatgatccctctaattagaagagatctgaaaatagaggagaatctagtaagctgtacagactgaaaaacgaagatgattttgatgcctaatctgacctaatcagtcatcacttttgtgaacctttatgtgatcacactggtgattactagatagccatcatgacatgccttattaccaaagcaatctcccaagatcacaatctgcaatattttataatgattgcaccagtgatccaaaaggttctgcagattgtgagatactatggtgcatatctgttgacagattatgttcactgactgatgacaaatctgactacctgataggctgccaaatgtatcactgtaaatcaaattgggatgtatattgtgcaccttattcaaaatgcaccgaacat

SEQ ID NO: 11707 - DNA, 127 bp, Zea mays
  Clone ID: LIB3279-189-Q1-K6-H11
tgcatggagtgtatgttatgggcctagccgctactttttctgatgggatgtaggtttaacatgtgatacaatcgtgtaaacaactgcttgtgcttggattatctgtcggatctcaggggtgcttctc

SEQ ID NO: 11708 - DNA, 638 bp, Zea mays
  unsure (1)..(638): unsure at all n locations; Clone ID: LIB3279-189-Q1-K6-H12
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggnggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtcccagagtgttatcttcgntcgtctc

SEQ ID NO: 11709 - DNA, 655 bp, Zea mays
  Clone ID: LIB3279-189-Q1-K6-H2
cccagcgtccggctatgtaccttgcaagaggaaatcatgaaagcaagagcatgaacaaaatatatggctttgagggggaagtgaggtcaaagctgggtgagaagtttgttgaactttttgctgaagtcttttgttggttacctcttgcccatgtcatcaacaacaaggtctttgtggttcatggagggctatttagtgttgatggggttaagctttcagacattaggtccattgatcgtttttgtgaaccacctgaagaaggtctaatgtgtgaattactatggagtgaccctcagcctcagcttggaagaggtccaagtaaacgtggtgttgctctttcctttggcgcagatgtgactaagaagtttttacaggaaaataacctggatcttattgtccggtctcatgaagtaaaggatgaaggccatgaaattgaacatgatggaaagcttataacagtcttctctgcgcctaattactgtgaccagatgggcaacaagggtgcatttattcgcttcacagctccagaaatgaaaccagatattgttactttctcagctgtgccacatcctgatgtgaagccgatggcatatgcaaataacttcctcaggatgtttcaatgacagaatataacaacattgtttagcaattttta

SEQ ID NO: 11710 - DNA, 636 bp, Zea mays
  Clone ID: LIB3279-189-Q1-K6-H3
ccccgcgtccgaaaaaaaattagtaacatgcatttagccttagcgagcaggtttacacatgctgttgaactgctgctgcatctttgtaaccttagagaattagagtggtcatcagaagtgatgctcacttgtcctctctccgtattaccgtctcccatgtcctctaatcatatcaacaagagccaggcgctgtaaaaaaaagtagtaggaattggaaccctacacgactcgaaatgattgtgctatctgtttgaggtctttgtaatgcctcttccactgcagacctgcaaaagattcccagctatttattgtattattcaggataataaaaaaaagagttggcttttatttctgcgaacaatggctttaccgtttgcagttacactgaagaggtagagcctgttcccagctgccgtggcggtgatgaacacatggggcggctccagctcgaactggtagtaagttcttcccgaatgcgccgccgtcgccgaggacaggaccttcccttccacgttctctccgatgacctccggaccgaaggcggtgatcaccttctccgggctgccgatcttctcgatggtcgcgtcgtccaggtcatctgtaggacgggaaccatatcacaacatttcttgagca

SEQ ID NO: 11711 - DNA, 423 bp, Zea mays
  Clone ID: LIB3279-189-Q1-K6-H4
attgcagagaggctcaggaagaggaggatgcggtcggggctcaacaacagcttgcctctgccaccactggctttctaagtagccgaagctgaacagagaaggtagagggatagttgcggcgactcgaaagattacgcatgtttatttgttgatgcttggtgtggaggactggtgggtgctcttggcacaagttacatgctggggagctataggagggtacctgttgcgttgtggaagacagtagctagtattatgtgttgtaattgtatgccttcgtttcatgttctgggtgcgtgacttgtcgactttgctgcttctggggttctgaccttggtaaggagagaataaagagataatatgagtgcgagatgcttgctgaactggtgctcagtaaattgatcccttgattgaatggttctgttc

SEQ ID NO: 11712 - DNA, 544 bp, Zea mays
  Clone ID: LIB3279-189-Q1-K6-H5
gcaggcggccaccatggtgaagggacgcacgggacagcgcgtcaggctctacgtccggggcaccatcctcggatacaagaggtccaagtcgaaccagtacgagaccacgtcgctcgttcagatcgagggggtgaacaccaaggaggacgtcgcgtggtacgctggcaagcgcatggcgtacatctacaaggctaagaccaagagcagcgagacccgctacaggtgcatctggggcaaggtcacccgcccgcacggcaactcgggcgtcgtccgcgccaagttcaagtccaacctcccgcctgagtccatggggcgcaaggtcagagtgttcatgtacccgagcagcatctaaggtttttgttgaagtaaaggtggactccaaatggccatgcttatttcttctctctgagcttaaaatgccatgtgttggcaacttagattgttcatgtactgaacctgttgaagttctaccaaaatttcttgtcgaacggctgaacagttgtcccaatgttatgctataaacagagcttatctttccccgtgc

SEQ ID NO: 11713 - DNA, 692 bp, Zea mays
  unsure (1)..(692): unsure at all n locations; Clone ID: LIB3279-189-Q1-K6-H6
gtgtccgcacaactctcctttgtgttcagaaaaaagtccacttctagattttagggccttcttgctaccctaaagtcatctttcacaacaatctggtttatagagacactgatgttcaggaacctaaaatataaaagcaagcccctgtatgaaaattatggttctgttgcatgctgctcatggcatggagatttggctaaagttgctggaccaatcatgtagaagacagaagtacatgtgtttgtgttttccagttttgagtatgcggaccaatcatgtagaggaattgtggtgttgccagctatttatgcagctgacagcatttcatatatatatatacatatattatatatatacatatattattttgcaggtatctcttcttagaaccttaagatctttgaagcatcgattggctgcaggtgaatgctagattttatttaaaaaaattatattagtgtgtttatcctactattttccattgaatcaaagaaacaaagtatacatgctttgcagtaccgacacaggacaaatggacatggtgtgagaaacaataatatggagggtcaatggattatttgtgcttctgacattntgtttagattgtaaactatataaatacagaatattggccatttgctgataggcgagctgnacaaatattctggacattntntctgagtatactactg

SEQ ID NO: 11714 - DNA, 697 bp, Zea mays
  unsure (1)..(697): unsure at all n locations; Clone ID: LIB3279-189-Q1-K6-H7
cgttagtataaaagagagacaagattcacctcacgagtgccccccngaaagagataatcacaaagatcgaagaagctgcaaagccgcttggctttgatgttcaaaagaaaaaatacaagatgcggatggagaacccgaaagcaggtagaaagggcaatctgaatgttgcaactgaggtcttccaaatagccccatccctgtttgttgtcgagctcaagaaggcgaagggggacactctggagttccaaaagttctacagaagcctgtcgacccagctgaaggatgttgtgtggaagtgcgacggcgaggtggacggcaacagcgcggcagcatgaaagcgccctttgaactttccactggacggcgccggttttcctttgtacatagcttctctttcggatgatcccgtgtccattgcagagtcggttttgcaagcaagttctttggtttatttgttgacggcgagtaagcccggtgaaacaaccgccctggaggctgttgtggatgagcttactggcgtgtttagttcgtttcatggtcgggaggttggatggaatgggaaccacaatncaagctgtagtagtgtgtgtagtaacgaggtatcgaggtagatacatcagatggtgtaagggagtaccagctgttagttcatggcttcaagcttagcgccccttcaattgttcgatgatgtattact

SEQ ID NO: 11715 - DNA, 634 bp, Zea mays
  unsure (1)..(634): unsure at all n locations; Clone ID: LIB3279-189-Q1-K6-H8
tgctctttctaggtgggaggattctattccttagtgtctccatttgtagtacataagtcagtcctcttttctttttttcattatcccacacctgtacagtagaaactggagagtaaggggtgtgtccaaatggtcattttttggcgatgtgttggtaactgggggcagataaagggttaccttctgtcctgaagatgcggtctctgagctcctggtcgacatctccagtttgctgcacactcaatgttcacttggtttcacttaattggacttcagtggcgctggttctccaactatcttgtacgggtggagaaagaattcttctgctggagttgtatttggaagcactgttgcaaaacttaagcatatttggagagaatctagtgttgaacagtgcataactgaacttctgtatggaggctgcatgtactgacagagggggtctattggtatatatactgcaagactgacgctggaatgctaatttgtttcatgtatcatttgttcccttacagccgatggaaatatatgttgatgatgaggcaaagttgaccctccatggtcttgtacagcactatataaaacttagcgaggcagagaaagaccgnaaactgaatgatctcttggacgctct

SEQ ID NO: 11716 - DNA, 501 bp, Zea mays
  Clone ID: LIB3279-189-Q1-N6-A10
gtgtggggtgggggttttttttttttttttttttttttttttttcatgcaaattaggcattgaataattaaatgtaaacccaacaaaagataaatgttatgcaaaagggatagagttagcctcatcatattgatgttataacatatcctaggggggggggggcgtaccatcacctagttattgttctagtcacaaaagatcaattgacaacaagcatatcattcatcggattttaaaccactaacctccaacctacttcccagggtcccttccatacatgagggggcctaggcatgaccacaacgaccatgagaacagtcatgcccaaaataaccaccatgcttagcaaaattggcaaaagccccgatgttgaggggcaatttaaattgatgttgaagttgctaggcctcataggacagtagatgagcataaacatcatcgagagggggggcctaatttttggggatcattgaggggggaaacaagttataatttggacta

SEQ ID NO: 11717 - DNA, 579 bp, Zea mays
  Clone ID: LIB3279-189-Q1-N6-A11
gggggggggggggggcgtggttggatgttagagcatcttttcaacttccaaaaattttcttccaataaacgaaaatgatgacttctataaaattttaaatcttaaaaaaatgctaccaatctaataactcctaatgtttttttagaaatggggtgggggggcttttctagacccgcaattccaatgtcacggcacacttcggcagcaccaaagatttgcacatggccttcatgtgttgaaaagcactgctcatgtccttttctagttcatcgtccactttctcctcggcccacatgaaaccttgaatgttctgcacgatcaatcaacatggcacaagaaagcagattagagcaaggaaccaatcgagcaatgaagcagcgacgaacaggcattttacctgaactcactcaattaaagtagctaacgaccacaccacctgaattagcatagataccaggtaatactactactcccttctcgacgagaatctacaacatatgcaagaggcagaagctcggaaaaaaataaaaaaaggttgcactcagaagtgataaaatacacttctcgcgttaactgctc

SEQ ID NO: 11718 - DNA, 590 bp, Zea mays
  unsure (1)..(590): unsure at all n locations; Clone ID: LIB3279-189-Q1-N6-A12
gttgggtttgttgggaaagcgggcgctccatgacaggaggcgccgccaccgcgctacgcgcgtgtctgcttatatttcatactttcttcaataacaaggattcatgttcagactgacttacatgaataaacaccagaggctgggaagcagtgggggacgaagaacacgttacatcaatgtaaacgtcgtctttacatgtccaattattaaccagccagatttcaagtacaacaaatacaggtctttaaacagctgatccttaatgaaaaatgaanccttatccntgcccccntgacatgatggcattcagtgcctgcaacaggcccttaccaaacctcanggcggatctcaccantanccgggggcatccatttcccggagttgtacacgctctcnccgaccttccaccctgnaacatctttcatgatcctcgcctcctccagaanatacttcttccactctttgacaaatctttcatcctcttctgcttggaacatcnncagtatancactgcaagcagcaattttctcttctttgagcgccccgcggaccttgttcccctgacccacctggtacatgccatatgcgaa

SEQ ID NO: 11719 - DNA, 448 bp, Zea mays
  Clone ID: LIB3279-189-Q1-N6-B10
gtgttgtgtggggttttttttttttttttttttttttttttttttttttttttgggacggggaacgaagaccaagggatatagtcattcggggaaggaaaaggcctacatagctacctttacagagctgtcgctatttatgtatggagaggtggagggggggtgtatctgggactggtatactactctcgggagacaaagctatttacaagtttcacgagctcaacaggctcgcaacaggcgttgtctttgctgccggcacggggctgttccccgtcgtcgtcgagttgctcttgctctttttgccccagggccacagaatgctctcccagaagcagaacttttcgaagcaggtttttagcctcgggagcgttacgttccgcttccaatgccccgccgtgaagttgggctttttgggctggcggcgtcccactccagcccgggcttca

SEQ ID NO: 11720 - DNA, 624 bp, Zea mays
  unsure (1)..(624): unsure at all n locations; Clone ID: LIB3279-189-Q1-N6-B11
ttggggttgttggtgcaaaagagctctngaaatccagtgccacaccattatcggcattctttctgagaatgatgcgtaaatcgtaatgcgttcggttagattttttttaaaaaaatatattttacaacatcacactgtaattggcaaacccgtgtgcgtggaggaagagtagtagcagtcttgcaaggacaagatatcagtacgtcttgtataatcccatcagcggcttctctctatcctccactctcttccttgctgcttcccgcgctttgagggccgcttcctcctccttggagaccgccttgggcttgccgtcatccctcttcctcttgttaacagcaacagcagacggagcaggagtgcccttaatcggtctcattgggttcaacggtttcgtcaccacccggcctggagctgcacctcctttaatcgcggggacagctgtttctgcggcagcaggagcttttgtttgtgaagctgaggattggccagcgtctgatttcgaagcttgcacggacttgtacgcctcttcttgggtaacccacttgcctaaactgtcagaataatagaagccagagtttgaatcgtagtaaagtccagtagatttgtcatggtaatatcctg

SEQ ID NO: 11721 - DNA, 171 bp, Zea mays
  Clone ID: LIB3279-189-Q1-N6-B12
tccaatggtttcgcgtgattccagtggcatacgtcaacatcagggttacatacacttgagtgggttcaaatcaactgtggtcttcctaataatcggggccgctattgcccattactgctgggttccgctgggggggggggggcctcgctgatgctgctgggggcctcaaac

SEQ ID NO: 11722 - DNA, 565 bp, Zea mays
  unsure (1)..(565): unsure at all n locations; Clone ID: LIB3279-189-Q1-N6-C10
ttgggcacgcggggcncgggttgggtccttcttctccacactcttgatgactccaacagcaaccgtctgcctcatgtcgcggacggcaaacctacccaggggaggatacgcggagaatgtctccaccaccataggcttggtgggaatcatcttgaccgtgaccagcatcaccgttcttcaggaacttgggctccttctcgagctccttgccagatcgcctgtcgatcttggtaatgagctcagcaaacttgacggcgatgtgggaggtgtggcagtccagcactggggcatagccgttgccaatctgcccagggtggttcatgatgatgacctgggaggtgaagctggcagcctccttggcagggtcatccttggagttggaggccacgaacccacgcttgagatccttgacagcaacgttcttcacgttgaagccaacattgtcgcccggaagagcctcctgaagcgcctcatggtgcatctcaacagacttcacctcagtagtcaggccagttggaccaaaggtgactaccataccaggcttgatgacaccagtcttcacacg

SEQ ID NO: 11723 - DNA, 365 bp, Zea mays
  Clone ID: LIB3279-189-Q1-N6-C11
tgggggtgggggggggttttttttttttttttttttttttttttttgtttcgggctaagaccgtgtgcaacagattattcatatagtcacccaaaacattgttttgcactgtagattgtgctgttcgtaaaggggggtttgaaataaggggggggggggggggtaggatgggtgagctcctaaagagaggctaaagacatgtacaaccttgagacactggatcttttttatagaaaaaagagagaggtaaaagactacatgatacaactttgagcctttagaatcttaaatacagttaagagacaatatgtatagaaaggcgtgtaaagacgggctctttgcagaaaggtcgtctcttgtatttt

SEQ ID NO: 11724 - DNA, 589 bp, Zea mays
  Clone ID: LIB3279-189-Q1-N6-C12
gggggggttgtttggtttatgaaaccatagaaatgtaatgcaaccaaatatttacatgagcattgatcgtaaatgttggccgagatgatatctaataaccttcacaaatcacgatagtaaaaacggggccacttgaaaccgcaacctggggtgggggggcatctctcaccagtgcaccaagtagtaaaagttataagcagtaatataatcaagacgcgccagcaattccttttgaacaaataattcgcatgcgtgtgtggcctgtgtgcaaacagcgcgtgaatgcaatgcgcgcaatataactacagctagatcatacgttatcttcttcaggcttgtccgaaggcctgataaggggggctaccctttcagaaatgattgccttaccattctcgtccttcttgacagggtacaacacgtagtgttggataatgaacaggacatcaaagaaaaccgtctccaatgaaagaagggttttcccaatgtttccatagaaattcaccaaagtatgttgatctatagactgcacacccatctgacaaaaatcagcacccctcctgtgagatcaagtaatatattgccaacgctc

SEQ ID NO: 11725 - DNA, 536 bp, Zea mays
  Clone ID: LIB3279-189-Q1-N6-D10
gtgttttttttttttgcagcaccaagaagcaccatttttttccttaggatttaacttagaataaagcctgacgggggtaacagcacccatcgatccgcagtccatgctggttgatgcatgggtctgctggagccgaggatgaacacaggagtgacgggtgagacagagcgaccttcaatcaaaaacacagatgggcaacaacaaacacgagacgaacgaagataaacactctggactagggtaaacaacacggtagggaacaggataacttggccgcgcgggccccaccggtcagttcctccagttcccgtcggagttgccgtagccgccgccacggttgccaccggcgtagccgtcggcaccaccaccgtagccgccgccgccaccaccgtagccgacgtcaccgccgtagccggcgccgccatcacggggcccgccaccggcgtagccgccgcctccacgggcaccaccgtacccggcggcggcgtcgcctccacggccgccgcgggactgtgccttgttgacggtgatgttgc

SEQ ID NO: 11726 - DNA, 564 bp, Zea mays
  Clone ID: LIB3279-189-Q1-N6-D11
catgtagctaacatttttttcactctttactgtaatagtacacctcttgtccaaagaatcacagttcgttacatcggaagcagcatccgacttcgatcattcgaaagaattataccctcactcgcgtacgtgataatacttcgccaccttacattcttgaattgacggaacccggtcacacacacacaccaatcagaggtctcaggaggctggccaggtcttcaggcacagcccgcctgcgaaaaatgaagaatacgctacgctctatactctgtgtcaatcagatttttgtgcagaggtgttcgttttcgagtcagtttggtagtacactacgtctccggtgtcgctaacataggggtcttgctttaagctttgtgctagcaccccaaacaggtgccacgggagaggacccgacttctttggttctttgtagtacttgccaagaaccggttttgctgcctcggtcgcctcaatgagatggtaatgcgggatttgagggaaaaggtgatggatgacatgagttccaatgtcatgggggatattgttaatcagtccatagtcccg

SEQ ID NO: 11727 - DNA, 525 bp, Zea mays
  Clone ID: LIB3279-189-Q1-N6-D12
gtgggggttgtgggtttttttttttttttttttttttttttttaaaagaaaaagtgccaacgatttcattcagacagcaatgcaacagacattgcacccaaatgtgcgttataccgtggcattccacagacattcaagtccccctatatggggggggcgtgactttagcaaatccccaaacagaagttaaaaggtacccagctatgcctgggtagcattttttatgttgcagcaaaaaaggatacattccccgcttaagaggtcgattcagcttcctatttcccagctcggggacagcaaaaccagagatcactcccacgctttaagggcaccacccctcccaattgccttgatgataggctgcttactgttgcgcgcactgcactctttgggagtccgcccggcatttcgtcgtcctcctcgtacgcctcctgggcagcgtgagcttgcttcctgcgcatcttttcctcgatgttgttcacatcatgcataggcggctcctcgcattcatctatctccatgtct

SEQ ID NO: 11728 - DNA, 598 bp, Zea mays
  Clone ID: LIB3279-189-Q1-N6-E10
aaaagctaatctcaggtcccatattagcgagcggatctgtcacagatggtagcaggaagggaaacaaaagtgcaaaacatgtccagactcagcatgaacctggcgacccagaggcacgcgccatccacatttattctcggcgtacacaagcagcaaccatccatgagaagcaggggggaaaaacccctactgggtcttgaacatgtggcggatcaggtcgacgacgcggttgctgtagccccactcgttgtcgtaccacgagacgagcttgacgaagtggtcgttcagagcgatcccggccttggcgtcgaagatgctcgacctgctgtcaccaaggaagtcggtagaaaccagatcctcttccacataacccatgatacccttgagtggaccctcggaagcagccttaatagctttcttgatatcctcataggaggcccccttctcgattctgacggtgaggtcaacaaccgagacatccacagtaggaacacggaaggacataccagtgagcttgccattcagatcaggaagaactttaccaacagccttggcagcaccggtgctgctaggaatgatgttaaagctggcaggcctg

SEQ ID NO: 11729 - DNA, 589 bp, Zea mays
  Clone ID: LIB3279-189-Q1-N6-E11
actgattgaaaatttgacatctgctaggcaatcacataattttacagcatcacactttttctgcacatcacactaggtaagaggagcgtgagacccaggctccacgagggtcactgcaggttggcacatccaaacaaacataagcagcaagcacagtgctaggaaataaactttgtgcgacaacgtaacggggcttaagttcggcaaggagcggcacagtttccgcatcctgttattgaactccacttcctcggctaaccttgccagcagccaccttgacaaacctcagctacacaacaatagtatgcggcaccggcaccgccccgttagcaacagatgcacgccccgtttcatttgtcggttgcacgctctgccgagtaaagcaacatctggctgcttgtacttgcaccggcaccaccattgttttcttttgccaacatctttttggctttcgtattcctcaaagcatttgtcaggagttcctcaagtttctcaagttcattggcatccgactcctcagcgttgttttgtttagaccatgttgcgatctccttaagtctcgactgtaaatctgaagcactacatcccg

SEQ ID NO: 11730 - DNA, 566 bp, Zea mays
  Clone ID: LIB3279-189-Q1-N6-E12
gttgtggttgtttgggttttactcaggcaaatgcacaaatcttacagaagcaaacgggtccggattcacgggtacaagcagctcagcctgacggcgacgactgctggtccaagggaaaagcaaacgatgctagcggcgccggcgcagcgggggggggggacagtctacgatgcatgcacgtgcacgagagaaactaaacgatcgacggcgagcggggagagagagctggatgctagctgcgcacccctgggtcggtcggcttcggcttttagtagtcggtggaggggagctgctcgtgggtgtgggagatgaagagcagctcgtagatgacgccggcgaggccgccgccgatgaggggcccgacccagtacacccactggtagccccactcccagctgacgagggcggggccgaaggacacggcggggttcatggacgcgccgtcgaaggcgccgcccaccaggatgttggcccccacgatgaagccgatggcaatgggggcgatggtgcccaggctgcccttcttcgggtccaccgccgtggcgtacaccgtgtacaccagcccg

SEQ ID NO: 11731 - DNA, 519 bp, Zea mays
  Clone ID: LIB3279-189-Q1-N6-F10
ttttgggtgtgtgtttttttttttttttttttttttttttttttttttttaatgtaaacgagtgttcttgcttatcgtaatcaatacagtatatatggcagctagcgcagcaataacaaaaaaaaccttgcaccctgctccgccaagggctgcggggggtgggtctgccaatccctctagacgctccagtgacgacggctaccggcgggggggcttcaagccgtgctgcccagccgcccgcgtccatgatggtcgcagcatcatctgaagccctgattcgctcgccttttttagccctacttttactcctacctacagatcaatggggagttgttccgctcgttacgttcatcggaaaatatatgtgagatggcaatgcaaggcacgcacgcacgcatgcacgtacgacagcagtctaacgataggttcggctggtcgccgcctgacgcaggtagggtcgccgccgccgccgccggccgtccagagcgctgcggcttgacaaaactgctgccatggcgc

SEQ ID NO: 11732 - DNA, 572 bp, Zea mays
  unsure (1)..(572): unsure at all n locations; Clone ID: LIB3279-189-Q1-N6-F11
nnacaaaccccttgttgggtttgttgggcacaaaaatgatcaggacatatcattaatacaacctanaaccttgtgttgtaatcacagtatataatacatacaaaagcaatgaactgactaactccagacacaaccaattatttttttatcgaactgggggcgggggggggcgcccaaacacaccaaacgctgcaaagttaactgggttctacttgtaacatccatgtccgtggtaaccaacattctcggctttgaggtcacgtagttgataatatacaccatttgcagctcctcagctctttgaaaagatttggtttcgttcatatacatccgtacgacgctaactgaactatcactcaggggggaaatgtgatgaatcattttgagagctggaacctccctgttggcttcttttatctccacccaaatatagcatantaaaagagtgtgaggatggcaagagcaacaaagccttactggaaaacattgtagttgtaaagatacttaattccacgaagggattgcaatgtgtggccaaagatctcttgagcagaagttgcttgtgcataata

SEQ ID NO: 11733 - DNA, 493 bp, Zea mays
  Clone ID: LIB3279-189-Q1-N6-G10
gaaccaaacaggttttgtttctataaattagagctacagtagtctaaacagttagttttaatcttaagtgaacaactcagtcaaacaaagggtggtgatagactgctgctactctaggagtatgtgctgccggcataaacaaagcattttgcgcccaacagccgcactgtgctgcactgccatgtcgttgtcagcagtttcagctgctgcttccagttccagtactgaaaaaaacatgcaacgagttcagtgcagctagtacgtaacgttacaccaagagccacccatcacatgctacggggaacatgtcaactttttcctttcctctacgaaaaaccaagcacaaacaactcccacgccgtgtcgctgatgaagccaaagcacaaaccatcacacacacgcatggcctagcccagccactgcgtcgcgcgacgatcgccgccgccgcccacgctgtgcccgatgctcatcttctcgcgggagtacttctcct

SEQ ID NO: 11734 - DNA, 645 bp, Zea mays
  Clone ID: LIB3279-189-Q1-N6-G11
ggttggggggtggggaaatcgaaccagagtctcaagactttgtattttaaaaatcgaaccagagtctcaagactgtacatgcccttaggggtggagagaaatagcgaagtagggtatgggtatctaacctatggatagaaaacaagattcgtgggggttggagtggaaaacaggattccttgtccgccattgcttccagaattcgcgtgcaccaactttctctcctccatgtccctcctccgtgtccgtgcgactgaacagctggcatctagtgctctggagtctggacggcgactttacctgcgcggcgtgctacagggtttgttctcccaatgacctcctccatcctcaagacctcaacctatataacagccattgttaacagaagcagctcattgctaagcccggcaagacgtaccaatcttttcgatggacgatggtgtagagcctagcagtgtaagcaaacttccagaaccgatctctcgatagtgtaaggtgtaaagactagcagtgcaaggaaaagttcaagggaagaaaaagatagaacgaatccatcccatgcttgtgctccaacataaggctgcacacacctacaacatcaagaaatttacacatcacgctctttctaagtcttgaaacgtcttg

SEQ ID NO: 11735 - DNA, 268 bp, Zea mays
  Clone ID: LIB3279-189-Q1-N6-G12
gtggggtttgtttggtgttttttttttttttttttttttttttttttttttttttttttttttttttacagaactgaatttattcctcaaatgcaaacaaatacacaactgacggggaaaatgccccataccacaaacatggatgaggggggggagggggcatcatgtacttgttcactcgcgatgaatctataacacaaacacgtgcgggtgattttcactccgaatagggggagccgtgtgtccccgttgaaacaaaggcgggggg

SEQ ID NO: 11736 - DNA, 498 bp, Zea mays
  unsure (1)..(498): unsure at all n locations; Clone ID: LIB3279-189-Q1-N6-H10
ggggaaaaaaaaactaatctttattttgtttctttcaagctttattcataaggcaagtaaatcatacaattcccaattgccatcaataccactcaacaatattagaaaaaaaaattgggctgatatgaaagcactgctctgggggcgggtttgagctttattcacgtgagagagaaaaaaaatccaccagcaaaactggtgcctcgctttacttcacaacaataccatggtagtatatcgatggtcgtgcttgactgatcttactgtgtccttccctctgtctgggtttgcttcgccagatctatggcactcgcatgttcaaggggccttgaccccagcgaggtcttgtgcgtgttgcgggctctcgtgtacttgagcgctgagcttgacacatatccagagcgtccatgccgcgagctctgtggcttgtgagcagacggngcacccaccaacctgnaagatctgcggtcgggtctgccaccacggtcagaatggtgc

SEQ ID NO: 11737 - DNA, 579 bp, Zea mays
  unsure (1)..(579): unsure at all n locations; Clone ID: LIB3279-189-Q1-N6-H11
gatgcgaacatcatatcatagttcaaagttcataatatggtaagcgcctccaaaatggtacagcggcaaagacagagcagagagcaggcgacgccagcacactcaccaccatcgttcaggtaacaacggccgagatcccaggcggggggcggggctgcgatgcantaagcagtaggagtacttaactatatacagagaagaagaaaaagaacaacggatctcttttgcgaaacactatgcacaaacacacacaacccccttccttctcccgcaacctcatctcacatgccatggatgatcttattctcggaccctctctaccaccaccggctccatacacctactacaagcatatataatactccgtacctgcttggctgctgcacaccagagctcgaacagaagcgcgttcgtcataccttgggttcggtggcttctcttctgctactctcaaaactggcaagacgtgcccagcctcggcatcgagcgctggccgacgacaccggcagcgtgcttcccggcgctcanggcacctgggagcagctcctgggacttgtcgagggaagcgctccactgttt

SEQ ID NO: 11738 - DNA, 556 bp, Zea mays
  Clone ID: LIB3279-190-Q1-K6-A10
tgagaacgatgaacagaaggttggggcttgaaattgtaaggaagtccttgagctatccacttaaattgattgcaaaaaatgcaggcgttaatggcagtgtggttactgagaaggttcttgccaatgagaacttcaggtatgggtacaatgcggctacaggggagtatgaggacttgatggctgctggtatcattgatcccaccaaggttgtgaggtgctgcttggagcatgctgcatcggtggcgaaaaccttcatcacctctgatgccgttgttgttgacgccaaggtggctgagcaagcaccatcatctcctgcaaacccaatggcaatgggtggtggctcaggttttgggttctaaattgttcagctgcccttcgttccatcgcagcgacagaatcttagtttcgagatataataataaattggatgatgttagtttcgagatattagttggatgtcgttattgttgtctcaaattataaaaaatcaagtgcaagtaaccaagacagctgaaaaaaatagtttttgatgagatgctgcttcgtttttcttttc

SEQ ID NO: 11739 - DNA, 683 bp, Zea mays
  unsure (1)..(683): unsure at all n locations; Clone ID: LIB3279-190-Q1-K6-A11
ctcggngccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcggccaggtgtgccaggtgatcggcgccgtcgttgacgtgcgcttcgatgagggcctcccgcccatcctcacggcgctcgaggtgctcgacaacaacatccgcctcgtgctcgaggtggcgcagcaccttggcgagaacatggngcgcaccatcgctatggacggcacggaggggctcgtccgcggccagcgcgtcctcaacactggctcccccatcaccgtgcctgttggcagggctacccttggacgcatcataaatgttattggtgaaccgattgatgagaagggtgacataaagacaaaccacttnctccctattcatcgtgaagcccctgcctttgttgagcaggccactgagcagcaaatncttgttactggaat

SEQ ID NO: 11740 - DNA, 672 bp, Zea mays
  unsure (1)..(672): unsure at all n locations; Clone ID: LIB3279-190-Q1-K6-A12
gctagcctcccgagccctatctatccttttctcggcacctcgcgggtctcccgtccgccccgtcccgcattcgtatcctctcctcactctcgccgccgccgcttcccctgcgccccgagccaagatgaatgttgaaaagctcaagaagatggcaggtgctgtgcgcactggggggaagggtagcatgcgcaggaagaagaaggcagtccacaagactacgaccacagatgataaaaggcttcagagcaccctgaaaagaataggagtgaacaccattcctggtattgaagaggtcaacatctttaaggatgatgttgttattcagtttgtgaatcctaaagtgcaagcttcaattggtgctaatacatgggtggtcagtggaactccacagacaaagaagctgcaagatctgcttccatcgattatcaaccagctcggccctgacaacctagacaacctgcggaggcttgcggagcaattccagaagcaggcccctggtgcttcaggtgcagaggctggcgccagcgctggtgctgctcaggacgatgacgatgacgttcctgagctcgtccctggagagacatttgaggaggctgcggaagagaaaaagagtcatcatgattntgccacatgcccgcccttgtgaagggcttataagtaaagccttgcgta

SEQ ID NO: 11741 - DNA, 614 bp, Zea mays
  Clone ID: LIB3279-190-Q1-K6-A2
cggacgcgtgggcggacgcgtggggtttagttggaaagccatctgtacgtttttcgccgatcatggaggatgagaggaacacccagcagcaccagggcggtgagcaggcccaggaccaggagaacgaggtgaaggacaggggactcctggacagcctactcggcaggaacaagcacgacgaccaggagaagaagaaccagcaggcggaggaggagctggcgaccggcatggagaaggtcacggtggccgagcccgaccacaaggaggagggacacgaggccgccgagaagaaggacagccttctcgccaagctgcaccgcaccagctccagttccagctcgtcgagcgacgacgaggaagaggaggtgatcgatgagaacggcgagattgtcaagaggaagaagaagaagggccttaaggagaaggtcaaggagaagctggcggcccacaaggcccacgatgagggcgaccaccaccagacgcccgcgccgcccgtggtggtggacacgcatgctcaccaccaggagggagagcacttcccggcgccggcgcctcccccgcacgtggagacgcccaccccgtcgtcgtccacaagatcgaggacgacgacacga

SEQ ID NO: 11742 - DNA, 647 bp, Zea mays
  unsure (1)..(647): unsure at all n locations; Clone ID: LIB3279-190-Q1-K6-A3
gngtgtagggcctcctcgacaagctgtgggacgacaccgtcgcaggcccgcgcccggacaccgggctcggccgcctccgcaagcagcctgtgcgtcccgccgccgtcaagatcagtgatccggccggggacgctgcggcgttcgtgccgccctcgccggcttcgggtagcgaggagacgccggtgaaggtgacgcgcagcatcatgatcaagcgccccgcggggtacccgtcgtcgccgaggagcgcggcaagcacgccgccggcctcgccactggggactacgccgcccatctcgccgtttgccggcgccggtggtcgcttcagaaggaaatcatcgtccgacgcatacgagagggcgaccccaccagggacgaccagccaccctcctcccttcgacgtgtgaactgaccgcaccctcgcacttgcttttgctccttgacaagcatcatctacggtagacagggaggaccggagaagacatcaagaggggaacggggataatctagtcgcgggttgtcttacctctactgtgatatattatattgtagatatatctgtatggtttccttcctagtatgtggcatatgatgtataataataatacgtcgaacgctcatggtactgtgctgtgtgtgccatgtgcata

SEQ ID NO: 11743 - DNA, 699 bp, Zea mays
  unsure (1)..(699): unsure at all n locations; Clone ID: LIB3279-190-Q1-K6-A4
ctgtgctgggatgatacccctgctacaacacaaaatccacttgctcttgttcctgtcacagatcctcttgctgactctacttcatcaaatcaaaatgcgctagcaattgtnggacacannttttcagaaaacagcaccacgaaccacaacgctcaaccagctgacccctttggtctcaatccgagttctgctattccaggatctcagctatacaacacaccaactcagcagcctttccagtcacaacagcctctgcagcaggcggcgctctatgcgaatgggggtgctgtggaccctggaacgtcttacgatcaggcatcccagtttaaaaatgttagttctgggtggaatggtcaagctgccaaccctgctgtgcccctgccagagcaagcactgaattacgatgatcaaagtggaaaccttccaccgcctccttgggaggctcagccagcgtcaaacaatgaattgccaaatggccaattgggaagcttgcaacctctcccaggttcagctggccagatcggtggcatgcagcagccactgcaaccacaagtntaaccacatgggagttccacaaagccagccaatgtatagtaaccaaccaatgcgacccggtcaggttgccgccacaacacagatgcagcctggcttcggaatacagcagttcggttcgctccaccaacatccatgctggcatgc

SEQ ID NO: 11744 - DNA, 660 bp, Zea mays
  unsure (1)..(660): unsure at all n locations; Clone ID: LIB3279-190-Q1-K6-A5
ctctgagcattctaaagctcatagccctctccttccagagcatttcacatcgctctcatctccacctgcttgcatccagcgcctcgtcactctgcaaaacaacagcacatacctccaaaggatgagccgcagcaacaggaagagctctaggggccttgacctgaaactgaacctctcacttcctgcaacaggggactcctccaggagggcgatggctgatgaggagtcatccccgagctcctgcctatcgtcagagaacgagcatggcctgcagtggtccaacagccctgaggccacatccatggttcttgctgcctgtcctcgctgcttcatctacgtcatgctcccacaagatgaccctcggtgcccccagtgcaagagccctgttctccttgactttctgcaggacaacaacaacaacagtaagaacaacagtaataatagcagcaggaggagcaggaggggatgagcaatatggttccataggcggcacgacatcaagaaaaaaattatatgaagtcctaggtccagtagttctatttgtctagtcatttcttcagtgtaactgtgatatatccattctaaaattgcgaagctagcacccatacgttagtatcacaattttgatatatncacagatcactgagtgagggcgatatc

SEQ ID NO: 11745 - DNA, 634 bp, Zea mays
  unsure (1)..(634): unsure at all n locations; Clone ID: LIB3279-190-Q1-K6-A6
aaataaattgcgtaagatattttcccccaaatcgaccccttgccacctgacgatatattttatcaatggatcaatgtttcatgaacataaaaaatgtataacacgtagatcacttaatactggcagaggctgcacccaggctccatacaggactgctcactaatcattattgcgcgcccgatatcttctctcaggtgaaggtgggcaatatatgcaaaacactgcggcttccctccatggcccttcttccaatttcctatttttcgggtcttgtaacttcagcaagcagatggatacaacaatagccgtattggtcggaactgatgtgccatgtgcctacttgttagccatagatgagtccataacactgcacgacttgtccatgaattttttcattgaatgtaactcccgtccaaatggctctaggaacttcatatctatatcaaggggccaaaccttgagccccatgagccttagaggcgcttgctgtccgggcacgatgcactccggcccggcggcttccgcgaacgcctccatggccagcccctcccctatcggattcggatgcttcatgatgtcgagggcgtaggcggcgtantcttcctgcgtagcaacgctgaggacggggcatggt

SEQ ID NO: 11746 - DNA, 243 bp, Zea mays
  unsure (1)..(243): unsure at all n locations; Clone ID: LIB3279-190-Q1-K6-A7
caaagccaaaaccccaatcgcacaggagagaccgagngtagaggttttccatccatggctcccggcgtcgcttccgtgctggtcccgcaggagcccgtcctcctcaagacatcctcgcctcaccgtccccctgcgggaacaccgctgtctccgcccgccacctcttcggcaacggagtcgcgccgccacgctcctcggacgacggcatcaaggacgccgctgccgaccgccacggtgaccgcg

SEQ ID NO: 11747 - DNA, 700 bp, Zea mays
  unsure (1)..(700): unsure at all n locations; Clone ID: LIB3279-190-Q1-K6-A8
cggacgcgtgggtggcggctacgacagccccaagctgacatacagcggctacgtgaagatgtggcaggggagcaacaagatctccatcctcagcgcagcagtcggcctccctaaccagggcacccactacgagacgtggaacgtcggagtgctcggtccggtcacgctgtccggcctcaacgaggggaagcgggacctcagcgaccagaagtggacctaccagatcggcctccacggcgagtcgctgggcgtgcagtccgtcgccggtagctcgtccgtcgagtggggcagcgcggcagggaagcaacccttgacatggcacaaggcctacttcagcgcgccgtccggcgacgcgccggtggccctggacatgggcagcatgggcaagggccaggcgtgggtgaacggccgccacatcgggcggtactggtcgtacaaggcctcctccagcggctgcggcggctgcagctacgcggggacgtacagcgagaccaagtgccagaccggctgcggcgacgtctcccagaggtactaccacgtcccgcgctcctggctcaaccccagcggcaacctgctggtgatgctcgaggagttcggcggcgacctgtccggcgtgaagctggtgaccagnacggcgtgaccaggaatggagagggggagggcatgccgcacgcacacaggatgtgaataatttgctggg

SEQ ID NO: 11748 - DNA, 598 bp, Zea mays
  unsure (1)..(598): unsure at all n locations; Clone ID: LIB3279-190-Q1-K6-A9
ngataagaagtgtggccacagcaaccagctgagggcaaagaagaagatcaagaactgaagcttgccaaatcggttccttgcatggtttgcgtcaacaagacgaagtttcaaagcttttgtagctgcataggctgctgcaacgtttttcactcgtaactcgtgtgttcctgttcagggtcttcagcatgacataaatcgtttcagaagtctagtaatattattactatntggtgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcggccgttttaaagaaccaaattttactaccccgtgcttgcaaagtaatagtttttttttggggcccccaaaataaaattcatgggccgggttttaaaaacgtgggaacgggaaaaacccgggggtacccaaattaaatcgcttggaaaaaaatccccttttcccaagttgggtaaataccaaaaagccccaccccaatcgcctttccaaaaatttgcccaccctaaatggcaattggaaccccc

SEQ ID NO: 11749 - DNA, 311 bp, Zea mays
  unsure (1)..(311): unsure at all n locations; Clone ID: LIB3279-190-Q1-K6-B1
gtgatacttaagnatgtcgtggtgacaatcacattggcatggagctcctgggctgcctatccattcatgagtgctgctgttaacccaaggnagaaaagctctggccctatatcctgtcttcctcatgtatatctcagttggtttcctcataattgccattgattaacgggggcaagcttcctagtaacatctgaatnnagttgtgactttcctcgtggatggttgaaccaccagaaacatacaagtttgagtagacaatgcttctaccctggagtctgaatcgtctcgtggggatttcgggtcttacatga

SEQ ID NO: 11750 - DNA, 601 bp, Zea mays
  Clone ID: LIB3279-190-Q1-K6-B10
gtttctgatgaagtacttccacccaaactgtcatataattatacttttggtgaaacaacatacactctctataccaacagctttttaaactttggtcaaaatgcagctcaagactcattccatgaaatgctgaggtcaagaggctctttcaaaaatggtacacttgctgatccttgtgctcccagaggatattcacgcaatgaaggtgcttcaaggtcaacattagagaaccagtatgttaataatgggactggaaactttacagagtgcatatcttcttcacaacttttactgcaaaaaggaaaggcatgatgttttacagattagtgccacatgtatctcatataaatgcagaaaagtgccagtatcaacaatgtcacctgggatctacttttgtacctgagctgcgtggatacttcttgggaactgaaaatttctattttacttcaaagttctttggacttaagaagtcttcatcactatctgatttcatgtttgctggagaacaactttgcaatcagcatttgtcgagtcttagaaaaaacattccaataggtcagatgaggatttttcaccgtattgcttctcgatggcatacatt

SEQ ID NO: 11751 - DNA, 688 bp, Zea mays
  unsure (1)..(688): unsure at all n locations; Clone ID: LIB3279-190-Q1-K6-B11
cccacgcgtccgacccaatccaaaccagacaagcaaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggcctccgcaagtcccggcgcgctctcctcagagaactcggggagtcggcgcacgaggcgcccgtgctccccaccganggtctccccgacgatttcgactggagggaccacggcgccgtcggccccgtcaagaaccagggttcgtgcgggtcgtgctggtcgttcagcgcgtctggagcgctggagggtgcgcactacctcgcaactggcaagctggaggtgctntcggagcagcagttcgtcgactgtgaccacgagtgtgattcatcggagcctgattcatgtgattcgggttgcaatggtgggctaatgac

SEQ ID NO: 11752 - DNA, 542 bp, Zea mays
  unsure (1)..(542): unsure at all n locations; Clone ID: LIB3279-190-Q1-K6-B12
ctcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggggccatcaagtacaggtgccgcgacttcctccccgaaaactgcggctgcaagatccactagagactcatccaattccaccatggccgcgcgccacagcggcacagccgatggatccttccatgttcctccgtccgtccgccttgctacaagcaggcagccacaccaataagctagctcttgttgttgttttgtatgtttgattgggtgtcccttcccagtcgagatggaataaaataaatcatcaggcgccaaaaaaaannnnnaana

SEQ ID NO: 11753 - DNA, 705 bp, Zea mays
  unsure (1)..(705): unsure at all n locations; Clone ID: LIB3279-190-Q1-K6-B2
ggcggcttttctggcgacggcggcggcgacgacgacgagcagccacctggggaagagcaggtagcaggaaatggcggcgttcctgaggtcaaaatgttcaccagttggacgtactttgatgggaagccttggaaatagtttgtttggggctgccaactcttctgttggggcaataacaaggccttctcattgcgatgctatcagtcagcaaatcagaacattcatccagatgaggactaacctgaaggtggtcgataactccggggccaagcgggtgatgtgcatccagtccctgagggggaagaaaggagcaaggctcggggacatgatcatcggatccgtaaaggaggcccagcctcgtggcaaggtcaagaaaggagacgtagtctacggcgtggtcgtccgtgccgccatgaagaaaggacgcagcgatggcagcgaggtccagttcgacgacaacgcggtggtcctcgtgaacaagaagggcgagctgatcggcacccgcgtctttggccccgtcccccacgagctgaggaagaagaacacctcaagatcctggccctggctgaacacattgtttgaggtgtgtcgcatagccaagtgtttgtgggaatgtttttttttgtgtgttctctgtttgaatatgcattgtgaaagatagcatggaccgttgactattntgagacttgctcgtcatttgatggc

SEQ ID NO: 11754 - DNA, 478 bp, Zea mays
  Clone ID: LIB3279-190-Q1-K6-B3
gttcaatggtcctcctcgacatgctgtgtgactacaccgttgcaggcccgggcccggacaccgggctcgcccgcctccgcaagcagcctgtgcgtcctggcttcgtaaagatcagtgatcctgccgatgacgctgatgtgttctttccgccctccactgcttagggtagctatgagacgctgttgaaggtgacacgcaacatcatgagcaagcgccacgcggtgtacccgtggtcacctatgagcacggcaagcacgaagacttcctcgccactggggactactgcaaccatctcgacgtttgtcggcgtctgatgtcgctacataaggaaatcatcgtgctacgcatatgacagtgcattccccccaggtatgatcagtcatattcttacctttgatgtgtgaactaaccaatccctctcacttgcttttgatacttgacagccaacaagtacggttgacatggagtacctgataag

SEQ ID NO: 11755 - DNA, 441 bp, Zea mays
  unsure (1)..(441): unsure at all n locations; Clone ID: LIB3279-190-Q1-K6-B4
atgagatcaaaattagnanaagaaatccagctacggacatttggaacaaaaagagaaggtgatgtcaggtacaaaacaggtgtcatgggggtgaagcaagcagagcctcgtcttgaactcaagaagcacaggagggtgtctagaaagaagattaaccaatcgattcttgacgaaatcgaagatgatgttgatgacctcgatgatgactaccagtttgacgtcaagcagcgttctaggaaatgataatcttttttcatctgatgatctaacggcatgaaggaacctttgggtgctgtacacagttggttttgtagtgccaccaccatgcccttgagcagtatgctgatcactgtaagtagaagcgtaatggccggaacccggggtgtcttgacgttgctccagacgtttttctttgcggtagaacgttaagggcatgtttgg

SEQ ID NO: 11756 - DNA, 698 bp, Zea mays
  unsure (1)..(698): unsure at all n locations; Clone ID: LIB3279-190-Q1-K6-B5
gagtagctaagacataaggtaccgttgactggntctgaagacaccatttcgcgatggatatgttagagatttagccgaggaagttctaaaactggccaagaatggattggaaagaagaggatacaaggaggtcggtttccttagagaggttgacgaagtggtgaggacaggagtgacacctgccgagagacttctgcatctgtacgagacgaagtggcaacgcaacgtcgaccatgttttcgagcacttgctatactgacgttgtagatgtaccctagtacaaaaatctcatctttgattcattcaacgccttgagtgggagggcacaggaacacatcttttggttaagttgctgaccgggggaacagctacccggtgctgcgtgcggtgcctacaaataacttcgctcgggacggatcactactctctagggagatggaacaaatcactgtttgtaccggccctttttgtttctgttttccttcagagatggagatgccgtatggaaaataagtccatcttctgtacgatgggaactgtttgttttcccgcctttcctttcagcattgttgggatgtttgtcccgtctcccgtgttaacatgcaaatcaattacgtgtacgataaatagctgatggtttgatccngnaatgtcacgaccctccancatgcatagatgctgacaagacaacagaggca

SEQ ID NO: 11757 - DNA, 676 bp, Zea mays
  unsure (1)..(676): unsure at all n locations; Clone ID: LIB3279-190-Q1-K6-B6
ctcctcctcgcctcctctccctagtctccacgacgcaagggagagtgacggaaagcgacgcggcgcgagcgaggagggccaaggcgaagaggggaagcaccgcaccaggacccttgttcgccgccgccgcctctgatctccgcgaggttgtcaggattcaatatgtcgaccagcacattcgctacttcctgcacgctgttgggcaatgttagaacaacgcaggcctcccagacagcggtgaagagcccttcgtctctaagcttcttcagccaagttacgaaggttccaagcctgaagacctccaagaaactggatgtctccgccatggctgtatacaaggtgaagcttgtcgggcctgaaggtgaagagcacgagtttgatgctccagacgacgcctacatccttgacgcagccgagactgccggtgtggagttgccatactcgtgccgtgctggggcttgctccacctgtgccggcaaaatcgagtctggttcggttgaccagtcggatgggtccttccttgatgacgggcagcaggaggaaggttatgtgctgacatgcgtctcctacccaaagtccgactgcgtcatccacacccacaaggaaggcgacctgtactagggctagggattntcaatttggcgagggaccaaaatgctctcgagtggtgctttgt

SEQ ID NO: 11758 - DNA, 572 bp, Zea mays
  Clone ID: LIB3279-190-Q1-K6-B7
ctctctcccagcggctctccctctctctcctcgcttctctcccctcctcttctccagccgctgccaggcaaccggccgccgagcagcgcagccacgccgttgctctcgccaggacaccaggaaccgctgccatggctgcagcaaatctgagcacagttggcttctttgcaggctaaggtgtgttcctacttcctcctgtatacacagtttattcctgcattttttggggtgattaattcctttttcaaggaacgtggatgcgggcgataaattgaagctgtgggtactctgttttctgaaaggagtgtggaagagagcagggtcaactggagggaacaatggaggtggtggagcgatgccctgtgcggcgccaaggctctgcatgtactggaacatctccgccatcctctgatgatctgcccggcgctccgcctcccgctccgccatcatcctcgcctccatctcgtgacgttccctcctctcttcttctagttgggtctgtaatattacaagtcaatgttatagtaactcaaagagaaggtatataactcaaggaaggacgagttacagaa

SEQ ID NO: 11759 - DNA, 384 bp, Zea mays
  Clone ID: LIB3279-190-Q1-K6-B8
ggcatggccatgatgagccatactacatccatgccaagcacatgtataacttgcacaggatgaagcatcagggtttgaaggtgacactctccgtgctgggagcggttggcatcggtgttggagtccctgtgtatgcagtcatattccagcagaagaagactgcctctggctgagatgatgcctctcgctgcctgcatatggagacttgttttgagcgacatttttttgaagttaaaagcttggacttcatcctatcttggttgttgcctgatactgcattttcttaccataagttgtaacctcgtttcttgcggtttggtgtaggacacgacttttctgttaataatgttgtggcttgaactttccaggctgtggagattggtg

SEQ ID NO: 11760 - DNA, 661 bp, Zea mays
  unsure (1)..(661): unsure at all n locations; Clone ID: LIB3279-190-Q1-K6-B9
caacaacagaagcaaacataattaagcagttggtggtcattagcgtactgcacagagtgcctacagaaaagctagagaagtaaacaaaaggctgcgtcctcgtacttccttcttgctgcttttctagcggtggttgcttcccatgccaccgcttccgatcctagcccgctccaggatttctgtgttgcggacatgcactctcctgtgaaggtgaatggatttgtttgcaaggactccatggccgtgaccgcagatgacttcttcaaagcagccaatcttgataaggctagagacaccatgaagagcaaggtgggatccaatgtcactttgatcaacgtcatccagctccctggcctcaacactcttggcatctccctggcacgtatcgactacgcgccattgggcgagaacccgccgcacacccacccacgtgccacgngagatcctcacggttcttgaggggacactctacgtcgggtttgtcacctccaacccaaacaagctatttgccaaggtgctcaacaaggngtgaatgtgttcgtattcccccaaggtctcatccatttccanattcaacccgtctataacaagcnncgccgttgctatcgcggcgctcagcagccagaaaccctggngttattaccatcgccatgcggtcttc

SEQ ID NO: 11761 - DNA, 603 bp, Zea mays
  Clone ID: LIB3279-190-Q1-K6-C1
agcgaggcgacgtggccggcgcggcgccaggtcgtggcgtgcgccgctgtttgccggtcgtggcgcgaggtcaccaaggatgtggtcaagacgctcgaggagtgcggcagaatcaccttccccatatcccttaagcagcccgggcctcgcgaactgccggtacagtgttttgtgaggagggagagggcgacatccacatatctactctacctagggctcagcccatctatgaatgtggaaaacgacaagctattgcttgcagctcgtaaggtcaggcgtgccactcggacttcttttgtgatctcactggtctccgatgatttctctcgctccagcagcacctacgtcggcaagctgaagccaaacttcctcggcacaaagttcacaatattcgacagccagccgcctcccgacgctgttgcgctaccaaacaacagaccgagcaaaaggcagtcgaagcaagtgtcaccgaggctgccactcggcaactacaacgtcgccacggtcacgtatgagctcaccgtcctgcgcaacagggggccaaggagaatgcagtgcaccatgcactcgataccagccgagtgcatccaggagggcgggaag

SEQ ID NO: 11762 - DNA, 652 bp, Zea mays
  Clone ID: LIB3279-190-Q1-K6-C10
cccactgtcgatggaatggttgacctcaagataccttcagggactcagccaggcacaactctggtgatggccaagaaaggtgttccgcttcttgggaagtcgaatgctcgcggagaccagcttgtgcgcgtacaggttgagatcccgaaacggctgagcagcgacgagaagaagctagttgaggagcttgcaaacctgaacaaggctcagacagccaatagcaggagttgatttattgagcaaatctttttaggacaccatgcttgtggtcacaggcaattttgatgcaaattgcagtgatgaaaagagttggtagtggttcaacacttcagcgaactaaagaggtacactggagcgaagcgtgtcatgctcatgccatatctgtggcctcgtttctaagctattggaaaccaagtcggtgaccactggacgtcttgcaatagcttaacatatacgactttattagccattttttgttacacggctttttgtattcttgagagccttatgcaaaaagtctggttgtggaatcatgcttagacttttacatttcttgcagaattcttctccattgatggtatatgtaagctgtccctggaaatgttgctgctgttttttgtttgtggtgcgtctgtgtctattgtttacaatt

SEQ ID NO: 11763 - DNA, 695 bp, Zea mays
  Clone ID: LIB3279-190-Q1-K6-C11
ctagatcgcgagcggtcgccctttttttttttttttcttaggggtagtatctgctgcaccgttctcctcctgtgcctcctcctccagcttatgcttctttttcttcttcttcttctcagttccaggctcagcttctccaccagcaacgttggagggtttatccacgtccattgcatcaccatcagccttggttttggtcttctttttcttgcttttcttgggagatgcatcggtcttctcgatatcatcatcatccattgaggtgccattgaccatgctgtcaatagcggctttcatcacatcaaggtttttacgaggcgcaacacccttgtcatagaattccagtctctcctcgacttgctcacgcaacttttgcccaaagacagaggtgctagcctccgagtagcagtcaatgcgtgaagcaatcgagcatttgtttgccaggtaacgagccattctgcccttgttcttagttgaagcacggccaataaaggaggagtggaatataagcccatactttggtgtgttccctcgagttttcagtgctctgaatagggccttctcagcaccaagtatttgaagggtggaggctgcacacttagcaagggttgaaagactgccagcatgagagattaggcgagctccaactacttcaccaatcaacgatgtcagggttggggtgcatatcattcatc

SEQ ID NO: 11764 - DNA, 674 bp, Zea mays
  unsure (1)..(674): unsure at all n locations; Clone ID: LIB3279-190-Q1-K6-C12
attctaccgataggcttagataattttntggaacacaacattgctccaaaagtttttctgaagaaaggtatcaatctgcagtttgaagaagttgagctttaagaggaacgtggtgtcattgtcatctgagctcaagggtgtgaggagcaagcttgcttcctaggagcagctgtttgtaagggaatctcaaactagaaagcttgcggagacaaaaacaaggagcatggaagaggaagtaatcaagctgcagaaatgcttacaggacaaggatgagcaactgtgttcatccacaagtagcacggaacagctacaggagaagcaggtgttgcatcagctaagttagctcggatgtagtgcatgtcattgctgaaagagctgaatgagaaggacagctcactcaaagaccatagacttcgagtgaacaatctaggtgagcagcttgatcttctccagaaggatgtacaagcaagggaggtcacacaaatgcaacttaaagatatagttataaggatcgagaccaacatcatggatgaagttgccaaagcttttgaaattgcgatattgagaggggaaatcggaatattatctactcactggacgaacaaaaccaagaaccttgaatcacagttaaaaaagcccagagaactgatcaggagctgaagaagaggttctga

SEQ ID NO: 11765 - DNA, 483 bp, Zea mays
  Clone ID: LIB3279-190-Q1-K6-C2
cacgcccccgctcctctcgtctctatcttcgcctcttccatcgcaggattcagcggccatgggcggcggcaacgcccagaagtccaagatggcgcgcgagaggaacgccgagaagacaagggcggcaaaggcagccagctggaggccaacaagaaggccatgaacatccagtgcaagatctgcatgcagaccttcatctgcaccacctccgaggccaagtgcaaagaacatgcggaggcgaggcatcccaagaacgacctctaccagtgcttcccccacctcaagaactagtaagcagcagaagcatatgctctgctcagctaaaagacaagtactacatatatatatatatacgctgtgtgtcaattaatgggttctaggctgctgctgatgcggctgcttcgttcgtgttgccccgtctgattatgtactgtaacccttggctgtcagcctgctgtgctaaaaaccattggttctgtgtgg

SEQ ID NO: 11766 - DNA, 670 bp, Zea mays
  Clone ID: LIB3279-190-Q1-K6-C3
cttcacgttttgagtgggactgcagctttcagtatggtagtctggtagaggaggttgatggccacactgcaatactataccataggctgcagctggattggttcccaatgtttgtttggcctcgtgatctttgttatgtgcgctattggcggcgcaatgatgatggaagctatgttgtgttgtttcaatccagagagcaccaaaactgtggtccacaaccaggatttgtaagggcacatattgagagtggtggcttcaacatttctcccctgaaatcccgtaatggaagaatccgaacacaagtgcagcatcttatgcagatagatttgaagggctggggggttggttatgtaccttcatttcagcagcattgcctacttcatatgctgaacagtgttgctgggctcagggaatggttttcacaaagtgatgagagtcaagtgcttcctaggattcctgttatggtcaacatgactcaatctgtttcttccaagaaaggcagaaaagcacaagagagtactacacaaaccggcattcagatggatccaagcagacattccacagttcttgaggaggagtctgatgaagatgacgaatttctgatacctgaatctgaaccagaccatcaaatcttgaggatgctgcagatgttaggaagtcagggcgcatg

SEQ ID NO: 11767 - DNA, 651 bp, Zea mays
  Clone ID: LIB3279-190-Q1-K6-C4
cgcgcggcacgctgcacgcgcggcaggggcagagcccccagcgacccaccacttctccccgtgcgcgcgcgcgtgaggcgctgctctctttctttgcatgtgaaggagtgagaatgagagagtggggacagcgtgggagaaggggagcaatgccgttcgtgtccgagtgcgagcggcggggcggcggcagtggcagctccagcgggtcgtcgttgtcagcgcggcggggaagtgacagcagggctggggtgctgcaatgggatgaggtagaggagatcgatggagaggtgcagagctcgtacaggggacccttcgacaccatggacgcgctccaggacgcgctaccaaacaaaaggaaaggagcatccaaattctacaatggcaaaacgaattctgtagcagatgctgcccaaccggcaaaaggcactgctgatcctgtgaacccatcccctaagaagcgcaagggcttcctttcattcggcttcagctggaccaagtcttggagcagacgtggtgcaaccagcagctcagagaacttcgggaagacgctgtctgcagcccttacaggcagtgctcaaggcaacagcaggggcggtagcaatgagcaccagggctgtcaagaccctgctgcccactgcctgcatctgcaca

SEQ ID NO: 11768 - DNA, 647 bp, Zea mays
  unsure (1)..(647): unsure at all n locations; Clone ID: LIB3279-190-Q1-K6-C5
cccacgcgtccgcgtctatctctcaagnaaaatgaatatgagaatcactatatcaaagaaacaaaaggtaaagaaactgctaatgtctataggtcaggaataaaggaaaaactggtcttggaaaagaagatcctaaagtagcaaagaatattgttgataggagaaggaaagggcttgcgttactcaaatctgcttggacatctgagatggaagatcctttgtatgatgttgatcttgctctcattctttgtaacactaatgcattcaaagatggtttgctctttctatatgagaaactaaaactttacaaagaggttattagttgttacaagcaagcacatgatcatcaaggtttaattgcatgttgcaagaagttgggggactcatctcaaggaggggatccttctctctggggggatctattgaagtattttggggagcttggggaagattgctctaaagaagttaaagaggtcttgacctacattgagaaagaggatgttgtacctcccatcgtcgtgctacagacactatcaaaaaacccatgcttgacactctcagtcgtcaaagattacattgctcgcaagcttgaacaagaatcaaagctaattgaagatgatagaaaatccattgataagtatcaggca

SEQ ID NO: 11769 - DNA, 455 bp, Zea mays
  unsure (1)..(455): unsure at all n locations; Clone ID: LIB3279-190-Q1-K6-C6
ccccgcgtccgaaccaanagaactagctatcaccatttctaaatccactatttgttttcttttaaaactcaatgctgaaaggagattaacagagacgacaactatggcaacttatgcgttctcctgcagatgtaatacgtgctcacgttcggcacccaaatgcccgtagaccatggtcaaggtgagggacgacgtgaaccttcccatctatcagggtgaaaacatcaacgacaagactttcgacgagaagagtcatgtattggacccatacaagatgctttaggagtacacccaattcgctgtcatgctcaacctactctacgccttctccaccggcggctactccaacattcagcgcgtcacgcagtggaaacttgatgtcaccgaacatagcaagtagggtgacatgtgaaataaaatcttccattcaccgagttgatttattctataatttt

SEQ ID NO: 11770 - DNA, 392 bp, Zea mays
  Clone ID: LIB3279-190-Q1-K6-C7
gcagtggtggtgaatgttactgggaatgaataaatgagtccagaaggaacaccgtatgaaccatcagagtacacagtaacatgcagtggtggtgaatggaaaatcgttcaaggcctcccgattgatgagttctcaaggaagaagatggatgccactgcccaagagctgacggaggagaagacgcttgcttactcatgcctcgagtaaattctaccacacccagagagcaattgccaccccaatgttttgaataaaaaaagaaactccaactcgattcatagattctcactcagaactgctgcacgtcgcagtgcaggcgtgttgctggcttcgcccagcttctttttttgcctgtgatttgcacgacatttatatttattgaaatcttgcag

SEQ ID NO: 11771 - DNA, 671 bp, Zea mays
  Clone ID: LIB3279-190-Q1-K6-C8
gaggaggggtgggtcagccatgacggggaaggcgaagccgaagaagcacacggcgaaggagatcgccgcgaagatcgacgcggcgacgacgaaccggggcggcggcaaggccgggctggcggaccggctggggcaggacaagggcgggcatgcgaagctggcgtgcccgctctgccgcaccccggcgcccgacatcaagtccatgcagatccaccacgaggcgcgccaccccaagctccccttcgagccggagaagctcctcaacctgcactcctccgcccccgctgctgctgttgccgccgccgccgccgccgccgccgctgccgaggccaccacctccaagcccaagcccggcgtccgcggcagcctcaagaagtaagcttgctggcttggttggctcgcccgcctgcatggggcacaattcccttcggtttcaatcccatccgccgacccgatctataatcaatcaaaccgccgccctccggcctggcggctgccgcagtcggcctgcggtgtactgttagtctgctgctgatttccgttgttatactgctggtacatgtgtcgtgtgatagatgtgtcaactatatatcaatctcgtcgccggcagctctagcatgtttgagtatgtgttgctgctctgtggtgccggcgacgatgcctgctagtac

SEQ ID NO: 11772 - DNA, 665 bp, Zea mays
  unsure (1)..(665): unsure at all n locations; Clone ID: LIB3279-190-Q1-K6-C9
cttggttcctcgcggcgacgactgggcgagcgcctcctcccctccctcactccctccgtgagctcctctccggcggcgcgcgccgccgcccgtcgccacgtcttctccgctgacgtgggctcaccaggttcaaggcaatatctgtgttaatcttggggaccttcagtagattgctgagagttctccttgatacaggggaataaagatccaaataagtttttgacattgatctgtagccagtactccaatggctacgaagcttgtggttctcggtatcccctgggatgttgacactgaagggttacgagagtacatggccaagtttggacccctagacgattgtgtcgtcatgaaggagcggtcttctgggcgatctcgcgggtttggctatgtaacattcgcctcagctgacgatgcaaagaatgttcttgattgcgagcatgttcttgggagccgtacattagaagtgaaggtagctactccaaaggaagaaatgaaatcacaaggatcaaagaaagctacaaggggatattcgttgctcgaattccgcaatcggtggatgagtcgatgtttcgtagacattntgaagcttttggggaaattcttgatctttacatgccaaaggaacatggttcaaagggcatcgtggaatgggtttatcacgt

SEQ ID NO: 11773 - DNA, 368 bp, Zea mays
  unsure (1)..(368): unsure at all n locations; Clone ID: LIB3279-190-Q1-K6-D1
gggngaaactcctgcctctgctgatcctgtctcagacagggccttcgtccagctattggcgaaagcctagggacacccgttgcttcagccacagctgtctaaccttatgtttatcacccagcaatgcttgaaacagcaaaggttctccattgcttgtttcagtttccttccgatcatgtttttagttccatcaatcaagcaatggagacatgcttgtgcttcatgcttggcagcatcgtgtttggggttttcactgagcagtactgtttaatttttatggactgaaaagactcagttttgtaaatattcgtcactgtgaccaattcctgtggtggtttatgtgatttgcagattgcagtggttagtgt

SEQ ID NO: 11774 - DNA, 382 bp, Zea mays
  Clone ID: LIB3279-190-Q1-K6-D10
cccacgcgtccggacttcgtgtgcccaccgggtaccttacccactgccatccctagacgagcgtgtgcggtggcggcgggaggagacgaaagagaaatatgcaggcggtggcacgggcggcgcgtgggctcgcggctgcggctgcggctgcgcggccgtcggcgacggaggcagggcaccgcgggcaggtgcagcaagctcggggcatcgtggtgcaggtgagggacgggaatctggagcgggcgctgtcgatcatggagcgcaggatgcggtccagcggcatggagcgcctcatccgggcgcgcacccattaccacgtcaaggactcggagaagcgcgtgctcgcgcgtaagggggcttatgcacgcgtccgttcccagga

SEQ ID NO: 11775 - DNA, 595 bp, Zea mays
  Clone ID: LIB3279-190-Q1-K6-D11
ttatattcaacagtaaaagcataacatcatgcaagtatacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccgtttttagaggatccaatttttcctcccccggcctggcaaggaaaaactttttttttggggcccctaaattaaaaacacgggcccgtttttttaaaccggggggtggggaaaaccctggggttccccaaatttaatcccttggaaaaaatcccctttttccccgggggggttaaaaaaaaaaggcccccccccttccccttttccaaaaattgcccccccttaatgggaaatgggacccccccttttgggggccttttaaccggggggggggggggggaccccccaaggggaccctttttttttgcaaggcccttagcccccgtttttttgttttttttcctttttttttcgcccatttggcgggtttttccccgaaaacttttaaagggggggttccttttgg

SEQ ID NO: 11776 - DNA, 310 bp, Zea mays
  Clone ID: LIB3279-190-Q1-K6-D12
cttgctgctagctagctagctagctagtgtgagttcttccgcgcgcgcaagcagcctttgcataccacccctcttgcttagctcatgcatgtccagcagtagccggttgctgggctcgtcgtcgtcgtcgtctgcggcggcggcggcgggggcgggggcggcgtcatctctggcgtggttacgttctcatcagcgacttctaatggcgctcgctcgatctttatttcctgcagtcctttttgtaataagaagccaattgatgtgtgtgcacgcgcaatcctaataataaatagatcttctttgtgcctta

SEQ ID NO: 11777 - DNA, 658 bp, Zea mays
  unsure (1)..(658): unsure at all n locations; Clone ID: LIB3279-190-Q1-K6-D2
tctgttcattgctaccaatatctgcgagaattcatctggaaggcatttagccccacaaccatcaacagtggtcgtggtgctgaatttgaaggggctgtcattgcactgtttcatctgttgattacgagaaccgataaagtccgtgctcttcgtgaggctttctaccgccagaaccttccaaatgtgaccaatttgcttgccacagtcttggtcttcctcatagttatctatttccaaggcttccgtgttgtgcttccagtgagatcaaagaatgctcgtggccagcaaggctcatatccaattaagctattctacacttcaaacatgcccatcattctgcactctgcactgattaccaacctctatttcatatcccagcttctctacaggaagtacagtggaaacttccttgttaaccttcttgggatgtggaaggagtctgaatactctggccattctgttcctgttggtggtcttgcttactatgtaactgccccatcaagtttggctgatgtccttgcaaatccattccatgcactgttttatgtggtcttcatgctgtcagcttgcgctctgttctcaaaaacgtggattgaagtttctggttcatcagcaaaggatgttgctaagcagctcaaggaacaacanatggtgatgc

SEQ ID NO: 11778 - DNA, 235 bp, Zea mays
  unsure (1)..(235): unsure at all n locations; Clone ID: LIB3279-190-Q1-K6-D3
gcaagtacatataggcacangagagatcaatatactttctagagataaccaatttacatattgtgaatcactaaggccaacgatgaaaggtattgcaaatacatgacctatctaatagaaaaggacctatccttcttctacaatcctcaagagggtatgatccatttcagtgcacactgggtgccacttacctaacttgaggatgctcaacatacttacatatatcagatggagg

SEQ ID NO: 11779 - DNA, 693 bp, Zea mays
  unsure (1)..(693): unsure at all n locations; Clone ID: LIB3279-190-Q1-K6-D4
gtcgtcatcgccgcccgcttttccgggcccccatcgcctcttctcttccacgagtggttcaagcatggtggtcgtgggctccgcggactccttcaacagcatcttttccaaggtgcaagatgaaaagctaccagctgtcttttactacacggcggtgtggtgtggaccatgtagggcgatcgcacctttagtatcaaagctgagcagccagtatcccaagataccggtgtacaaagttgacattgaattggaaggactgggaaacaaactccgtgatctaaacatatgttcagtgccgacgttccacttctatcacaaggggcagagaattagtgaaatcgtgggtgctgatgcaaagaaaattgaagctaccatggaaagtctccacaagcagcagtagaagtttcagagcagagcctcaacctcacaccaatggaatggtttaatctacctcgcatgagaagtgttgcgcacttttggattcgtgtttttctttacgtgtcacaccgtgtgaacgccagcgtttcgtcatcagatgcttgtgattcgtgccggcttgtttcatgtgaagacatcagatgcttgtgtttcgtgccggcttgttttgagttttgggtcttgagcttcggcgactctgtccagagctgcngatgtttctcatgcttggaatgagtgagatggggtgaaaatggc

SEQ ID NO: 11780 - DNA, 656 bp, Zea mays
  Clone ID: LIB3279-190-Q1-K6-D5
ggcgcgtccctgagagacgaaggaagagagcctaggactgactcactgacccgaacccgttcccggcgggacttcctctcgaatcgtcccagtcgagaccctagttgccccacgaaccgaggatccaagatgagtttcctgttcgggaagaggaagacgcccgccgagctgttaagagaaaacaagagaatgctagatcgatccatcagggaaattgagcgagagagacaaggattgcaggcccaggagaaaaagctcatcactgagatcaagaaaacagctaaagaaggccagatgggagctgtcaaagtaatggccaaagatcttattcgcacccggcatcagataacaaagttctaccaactcaaatctcaactccaaggagtttctctaagagttcagacactaaaatcaactcaagctatgggtgatgccatgaagggtgtcacaaaggcaatgtcccaaatgaacaggcagctaaatctaccaggattgcagaggataatgcaagagtttgagcgacagaacgagaggatggagatggtgagtgaagtgatgggagatgccatagatgatgctttggaaggagatgaggaagaagaagaactgaggagcttgtgaatcaagtacttgatgaaattggcattgatatcaac

SEQ ID NO: 11781 - DNA, 649 bp, Zea mays
  Clone ID: LIB3279-190-Q1-K6-D6
cggacgcgtgggggagcaggaagagccggcggggcacgggctgcggtcgcggacccgcgacctgttcgcgcggcccttccgcaagaaggggtacatcccactcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaggaagcggatccatgtccgcgtggagcatgtgcagccctcccgttgcacggaggagttccgcttgaggaaagccaagaatgaccagctcaaggcggatgccaaggcccgcggtgaggtgatcagcaccaagaggcagcctgtgggacccaaacctggcttcatggttgagggtgctacactcgagacagtcactcctattccttatgatgtggtcaacgatctcaagggcggttactagagagatttttgtaccttcagcagttcaaacgagctggcaaacttatctgaatctttttgataattggctagttcttctggtctggtgttatgaactcatgtggctattgctggtggcgtcaaaagatttttt

SEQ ID NO: 11782 - DNA, 606 bp, Zea mays
  Clone ID: LIB3279-190-Q1-K6-D7
gctacagcttcaaaatcaaatcttggccttgaaaacaaaagcaggatgactctgctgattctgatgaggatgagtctgatgattctgatgaggatgattctgatgattctgatgagggcgagggattatctcctgacgaaggcgatgatgattcaagtgatgaggatgataccagtgatgatgacgaggaagaaaccccaactcctaaaaagccacaggcaggcaagaagagaggcgctgaaaatgctctgaaaacgcctctttctgatcagaaagcaaaggttgccacaccgccagcccagaaaacaggtggcaagaacggtgccacccatgtggcaactccacacccagcataaggcaagacccctgcaaacaatgacaaatcaacggagaagtctccaaaatctggtgggtcagtcccttgcaaatcatgcagcaagacattcaatagtgagatggctctgcaggctcactccaaggcgaagcatggggccaaatgagctgcaggtccaactgactccatgaaggagaagcatggtggccaagtgagtcgcacgtccattcgagtccatgaaggtgaagcatgtgagatccaagcgagtctgg

SEQ ID NO: 11783 - DNA, 629 bp, Zea mays
  Clone ID: LIB3279-190-Q1-K6-D9
ggcttgtacgcgcgctggttgaggtgtgatggtgagcgacgacgtagatgtggcggacacacggcggagatgtggtggaggctgcgtgttgcgggcgaacagcgcaggaacagacgcggtgaaagagcgatgggaaaaaattagctccgaataccaggtgttatggtcactagatcggtgagggattggagaggggtatcgatggacaggaacgtcggccaggggcctttgcccacggtcgagcaagagggtttctcccttctaattcttgcctactttatttcccatccattaattacataaataggccagctggctgcccttatctagctagagatccttatctccttaaaattctcctaaaaactctcaagaactagtaactgataaccttcctatataatctcaactaatcttctaatcttatctctaactatccttatctaatcctccttggagggcccatggctgctgctgccgcagcccctccgtgggcctccttaggccctgacagatacaccatgaaactcattgcttgttgttttgtccttattctattcagtagtgtatcttgtactcagcttttggataataaacaggttgatgatttatcaatggaaccacaagtt

SEQ ID NO: 11784 - DNA, 620 bp, Zea mays
  Clone ID: LIB3279-190-Q1-K6-E1
tttttctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagttcagagtgtttatc

SEQ ID NO: 11785 - DNA, 614 bp, Zea mays
  Clone ID: LIB3279-190-Q1-K6-E10
ctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggcttcgtacaagctctcggacgccgccaagaaggcatcccccaagaccaaggctaagccggcaaaggccgccgctgccaagaccaccgcccccaagccggccaaggccgccgccgccaagtcaaagaaggcagcggctgccaagccaaagaaggccgctgctgctgggaccaagcgcatagtgcccgagaagaaagtcgtggcgaagccgaagaagcccccgcctgcaagccaaggccaagccg

SEQ ID NO: 11786 - DNA, 648 bp, Zea mays
  Clone ID: LIB3279-190-Q1-K6-E11
cggacgcgtgggcgcgcagcgccgccgccgtgctccgcgtcttcttccacgactgcttcgtcaatggctgcgacgcgtcgctgctgctggacgacacgcccacgacgcccggcgagaagggcgccggccccaacgccggcggctccaccgtcggcttcgacctcatcgacaccatcaaggcgcaggtcgaggccgcctgccccgccaccgtctcctgcgccgacatcctggcgctcaccgcgcgcgacggcgtcaacctgctcggcggcccgagctgggcagtgccgctgggccggcgcgacgcgacgttccccaacagcacgggcgcggcgacggacctcccgggcccggactccgacctggccggcctggtggccgggttcgccgccaagggcctgggcccgcgcgacctcgcggcgctgtcgggcgcgcacacggtggggatggcgcgctgcgccagcttccgcacccgcgtctactgcgacgacaacgtgagcccggcgttcgccgcgcagcagcgccaggcctgcccgtcgtcctcgggggccgacgccgacgacgcgctcgcgccgctcgactcgctcacccccgaccagttcgacaacggctactaccggagcctcatggccggcgccggcctgctgcact

SEQ ID NO: 11787 - DNA, 673 bp, Zea mays
  Clone ID: LIB3279-190-Q1-K6-E12
cccagcgtccgcccacgcgtccgggcatttcaagtgctcaagtgacatcatccttgttggaatctgttgagagtggtgatctaatagcttatggacttatcccagaatttattggacgcttccctatccttgtgagcctggccgctctaaatgaggaccagcttgttcaggttctgattgagccaaagaatgccctgggcaaacaattcaagaaattgtttagcatgaataatgttaagcttcactttacggatggtgcacttcgaataattgccaaaaaggcaatgtcaaaaaatacaggtgcacggggtttaagaactatccttgagaatattctcatggattctatgtatgagatcccagatgcaaaatctggggagaagcgaatcgatgcagtggttgtagatgaagatgcagtaggatcagtggaccaacctggttgcggagctaagattctttacggtgatggtgctttggatcaatatctatcccagataaaggtgtcaggagacggagtggggagcgaaatggatggggaagctgagctttcgtcatcgagagccattggcatgtgattcctggttctgaccgcaccagtgtaacctgtaaaaatctaatcccagttatatcaatgtaagtagtagtagccttgtaatgaaacgaatgtgcagcg

SEQ ID NO: 11788 - DNA, 532 bp, Zea mays
  Clone ID: LIB3279-190-Q1-K6-E2
gcaccgctacgtgtggtcgacatatgtatgggcacaccgagcgtgagaaagaaagcgtcatagaggacggcgttgacaggaaatccccgaggtgatgatgctgaaacctcacagctggctgttgggaactgtggttggatgcttgcccctagttgatgtacacccttcatctgctagcgcgtagtacctggcagatgatcgacactttctcacagcatgcataccgtttgcacgtggatgctgtggctttattaggaaacctagcacttaagtgctccatgtattccggatttttgctatattctatgcaacaatctccatacaacatcactcgcccattttgtggaagtggatgaagcaacgctaaggtcaatcttgatgacgtgcgggcgctctatgcatgccgatgtcactgacggaaagatacgatcgagtgcatacttttactgttacattgatgaagatgatattcatgtcgtggacaccaaacctactaagcaaaatggcgattactctatgagacaaattttga

SEQ ID NO: 11789 - DNA, 625 bp, Zea mays
  unsure (1)..(625): unsure at all n locations; Clone ID: LIB3279-190-Q1-K6-E3
gttgctcctcaagttcacgctgcggctatataaagccacgcctccattaccctgcttggccaaagcaacaacagaagcaaacataattaagcagttggtggtcattagcgtactgcacagagtgcctacagaaaagctagagaagtaaacaaaatggctgcgtcctcgtacttccttcttgctgcttttctagcggtggttgcttcccatgccaccgcttccgatcctagcccgctccaggatttctgtgttgcggacatgcactctcctgtgaaggtgaatggatttgtttgcaaggactccatggccgtgaccgcagatgacttcttcaaagcagccaatcttgataaggctagagacaccatgaagagcaaggtgggatccaatgtcactttgatcaacgtcatccagctccctggcctcaacactcttggcatctccctggcacgtatcgactacgcgccattgggcgagaacccgccgcacacccacccacgtgnccacggagatcctcacggttcttgaggggacactctacgtcgggtttgtcacctccaacccaaacaagctatttgccaaggtgctcaacaaggggtgatgtgttcgtattcccccaaggtctcat

SEQ ID NO: 11790 - DNA, 268 bp, Zea mays
  Clone ID: LIB3279-190-Q1-K6-E4
gctgtggcaagagagcgggcatgggcagcaaggttgatagagctaaaacagattgaggaagacgttaaagctgtaatggcataagggcctgctctggaaaatggcaaggcgtctaacctgtttctgctgctctattttctcctcctttgttcctacatagtttaaattgtcacaattctttgtgatggaatggaagaccagtaccacttctttcaacagtaatatcaaatgccggaactgtttttttaatacagactctcattagacc

SEQ ID NO: 11791 - DNA, 563 bp, Zea mays
  Clone ID: LIB3279-190-Q1-K6-E5
actacccattcgactgtggcattggctgatggtagacatgctgtcctacattctgaccatgattacatacaccaacacataggaccacgtcttgcggggctgctaatcactctggcaaacactgctggagttctggcaacagttgtcggtgcttatatcactgactacattcttcagaatggtgcttggaatagggtggttaaggtgtccatagtgtgaaccatagtatgaactgtggtttgaaatgtatataaaactgtagagaaaactgtcgacatacctatgtacatttctatataccactatactgaactggatgatattgatgatgacattttggctaacaaaataaattcttgtaagaaaaacatttcataataataactacatgttatccaaaatgtgtacctgaatctgatgttagaactatatcaagaaccagatcaaattaaggtactgagtgagcacatagaaactacactaagaacttgtgcaacaaacttgcccacacagcaaccgcaccaatggcaccacatatttctgcagaagttcattgagaagtc

SEQ ID NO: 11792 - DNA, 458 bp, Zea mays
  Clone ID: LIB3279-190-Q1-K6-E6
cccacgcgtccgcagggctttcattaatggagtaccccggggtgaagcctttggatcctgcctatgcactaccattgcacgttgtcaatcggattttcttgaaaaaatagaacattccattcgatctgcggcgcagagatatgctgagatggcgctgtcagatgtggacgctacttcacagaaccacgattcgacggagaaatagctgagggggaatcaattacaggaacatgttgggataccataatcttggacttgtattctcgcattggctgtggccgcttagtcgatgtttttttgtcatttggcacttgccctgttgaatgcttggtgcatgctgtgttttgctagttgatctgattctcttgtttaagtcgtaacattgtgtgtcctgatgacgacgacattagtcaggagctatctataaacagtatgtcttttttgtttgctttttttac

SEQ ID NO: 11793 - DNA, 382 bp, Zea mays
  Clone ID: LIB3279-190-Q1-K6-E7
gtcctggccaccgtggtgttctcgggcttcatcgtctatgacaccaacaagctgctgaagcgccacgcctacaaccagtacgtggtggcagccatctccctctacctggacgtcatcaacctcttcatggcccagatggccatctccttccagtgatggattgcgggtctcacctgtacggctgtaccccatgcatgacggcgcctcgcccgtctggtacatggtggatcacacatccacatagcttcgcaagtcgagctgtctttcattatccttatcctaatactggtagtaccaatagcattacagtcctacagatctgtaattggctggccacccttcagctgagacagtatatatatcgtatatggcacctcaccat

SEQ ID NO: 11794 - DNA, 690 bp, Zea mays
  Clone ID: LIB3279-190-Q1-K6-E8
ccagttgcaaacaaattatgttcaagtggcacacgcacatacacaaattgaaccaagatgaaaaataatcttttgaaaaataggcaagccaggaaaggtaatatgaaagcatgttgtggcatcctttttcattggcgatgttttgttgacgaggagccagaattctctagcgtctgatattttgcttgatcaattacatttttagtgaatgcttgatcaagcattgccctaacctagcgtctgatattttgcttaatgagttgggttcaacgcccattttattgtttcaaaatcttaatcatcattgaacactcatgtgtagttagtgtagcatgctttgtgtcgcactggcagttaaaaagttccccaccccccaccgcaccccgacagctggcacctgaaaacataagacggggatctgcctatcaaacccttccacatcagggtggttggctggcatctgatggtgctacgaaaggtatggatgggagaagcggaaggtatcacacgaacgagtattatgcttcacataatgacatggggcttttgaacttcaatcgtactgacatacctgatactgaaactcttgtgaaaaagtggagaaggtattatcccgccagatgtgtatgcaattgaaaggcaaagaactgctataggccaagacagtcattgcttgatgcattgccaaat

SEQ ID NO: 11795 - DNA, 658 bp, Zea mays
  unsure (1)..(658): unsure at all n locations; Clone ID: LIB3279-190-Q1-K6-E9
gccagcggagctccctatgggtattgcacaaggccaacaccagcaactcccaaacaggatgccctcaggatggtccaataacctggataatccaaatccaggttctggtaacttcagtttggcacagggtgcaatctctaacaggacacaggatccgtacacatttgctcctggagtagtatcaactgggacagcttcagggtatgcaccaggtgaagcatccaacagcatgtcctgggcttccatgcaatacaactcacagcaggtagctagatctgatcaacctactattccagtatcactgccacctgatcaacttgcacagctagctgcccttcttgcacgacaaaaccaacctagaaaagttggtttgcctgtggacagctcaaacaatctgtctggattcatacagagtcccaatcctcatggacatgctacaatgatgccaggcaactctggctccatccctatccagaactcactgccacctgttccatctatgcaacaattacatgccaatgtgccagtgtcaccaataggctcgctacctgcaaatccattcaatgtgccgaccagtgctcctgtactttgtaacagcacttcgcctatgctgcccagtcatgctntggtcaacccagctcattcttncatgccaatg

SEQ ID NO: 11796 - DNA, 605 bp, Zea mays
  unsure (1)..(605): unsure at all n locations; Clone ID: LIB3279-190-Q1-K6-F1
cgcagccaagnaggcagttcagcgctcagaggagcttgatataaggaggagcccaatctcaattgcagccgccgtcatttacatgataacccaactctcagaggacaagaagccacttaaagaatatccttggctactggtgtggcagaaggcaccatcagaaattcgtacaaggatctgtatccctacgcctcaaggctcatcccgaatacctacgccaaggaagaagacctgaagaatctctgcacaccttaggaagctttactttttttcccttctgttatataaatcggaattagatttgtcaaagaggagtgagtgaagttgttcctgttgtgaccgactgtactgagcaatgtgtcgtcgccggcgcgcttaactttgtggatggaccaatgagaacataagttgtcatcatcagatcgaatttcttttcagagcacctgccacctgaagatttttttgggatagcaaaggtgtcgttttcgtatactccctttgggaaaggatgtagatagcaagcagtcccttggaagtgcacaagattttatttaaaagaacagattctgttccccatcttcaaaagaaaccgtcatttatccatc

SEQ ID NO: 11797 - DNA, 628 bp, Zea mays
  unsure (1)..(628): unsure at all n locations; Clone ID: LIB3279-190-Q1-K6-F11
gaatcgagtaaataatacaatcaatatatatataaccaaactacatacttcatacagtggacggctgactccacaatgttaccggatatattggcaaacacaaaaactgcgagctatagcagagcaaccacccatagatatgtcatcaaacgaaggtatttccagaggagaattaaggctaggtgacgtctagaagcacttcctgtggacaatagctggaccagactcctcatactcagcccttgagatccacatctgctgaaatgtgctcagggatgcaaggattgatcctccgatccagacactgtacttcctctctggtggagcgacgaccttgatcttcatgctgcttggcgcgagcgcagtgatctccttgctcatgcggtcggcgatgccagggaacatggnggatccaccactgaggacaatgttgccatacaggtccttcctgatatcaacgtcacacttcatgatggagttgtaggtcgtctcgtggattcctggagcttccataccaatgaaggatggctggaagagacctccgggcatctgaagcgctctgcgcctattgtgatcacttgtccatcaggcagttcatagctcttctcaactgatgagctgctcttgg

SEQ ID NO: 11798 - DNA, 700 bp, Zea mays
  unsure (1)..(700): unsure at all n locations; Clone ID: LIB3279-190-Q1-K6-F12
tgggggtgtagtacttccaaaacacgtttcagtgctatagactgtaaacgttctgacaagtgctgatcagaaagggtccaangaaaaaaaagaagtgggggcagatcgaacatcctagcacgagtaaatttcccatgagtgcggtcacggtcgtcaaatgttatctaagttggcagtacaaaaacatggttccataaaattggcgccgggtaactcttggcttatagcacaacattcagtgcccacagatcttggtcacgtcagcctccagagacttgtgcgctcccatgagtcctttatttgtggtacaggtacacaaacgagaatacgaagaaagcacccattgttgaaaatgaggcggtgtagtatgggtacgctgatgttatgaatctctcatactcattatgtctgtaaggacgtactggaatctgctttgtaaaagacagaccagtatatcccagtctttggtactcaactttgaactggaaaactccataaacatctggaactttgaaggttgttgaatacaaacccttgttgtcagtcgacatagttttcagaacgtaagggctcatcatgaaaaattgaagctgcacatcatcagcaacataaggcttccagctcgttccngaccattcatagatctcaacagagtattccaggtcatcattaatgcngtacatgcctgggttcattcgtc

SEQ ID NO: 11799 - DNA, 677 bp, Zea mays
  unsure (1)..(677): unsure at all n locations; Clone ID: LIB3279-190-Q1-K6-F2
cggacgcgtgggtgccgccctcgcccgccttcaacaccggcagccgcaccacaaattcctccccacgcgttgccttctccccaccaacggcgcccttccccaacggctgcgaacgctaacgcgcttccccaatcgttgctccttcgaccaggtgcttcggtagaaggacgtcgcctagagccatcccatctctgagcatcgtggtctccccgatgtggatggggaaagaatataggttgcccaatatctacaaagctgaacacaccctatcatctgcaccagcaagcagcctagcagcagtcctcacccatcagcaattcagcatgcatctggaagactacgtgtgtctacgtctgctactgctgccgaggtgtctactctcttaggatcaggggaaaatgattgaaagaatggaaggatctatgaattgtcaatgtcctcagaagaatggataactcatgtgtttcagtgtggacctcatccttttcgattccaccagctacttgaatttgaccaactaaaggagagctaccacagacgtctcataggccacaatgaacgtcgaaggaggccgcctcctggacctcttgtatcacactacggtcgtctgctgcgttgnttggtggtgacaaagctaatttaccttatgtcattgatatcttatctgatgctctatg

SEQ ID NO: 11800 - DNA, 606 bp, Zea mays
  unsure (1)..(606): unsure at all n locations; Clone ID: LIB3279-190-Q1-K6-F3
gaattctctcggtctctaccaaaaaacagcgacctctaacgcttagctagctctttgtgtcagcgcctgagcatcgagctattggcatggcgcactccaccaccttggccctggtgattgtcgttgtgctggcgctcacctttggtgccacggtcagtgtctccgctcccgtgaacaagtcgtgcgtcagcggtagcgccggcgccagcgtgagcattggctacggcggggcaagagccagcgccggcgctggcgtgtcccttggcgccgacgcgtaccggagcacgtgcccccgtgccgaggagatcatccgtgcggccgttgagagggccgtcgctgccgacccacgcatggcagcgtctctcctgcgcctccatttccatgactgcttcgtcaacggctgtgacggctccgttcttctggacgacaagccgttcttcatcggcgagaagacggctgtgcccaacgccaactcaatcaggggcttcgaggtcattgacgccatcaagaccgagctggagcgggagtgcccagatacagtttcctgtgccgacctccttgccatcgctgcccgtgactncgtcgttgtgtctggcgggccgagct

SEQ ID NO: 11801 - DNA, 550 bp, Zea mays
  Clone ID: LIB3279-190-Q1-K6-F4
cgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcggttaggtcgcccctctcccgatggcgaattacgtggtggcggtggcggtcgtgttgtgttcttggtctagttagtctgtgttgtctttatcggtgctgttttctgtggtggttgtactgcatcgttctagtttctagtccatgtgctgtaatatctcgctgctgtaatcaatggaatgtcctcgtttcaagcct

SEQ ID NO: 11802 - DNA, 630 bp, Zea mays
  Clone ID: LIB3279-190-Q1-K6-F5
atcgagcctacctccaaatcctggggtttgtccgtcagcttcatcagcatcatacttctacccatcgtggggaacgccgcggagcacgccggagcaatcatttttgctctcaagaacaagctggacattaccctcggagtagcgttggggtcggcgacccagatctccatgtttgtggtgccgctgagtgtcattgtagcttggatcgcgggtattcaaatggatcttgacttcaagctcatagagaccggctctctcttcgtctcagtaatagtgacagcattcaccctccaggatggttcgtcacactacctcaaggggatccttctgctgctgtgctacattgtgatcggtgcatgcttctttgttacgaggcaacctgcaagtaacaacaatggcgctgggctgtcgctgccaactggcactttgagtgcgcaagctgcatgatggttcaagggtcctgcctgagcctgaacaaatgagcatccaaggcagcaacgcagttgtgagtcagaaacaatgccgtgcaaaggttgatgctttcagaagcggtgaaatctcagccggtggctcagtgctatgggagaaatgaaggctagctgctgttgcaataagggtagcgaatatgca

SEQ ID NO: 11803 - DNA, 325 bp, Zea mays
  Clone ID: LIB3279-190-Q1-K6-F6
cccacgcgtccgcccacgcgtccggatacaaccacgacgacgcagctgccgtgaagagtgctgaggaagcctttgcggacatgctcgactggttcaacaagaatctgaaataaactctgcaattgcatcctgccttgtaataatgcgtgttccagtgccctgggatcgaatctgctgtgtttgggcttttgcatggtcaggctattcagagttgtcatggacttagggttgtgttagtagattggttgcgctgaatctataataaaaacgaggtaaactaggacaatgatgatgtggccgtgtgtatttaatgtattctgttcac

SEQ ID NO: 11804 - DNA, 351 bp, Zea mays
  Clone ID: LIB3279-190-Q1-K6-F7
aaacaccatgtttcaattttcacatgtagaattgagggcatctcaagtaaattgggtatgaagaaggcgctacagctgctggattacctgaacccgacggagctgaagatgacgctcaatacgatcaaggccttcatgccgatcgtcttcgtaagggaggcacgacacctggatgtatcatttgggagcaaactttaaacgtctacctcttttaactaagaggtatcattttcttccaaagacacgaaagtatgacacattgggtttgttaccggttagaagctcgtaagacgtcttcttgaggaggggatgaagatagagtcaatttatggcatggcaagccgtatttac

SEQ ID NO: 11805 - DNA, 583 bp, Zea mays
  unsure (1)..(583): unsure at all n locations; Clone ID: LIB3279-190-Q1-K6-F8
agcaacttgattcatccttaaggcacataagatccacaagnacacaacatatgcttgatcagctcactgatcttcagaggagggagcaaatgctgtgtgaagcaaataagtgccttagaagaaagctggaggagaccagcaaccaggtgcatggccaagtgtgggagcacggtgccaacttactcggctacgagaggcactctcctcaacagcaggccccatcacatgttggcaatggtttgttctttcatcccctggaagctgcagcagagccaaccctgcagatcgggttcgctcctgagcatatgaataacttcatgccaacatggctaccctgaagatggatcttgaggcaaaggaaataaataaagatgcggtggcagcatcatactctatgcaagctaagagtgacagctgtgtttcagtcacatatatgatctagtctgtgtgtcaatgtgtcgaaaaacatgtctgtgattttgttatatgaatgtaacgcgcaatgaaacatacaggactagctgcttgcttgacgatgcgtttgcgtgtatccgtataaattaaaggctataagccacatcgt

SEQ ID NO: 11806 - DNA, 205 bp, Zea mays
  Clone ID: LIB3279-190-Q1-K6-F9
atcagagagagagaagatcgtgagagagcgagagatgcttgagatgggcttgtggtttgcatgaccgaggagctgcctcgtccccttcgttgaccgctgtttggactgaagggagctctgcatcttgctcccatgactttcttcccagatttatgtttgctatttttttactttgttgtaacttatatacatgaacgttttattc

SEQ ID NO: 11807 - DNA, 656 bp, Zea mays
  unsure (1)..(656): unsure at all n locations; Clone ID: LIB3279-190-Q1-K6-G1
tatcaaaccaatctctctctctctactaatgacactcaagcgcctagggctgctaccctagaaccaagcctgcggtagaggggtataacctcgccggagaagacagctatccccatggaccgaaggtccatgacagcaaccacccgtccacctgtgccgtcgctcctgcaggcgccgaaacggttgcagaagaaggcgctggattcgcagtcagatgggatggtccggcgggccacccagcagccaccagaacgtgaccagctccataggctcacttgccccaggtggagcagcagatgctccgctatgcctgcgcctgcagccggacggttagtctgcagtaccagcgagctgttgtgtctctggccacgatagaagagaagctaaggaaccaagaggaaatgggcctgcagaccaagactagaattgaggacgaccttaatatgtgctgaatgaatatacgagtggccccgagcgcacactaccggacggaggaagaaggaaatgacaggtaggccaaggaagaagactgaaaaacctgctaccggatttgtttcgaaccgttttggacctaacagagacccgaacagcgattaagactttnagagacacattntaaaactntatggaccgggctgnacacaccgcgcaagtta

SEQ ID NO: 11808 - DNA, 325 bp, Zea mays
  Clone ID: LIB3279-190-Q1-K6-G10
tgataaaaaaaaaaaaaaaaaaaaaaagagggagagggaaaaaaaaaaaaaaaaaaaaaaaaaaagaggaaaaaaaaaaaaaaaaaaaaaggaaaagcagagggcgggccgctcttaagggtcccgggctttccgttcgccgtgcttgcggcctcttttgcccctcgctttggggtgtcttttcctctggtcccttggtcggggggggggcgtcgtcgggccccgggcttttccccggcttgccccgtctttgtcgggtcgccccctttccccttttcgcccgttggctcattttttttggggccgggcccgcccccttttcccc

SEQ ID NO: 11809 - DNA, 601 bp, Zea mays
  Clone ID: LIB3279-190-Q1-K6-G11
cctacgcgtccgctgacgcgtgggctggacttgatcaatgagccaaacaggcctttacacaagcccctgcatgtccccctccaggaatgtgtacaagattgctggtattggaactgtccctgttgcacgtgttgagactggtgtcattaagcctgctatggttgctacttttgggcctactggtgttactactgaggttaagcacgatgagatgcaccatgaggctcttcaggaggcccttgccggcgacaatgttggcttcaacgttaagaatgttgctgagaaggatcttaagcgcggctatgtggactacaactccaacgatgaccctgccaaggaggctgctaacttcatcttccagaacatcattatgaaccaccctggccagattggcaatggctatgcctgacatatggactgccacacctcacacattgctgacaagtttgccgagctcgataccaaaattgataggcgatccgacaaggagctggagaaggagcccaaatttctcaataacgttgatgctattatggcgaatatggctaccactaagcccacggtggtggagaccttttctcaggatccttctcttggtcga

SEQ ID NO: 11810 - DNA, 615 bp, Zea mays
  Clone ID: LIB3279-190-Q1-K6-G12
gcccatggccctctcgagctcgctccgtggcctggtggccctgattccaccggccctccctcccgctcgcccgagcggggcagcggcggcggccccggcaccccgcgcgcggggtcggacggggagaggggcgggggtcgtggcgctggcggcggcgctgccgtcggacgcgcagtggctggagcggctgccggagaagaagaagcctctgtacacgcacagcctgccgtgcatcgaggcgtggctgcgcagcctcgggttcacgcagtcccgcgaggaccccgccgtctgggtcgccgagaagccgctctggcacgcgcgtctcagcctcgatgtcaccgacctccacatcaggtacttgaaaagcggccctggaaatcttgacaaggatatggagagaaggtttagctacgccctaagcagagaagacatcgagaacgccatactcggaggaccttaagctgaacacatggccaaggggctcagagctaggaattgcttagtcgaggttggcactgaagaaaaatcgctccagtgatctgcgtgctaccattacgccattgtaagagcaaatggatcatgtgtcgagaaataatattcatgagcaataatctc

SEQ ID NO: 11811 - DNA, 667 bp, Zea mays
  unsure (1)..(667): unsure at all n locations; Clone ID: LIB3279-190-Q1-K6-G2
ccccgcgtccgctcacgcacttcttcctccacacagacacccacacccacccacccacttggccgcccggggcgccccataatcccccctggcctcttgatgactactgcgcccaacatcgagatgatcgcctcctcgctgcgccactgctccctcaccggcggcgctggcgggcggcgccggggaggcaccaggcgccgcggcgccgagggtggcggcgacaccgacggcgtcaccgtggagctgaactccgaggtggcactgccctaccactgggagcagtgcctcgacatccggacggggcaagtgtactacatcaactgggagaacggcacccggacgacggtggacccgcgcacggcgtcggccttcgtctcctccccgacaccgcgctcctccacgtctcggcgcacccggcgcgcgtccacgccgtcgtcggggtacacctccgtgtcgtcgtccgtgggcgcggcggacgtcgtgaccggcgcgtggcggggcgccagcaacgacagcgggtacgacaacgacgacgagcaggaggacggngaggcggacgacgaggacgaggccgagagcagcagcaccaccaccaccagcagcagcagctccagcagcacgggcagcagccggnggtcggcaatctcgtcgagctctcgtcttctcg

SEQ ID NO: 11812 - DNA, 683 bp, Zea mays
  unsure (1)..(683): unsure at all n locations; Clone ID: LIB3279-190-Q1-K6-G3
cactttgaaatcttgtgnncctaaagtggaaatccaagtttgtctttataaggaaaaggtaaggataatcagagtaaagcggaaatagatgagaatagattaagaaaagtttagaaagaatcagagtagcaaagataagtagacaatggttgtccagttctatctaggtttcgtcctacagtcaacattcctctgataccacttctgtcacacccgggttttaggggcaccaagacccgggcgcgaacataatcaccaggtgtgctgggaccaagtctcacacatatgatgaatcatggcacaggatcgaatgtcacatctttactacataacaggagttctgtacaaaataaataaataattacattataaggagacaacggtccagcaacccaaagttgactgggagacgacgacctagaccactcacgaactcatcacagcatcctccatgcgcctcatcctgcggtacctgttcttgacctgtggggggtgtgagacagcaagagtgagctcacatacgttcatcgctcaacaagttgtggggaataatgtgcatgaactcgccaaaggtgggaagctcacgtgaagtgtaaggcttaccaaagaggatggttagagctgagcattgcttttaaagttggtcaaaatttattagcattactaagtataagtaataccac

SEQ ID NO: 11813 - DNA, 666 bp, Zea mays
  unsure (1)..(666): unsure at all n locations; Clone ID: LIB3279-190-Q1-K6-G4
gcgagtccccttcccgatccgccggcccatccacccaccgccgccatgccggcgttcaaggccccggcgccgggcttcgccgtgcgcttcagccccttccacgagaaccgcctcctcgccgccacgtcccagcacttcggcctcgtgggcaacggtcacctcatcgtgctcgacctcgccggcggcgggcccggggccgccccgacgccggtcttctccttcccgacctccgatgcgctcttcgactgcgcgtggtccgagtcccacgactccctctgcgccgccgcctccggggacggctccgtgcgccttttcgacgccgctctcccgccggcgcagaaccccgtgcggctcctccgggagcacgcacgggaggtgcacggcctcgactggaaccccgtccgccgggacgccttcatctccgcctcctgggacgacacgctcaagctctggtcccccgaccgcccagcctccgtccgcaccttccggggccacgagtactgcgtctacgccgccgcctggtccgcgcgccacccggacgtcttcgcgtcggcctccggggaccgaaccgcgcgcgtctgggacgtccgggaccccgcgcccacgctcatnctgcccgcgcacgaccacgaggtgctctcgctcgactgggacaagtacgacccc

SEQ ID NO: 11814 - DNA, 660 bp, Zea mays
  Clone ID: LIB3279-190-Q1-K6-G5
tagggagcggctcgcagggcaagaacgaagcagatggcggtgatgagccgccgccgcgtcatccagctcgtcctcgttggcgtcgtcgtcttcctggtggccccgcggctgtcgtggaaccttccgggcggcctcgagaagctggggctgcagcagagcccggcggcggtggcggtggcctgctgggcggctgcggtggcggcgtgggcgtacgcggtgtcccggccccggcccgtgtacctggtggacctgtccgggtacgtggcgggcgcgtcgcacgaggcgtcccgcgccaagacgatcgcccacttcgggcggtgcgggcggttcagcgacgagagcatggcgttccagaagcggatgctggagcggtcggggctcggggagcagactcacttcccggcgtcgctcatcagcgtgcccgtggacatgtgcctccgcacggcgcgggaggagtcccacgccgtcatcttcggcgtcgtggacgacctcctccgcagggcgcgcgtggccggcggcgacgtcggcgtgctcatcttcaactccagcctgctcagccccacgccgtccttcacgtcgctcatcgccaaccgctacgggatgcggcgcgacgtcgtcagccacaacctcagcggaatgggatgcagcgccggcatcatc

SEQ ID NO: 11815 - DNA, 562 bp, Zea mays
  Clone ID: LIB3279-190-Q1-K6-G6
gtcctgctgaagtgttcaagtggatcctggaaagcgcccaggcaaaaatatttgaattcctagagaatgttcagaagataatcaacatgctgatccacactccagaggatgatgataatccagatggatacagcgatgcagttaaggtgtcgttcatgctcacggtattcgtcttcatcgtggtggccattgctcgtatcaattatgaacattgggattacaaagtgtggtgaggcgagattctggcatcctacaagcccgtctatatatatgttttgtagaacacaccaaagttcgataacttagcctacacaaagttttactcaatgctttggctgtatcatttcatcccggcagatcatgcaagggaatgttgttctgggtcatatttgtgtggtcgactttggagccggatggacctctgtagctacacttccttactccagcagtccagcgcctgcaaatttcatgtttgcagtccattttaagcatacagcattaactgttggaatagcctgtataaatgttacttgaggaaattattttacagggtgtttggatc

SEQ ID NO: 11816 - DNA, 652 bp, Zea mays
  unsure (1)..(652): unsure at all n locations; Clone ID: LIB3279-190-Q1-K6-G7
aatatgttccaaaacaagcacaaggttcaaagtttgtgcctcggcatgattacactcgcaaaatttttgttggaggactcccaccttcagtagactcagaataccttattgaattcttcaatgctgagtttggtcctgtggaggaagcagtagtcatcggcataccaattggcaaccgagttcagtcccgaggttttggctttgtaaaatttgagagagaagaggatatgataagtgcaaaggaagctcatcatgtttacatgcttgggaagagagtggaggtaaaggatgctgttgctagagcatacttgcctttagaagaccaaagatatacttctttgaggcaattcatcaaggagcggccaaagatccacagggtgctggatggtgaactgactgaggaacacaacatccagaagcggcgaccattgccagaaaagtgtcttccatcctggttctttatattcaggaagtggttacctggatttcttgaagatgaaacagcacgacttagaggagagaggtatccgttgagctccctgaagggtgatttcagagcgacttgcangatggagcttgatacaccgcacttggttatcctaagctaagtgactntatccgctccctccctggcatctgcagaatgtgtgta

SEQ ID NO: 11817 - DNA, 651 bp, Zea mays
  unsure (1)..(651): unsure at all n locations; Clone ID: LIB3279-190-Q1-K6-G8
cggacgcgtgggtgatgaagttggccgtctcgaggttctccgcattcacactaagaacatgaaactagctgaagatgttaatttggaactcatttcaaaagatacccatggatatgttggtgctgatcttgctgccctttgcactgaggctgctcttcagtgcattcgtgagaagatggacatcatagatcttgaggatgagacaatcgatgcagagatattgaactcaatggctgttacaaatgaccatttcaagactgcgcttggaacaagcaacccatctgctcttcgtgaaactgttgtcgaagtcccaaatgtctcttgggaggatattggtgggctggagaatgtcaagagggagctccaggagactgttcaatatcctgtggagcatccggagaagttcgagaagtttggcatgtctccatccaaaggagttttgttctatggtcctcctggttgcggtaagaccttgttggcaaaggcaattgccaacgagtgccaggctaacttcatcagtgtcaagggtcctgagttgcttaccatngtggtttggtgagagcgaagccaacgtccgtgaaattnttgacaaggctcgtcaatctgctccttgtgtcctcttctttgatgagcttgactcaattgctactc

SEQ ID NO: 11818 - DNA, 691 bp, Zea mays
  unsure (1)..(691): unsure at all n locations; Clone ID: LIB3279-190-Q1-K6-G9
gttacaggnacaaagaacctgttaaaacttccacaagcaatagcggcagtcggaaatctggcagcaagctgaggaaggatgcgaagcctgataggaggaatgaggattatagttcacccagctctttgagacccccatctaatacaaataacactgaggacgactttgatgactttgatcctcgtggatcagatggcaaaacaactgctaagtcaaatgaggtggatctgtttagcccaaacttgatggacgattttattgatgcatctgcagcaactccagcaacagacaatgctgcagaaccacaggttgatctgtttgctgatgcagattttcaatcggcaaccgcaagtacagatacagctgcaaatacagatgtcaaggtcaatgttgacctttttgcggaaaaggcatcttttcctgcagcatttccaccacaggctgggtttattccaccaccaagtgccgggacatcttctgaagtaaatacttccgtatccaagaaggcagctccggaaccttttgatccttttggcgctattcctttgaacagttttgatggacctgacccatttggtggcttcagctcaatgctggatcatctaccgcagcagcacccacccacggttcaactggaaatatcagcacatcgaaccagaaccttcatgctgcaaccgactttgctggcctt

SEQ ID NO: 11819 - DNA, 555 bp, Zea mays
  Clone ID: LIB3279-190-Q1-K6-H1
tgccgtcatgtgaaggccaattctacgaggttatgccagacgatgaagctagatgctagttccgcaagctctcaccctttcgctagttaaagcaacaataagctcactagatccctttgattaataaattatctatatttcgaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccttttaaaggaccaaattttacgcccccgggcttgaaaagtaaaattttttttttggggcccccaaaataaaattaaggggccgggttttaaaaacgtgggaacgggaaaaacctgggggtacccaaattaaatcgcttggaaaaaaatccccttttcccaagtgggggaaaaagaaaaaaggcccgcaccgaccccctttccaaacatttgcccaccctaaatggcaaagggaaccccccctgtaccggccaattaaccgcggggggtggggg

SEQ ID NO: 11820 - DNA, 687 bp, Zea mays
  unsure (1)..(687): unsure at all n locations; Clone ID: LIB3279-190-Q1-K6-H10
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgntcgtctcgtgtttggtgttgcccatctgtgtttntgattgaagtcgctctgtgtca

SEQ ID NO: 11821 - DNA, 675 bp, Zea mays
  Clone ID: LIB3279-190-Q1-K6-H12
cggtcgcgtgggcggacgcgtgggcggacgccccgtgccctgcaggtgccagcgccctgcccgcgccacccagcagcgaccgcgcctgctccctgcgcaagcagccgagccgccctgcatcgacgagtccaagcgccatgaagccgccaaccaagcccgacgaccccgcccaggcggcgaccgagcagctgcccgaccccgtcccaaggacgcgactccgaccggcgcgatgcaagcccaagaccgcgcgcgtctgttcgattacgtgcgcgattaatggtgtttaaatcctccgttactccttctcccatttctccccattatgagcagaaaaccgacgccatcaatggccagtgaaggccgtcggcgccccatgacctccctggcgtcctttcccctctcccctccctctctctataaaagggacagcagagctctctcccatcctccctacccgagctctctcccattccccgcctcgctctctagctctcctcgctcatcgctagtgccgttcgtcgccggagtttgccgctcgtcgccggagcccgtggagttcgccggagctacgccatccgccgtccgtagtcaagcccctgctcttctccatccggtcgaaacccgtcgatccatccccgtcacacgcacggacccaaggttgaagacgacccaata

SEQ ID NO: 11822 - DNA, 682 bp, Zea mays
  unsure (1)..(682): unsure at all n locations; Clone ID: LIB3279-190-Q1-K6-H2
ggctgcaggaggtgctgcggtcgtcggacctcaacaccacgaccaccgctgccctgcgccgccgcctcgaggaggacttcggcgccgacctctcccacaaaaaggccttcattcgggagcaggtcgacctcttcctcgccgaggtcgccgctgtgatgacccgtggccgcggctagagttcgccgggcgtgagtcggtagcagaccggtgaaaagaacgaagccaaggacaccggggtaatgatggcaaaaagaggggtggtggctttacaaaattatgcagtctttcaccggcacttcaagagtttgtcggtgcctctgagttagccaggacagaggttgtcaagaagctttgggcatatattcgagaaaataatcttcaagaccaaaacaataggaggaagattttgccggatgagagattgaagaagatcttcaatgtcaattccattgatatgtttcaaatgaataaagctttgaccaagcatatctggccattgaattctgagggtcctgtctctcctgatagatcaacacccaaagagaagccacaaaagagagacaggagtgaaggaaagaagcaaaagggtggctcttcaggagctggatctggttttctcgtgccccttcaactntcggatgatntagtaaaattatcggcactggtgagagcatgtatcacg

SEQ ID NO: 11823 - DNA, 460 bp, Zea mays
  Clone ID: LIB3279-190-Q1-K6-H3
gtagcccagccagattcgacccgagttcgcgacgagagcacgagatggcgatgcggaccgcgctgacttccctccccgcgcgcctgcgcgcccctgcgccccccgcggcgacgggcggccggcgcctcctcagcgacgggaaggggcgcgtgctcagcgaggaggagcgcgccaaggagagcgtctacatacacaagatggagagggagcggcaggagaagctcaagaagaggctcgagcatgagaaggccgactctgacaaggccaagcccgccgacaccgacaagaaggccgagggatctacctagctaggattggcatggagctgttggaaggcaatcacgattcgcatgtatcccaatccgatggtcagctgtgtgaatgaataaattctgtaaaacgtcaacagcactggatatgctgttgattaggttgctcgcatgttgaagttgaagacgac

SEQ ID NO: 11824 - DNA, 660 bp, Zea mays
  Clone ID: LIB3279-190-Q1-K6-H4
ggaggtgagccaccggaagcggagacgtgagcactcgaccaaccccgtcgatccggctgcggcgcggcgtgctagatcgctaccgaccatggtggtggaggagatcgccgagggggtgaagaacctaaccgtcaccggagatgcggcggcttcaggcggagaggggcagaggaggggcggcggcggcagcagcaaccgcatccaggtgtccaacaccaagaaacccctcttcttctacgtcaacctcgccaagaggtatatgcaacagcacggcgatgtagagctatccgctcttgggatggccatagcaacagttgtgaccgtggcagaaattctgaagaacaatggatttgctgttgaaaagaaaattaggacctctactgttgaaataaacgacgaatcaagagggcgtccattccaaaaggccaagattgagataatcttgggaaagagcgacaaatttgatgagctgatggccgctgctgcagaagagaggggcgaagtggaagatggtgaagagcaggcttgaaaacagtaccgatgacaagctgctgctgttgtgctctgttagtgttgtttaatttagtttaataccgtgtgcatgagatatggcacgcgttcatcaccatggcaatgtctgcaaatccatggattgatgga

SEQ ID NO: 11825 - DNA, 664 bp, Zea mays
  Clone ID: LIB3279-190-Q1-K6-H5
cggtcgcgtgggccgctccccgtccttcgtcccctcgcctgtcgcctcagcctccacgcgacgcgaccacggctcgcctccaaaattcaaatcctcgccgctagacgcgcccactgccatccagcctctggggtctggctcactgcccggccgtcaggccacctggcactggccacgcccagtcggtgcggaagaggaggccgcggacctggccgagctcccttgtgaggtggtcccggggcgcgcgggcctcacggtggcccatggacgccgggcggaagtcacgccgagcggaagtcacgccgagccatccatgcctaccctggcttcttccctgcctacgcggaagttggagctgagtcttgagtgcccatgaagctcatatcgacatgttggccttgttgggtagcaggttggagcaggttactccgttactgccgatgtgcattcacagtatgaaaatgagatccaggaattgatggatgtgatttctgttgaataagaggagaaaaatgacattcacaggaagcttcagaatgtggaaaatgagtgtaaatgcaagctggattgatgagttgaaaaggaagacgagtttcttcaaacagaaaacgtcatgaaccaattctaataggaaaacagaacaagatttgtatcctcaacatgc

SEQ ID NO: 11826 - DNA, 626 bp, Zea mays
  unsure (1)..(626): unsure at all n locations; Clone ID: LIB3279-190-Q1-K6-H6
ggtaaggtctgtgtcactggggcgtctggtttcatcgcctcctggctcgtcaagcggcttcttgagtctgggtaccatgtcctgggaacagtcagagacccagggaatggcaagaaagtagggcacctctggggcctggaaggcgcaaaggaaaggctgcagctcgtgagagctgatctcttggaggaagggagcttcgacgacgctgtgatggcttgcgagggcgtcttccacaccgcatcgcccgtcgtcaccggatctaattccaaggaggagatgcttgattcagcaataaacggcacgatgaacgtgctacgctcgtgcaagaagaacccatcgctcaagagggttgtcctgacatcctcgtcgtcgacagtgaggatcaaggacgaagccgacctgccccctaacgtgctgctggacgaatcgtcgtggagctccatcgagttctgcgaaagtctccagatatggtacgccgtcgcaaagatcctcgccgagaaggcagcctgngagttcgccggagagcacaggatcgacctcgtcaccgttcttccgaccttcgttgtcggacctactctgtctcctgagctcggccccaccgcttctgatgtcctcggcctgttcca

SEQ ID NO: 11827 - DNA, 462 bp, Zea mays
  Clone ID: LIB3279-190-Q1-K6-H7
cccacgcgtccgcccacgcgtccgcccacgcgtccgcccacgcgtccgcccacgcgtccgggctgacatgaagaacggcgtgctcagggtcaccgtcccgaagatcaaggacgaggagcgcaaggacgtcttcgagatcaagatcgagtagggtgtgtgcatcggatgggtcctcccaggtctcctagttgcagtccatatccataccgtagttgcagtccatatccatatcgtagttgccatgagctagtcgtattagtagtttcaattactggagtgcagtagtcgtttctgttgcagagcagtcgtagtactagtagctttctggtggtgctccgtctctgcctgatctgaggcagcgtttacctttctgttggtcttgcaaagttcagttccctggatggcgacgatcactgacgatcttgtgatgaacttcaaatggtaatggaatctgcagttaat

SEQ ID NO: 11828 - DNA, 654 bp, Zea mays
  Clone ID: LIB3279-190-Q1-K6-H8
cttgaagatggaacgacggttgctgtgaaggttctgaagagatatgatgaccaaggtgagcgagagttcttggctgaggttgagatgctgggacgtttgcatcaccggaatttggttaagttgttaggcatctgcattgaggagaatgcacggtgtctggtatacgagcttattccaaatggcagcgtagaatcccatttgcatggagcggaccgtgagacagctccacttgattggaattcacgtatgaagatagccctcggggcagcacgagcacttgcatatctacatgaagattctagtccttgtgtgattcatcgcgattttaaggcaagcaacattcttctggagcatgattacacaccaaaagtgtcagactttggacttgccaggactgcaaggggagaggggaaccagcacatctctacgcgtgtcatgggaacattcggctatgttgcgccagagtacgccatgacgggtcatcttcttgtaaagagtgatgtgtacagttacggagttgtattgcttgagctcctcactggtaggaaacctgtggatatgtcacggcctgccgggcaagataacctagttgcatgggctcgaccgcttctaacaaatgttctgagcctacgccaagctgtcgatccacttctt

SEQ ID NO: 11829 - DNA, 640 bp, Zea mays
  unsure (1)..(640): unsure at all n locations; Clone ID: LIB3279-190-Q1-K6-H9
acctggtgccctaccctaggatccacttcatgctttcgtcctacgctccagtcatttctgctgagaaggcctaccacgagcagctgtccgtggcccgaaatcaccaacagcgccttcgagccatcctccatgatggccaagtgcgacccccgccatggcaagtacatggcatgctgcctcatgtaccgtggtgatgtggttcccaaggacgtgaacgctgctgtggccacaatcaagaccaagcgcaccatccagttcgtggactggtgcccgactggcttcaagtgcggaatcaactaccagcctcccagcgtcgtccccggcggtgacctggccaaggtgcagcgtgccgtgtgcatgatctccaactccaccagtgttgtggaggtcttctcccgcattgaccacaagttcgacctcatgtacgccaagcgcgccttcgtgcactggtacgtcggtgagggtatggaggagggcgagttctccgaggctcgtgaggatctggctgcgctcgagaaggactacgaggaggtcggtgctgagtttgacgagggtgaggacggcgacgagggtgacgagtactagacgctctnactggcgcgcgtcgtcgggcttgtgtgccactgctatcctgtgatct

SEQ ID NO: 11830 - DNA, 553 bp, Zea mays
  unsure (1)..(553): unsure at all n locations; Clone ID: LIB3279-190-Q1-N6-A10
tttttggtggggaaaagaaaaacgaagcagcatctcatcaaaactatttttttcagctgtcttggttacttgcacttgattttttataatttgagacaacaataacaacatccaactaatatctcgaaactaacatcatccaatttattgtggggtgggggaactaagattctgtcgctgcgatggaacgaagggcagctgaacaatttagaacccaaaacctgagccaccacccattgccattgggtttgcaggagatgatggtgcttgctcagccaccttggcgtcaacaacaacggcatcagaggtgatgaaggagttcgccaccgatgcagcatgctccaagcagcacctcacaaccttggtgggatcaatgataccagcagccatcaagtcctcatactcccctgtagccgcattgtacccatacctgaagttctcattggcaagaaccttctnagtaaccacactgccattaacgcctgcattttttgcaatcaatttaagtggataggtcaaggactttcttacaatttcaggcccaaccttttgt

SEQ ID NO: 11831 - DNA, 548 bp, Zea mays
  unsure (1)..(548): unsure at all n locations; Clone ID: LIB3279-190-Q1-N6-A11
gtgggggttgtttgggtttttattatttttttttgggtgcanccccaaaccaacgtcactgcagttgcttatttgggtgtaagggggaggaagcaaagaagggtaaaacaaacatctctcagcaggagattgtctctccaactcntcatgggcggggggggggaaaagcataaataaacgcttaaaatccaaaaatggaacttgtacagggttgaacaagcaagaagcctccttatgaagcagactccttggcaattttctcagccttagcaatgacttcctcaatgccaccaaccatgtagaatgactgctcagggaggtcatgatacttcccatccaaaacaccctggaaactcttcacgctttccttcagctccacatactttcctggagcacccgtgaaaacttcagcgacatggaaaggctggctcaggaaacgcttaatcttttttgcacgggcgactgtcagcttgtcatccttactgagctcatccatacccaagatagcaataatatccctgaagatttttggggttttttaaaaacct

SEQ ID NO: 11832 - DNA, 607 bp, Zea mays
  Clone ID: LIB3279-190-Q1-N6-A12
ggtgtggggggggaaaaaaggggggcaaacttcatgtaaactaaaatcccatcagtgctggactaccaaattctcgttcatgacataaccgtacgcaggcacaaataaggcaggtcagagttctcaacaggtcccttctacgcaaggggggacgtggagcccttcacaagggcgggcatgtggcaaaatcatgatgactcctttttctcttccgcagcctcctcaaatgtctctccagggacgagctcaggaacgtcatcgtcatcgtcctgagcagcaccagcgctggcgccagcctctgcacctgaagcaccaggggcctgcttctggaattgctccgcaagcctccgcaggttgtctaggttgtcagggccgagctggttgataatcgatggaagcagatcttgcagcttctttgtctgtggagttccactgaccacccatgtattagcaccaattgaagcttgcactttaggattcacaaactgaataacaacatcatccttaaagatgttgacctcttcaataccaggaatggggttcactcctattcttttcagggtgctctgaagccttttatcatctgtggtcgtaatcttgtgggact

SEQ ID NO: 11833 - DNA, 560 bp, Zea mays
  Clone ID: LIB3279-190-Q1-N6-B10
attcatcaaataattcaattaacacatgacaatttgttctacacatcattcttctatacgcacaaatgagctatcttcctgctccacccacccagctctgctacctaaagatagaacacaaagaattgagactcgtacatcgttgcacaacacagcatctattcatgtcgtataattttgttcttctgcacaagatttagcgtgcaactgatgcgtgttatgatgtatcggcctttctctaagtcgtatatgattttcgtcttgggcttcctccatcttgatacaaagagtactccacataaaagaaacattcccagcacaacaaacaatggtctattgctatgggttgattctgcggtggtgtgtaatggctttaaactcgtattttgcatcagtgtgatgaaagctcctagagcccattcaacctgaatgtctccaacctgggttgaatactcaatcctcttgtcatccagtgggacaccaagactgtcatgcagtagagccacaatgtatgccatcgagaaacaataccgtgaaaaatcctcatctgacctattggg

SEQ ID NO: 11834 - DNA, 601 bp, Zea mays
  Clone ID: LIB3279-190-Q1-N6-C10
ttttgtgtggggggggtttaaacaataaacccccgacgcatcacaaaccataaaactgcagtcacatttccatggggcagcttacatattccatcaatggggcagcatttctgcaagaaatgtaaaagtctaagcctgattccactaccagagattgtgcctaaggctctcaagaatacaaaaagccgtgtaacaaaaaatggctaataaagtcgtatatgttaagctattgcaagacgtccagtggtcaccgacttggtttccaatagcttagaaacgaggccacagatatggcatgagcatgacacgcttcgctccagtgtacctctttagttcgtagaagtgttgaaccactaccaactcttttcatcactgcaatttgcatcaaaattgcctgtgaccacaagcatggtgtcctaaaaagatttgctcaataaatcaactcctgctattggctgtctgagccttgttcaggtttgcaagctcctcaactagcttcttctcgtcgctgctcagccgtttcgggatctcaacctgtacgcgcacaagctggtctccgcgagcattcgacttcccagaagcgggacacctttcttggcca

SEQ ID NO: 11835 - DNA, 656 bp, Zea mays
  Clone ID: LIB3279-190-Q1-N6-C11
tcgcgagctaggagccccagcgtccgcccagcttggcctggggcatagctacagcagggccaaggtgaagttcaatgtgaatcgtgttgacaacatggtgatccaggcaatctttctattggatacgcttgacaaggacatcaattccttctccatggggaggagggaatggttctcatggcacttccctgagcttgtcaagattgtgaacgacaattacctatatgccaagcttgctaagtttatcgtgaacaaatctgatttgacggaaaaagatattcctgctttggctgatatagttggcgacgaggacaaggctaaagaaattgttgaagcagcaaaggcttcaatgggccaggatctgtcaccagttgatttgatcaatgtccagcaatttgcccaaagggttatgaatctctctgagtatcgcaaaaacctttatgagtatcttgtgactaagatgaatgatattgcacccaacctgacatcgttgattggtgaagtagttggagctcgcctaatctctcatgctggcagtctttcaaaccttgctaagtgtgcagccttcacccttcaaatacttggtgctgaagaagccctattcagagcacttgaaactcgagggaacacaccaaatatgggcttatattccactc

SEQ ID NO: 11836 - DNA, 594 bp, Zea mays
  Clone ID: LIB3279-190-Q1-N6-C12
gttgggttgttgggtttttggtccaactcaatatactaccttgtctccatgtcaaacataatgtataagaggatccatagtaattgcagagttcccataaggctcatacatggatatagcaggctaaaataggctaatagaaatgtgtgtgcgaataggagtggtgtctaaaatagctaaaactgactatagtgcctgctataggtgactacacagttttctagggacaaaagaattgggcacactgcaccaaaatatttcccctttttcctttatattgggaaacataaataaacaaaaggatgattttttgcttctattgttgatcaagcaagagataaacctcatatttcagataacattcgagaacatctaaaaacattggaccactttcaggctttcagcactcttgctcccctcagctccacttttgttagagaagtctttcagttcattctatcagaagttcgactggagcgtaaaagttgagcatcctgttagcatggtccaggggatgacaggaccagagacaaaattcaagcttcagaaccctcttcttcagctcctgatcagttctctggtgcttttttaact

SEQ ID NO: 11837 - DNA, 554 bp, Zea mays
  Clone ID: LIB3279-190-Q1-N6-D10
gagacaagaggccaggattggaaactcttgtaaacgtcacttgtgtaaaacatgtctcagtaaacaagtttttccgttttcatccgttgaagcattgccacacattgctcagacagcatttgcatgcacacaagtcaagcacaaacagtaattaaatccatatatatactaagttgtacaataaaaaaacaatagttttaccatcaatctgtcctccatgcaatatagcaaaagcctttttgctcaaggtaggttgagttattctcaggctgcgccacagaaccatcgatgaaagtacccagcattgttacgcgctcaaaacgaagcacccacacacaaatgctaccggtaaacggccaatgcgttgatgccctcactgctccctgatcttcttgatgaggatctcgcggagcttcttgccgagctcctgggaacggacgcgttgcataagccccttacgcgcgagcacgcgcttctccgagtccttgacgtggtaatgggtgcgcgcccggatgaggcgctccatgccgctggaccgcatcctgcgctccatg

SEQ ID NO: 11838 - DNA, 549 bp, Zea mays
  unsure (1)..(549): unsure at all n locations; Clone ID: LIB3279-190-Q1-N6-E10
cagaaacctgactacaaaagccagaggtaaaaccattgttaaactaaaacactctgatagatagaacttgctaagcacataacacaccgcctgagacactttgggcacacacttagtttgtacagtacctaactgacaccaaccacaatcagagcttagacctaaagcaacccatctcatgcggaggccttccgtgccttcttggaggcaggggacttcacggtcttcggcttggccttggccttggcggcgggggacttcttcggcttcgccacgaccttcttctcgggcactttgcgcttggtcccagcagcagcggccttctttggcttggcagccgctgccttctttgacttggcggcggcggccttggccggcttgggggcggtggtcttggcagcggcggcctttgccggcttagccttggtcttgggggatgccttcttggcggcgtccgagagcttgtacgaagccttgaccttcacgagcttgcccttggctgcggacccacgnagctggatggaaagcatcttcttgaagttggccggc

SEQ ID NO: 11839 - DNA, 572 bp, Zea mays
  Clone ID: LIB3279-190-Q1-N6-E11
cgaaattcgaaatcgttgaaggaatgcaaattctacaactccttgtggggggaaaaagagcagtaccaattcaaaatggtggcattcaccgtcctgaactcacgaattcgaattcaccgtcctgcagttgagcgtgacctcccccgcggaacccgtgagcgggccgatgttgccgagcctgaccatggacgcggcgaagtccgacgagaaggcgtcggcgttggtgccgtagaggcgcacgagcgagtcgagtgcgccgttgctgaagagctcctggtccgagtgcagcaggccggcgccggccatgaggctccggtagtagccgttgtcgaactggtcgggggtgagcgagtcgagcggcgcgagcgcgtcgtcggcgtcggcccccgaggacgacgggcaggcctggcgctgctgcgcggcgaacgccgggctcacgttgtcgtcgcagtagacccgggtgcggaagctggcgcagcgcgccatccccaccgtgtgcgcgcccgacagcgccgcgaggtcgcgcgggcccaggccctttgcggggaacccgccaccagcccggccaggtc

SEQ ID NO: 11840 - DNA, 608 bp, Zea mays
  Clone ID: LIB3279-190-Q1-N6-E12
gcaactccatgccctcttgatccatttctttgtttcaagttttaacatagatccagcagctattacaattcatggcattgcgccatttataagtgactggtatctacacgaacctgctcgactacactcattaaaatgctggggcgaatcatgcgatgcgtgagcgcgggcggggcaacgtgtgccagggcttcagaagaacaatggacgctgcacatatcgtttcatttacaaggctactactacttacattgatataactgggattagatttttacaggttacactggtgcggtcagaaccaggaatcacatgccaatggctctcgatgacgaaagctcagcttccccatccatttcgctccccactccgtctcctgacacctttatctgggatagatattgatccaaagcaccatcaccgtaaagaatcttagctccgcaaccaggttggtccactgatcctactgcatcttcatctacaaccactgcatcgattcgcttctccccagattttgcatctgggatctcatacatagaatccatgagaatattctcaaggatagttcttaaaccccgtgcacctgtattttttgacattgccttttt

SEQ ID NO: 11841 - DNA, 671 bp, Zea mays
  unsure (1)..(671): unsure at all n locations; Clone ID: LIB3279-190-Q1-N6-F12
gcacgctcgtagcttggtccttaacgccgcgagggggcggtggggccccacgggcgccggctgctcgtcctcctggacgacctggccgtgcggtcgtcgcactcggccttcttcggctcgctccaggcgcgcgggttcgatctcgacttccgcctctctgacgatcccaagctctcgctcgcggcgggcggccagtacctctacgacggcctcgtgctcttcgccccctccacaccacgttttggtggatcagtggaccagaacgcagtcctcgaatttattgatgctgggcatgacatgatcctggcggcagattcctctgcctctgatctcattcgtggcattgcaacagagtgtggggttgattttgatgaggatccagaggcaatggttattgaccatatgaactatgccgtcacagatgttgaaggtgatcacaccttgattgctggtgatgatcttatccattcggacatgatactagggtctgaaaagattgaggctcctgtattgtttcgaggaattggacacatggctaatccatcaaacagtttggttctgaaggttctatcagcctctccatcagcatattcagctaatccaaagactaagntagcgtctcctccatcgctcactgggtcagctatatcattggtttcggttatgcaggc

SEQ ID NO: 11842 - DNA, 463 bp, Zea mays
  Clone ID: LIB3279-190-Q1-N6-G10
tttgtttgttttttttttttttttttttttttttttttttttttttttttttttttttttttttttttttttttttttttttttttttttttttttttttttttttttttctttttttttcgtttttttttttttgccttcctggggggggggggggggggttttttttttgttgggggtttttttttttttgggggttttctttttctatttttaattttttcctctttccagagggatttgactcccgttgctaaaggtgtaacgcctggggggcttattgtttaagttttttttctttcatttgtttgggttgggtgccttttttccgttggggtttttttttgtttctgttccctaaggtgttcggctttctccccgttagggggtgtgggggtttggggccctagtttttttttttttttggcctgtgggagggtttttttttggttgtttttccccc

SEQ ID NO: 11843 - DNA, 626 bp, Zea mays
  Clone ID: LIB3279-190-Q1-N6-G11
gtggggggtttgtttgggtaaacaagaacacactgcaacaagggtagtacaaaactcataaccatgtatgccttacattcgatgttccataaaaaaaataagtcttaatagcatcacgggttcaacgaaagttataatacttcatgaccaggggggggggggcatcatagattacttgtgcacgcgacaactgcaaggatgtcaacaagacgagatattttaagcttccacgaggtaaccaacaagcaagcacagcaccagccagatagatcatttcttcttggcagcagccttcgtcaccagccagatagatcatttcttcttggcagcagccttcgtcaccttggctccagttgggtccttcttctccacactcttgatgactccgacagccaccgtttgcctcatgtcacggacagcaaatcgaccaagaggaggatactgagaaaaggtctccaccaccatgggcttagtgggaaccatcttcacaataccagcatcaccgttcttgagaaaatttggctccttctccagctccttgccggatcgcctatcaatcttggtaacgagctcagcaaacttgacagcaatgtgtgggggtggggcagtccagaactggggcatag

SEQ ID NO: 11844 - DNA, 573 bp, Zea mays
  Clone ID: LIB3279-190-Q1-N6-G12
gggtggggtttgtttggtttttaatttttttttttttttttttttttttttttttttttttttttttttttttccgagaatatggcccatgaatattatttctcgacacatgacccattggctcttacattggcttaatggtaccccgcggggggggggggggattatttcttcagggccaaccccgactaaccaatgcctagctctgacccccttggccatgggttcagctaaaggccccccgagtatggcgttcccaatgtcttctctgcttagggcggagctaaaccttctctccatatccttggaaaaatttccagggccgcttttcaagtccctgatggggagggcggggacatcaaggctaaaacccccgtcccaaagcggtttttcggcaacccaaacgggggggtcctcgcgggactgcgggaacccgaggctgcgaccccacccctcaatgcacggaaggctgggcgtgtacagaggcttttttttttccgggagccgttccagccattgcgcgtccgacggaagggccgccgccagcgccaaaacccccgcccctctccccgt

SEQ ID NO: 11845 - DNA, 618 bp, Zea mays
  unsure (1)..(618): unsure at all n locations; Clone ID: LIB3279-190-Q1-N6-H11
tcgcgaggganacganggggacacgtgggttcgtgtagcaccagaagagcacccagttcttcttacagaggctcctcttaaccctaaggctaacaggggaaaagatgacacaaatcatgtttgaaactttcagtgttcctgctatgtatgtggcggggggggcgtggctttccctttatgctagtggccgtaccactggtattgtgctggattctggagacggtgtcagccacactgtcccaatctatgaaggctatgccctcccgcatgccattcttcgtctcgatcttgctggtagggacctcactgattccctcatgaagatcctgactgagaggggttactctttcacaaccactgctgagcgggaaattgtccgtgacatcaaggaaaagcttgcatatgtcgcgctcgactacgaacaagaactcgagaccgccaagagcagctcatcagttgagaagagctatgaactgcctgatggacaagtgatcacaataggcgcagagcgcttcagatgcccggaggttctcttccagccatccttcattgggatggaagctccaggaatccacgagacgacctacaactccatcatgaagtgtgacgttgatatca

SEQ ID NO: 11846 - DNA, 615 bp, Zea mays
  Clone ID: LIB3279-190-Q1-N6-H12
gtgttaccaaaaattccataacgcacatatacatgaattgcgaatcacacgtgttcatattacaacaaacaaaatatacaactcatgaattgcatcaaaaagtattttataaaatacacaaaataattgggtcgtcttcaaccttgggggcgtgcgtgtgacggggatggatcgacgggtttcgaccggatggagaagagcaggggcttgactacggacggcggatggcgtagctccggcgaactccacgggctccggcgacgagcggcaaactccggcgacgaacggcactagcgatgagcgaggagagctagagagcgaggcggggaatgggagagagctcgggtagggaggatgggagagagctctgctgtcccttttatagagagagggaggggagaggggaaaggacgccagggaggtcatggggcgccgacggccttcactggccattgatggcgtcggttttctgctcataatggggagaaatgggagaaggagtaacggaggatttaaacaccattaatcgcgcacgtaatcgaacagacgcgcgcggtcttgggcttgcatcgcgccggtcggagtcgcgtccttgggacggggtcgggcagctgc

SEQ ID NO: 11847 - DNA, 360 bp, Zea mays
  unsure (1)..(360): unsure at all n locations; Clone ID: LIB3279-192-Q1-K6-A1
cggncgcgtgggtttggtcctaattttttttcacaggacccaatgatatgccgctgcatggaaagtttcatcatttcatgcctgtggtcggtttgctcgtgaagattgcttttgtttgctgtggaagcgggtgcaagtgttacacagcagcaatatcgggactgttgtgaaggatgaagttgagagtcaacatctgagaaccatggagctcaccatacgccacataggaactaaagctgcttgtttaggcatggttaagagagtcagtgctggtcctttgggttaaataaaaactttgcggggccgcacagtgtgcagacaaggttgagtctatggccctaggctgatggtctatgtatg

SEQ ID NO: 11848 - DNA, 565 bp, Zea mays
  unsure (1)..(565): unsure at all n locations; Clone ID: LIB3279-192-Q1-K6-A10
ccccgcgtccgcttttccacccacccgcccacccctcgtttcctgcaattcgccgccatcgttcgctgaacttgagcgcgtctgccgcctgccaccaccgctctctgcctctctgctgctctgttctttctcccgccggggcagaggagggcggggaggcccgttgagcgagcctcggtcggtgtggggatctgcgcctcgtccaagcgcgtgcggcaggaggagcaggactccgacgagaacgtggtgtacgtgatggacgagcagggcggcgggggagaaggcgaggacggccgtggcgcccgcgcggcggcttcccgcagggtggcctccctcttctcgcagaagggcaagaaggggcccaaccaggacgccgtcttactctgccagggattcggcntggaggacggcgtgttctgcggcgtgttcgacgggcacggccggtgcgggccgttcatcagcaagctgtgtgagggactacctcccgttcatgatcctgagccaccggaacgcgctcctcatgggctccgacgacgacgacgactacccggccttcagcgacgcg

SEQ ID NO: 11849 - DNA, 658 bp, Zea mays
  Clone ID: LIB3279-192-Q1-K6-A11
cggccgcgtggggccgccgtcttctgcggttctgccgtttactcttccactttggcctcctctcttgcaagtttaagcttcgcctccagccatgggtaaggagaagtctcacatcaacattgtggttattggccacgtcgactctggcaagtcgacaaccaccggccacctgatctacaagcttggaggcattgacaagcgtgtgatcgagaggtttgagaaggaggccgctgaaatgaacaagcgatccttcaagtatgcttgggtgcttgacaagctcaaggctgagcgtgagaggggtatcaccattgatattgctctgtggaagtttgagaccaccaagtactattgcaccgttattgatgcccctggacaccgtgactttatcaagaacatgatcactggtacctcccaggctgactgtgctgtccttatcattgactccaccactggtggttttgaggctggtatctccaaggatggccagacacgtgagcatgctctccttgcgttcacacttggagtgaagcagatgatttgctgctgcaacaagatggatgcaaccactcccaaatactccaaggcacgttatgatgagattgtgaaggaagtctcatcttacctcaagaaaggtgggtacaaccctgataagattgca

SEQ ID NO: 11850 - DNA, 520 bp, Zea mays
  Clone ID: LIB3279-192-Q1-K6-A12
cggtcgcgtgggttcagtgcctttccatctgcacaaacacctccagttcatccccattctcgtatggcacacatgaatcccatgggccaacaagctgttgcaccttcacacaatccttatgctgcacagtcctttccaaacagtcagagccattatccatctgaagaacattggcggatggcatctggtaacttcagtccagatgaccagcataattggatagcaagtggcagatcattaccttgctcagaagggccatttgtgcatgatggatattcaagatcaaacattgacagatcttcaatgaatcctatgaatcatcaacatactgttctgaatcatttgccatctggagcaccactaccaggccatatttctcagatgctaccagccaggtctgatatgcacactcttaattgctggaggccctcttgatagagttgtaaactgaacttcttgtttgtgattttgacatggaaagctcagggcattggaggcaatttgaattgagttcaacaat

SEQ ID NO: 11851 - DNA, 304 bp, Zea mays
  unsure (1)..(304): unsure at all n locations; Clone ID: LIB3279-192-Q1-K6-A2
gtgtgagatnccctgctggncttgcccgcccttttcggtttggcttcgcgtctggaatgtgtatacaggattactggtcagnattctgagagtaacgggaagattctctgctggggtagtgggattccctgcntatttatgtgnaaccngctgtcggtctttatgcacaggtgcaacggcaacacaaatctggtnggaacactggtgggtttctgtccgtggttgggtgttgtgtagtattatgtagtctattccagggaaacgtagtttagccgtggttgtgaccgcgcgggaggttgaggaa

SEQ ID NO: 11852 - DNA, 504 bp, Zea mays
  unsure (1)..(504): unsure at all n locations; Clone ID: LIB3279-192-Q1-K6-A3
ctttcttccattcgaggtgatttttcgtggggttagggttagaaatgggggcaaccacagtttgttcgatggtggcagggcgaatgtgggattatgattttcccacgcttgctaggtggagagtgaggagaatgaggattcttgaattgctagctattgttgtntctgttagatggatttatctgttttagcttgagtaatacaggtgttagaacattttagggcgaatgtgcttgtggtctcactggctggaaaattgcctatcaacagattaagagtatgaagtcaaggtacttggacgagctgaatggtgttcagtcagatcagatgtgggtcatgctggaatgaagtgtttctagctaatggtgaactatgaaagcatttgacccccttgatattcatgggcggttttagttatctgtngcttttntttcccactccacccgtttcaaattatgcttttctttggctttgnccttagtcaattttctctaacttttacaa

SEQ ID NO: 11853 - DNA, 598 bp, Zea mays
  Clone ID: LIB3279-192-Q1-K6-A4
cctcgttccccaatctcctctccatcgaaaccctagcacgacgcaattcccgtcttcccacgccgtgtcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggcgaggatgtagaggaaatcgaggaggtggaggtcgaggaggaagtggaagtggaagaggaagaagaaggcgagagcgaccaggcttcgatccaggcgctgctggattcgttccccaaggaccagctcgtcgagctgttacgcgacgctgccatcgctcacggcgacgtgctaaccaccatccggcgcgtggccgacgccgacccggctcagcggaagatcttcgtacacggcctcggctgggacaccacaaccgacaccctcaccgaggccttcggcccatacggcgagatagaggatctcaagttcgtcaccgaccgcacacggggcagtgcaaggggtacggggtcattctttttcg

SEQ ID NO: 11854 - DNA, 296 bp, Zea mays
  unsure (1)..(296): unsure at all n locations; Clone ID: LIB3279-192-Q1-K6-A5
ccccccagaaaaggggccagaagggaaagaagcccacannggggcgggggcaaacnccaaaacgcgcaaccnagcnnaggcnnggggcggcngcgaggggcacagcccccggggccggagggggagggcgaggccgagccnccgccgggcgccgngccnccaaggccccngaccaccccggcgacgggcacggcganggccgcggcgagcgcgngagggacggggagaggcacccggcggcagagggggcggccgcggccgcccccgncggcggggcngacgnnggggcgccngcc

SEQ ID NO: 11855 - DNA, 148 bp, Zea mays
  unsure (1)..(148): unsure at all n locations; Clone ID: LIB3279-192-Q1-K6-A6
cgttcgtttctgctccggccgtttctccctcgccaggccctttttgctgccgacgccgcgccgngttctccttcgtgcccgttcttctccgtgcctccgcctgctcggggtcccaccgcagcgccgtcctgctccggcccctcgctgc

SEQ ID NO: 11856 - DNA, 550 bp, Zea mays
  unsure (1)..(550): unsure at all n locations; Clone ID: LIB3279-192-Q1-K6-A7
ccttcatgcatttgcaaacgagtccaaggagaagctccagcagctgatattctacaggttcatatatctcattttgttctgtgatgccaccacatgagtgctttttctatctatgttcttttgttatgtatttggttactagggatggcataagtgagggtcaattcaatcgaattttggagaaagaaatcccagcgatagaaaaggcttggaacgcactgtatgacaatgagaagccacaaatcaccttcgttgttgtgcagaagaggcataaactgaggctgttccccgtggacgacaactataagatccgttctgctaagaagaaaattgttgagcctggcacagtggttgatagtgagatatgtcacccagcagaatttgatttcttcctttgcagccaatctggtgttatcaaaggcccaaggcgtcctgtgaggtaccttgtactgcgagatgatnacaacttcacggcagatgaactgcangctctcacaaataacctgtgctacacttatttangcngcaattgttcgttgtcggtcgcttc

SEQ ID NO: 11857 - DNA, 530 bp, Zea mays
  unsure (1)..(530): unsure at all n locations; Clone ID: LIB3279-192-Q1-K6-A8
gtgaccgccgcctctgccgccctacgccaggttccaggtcttcgtcactccctttccttatcttcgtcgtctcattcgccggcgacgagcacccaccagaaatcatagctgctttgggtatggaggcgctgtttgggagcaataaccatggcggccacaaggccgctgctttggcatcgcttgtaattgcccacgttgccttggaggtgccaaggttacttgggctccttgccctgattctgcataatggaatctttacatctggtggagaccccaatttgattactcggattctgggccatagcgaagatgaaactattcctgcgaacaaagatgatggagagtccgntgatgattatgatgatgaaggggacgctgatgatgctgtaaacgcggaggcagatgatggtggtgttgtgggatctgctgnctctgcnaatgcggaggttgtcgatggcgatgatgatgatcctgctgcctctggcgttggggggtgcgttgtcgcccaagatgatggtgggagaggatga

SEQ ID NO: 11858 - DNA, 603 bp, Zea mays
  unsure (1)..(603): unsure at all n locations; Clone ID: LIB3279-192-Q1-K6-A9
gccgggnaatgcaacaacatgctgtacccgcgggaggacaaggagacgcgcaccctcctgtacgcgtgccaaacgtgcgagcatgaggagattgccactgatacttgtgtgtacaaaagggttatccgcaagcctggtggtgagcccaaggatgtcctgaaggatgcagcaactgatcctagcctgcctcgcaccagaagcgtcagatgttacaactgcaaccatccagaagctgccttttttcaggccccgactaagggagaacaagccatgacgctgtacttcatctgctgcaacccaagctgcgggcacaggtggagggactgagaaggatctggcttggtcttcgctgcaaacctgccgtattgttagcctatcacataaatattgtaggtacaagttgtgccgtcaactgacgtttgatgcaagtttataagctactataacctcgtaacaaaacgatggtttggctggagacgaaatctgttgttcctgatgataagccaaaaactntacggccgagctcaggtaagaaacagaagcggctatgaactactgtggtgtttggtttgaggaatgagctagtctatcatcttctcactc

SEQ ID NO: 11859 - DNA, 247 bp, Zea mays
  Clone ID: LIB3279-192-Q1-K6-B10
cagcgtcgttttttttgcgctgtcactcgcagccagcaggtcaagagcgaacactacacaccgcgagcactgttaccatgcatacagcatacatagtctactagaaacgtgatacaacgtcagacaacacaacgaacacgcgagcccttaccaaggaggagcatggtcttgactgggaacctgcgcccagcgccggggaaccgcccctcggcttagcagagctgaacgccgcaccgtcacggacggt

SEQ ID NO: 11860 - DNA, 652 bp, Zea mays
  Clone ID: LIB3279-192-Q1-K6-B11
cgggtcgcccagcgtccgccaagagagacaggatggaagcttgttcatggagacgtttccgccctcctgcaaactctgacttactctgtgtctgtgttgggactggtgttcagttcttcggtatgctgctagtaaccatgatctttgctgttctgggtttcctttcaccatcaaaccggggaggactgatgactgccatgctgctcacttgggtcttgatggggttgtttgctggatatgcttcttcacgcctgtataagatgttgaaaggatcagaatggaagagcatcaccctgaggaccgccttcctgtttcctgggattgctttcggtattttcttcgtccttaatgctctaatatggggggagaagtcgtctggcgctgttcctttcaccacaatgtttgccttggtcctcctctggtttggtatctcggttcctcttgtatttgtcgggagctatctgggcttcaagcaacctgccattgaggctccggtgaagacgaacaagatcccgagacaggtccccgagcaagcttggtacatgaaccctgccttcaccattctgattggtggcatactttcggttcgagcagtcttcatcgagctcttcttcattctgacgtcgatctggcttcatcagttctactacat

SEQ ID NO: 11861 - DNA, 497 bp, Zea mays
  unsure (1)..(497): unsure at all n locations; Clone ID: LIB3279-192-Q1-K6-B2
nggcaaagcgagcacagacagacaccgttacgcgagcacgcaacgcgacgaggagaggagacgcttaccgagcgaagagcactaggctccgccatcgacgcacgcacgcaagcgtgaagcgtcctcgactcgcctttcggttcggttcggttcctcgccgtcgcgggcggcctcgtcgggcgaccgctctctcggcatttctttctatctggttcctgtccgcggcgcggtccccgttcctcatcaactgctacccctgcttcgcgtacaaggccgacccgggcaacgtgccgctggagtacgtcctgttccagcccgacgccgccggggtcaccgacgccagcacggggctcaggtgcgacaacatgctgtacgcccaggtcgactcggtgtncgccgccatccagaagctgggccacaccgacgtcgacgtcaaggtctccgtgaccgggtggccgtccatgggggaccccgtcgaggccggtgccacgccggag

SEQ ID NO: 11862 - DNA, 223 bp, Zea mays
  unsure (1)..(223): unsure at all n locations; Clone ID: LIB3279-192-Q1-K6-B3
ccccgcgtccggntcagctagcgagagaagcaatggcgtcggctcctgcgttctgcgtcgcgctgctgctgctgctggcttccgccgctgccgtccaagcggtgccgccccaggccggcacgtcgtccacctgcagcactgacctcctccgcctcctcnccctgncncnntgcccttcatcgagggcgccgcgcaccgtgcnccgggggnncggggggggggg

SEQ ID NO: 11863 - DNA, 537 bp, Zea mays
  Clone ID: LIB3279-192-Q1-K6-B4
tgggatgccgtccaaaccctacccccagtccctgacctcctcttcctcctccgccgtcgcccccgcgacctggatgtccgcatccgcatggacggtgcccgagtcctgatcgccgccggtgccaccgccgtctgctgcttcgtctgcgccttctgggtcttccgttcctcttcgtcctcctcccccgcatccccaaagaagcaccaatccccttccaccaactgctgtggctgcgcctcctgcggctgccgcgacgccaagcccgccaacggcgagatggccgtgggtggggagaacaagaagaaggcgccggagccggatccgccggaggcgccctccatgatggagcagctcgtgcccgagatcaccacccacgcgctcagctacctcgactacaccagcctctgccgtctctccatgaccaactccgccatgcgccgcgcagccaacggcgacggcgcctgggaggcactctaccacaaggattttacggtggaacagggtactataaatcctcctaatggatggaaggcatac

SEQ ID NO: 11864 - DNA, 627 bp, Zea mays
  unsure (1)..(627): unsure at all n locations; Clone ID: LIB3279-192-Q1-K6-B6
cctacccctacgagtatccaagtccaaccagcaagaggggaggcgctgcacgcaggtcacgcggcgatggacatatgcgatgtttgagcaggcggtggcagatttctgctggcatgcgagggaagtagtgtcgtcagggatggggctctggggttggccgtgggggcgacgtgggccgtggggcttcggctccgcgtccaccgccgaggaggtcaccgccggcgtcgacgcaagcaacatcactgccatcgtcacaggagcgacgaatggcattggaaaggagacagccagagttctagcactgaggggagccaaggtaatcataccagcttggacactggagagtggcctcaagttgaaggagagcctcgcagatgaggtcccaagctccaaggtacacgttatggagatggacctgagctgtctcagctccgtccgcgacttcgcacggtccttcaattcatcccacaagcatctgaacctcctcataaacaatgcagggatcatggcctgcccttaccagctgnccaaggatggaatagagctgcnnttcgcacgaatcatgttggccatttcttgctgacatgtctcctgcttgncaagatgaaatcaactgttgcagagaca

SEQ ID NO: 11865 - DNA, 618 bp, Zea mays
  Clone ID: LIB3279-192-Q1-K6-B9
gtgaacgtgacggggctcagcgtgggtcggacctgggtgaaggtccccgcggggtcgttcgcgttcgacccggccaccggcgccggcacggtgatcgactcgggcacggtgatcacgcggtggacagcgcccgtgtacgcggcgctgcgcgaggagttccggcggcaggtggcggcgccgagcgggtacacgtcgctgggagcgttcgacacgtgcttcaacacggacgaggtggcggcgggcggcgcgccgcccgtgacgctgcacatggacggcggcgtggacctgacgctgccgatggagaacacgctgatccacagcagcgccacgccgctggcgtgcctggccatggccgaggcgccgcagaacgtgaacgccgtcgtgaacgtggtggccaaccttcagcagcagaacgtgcgggtcgtcgtcgacgtcgccggctcgcgcgtcgggttcgcgagggagccctgcaactgagcccctgaatccgtccgtgccctatgcacgggaggaaggaggagacgcgctgcggctgctgcatcggtcggtgtgcagttaggtgtcctgttagtctatgctacgttgtctgcactcttgcataacggacgtgacccgggg

SEQ ID NO: 11866 - DNA, 453 bp, Zea mays
  Clone ID: LIB3279-192-Q1-K6-C1
cgtgggcgctccggaatgtcggcgggtgagctgcggttggagctggacgagctgcggcggctggagagcctcgccaagcacccccgcgtccagatcctcctcgccaacgaaatccgcaacgttgatacgaagttggcgaaggcaaccgaaccatcgcctgagccactggcggcggcttctgcgccagcgcccgcgcccgctgcgcgtcctgttttaagctacgtcactcttgggtcgttcagctgggagcaggacaaccagaagattaggatatatgtttcccttgagggagttgagcaagagaaggtggagactactttcaagccaacatgagtggatataaagttgtatgatgtcaaaggcaagaattaccggtgtgctataccaaagctgaacaacgaaattgttcctgagaaatgtaaagatgccgtgagtccaaccagggttgttgtt

SEQ ID NO: 11867 - DNA, 551 bp, Zea mays
  Clone ID: LIB3279-192-Q1-K6-C10
agaaaccactctcatcctctcgcaccgcaccgttcgcttcctttcgtcaactccactcctcttggccgccgcatcacctcctcttcgccgctgccgccaccgctccaccgggcagccagccagccatggatgaggagtacgacgtgatcgtgcttggcacggggctcaaggagtgcatcctcagtggtctcctttccgtcgacggcctcaaggttttgcatatggacagaaacgactactatggaggagattccacctcgctcaaccttaatcagctctggaagaggtttagaggggaagacaagcccccagcacatctaggtgcaagcagagactacaatgtggacatggtgccaaagtttatgatggcaaatgggacattggttcgaaccctcatccacactgatgtgacaaagtacttgtcattcaaagctgttgatgggagctatgttttcagcaaagggaagatttacaaggtccctgccactgatatggaggctctgaagtcccctttgatgggtctattcgagaagcgcagagcaaggaacttc

SEQ ID NO: 11868 - DNA, 622 bp, Zea mays
  Clone ID: LIB3279-192-Q1-K6-C11
cggtcgacccagcgtccgtgtttatgttgcaaatgatacggttcaatccctgcataagcaagatagtaagatagtgataaaaaagaccataaaattgttggacgggccaccttatccaaaaaggccaaagcttgagccagcacaaactggtagagatgctgaggctaagggacatgaattcatatcacagaagaatgtgggggaggtaacaccatgcacaacatctggagaactgcgtgtcattatattaagaagaaaaagactaaggtcctagatgaccagtacaaacatcaaagggcctccttacggcggctaccaacaagcataaacgaaaccatccatgactaaaaaataataataacggccaatcatcaaaaggaacctgtcaccccttttcagaaggactaaggccacattcttcgcagtcatgcagccccagccagacaccatatcctagcatcattcttgatgtcctgagtaatagtattgatgctcggagtattgattcatagtttcgtacaattacaaggcaaatgcccaaagctggaatggaaagctaagttgtgcaggacatattctcaatcttggcagcaatggaactatgtttaccaggcagatttgc

SEQ ID NO: 11869 - DNA, 636 bp, Zea mays
  Clone ID: LIB3279-192-Q1-K6-C12
cggacgcgtgggcggtttgttactctgcctgaggaaagacttctagctgtggttaatgctctgcttcatcgctgctacaaatatccaactgcaaccactggcgaggttccacagtctctcaagaaggaactctctggtgtatgtagagcttgcttctcacaagatgctgttaacaagcatgttgattttgtgaaggagtacaagcaagattttgaacgtgatcttgacccagagagcgctactacttttcctgcaacccttgctgaacttacggagagattgaaacactggaagaacattcttcagagtaatgtagaggatcggttcccagcagtattaaaactggaggaagaaagtaaaacacttcgggattttcatgttgttgatattgaactcccagggcagtacttcacagatcaggaaatcgcaccggaccacactgttaagttggacagagttggacctgacattccaattgtccggaggcatggcagtagctttcgacggttgacactcattggttctgatggttcacagcgccattttattgttcagacatcactgactccgaatgcccggagtgatgaaaggatgctgcagctattccgtgtgctaaataaaaatgttgacaaacac

SEQ ID NO: 11870 - DNA, 483 bp, Zea mays
  unsure (1)..(483): unsure at all n locations; Clone ID: LIB3279-192-Q1-K6-C4
gttttactgatatgttagtgnaacatatcccctcggtgaaggatgctgctgcaaggaagatagaccacatatacactggaccacaagattcctctattgtagatgccatgaaaaaatgtgatcccaatggaccccttatggttaacgtaacaaaactatatccaaagtctgattgcagtgggtgtgatgtcttcggacgagtttatagtggcacaatacagactggacagaccgtgagggtccttggagaaggctattctccagatgatgaagaggatatgactgtcaaagaggtgaccaaattgtgggtttatcaggcgcgataccgtgttgcaattngtaaagcccctgctggctcttgggttctcattganggtgtngatgcctcaatnntgaaaactgctgctatgtgtcctgtgantnttggtgaaggcgtgtgcgtgtttagacctgtacgttggagcaccttgcgcgttgtggaaa

SEQ ID NO: 11871 - DNA, 546 bp, Zea mays
  unsure (1)..(546): unsure at all n locations; Clone ID: LIB3279-192-Q1-K6-C5
ggnacttccgcaagctattggtgccacttgtaagtacttaccgctatgatggaccaggggtcaacacaaggttggcacactcagaagccaaactacttcatgagaagatccatcacaaggcttacagtgatgatgagatcatcagaatcctcaccactaggagcaaacctcagctgattggtgggttcaatcattacaatgatgcatttggcgcccgaatcaacaaggatctgaaggctgacccccaggacgaggtcctcagaacgctgcgggcgatcatccggtgcttcagttgccctgacaggtactttgagaaggtggctaggcaggccatagcggggcttggcgcagatgagaactccctgaccagggtcatcaccacccgcgctgaggtggacctcaaactgattaaggagggcgtccagaagaggaacagcgtgccgctggagcgggccgtcgcgggggacacctccggcgactacgagagcatgctcctcgcgctcctngggcgggagtgatgagcccgtctggtgcgctggtgccttt

SEQ ID NO: 11872 - DNA, 616 bp, Zea mays
  unsure (1)..(616): unsure at all n locations; Clone ID: LIB3279-192-Q1-K6-C6
ngntagttaatccatgcgggattaaaattgtaaatagcatagcattgcattgcatgtcaagacttgtgctgttattctttgccccttctcgttcctaaagtagttgactgacatttcttcagatcatggtatgccggttcaccaaggaatcataaacgatgcaagttctccagaacagaacatcaacacaactgcctgcctactagagtgtttgtttgtagaactggcgcatctgcattcagtgacagtgtttgcctttctttctttgcgcagagatctggatcctcggctacaggctgctttacgagagtatctggtagcgagaggcttcaactccaagctggcaagttcgattcttcaacacctccttcggaaggagcgcaaccagtatgtgaattggctgaagactttggaagaggcgttcgccaaacatcactgacccaatgaaacgattagtggatccttctacatagcctggatttggcactctactattgggaaaaaaccggcgagagtgtaaaccttctacgtctattttccaaaaccaaagctgtcgtgttctttcccatttaacactagaggtattcgatgagccaatacagttttgcagagagct

SEQ ID NO: 11873 - DNA, 580 bp, Zea mays
  unsure (1)..(580): unsure at all n locations; Clone ID: LIB3279-192-Q1-K6-C7
tggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccgaggggatcaccgaccgggagacggggaggtctcgcggcttcggcttcgtntccttctcctccgagaactccatgctcgacgctttcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacngcggtcggcgcgagggtggtggcggcggcttcggaggcggtggcggctaccgcggtcggcgcgagggtggtggtggcggcttcggcggcngcggctgctgctggagggactgttgtgtgggcccatcctggcttcggcgngttttcttttc

SEQ ID NO: 11874 - DNA, 308 bp, Zea mays
  Clone ID: LIB3279-192-Q1-K6-C8
tccgaagtacgggctcatgtgctgcagacagtgcttccgcagcaacgccaaggacattggcttcatcaagtaccgctgaaacttggggagctccaaagcatggcaataatggaagcatggatggggacctaaaagatagcctgtactcttattcttatgataaaaccatgtaatgaattgtttggctttgtgtggacgaagttggtgtattctagatggtactcttgaatcttgatgcttccctgctatgctagctgagcatgtcgaaccgctatgaatcagacaatacagtatcaatgttaccgctc

SEQ ID NO: 11875 - DNA, 529 bp, Zea mays
  unsure (1)..(529): unsure at all n locations; Clone ID: LIB3279-192-Q1-K6-C9
gcccacgtccgggcgacttgccggggggttagcatcagcttcaccctgagcctcaccctaggcccttgcgaaagcatctccattcttccctcccttgtttccggactggtcttggaatcggtcctgttcttcgggctgaaatggggaacgaaaggtgggaaacgcaatgagcaaccagtgcgaggacctgttcaagcttgtcctgatcggggacacctccgggggcaagctctgcttccttctccgcttctctgacgactgctacgtgggcagctacatcagcaccatcggagtccactctaaaatcctcacgggcgaggcggagggcaagaccatcaagctgccaatttgggacacaccagggcaggagcggatcaggaccatcacnagcagcgactaccgaagagctcacgggattgtcattgctgacgacatcacggtcatggagagctagaacaacgtgaagcagaggcttcgtgagatcgaccgcaacgccaacgacagcgtatgcaagctcctctgtggtcac

SEQ ID NO: 11876 - DNA, 298 bp, Zea mays
  Clone ID: LIB3279-192-Q1-K6-D10
ggggtccgacagggggcctggtcctcggtgcacacacctattccccacaagcatacaacacaatgtgtgcctgaagagccgtctaagcacatcccacatcctgcagaagaaattcactaaccttggcgtctcatggggcctacggacccgctatggccgaagaatatgaactacgggctggggagcagcggggcgcctttcgaggcccccaagtggccgacgggcctactcgaggagtgcaaacatgtgcgcggctgccgccccatgcagttctaccatcgggcccgacccttcggtg

SEQ ID NO: 11877 - DNA, 476 bp, Zea mays
  unsure (1)..(476): unsure at all n locations; Clone ID: LIB3279-192-Q1-K6-D12
cggtcgacccagcgtccggnggtcgagaagcagattgcgactgaggtggtcgaaaagatgcatctgcacaagtggagcccggtaatgggggaggctctgctgcaagggctttgaaccaaacgttgtcttctgaagagatgcaggaccagctggagcagttcacgtatgtgatgcaacagaagttcctgtccggtgaagacaccgaacatatggactactcacggatcgataacgatgagatgctggatgaccactggtccagagaagccaactatgacgcagaggagaagtatttcgaagaagattaggtagtaataggcctactgttttggtgccttggatgcagcgcctcgtcttatgtgatggttatgtttggaaacttgtagagttagcatgtgttttgtatataatgaacagattgttatgttcagaactcgagaaaccaaatataaaaaatccagtttttgtggaatatc

SEQ ID NO: 11878 - DNA, 412 bp, Zea mays
  unsure (1)..(412): unsure at all n locations; Clone ID: LIB3279-192-Q1-K6-D2
gtgtccgccagnacggactggagagctcagcagtgccatgcaccgagcaagagttacatgtcaagcacgaaggggatgatcgaggtaaactaaaggatagttctgggtacactttgggtcagactgcacaatttgtcttccctggggcaggcgtgttttgcaagaacgatngctgcngcangcaagcncatgagaactcaatctactgtnngttgcntagcggtgtttgcaagggctgcntggtccgaggctgtccaagaggtgcacatggnggcacacctctgtgcattgggcatggtggcgggtaacggtgtgtgatccctggatgcccaagtgccgcgtgtggtcaaggcctcagtgaccgctgtgtgtggcgtggtggtggcgggngatgtnnattcctagggtgtgc

SEQ ID NO: 11879 - DNA, 568 bp, Zea mays
  unsure (1)..(568): unsure at all n locations; Clone ID: LIB3279-192-Q1-K6-D3
cccgggtcgaccccgcgnccgnagaaccnggctcgacaccatgctcccaatggccgnccaccccacgagcacgccggccctgtcgccgcgcgcccgcgtctccccgcccaggccttccacctctctggccgccacctcgtcctcgccctgctctcgcatcgtcagtttcaagagcaggaggctgccacttcgctctgtccgcagcgtcgtcgccgctgccgctgccgccgctgcagaggaagaagaggtacaactaggtacaggtgtggatgcggtcgacgaggaggaggcggagaataaggtggtggtgcctgagaggcaggacccgntgctggtgctcaagttcatctggatggngaagaacatcggcgtagctctcgaccacttggttcctggctttggaagcatcccgttgagcccatactacttttggccgcgaanagacgcgtgggaggagcttagagcgaagttggtngagaaagagtgggtctcgcngaagcggatgatcatgcttctcnaccaggccgccggtttcatcaacctctggcagcggggtggcgggagcctc

SEQ ID NO: 11880 - DNA, 502 bp, Zea mays
  unsure (1)..(502): unsure at all n locations; Clone ID: LIB3279-192-Q1-K6-D5
tcgttccccccttcgcaaccaaaaccccagctcgccccgcatcgttggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctgaggccgccaagctcgcgcgctntaacaagaagcctaccatcacctcccgtgagatccagacctccgtgcgcctcgtccttcccggggagctcgccaagcacgccgtctccgagggcaccaaggccgtcaccaagttcacctcggcctaggctgc

SEQ ID NO: 11881 - DNA, 612 bp, Zea mays
  unsure (1)..(612): unsure at all n locations; Clone ID: LIB3279-192-Q1-K6-D6
gccggcgcctccatttcgttttcctcactctctcctccagctcagggtccggcggcgaagggaaggcaagatgtacaccgcgaggaagaagatccagaaggagaagggtcttgagccctccgagttcgaggactccgttgcccaggctttctttgatctggagaacgggaaccaggagctcaagagcgacctcaaggacctgtacatcaacaatgctatccagatggatgttaccgggagtaggaaggctgttgtcattcacgtcccataccgcctgcgcaaggccttcaggaagatccatgtcagactcgtcagggagctggagaagaaattcagcggcaaggatgtggtaattgttgctacacggaggattgtgaggccacccaagaagggttcagctgttctgcgccctcgcaccaggactctgactgctgttcacgatggcatcttggaggatgttgtctacccagctgagattgtggggaagcgtgtcagataccgtctggatggttccaagattatcaagattttcttggacccaaggagaggacaacactgaatacaagctggagacctgcnctgcggtctacccgcagctgtgtgggaaagatg

SEQ ID NO: 11882 - DNA, 473 bp, Zea mays
  unsure (1)..(473): unsure at all n locations; Clone ID: LIB3279-192-Q1-K6-D7
gnatgaaagtctggttcagtctgtttggatgtcatcaaccagacttggagcccaatgtttgatcttgtcaatgtgttcgaggtcttccttccacaacttctgttatatcctaatccttctgatccattaaatggagatgcagctgcgttgatgatgcgtgatcgccctgcttatgaacaaaaggtgaaagagtactgtgaaaaatacgccaaaccaggggatgctggtgtcaccccagaagagcagtccagtgacgaagagctgagtgaagatgaagacgactcgggtgatgaggagataatgggcaaaccagacccatagtcaagttggcacctactatacctgtaatctgcactcgatgtttattgcagcaactgcaattaaacaccccatgaacgtccgcgtgcagtctgagtgccatgtaaataaactgcagtttcaccaattggatttccagcaaaaataatnttant

SEQ ID NO: 11883 - DNA, 320 bp, Zea mays
  unsure (1)..(320): unsure at all n locations; Clone ID: LIB3279-192-Q1-K6-E1
cccacgcgtccgcacaaagtngccagaaggcagcactngagtatagggccaacgatgcagagaggaaggtggaggnactgaatgaaaagcttaatncaatccaaaaggaaagtgatgangaaaaagcgcagaatcatgaagacagaacgtgctcttaatgtcgctgaggcggaattaatggggttgccgttggaagtgactgctnaatcgaaactgctgtcagaggttcatggagcgtgggtaccaccttggctaatggcgcaatatgctcgttatgcggaggttgtctcaggtcactggaatcaacatgtgaagcctgc

SEQ ID NO: 11884 - DNA, 616 bp, Zea mays
  unsure (1)..(616): unsure at all n locations; Clone ID: LIB3279-192-Q1-K6-E10
gnatgagaccagcggcgtaagaaggaaaaacggtgatggaggatgacacaatgaagcgccttgctcatctggagaatgagctgaagaaaaagagtgggcagcttgacaggagtaatgcaacagttcagaggctggaaatggagaatgcagagatacgtgctgagatggaagctgcaaaactgagtgcatcagagactgaaaaacaatgccagggtctcttaaggaaagagaagaaggatagcaaaaggcttgaagtctgggagcgccagaaagcgaagctgaaggaggacattgctgaatgcaagacaaatattacacaagctgaaagggagcttgctgaggtcaacaaggcaataaaaaatatggagaagaagatgcgagaagacacaagggtcaaagaagaaaacatggtgcttttggaagatgagcgcaggaagaaggaagctgcaaaagcagacaatgaccgccgacttgaagagcttcgtcgcaagaaagaagtcgaatccgagtgctacaaggatgacctacacaggctccaggatgaactcagccgcctgcagaagtcagcaggtgcaactcaaacagctgtcccatcagccaactttcctggcacagc

SEQ ID NO: 11885 - DNA, 568 bp, Zea mays
  Clone ID: LIB3279-192-Q1-K6-E11
cgcactccgcaaggcgcaagaccacctcacaagcctcctcgtccccgatctcctcccacccgcatccaagggtttccttctcgaccgtgcggaacgagccagagaacaggtatggcggcggcgcggcacctcagatccggcctccccctcctccgcgcccacctcgcatcctccgaatccgggggcggggctcaggtttcgaggggcttcgcgtcgcaggccgctaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggacttgtcagttccaaaagcgaccagggtgaaggctatagccgaaatatttgctgacgctgggttttcagatgttacaaagaatttcttggctgtcctggcggacaatggcaggctgaaatatattgaacgcattgcggagagatttgttgatttgactatggaac

SEQ ID NO: 11886 - DNA, 555 bp, Zea mays
  unsure (1)..(555): unsure at all n locations; Clone ID: LIB3279-192-Q1-K6-E12
gttttgcagctagcaatggagagttctcagagaatcttgacaagacatactatgtatatttaccacccgaattgtgccttgtgcatcctctccccggatcacttgttcgtggagctcagaggttaccctcaataatgagaagggtggagagcatgcttcttgcaattcaactgaaggacataattgggtatccagttcctgcaaataagatattagaagccttgactgctgcgtcatgccaggagacattctgctatgaaagagcagagctgctgggtgatgcatacttgaaatgggttgtgagtagattccttttcctaaaatatcctcaaaagcatgagggacagctcacaaggatgcggcagcagatggttagcaacatgatcctgtatcaatacgccctgaataaaaacctccaatcttatatccaagcagatcgatttgctccatcaagatgggcagctccaggagtgttacctgtatttgatgaagaaacgagagattctgaaccatccatctttgatgaggaatntactcctagcagtgagttacaaa

SEQ ID NO: 11887 - DNA, 368 bp, Zea mays
  unsure (1)..(368): unsure at all n locations; Clone ID: LIB3279-192-Q1-K6-E3
gtttcagctgaatccgatgcaaagaggacgtcgacggacatggaaaagggggagacggggaaggagaccatggatctcttcccccagatcgctggattcggctcggaggctgccacgaaggaagcccctgatgcgaggtatacctctctgttctgtgtggggtttcagttcacagccattctcatgtcatgttagcatggtactattgctgtagtcagttgatgactgaaaacgtaaaaaaaaacaatctacctgctgtgagaagcagctcttggtggccagttttttatttgtcaaacagttgtgcctcagattgatgtagatggttcgatctccacacacagcngttcaacccagatctttgtctt

SEQ ID NO: 11888 - DNA, 579 bp, Zea mays
  Clone ID: LIB3279-192-Q1-K6-E4
cgggcgcgtgggcccagatctcccaccgggggaaccctacccgagcatcagccatggcgatcgcggcgcgcgtcctgcgccgcctcccgctccacctctacccctcgctcgctcgctctttctgcgcagtttccccggccgccgcctcggccgccccggcgtccgcctcggccgccccggcgtccgccaaggtcgccgatcgcatcgtgcgcgtcctcgccatcgatctcgagggggcgcgccgcgaggtcgtcggcctctccgggcagacactcctccgcgcgctcgccaacgcggagctcatcgagccggcctcccaccgcctcgaggatatcgacgcgtgctccgccgagtgcgaggtccacatcgcgcaggagtggctcgacaagctgccgccaccgtcctacgaggagcggtacgtgctcacgcgcgcgtccaggaaccgcgagctcaacaagcacgcgcgcctgggctgccaggtcgtcctcacgccggagctgcattgcatggtcggcgctgtccccgagccttaagccggggacatcccgtaatggcctgccgcggcgaatgggcaagtgc

SEQ ID NO: 11889 - DNA, 433 bp, Zea mays
  unsure (1)..(433): unsure at all n locations; Clone ID: LIB3279-192-Q1-K6-E6
cgcgccgctccncncccaacccagncgcgcaaaacccgagagcgcncgccggcncgccnccgccgccggagcgagcnccccancnncanccgncaaccatggcgancccagacagcaagaagaagaaggncgncagcgacgggggnnnctacgccgagcncaacgaggagccgacgcgggagcggggggaggacggcnacccnggcgnggaggggcgcgncacgccgnagcgcacggagancatcanccgcgccacgcgcacgcagaacgggcncggcgagaagggccgnaggancagggagcncaccnccgncggccagaagaggggcaaccccccggagaagggcgnagagcnnnacgccgagaagggcgncaaccgnggccccngngccancgcgcaggccgaggcccnccgnnacaagcnccncggagg

SEQ ID NO: 11890 - DNA, 344 bp, Zea mays
  Clone ID: LIB3279-192-Q1-K6-E7
cgcaagtcaaccaggacaagatgatctgccgcaaatgctatgcacgactgcaccctagggctgtcaactgccgcaagaagaagtgtggtcacagcaaccagctgagggccaagaagaagatcaagaactgaggtgctgctcctagtcagtttcatggacaatgttgggctgtattgctgtgtggttgttgaaccgtgtttgtttacccaacatttgggccttctgttatgttttaccttgttgtcgatgacacaatactatatgacaatagcaactctgttattgtagttttggtcactgttcacctgatatgtgccatatttcggtaagtatcgttagtgggc

SEQ ID NO: 11891 - DNA, 532 bp, Zea mays
  unsure (1)..(532): unsure at all n locations; Clone ID: LIB3279-192-Q1-K6-E8
cccgggncgacccagcgnccgcccacgcgnccgcggacgcgnggggccgagggccaggccancgncccgcagccnncggcggaggnnangaggancnngcaaagacnnagcagcancggagacacagncgncancncggggaccaaggagggcgngaaanncnccacancnggagaaanngggagngcaaacangggcggggggggggaccaaacnanngacaagccagaagaggcnaccacnannagagagcaggagccggnnncccngaccnnngcccngcgggacaggaaccccnncaccaaggcgncnncacgggcggagcaaggcacnancagccnggcgnccgagcnnccaggggngggcgaggacaagaacgcnngagagggggacannagannnnaccnggcccccaagancgacgangacgaggagangaagcccnngaggccngngacgacanaangcncgngnngccggcncnnccnnccagccgnnnggggcnnagcnacncnnngcaagcgaagaaggg

SEQ ID NO: 11892 - DNA, 492 bp, Zea mays
  unsure (1)..(492): unsure at all n locations; Clone ID: LIB3279-192-Q1-K6-E9
gttccaactcctgagcactttctcctcgtcccagacaagccaatcgaagccgagatacgaccatggactccaccggcaccggggcagggggtaaggggaagaagggagcggccgggcgcaaggtcggcgggccaaggaagaagtcggtgtcgaggtccgtgaaggccggtctccagttccccgtggggcgcatcgggcgctacttgaagaagggccgctacgcgcagcgtgtcggcaccggcgcccccgtctacctcgccgctgtcctcgaatacctcgccgctgaggttctggagctcgccggtaatgctgccaggggcaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagaggcggngaaggcgtccagtggcgggagcaa

SEQ ID NO: 11893 - DNA, 333 bp, Zea mays
  unsure (1)..(333): unsure at all n locations; Clone ID: LIB3279-192-Q1-K6-F1
ccgggnncgcccagcgtccggcaggccccaaccccataggccaaggaatgcggatgtntcgcgacaacaaaaagggggggtcctccggtaggagaaggcgagtcgtaccaggatgnagatgactctgagaacnttgatgaatttgatagtgatatcatgttctccatgaatgggccaccaatctctttggcaagcaattctcgtcctcaagccacatcggctcctggggcaagagagaaggtgatcgcggaactctttaaaggggtttntgcgcagctgcgagctagggggaaatgcagggtagacattatgcctgatcatgcaaaagtgcag

SEQ ID NO: 11894 - DNA, 518 bp, Zea mays
  unsure (1)..(518): unsure at all n locations; Clone ID: LIB3279-192-Q1-K6-F12
gcactcccatcctcaatccctcccctccgcgggtgcggcgtaaaccccgctgttcttcgccggagcactccctccccgttcccccgccgcccccggccccccgacctcgatatcttcggagcccgccgttgggggcctactgcatgctcaaatcgttgacactgtntcngggcgtgggggatgtcggggcgggctcggatcgatttcttcgttcgctggtccccaggctctaataatttgtccaaaaccgatggaaacttctaaatctcctcaatcgtcaaagaacagtcatattgtggtgccttctgatggtaatggcccccgntttgacaatgatggtttttcttcagaagctgcntcaaatcaaatggtcgttttcaactctgaagcnggtgataaagagcaagatgaactgggggaaaaccgtttgcgggagtcaatcataacaaggggaatatcgcgctctattggagcgttcactgtccaatgtgctgaatgttttaaatggaggcttattc

SEQ ID NO: 11895 - DNA, 313 bp, Zea mays
  unsure (1)..(313): unsure at all n locations; Clone ID: LIB3279-192-Q1-K6-F5
gccgagccgaaaggcaccctgaaaaggaagcagaggagcccaagaaagaagacccaaaattcgcagcattcacaggaaagaaatactcactgaagggctgaattaataggaagacaatgtattatcagtatttccggtgacggacattctcagggagaagcgcttaccaaccatgttatgtgggagggtctttcggtgggatagtggtctctgtttctcctgaactattacccttgtgtngttgtgtcagccacaccggagcaactgatgtataaagccgctcttgtccgataatggatttctgttgagcttg

SEQ ID NO: 11896 - DNA, 658 bp, Zea mays
  unsure (1)..(658): unsure at all n locations; Clone ID: LIB3279-192-Q1-K6-F6
cccacgcgtccgcccacgcgtccgggggactgccgcagagcatgcggacgacctactacccgccgtgcaggctggccgccgatgtgcttggcctgtcgccgcacaccgacgccaccggcctgacgctgctgctccacgtcaacgacgtgcagggcctgcagatcaggagggacggcaagtggctcgccgttgaccctctggacggtgctttagtcgtcagcatcggcgacatactggagattctaagcaatgggaggtacagaagcattgagcacagagccattgtacacccggacaaagaacgcatctcggcggcgatgttccatcagacatgccccaacacgacggtcggccctctgcaggagctcgtggaaagagacagtggcggggcacggtacagatccatggactacatggatttcatgaagggcttcttcgcggccaagctcgatgggcgaaggagccacatggacgctttgaggatatactagtccaaatgctggatgaatcatgttcctgtcttcataatgaattggacaactagtagtaaaatatctaaggctatccccaatagttcctctatctttatcctctatcacatnccgtattntaatcttcactctacaaacactgcaaagtgcaaattatgttatctaca

SEQ ID NO: 11897 - DNA, 596 bp, Zea mays
  Clone ID: LIB3279-192-Q1-K6-F7
cggccgcgtgggtctagtaccaataaaaccttctaacttgtttaagttaaaagctatgtaaatggttcttgatccatacttcttatagacctctctcaaatcgccaggagctaaatacacctaacgttcaccacattagactctctaaacttatatagatcaagcatcaagggactagttcataccagtttgtaaaatgttgcgcctgctccagattttttcatgctcatgcaacggtaaagcatggccgcaatacaattgcgttgctctcggatgacagtggctcaatcttttcagagcatgatcttaaagctaacctgctttggaatgttttcaaatgtcgcttgggatcttctgattttgtggaaaatgtctttgatctccctagcttgctgctcttccacagtgacttgcattggttagatgagcctttttcaaagcaagaaatgtatagtattgttgcggcccttccttctgacaaatccccgggacctgatgggtttaataccaactttatcaaaaaatgttggccgattatttctcaggacttctatgacttatgtgaccaattttaccatggggatggtttgtcttcg

SEQ ID NO: 11898 - DNA, 581 bp, Zea mays
  unsure (1)..(581): unsure at all n locations; Clone ID: LIB3279-192-Q1-K6-F8
cggccgcgtgggctcagnggntgagccatacaacagngncctgtccacccactccctcctcgagcacactgatgtggctatcctgctggacaacgaggccatctatgacatctgccgccgttcccttgacattgagcgcccaacctacaccaacctcaacaggcttgtgtcccaggtcatctcatccctgactgcctccctgaggttcgatggtgctcttaacgtggatgtgaatgagttccagaccaacttggtgccctacccgaggatccacttcatgctttcctcctatgctccagtcatctctgctgagaaggcctaccacgagcagctgtctgtggccgagatcaccaacagcgccttcgagccatcctccatgatggccaagtgcgatccccgccatggtaagtacatggcctgctgcctcatgtaccgtggtgatgtggtccccaaggatgtgaatgctgctgtggccaccatcaagaccaagcgcaccatccagtttgtggactggtgcccaactggctttaagtgcggcattaactaccagcctccaagtgtggtgcctggtggtgacctgg

SEQ ID NO: 11899 - DNA, 494 bp, Zea mays
  Clone ID: LIB3279-192-Q1-K6-F9
ccagcggcggctgaaggcggcgcggtatcagcttggtgatttgtgagcgatggcgccgccggggtcgcggcggtgggcttacgtgcgcgtgatggccggcaccatcctcggtggcgtacttggattctacgtcatgcaccgcatcgagacctcgtacaaggcgaggatggaggagaggctgcggaggtacgaggcgcatatgctcgccaaagccaaggagtcgcagcagttgcaggacgaggtacagcgggaggataaagcccagttcctgcccgactcgtgacaccgacattcttcccctcttgcgcctgctcttttccaagctgttagaataacatagggcactggggcaaaggagtccgtccactcgtttttttcagatgtagagacataagatcgacatgtactttttgcttgttgctgtctttttttttttttggtatcaagaaaaatgcaccattcgaacgcaaggttggggtcaatgtatgaactcc

SEQ ID NO: 11900 - DNA, 148 bp, Zea mays
  Clone ID: LIB3279-192-Q1-K6-G1
cccgggtctgaccccgcgtccgttttggttcagttcaagtgggtcccgtgcgtgtacagcggcgtgatcatcgccttccgggtggacctgggctccattccgttctacttcgtggtgctgctcgtgttcgtggacggtgacggtgacc

SEQ ID NO: 11901 - DNA, 580 bp, Zea mays
  Clone ID: LIB3279-192-Q1-K6-G10
gtgaccgccgcctctgccgccctacgccagggtccaggtcttcgtcactccctttccttatcttcgtcgtctcattcgccggcgacgagcacccaccagaaatcatagctgctttgggtatggaggcgctgtttgggagcaataaccatggcggccacaaggccgctgatttggcatcggtggtgattgcccaggttgccttggaggtgccaaggttacttgggctccttgccatgattctgcataatgaaatctttacatctggtggagaccagaatttgattactaggattctgggcaaaagcgaagatgaaactaatcctgagaacaaagatgatggagagtccgatgatgataatgatgatgaaggagacgatgatgatgctgaaaacgaggaggaagatgatggtggtgatgagggatcagatgacaatgagaatgaggaagatgacgatggagatgatgatgatcctgcagccaatggcgaagggggaagcgatgacgacgaagatgatggtggagaggatgaagaggatgatgacgacgacgacgatgatggggacgatggcaatgaggaaga

SEQ ID NO: 11902 - DNA, 532 bp, Zea mays
  unsure (1)..(532): unsure at all n locations; Clone ID: LIB3279-192-Q1-K6-G11
cgggcnggcnncnccccccccgcggaccaaggccccnncggggnagggggacnnaggggnnngnggaggggcganggcggcggcnngagnggagnaccgnngcnncgncggcgggcnggccngggccaccagcaacgagncgcnggagaaagccnncgccnccnacggggggagccgcgacnccaagggcancaccgaccgggagacggggagggcncgcggcnncggcnncgnnacccccnccnccgagaaccccangcgcgacgcnnncgagaacacgaacggcaaggagcncgacggccgnaacancaccgnnaaccaggcccagncccgnggcggnggcggnggcggcggnggcnacggcggcggncgcggcggcggcggcnangggggcgggcgccgngacggcggnnanggcggcggnggcggcnacggcggncggcgcgagggnggnggcggcggcnacggaggcgggggcggcnacggcggncggcgcgagggnggnggnggcggcnaccgcggcggcggcggc

SEQ ID NO: 11903 - DNA, 569 bp, Zea mays
  Clone ID: LIB3279-192-Q1-K6-G12
cgcctccaccctcctcgccgcctcactccctctgaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggccagcggggggctcgagtcctactggccggcgcttttcgctaagctcctggagaagcgcagcgttgaggatctaatcctctccgttggatctggtggtggcgctgctccagttgctgcttccgccccagctgggggtgctgcagctgctgctgcccctgctgcagaggagaagaaggaagagcccaaggaggagtctgatgacgacatgggcttcagcctgttcgactgagagtctgagaccctcgctacccagccattagcaaattcgcttatgctgtccaagacttatcttacgttatgtctgtaggcttttgttattacaagtactcaagttttgagtttttgagatgtggctatgacaatgtgatgaagaatcctaaaccatcgtattag

SEQ ID NO: 11904 - DNA, 451 bp, Zea mays
  unsure (1)..(451): unsure at all n locations; Clone ID: LIB3279-192-Q1-K6-G4
cggtcgcgtgggcacaaaccaccgtaccctcctgcccgtccaccgagacgtcaagcgggtgaatactcggggagtgagagggaggagtcagagtacgaaacggatggtgaggatatcgaacattcaccgcctcgtggaagaagggaggacgagctggttgaggaggaagaatacgagggagatgttgaagaagaagaagcgcctctgtcggctgaagaaatggaggcaccgaaacgtaagagagaatcagggggtggtgggcaaaggcgcgaggagctggtgtctgtggaggaggacgaggaccacgacgattctcctccaaggaagcagccggctgtttcgcctcgtngaaaggctgtcgtgtttgttgacagcgacgaggactaaaatttgtgaaacgttggtgtgtgtgtgacgacctgtcctgatacgcttgcttttttttccccat

SEQ ID NO: 11905 - DNA, 565 bp, Zea mays
  Clone ID: LIB3279-192-Q1-K6-G5
tcgttcccctccgtctctcagttaggcacaatgatgctagctaataagcttggtggtctgctcaagaatgctacgagttcaaatatgtctgtctaccaagcaatcagatgcatgtcatcatccaagctttttgttggagggctttcttatggaaccgatgatcacagtctcagagacgagtttgccaaatatggacaagttattgaagctaagattatccttgatcgtgagtctgggaggtccagaggttttggctttataacttacacgtcttctgaggaggcttcggctgccatcactgccatggatggaaagactctggatggacggaacatacgggttaatcatgctaacgagaggacaggtggcttccgcagcagcggtggttatggtggtggcggctatggtggtggtggtggtggctatggtggcggtggctatggtggcggctttggtggtggttgcggtggctttggcggcggcggcagtggtgactatggtggcggcagcggtggatatgggtgcaactacggccacagggctggtggtggctttggtggtggtg

SEQ ID NO: 11906 - DNA, 574 bp, Zea mays
  unsure (1)..(574): unsure at all n locations; Clone ID: LIB3279-192-Q1-K6-G6
ccgggtcgcccagcgtccggccccgtcgcggcaccgcgtgacacttaccgtgtttgtgaatggtagtttcgctcttctcaagcttacgttgtgaggataggtgagtcgtcttactctaagctgggctcgtgaccatgttgatggctcaccactgctggtggagcaggaagcaatgggatcattcgggtcatcaattgtgctacagaaaagttagctaagagctttgttggcctggcgactcaataaatgagataagaactcaaccgttgaagccttcgctcatcatttctgcaagcaaggatgaatctgttaggctatggaatgtccatacagggatctgtntcttgatntttgctggagctggaggtcatcgcaatgaagtattgagtgttgacttccatcctagtgatattgaacgttttgcangttgtggcatggacaacactgtgaaaatctggtcaatgaaagaattttggctatatgttgacaaatcatattcatggactgaccttccatcaaagtttccaacaaaatgtgtccagtttccagtcttgattgctgcggtcactctaac

SEQ ID NO: 11907 - DNA, 542 bp, Zea mays
  Clone ID: LIB3279-192-Q1-K6-G7
cgtaaagcacccgcaccaatctctgcgtctcttcgtcttcggctgcgcggcgggcggcagcagcggaggaggttgaggagatgctgtccggcgacattcccccgaaccagaccatctacctcaacaacctcaacgagaaggtcaagaaagaagaattgaagagatcgctttatgccttgtgctcacagtatggaaggatactggatgtggtggccctgaaaacacaaaaattgagagggcaagcatgggtggcgtttagcgaaattacagctgctaccaatgctttccgtggattgcaagatttcgatttctatggcaaaaaaatgcgagtacaatatgcaaaaacaaaatcagactgtattgcaaaagaagatggtgcttatgcacctaaggagaaaaggaagaagcaagaggagaaagctgctgtgaaaaaacgacgaacagaagaggcacaacaagctggcctcaatgctgctgctgcccaaagcaatggaactggctatcaagcgtctcgtctgggcaaggcctcacaggagccacct

SEQ ID NO: 11908 - DNA, 309 bp, Zea mays
  Clone ID: LIB3279-192-Q1-K6-H1
atccccattcgttccccttctcgcctccacgagccttcacaaattgccctctcagctcttctcctaatctcgctctggccctagccaaatcccagacccatccgagccctagcgacaccaagcagcttgccagcgaccatggggaacccggaggagctgttgaatgagatcttcgacctcaagttcacctccaagtcgctgcagcggcaggcgcgcttgtgcgagagggaggagaaggtgcagatgctcatggtcaagaaggcgatcgagaagggcagcatgggcggagcccgcctctacgccgagaac

SEQ ID NO: 11909 - DNA, 578 bp, Zea mays
  unsure (1)..(578): unsure at all n locations; Clone ID: LIB3279-192-Q1-K6-H10
cggtacgcgtgggncggacgcgtggngaaaaaaatgtgaaggattttaacactgacccagaggttagagttatgattatgtcactgaaagctggtaatcttggtctcaacatggtttctgcttgccatgtaattctccttgatctctggtggaacccttatgctgaggaccaggcagttgatagggcacacaggattgggcagactaggcctgttactgtatctcgcttgaccgttaaagacactgtggaagatcgtattttagctctgcaggaggaaaagagaaccatggtgaactctgctttcggtgatgacaaagccggcggccatgcgacccggctcaccgtggaagacctgcggtacctatttaggatatgattgcgagggaactctctcaatgcctcggtcaacttgtcaggtcatgatgcgttgtaccttgtaatcgtagtccggcaaaagggcggtgtaccattgcgagggtaggctcattggtccatgtccgccacgccttgctgcagcttcagttttgtggtgctcagatttctagatgggtaatctagggctagatagcatgtgtaa

SEQ ID NO: 11910 - DNA, 556 bp, Zea mays
  unsure (1)..(556): unsure at all n locations; Clone ID: LIB3279-192-Q1-K6-H12
tcccccgcactgcggggcgtgcacatccgccaatnncggcacctcctcctcctcctcctcctcgcccctgtgcctcgacatctcgcatccgctccatctatggaaggccaccacgcgccatggatcgccgctctctaccgccacctcaattgaaggttcaggggggggggggtggatccgccacctcctcctcggccgccgtcaatggaaggtcccagatctcctctcccattacttctctccccattaccgcgctcgaggtctgccatttttggaggtccgccacctccgcctctgctcgccgtcaatggaaggtcctagatctcctctccctattaccgcgctcgagtcagtgggaggtccgccatttttggaaggtccgccacctcctcctcgacccgcggcaaaaatggcgtgggagatccgccacctcctcctcggcccgcggcaaaaatggtgtgggagatccgncacctnacctnctcccattctcacgcccgcgcctgatatggaaggtccgccgaagggactcgnacgtcgaggccatggctgagcc

SEQ ID NO: 11911 - DNA, 382 bp, Zea mays
  Clone ID: LIB3279-192-Q1-K6-H3
cccacgcgtccgtaaatctttgatctttgctggtcagcagaggaatcaaagcaggaatgtaggatcgaggagagtgacaggacttcccctctgtgcacttcgccgaaaagtaataatgggattgctatgcatggcccttgttgtacactatgaaaattgggcacgcaaacttgtgtcagtttttccgctgttgcgaaattcagtgatggtgtttttgtaactataccaacctgtgtcagttttgccgttgttgcaaaactcagtgatggtgttttttgtaattattatacatccgaataataagactggtgtttccagacagactatgcaagctaaggggaaatcacgattttcctaaaaaagcaaagttaaaagaaaagta

SEQ ID NO: 11912 - DNA, 501 bp, Zea mays
  unsure (1)..(501): unsure at all n locations; Clone ID: LIB3279-192-Q1-K6-H4
ttttgccggaacaaaacccccccggggcgacccagcgnccggngatcncacccaggcgngcctccgctccgggcacccgncactccacgcaaccatgncgaggaggaagaccagggagcccaaggaggagaacgncacccnnggacccactgnccgngaaggagagnatgtctttggtgtcgctcacatctttgcgtccttcaatgacaccttcattcatatgactgatttgtctgggagggaaactctggttcggatcaccggnggcntgaaggtgaaggctgaccgtgacgagtcgtcaccttacgctgctgtgcttgctgctcaagacgtcgcacagcgctgcaaggggcttggcgttgctgcgctgcacattaagcttcgcgccaccggaggcnncaggaccaagacccctggacctggtgcccagtctgccctcagggcgcttgctcggtccggggtgaaaatcggacgcgttgtggacgttgccccggtccccac

SEQ ID NO: 11913 - DNA, 563 bp, Zea mays
  unsure (1)..(563): unsure at all n locations; Clone ID: LIB3279-192-Q1-K6-H6
ngactagtccacgctctaaagtctagtcctcgtcttcctcccgtaaaccacctcgtccctatccgcagcaaccgttcgccgcgccgcgaggcccgctgatcccaccgacctccaccgctatggctcctctgtcccgcgcggctcgcctccttcgatccgccgtcgggcggctgaggttgccgccgccggcccgggccttctccagcgccgcggcgaccgagacgggggcggggaacggacgcgaggccgtgatcgccgctgctgccgtggcgatggccgggtccgggcttgggctgtggctgaaaccgccgtcgcttgccgactccggcgaggcgcccggcggtcagatctcggtcacctgcgctgcttccacngaggcgcaggaggagaaggggaggttcctgttcgcagactcattccgcagaagagtgttctttaactntgagaagaggatacggcttctcagccctcctgagaagattttgagtacttcgcttctgtgaggaacccacaaggggaagtttacatagttgctcggggctttgtgagagcaggtagtcctg

SEQ ID NO: 11914 - DNA, 626 bp, Zea mays
  unsure (1)..(626): unsure at all n locations; Clone ID: LIB3279-192-Q1-K6-H8
gtcgaccagcgtncttctacaaaaaacacgacnctaagcttagtagctctttgtgtcagcgcctgagctcgagctttggcatggcgcactccaccaccttggccctggtgattgtcgttgtgctggcgctcacctttggtgccacggtcagtgtctccgctcccgtgaacaagtcgtgcgtgagggggggggccggcgccagcgtgagcattggctacggcggggcaagagccagcgccggcgctggcgtgtcccttggcgccgacgcgtaccggagcacgtgcccccgtgccgaggagatcatccgtgcggccgttgagagggccgtcgctgccgacccacgcatggcagcgtctctcctgcgcctccatttccatgactgcttcgtcaacggctgtgacggctccgttcttctggacgacaagccgttcttcatcggcgagaagacggctgtgcccaacgccaactcaatcagggngcttcgaggtcattgacgccatcaagaccgagctggagcgggagtgcccagatacagattnctgtgccgacctccttgccatcgctgcccgtgactcccgtcttgtgtctggcgggccgagctgggagattgaggcggccggaaggac

SEQ ID NO: 11915 - DNA, 529 bp, Zea mays
  unsure (1)..(529): unsure at all n locations; Clone ID: LIB3279-192-Q1-K6-H9
cggacgcgtgggcaggcctatcgtacctacgaggctacgaccatatcccagcccatttcggcctgctactcccgaacttccatatctctcgtctgcttctcactctcctcccacccactccagaaaacctcacaaaaaccctcgctccccacaacccgccgccgcccacgccgccgcctgtgccagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgttggtacaaacttatatgaattgaaactagatctgaatgacaaagtaaacgttgaggctagcaaaataagtgtgggtgtcaggtccctattctgtnttgtngaaaaagctgnggcccantggtggaagaaacttgttcgggatgatcaaagggcacctctctttgtggaagttgnttgggacaaatggggttgcgaagatgat

SEQ ID NO: 11916 - DNA, 351 bp, Zea mays
  unsure (1)..(351): unsure at all n locations; Clone ID: LIB3279-193-Q1-K6-A1
acaggngaaccaagcnaagnnaaaaggagaggcgcgngangccnaaccnacgaaggcttcgagcatgaagncganngtccgangaagccgcaccnacgaaagcngtgggngcnnggnnatgcagcgtgggaggccnggncnngaatggctccaagcccttaagaagtcaaagaaccttcactaggtgcatgtctgtgttcgtgcnggccagtcggtcatgnggacccgttgttaccatggnttttggntgagcccttgtgttttaagccaaaaggtggttggtggcctttaaaagctctgtgtttcctcctgtcgctttntcagtcctatggtcattttggggtgtagaaa

SEQ ID NO: 11917 - DNA, 611 bp, Zea mays
  Clone ID: LIB3279-193-Q1-K6-A10
gctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaggaggatgcagccaacaactttgcccgtggtcactacaccattggcaaggagattgttgacctgtgccttgatcgcatcaggaagcttgccgacaactgcactggtctccagggcttcctcgtcttcaacgctgttggtggaggaacgggctctggccttggttccctcctcctagagcgcctgtctgttgactacggcaagaaatccaagcttgggttcactgtgtacccttccccccaagtttctacttcggtagttgagccatacaacagtgtactgtccacccactccctcctcgagcacactgatgtggctatactgctggacaatgaggccatctacgacatctgccggcgatcccttgacattgagcgcccaacctacacca

SEQ ID NO: 11918 - DNA, 593 bp, Zea mays
  Clone ID: LIB3279-193-Q1-K6-A11
atgatgaggaggtggatggggaggagaaggaggcggcaggggttgtggagatctccgacgaagacgacgacgacggtgacggggaggcggacgacgacgacgacgatgacggggatgacgacgacgacgacgacgaggactcagacgacgaggaagaggtcgacggtgaagacgatcagggggaggagctgggaaccgagtatctggttcagcctcttgggcgggctgaagacgaagagcactcgagcgactttgaaccggaagaaaacggtgagggtgccgacgatgaggagatcgatgaagaggacgatgacggtgaggactctgtgaaggcgcagacctctacgaagaggaagaggtcaggcgacgaagaagaagaagacgacgacgatggggatgatgatggtgacgatgatgacgatgggaggccaccatcaaagcgatagtatggttagctctagttttgtagctgtgtccttgggtgtttggtaggtaggtagtgctgctgatgttggtttagaagaactcatcatcacctgggatatgtgtgtgatttggcttggccgatggatgaatgatgaaggtcttgttct

SEQ ID NO: 11919 - DNA, 525 bp, Zea mays
  Clone ID: LIB3279-193-Q1-K6-A12
ggcgcacagtgctccaaacgcaggttcctttcccgctttggtgaaccgtctgccagttatcaaatctgaatctctggagttctctcctgtcgagaatgcgattggaatgatcgaaacaaggacagctgcattgagaaatgagctagaagaaccacggagttctgaaggtgatcaactgcgggggttcagagcttgcaaaggatactccaaggaagtgtggctgtgcaggtcaacagtggggtattaagtgtgtgcactgcattcttatctggtgagccagcgactaggctcagatcccaagaactgcatcagctcatcgttgcattgcttgaattcatggctgtctgcaagcgtgcaatccgtgtgcatttcagattgatcggggaagaagaccacgaattccacacccaacttgtcaatgggttccagtcactcaccgctgagctatctcactatatccctgctatactctccgagctatgatagaactgtagcacgccagaacttaggtagcatgtgaatggt

SEQ ID NO: 11920 - DNA, 633 bp, Zea mays
  unsure (1)..(633): unsure at all n locations; Clone ID: LIB3279-193-Q1-K6-A3
cgcttctccanaaggggatggnnngggancnggnntnnctctgntcattgctaccaatatctgtgagaattcatctggaaggcatttagccccacaaccatcaacagtggtcgtggtgctgaattcgaaggggctgtcattgcactgttccatctgttgattacgagaaccgataaagggcgtgctcttcgtgaggctttctaccgccagaaccttccaaatgtgaccaatttgcttgccactgtcttggtattcctcatagttatctatttccaaggcttccgtgttgtgcttccagtgagatcaaagaatgctcgtggccagcaaggctcatatccaattaagctgttctacacttcaaacatgcccatcattcttcactctgcgctgattaccaacctctattttatatcccagcttctctacaggaagtacagtggaaacttccttgttaaccttcttgggaagtggaaggagtctgaatactctggccattctattcctgttggtggtcttgcttactttgtaactgccccatcaaggtgaaaatctagntccttcagtggggactggggaggcctcttcgccttgatcatttttgtggtttttgttgttcaataattagggtttctt

SEQ ID NO: 11921 - DNA, 483 bp, Zea mays
  unsure (1)..(483): unsure at all n locations; Clone ID: LIB3279-193-Q1-K6-A4
caccaggggaacccgcagcgcccgccannggccggcgccgaggcccccgcgcatccagggcnggcgancgnggncangggagncagcggcggcggcaaancaaccgncgcggcaaggcncgccgaagcccngggcggcagcnncancgaagcggaggggggcgaggccgaggcaaacaaagccaangagagcgcgggcgngccgcncnccgacgccgaccgcgcgccgnggcnggagncggngcgggacgccanccgggggcggcnggacggcggcgaggacgnggccgncagcggcncggcgcngcggcncgggnaccgggangngcnccgcgcggccgaccgcgccnacgagccggggcgccccgccgccngcngggggaggggcgngngccngngggcgccggcggaggggcncgcggngagggggcngcggggggcgggggaaggggagcacnncangccggcgagccggcggcggggc

SEQ ID NO: 11922 - DNA, 492 bp, Zea mays
  Clone ID: LIB3279-193-Q1-K6-A6
ccgggtcgcccagcgtcgtctggatggtttagacagggtatccgtctggcatgtgctcaaactatcaaaacatgggtacactacacctgtaacaagggttctgcaatgttgcctgaggtgggaagtcccgccaatgcaatctactataggattgatccaacagggggccaaatccgggtgtctcagttgtttggcagaaacattgccctgcaattgacatatgaggaactttggatttgggaggcagtggacccaaccgggtcttccagaatgattcgtgcttcctcctaagttaaggggatctttaaggaagaaaacgcccgaaaggggtgtttgcaatgggtcagagaggaatttgaataccttctgcagctgttccatccagctgctacagatggctagctaacagatgcctgttgtttgtgagttctgcgggttcttgagcgtgatatagtgtgtgccttgagtctgtctggtctggccccatggcgc

SEQ ID NO: 11923 - DNA, 126 bp, Zea mays
  unsure (1)..(126): unsure at all n locations; Clone ID: LIB3279-193-Q1-K6-A7
gaaggcgcccaacgccancaagggagacagggggggggcacagaaggccangggcaccacggacgncagganncgagngaagcncaacaagcacancnggagcagcgggancaggagcgngccgcg

SEQ ID NO: 11924 - DNA, 547 bp, Zea mays
  unsure (1)..(547): unsure at all n locations; Clone ID: LIB3279-193-Q1-K6-A8
tttttacagnaggttcagagcattagaggtaacgtagagaagacggcggaggcggcgatcgaggtgatcgactcggtggcggaggcgaccgagaaggtcgccgacgaggttgcgcaagcgttccccggcngtgaaactctcaagcaggcagcctccaagattaagacgatcgcgggtgggggggggggagatgccgncaaagctgaggccctgattgagaaggttgacgagataaagaaagaggtggattcaatcgtcgaccctatactcgacaaggtcgccaaagacaagtcctagagaaagagcccaactggaggagacaaataacacatccagtaaattagtttaagaagtattagttcagcagtaaccggaagacactacgtacgggggcaacatgacacgtcgggtgtcatcacctatttctctcatcgattcattgctttcagtttcagtcacgtgtttgttcagttttagtgatttactccctacgaacttctatgagagaacaaattttcttggttgttttattgacaagtgcttgtgc

SEQ ID NO: 11925 - DNA, 466 bp, Zea mays
  Clone ID: LIB3279-193-Q1-K6-B10
gaagaaactccaacacctacctctctacgaactacctgccgccggaaaaccctagagcgctcgaccatggatccgcagcagccggagcctgtcagttacctctgcggagattgcggagctgagaacaccctgaagcccggagatgtcatccagtgccgtgaatgtggctaccgcatcctgtacaagaagcggacccgccggattgtccaatatgaagcgcgctgaagagtgaagacaagggaaaacactgaagatggttgatctattactcgccacattacctatgtaaacagtcttctgggggaaatgaaaatgtcagacttaacgtttgtatgtcgtgtgcctcctttgaacctgagctgtataatttgtaacgcttgaactggggactgatttgagaactgagacactgcagcaatatgttgatggatcctaagtggcgaatctaatgcatgcgtgttatgcc

SEQ ID NO: 11926 - DNA, 639 bp, Zea mays
  unsure (1)..(639): unsure at all n locations; Clone ID: LIB3279-193-Q1-K6-B11
cacgtgacttctggagtaaaagaagaccgcatgatgatcacaggaatgcatactgtttctgatatcttctgtgttggctgtggatccatagttgggtggaaatatgtaagatttgcgaaggttgtttcatagtgtctccttgtatattgccttgcacctaactttttatgacgctcttctctaggatgcggcacatgagaagggccagagatacaaggaaggcaagtttattctggagaggtgatggccgcaacattgtcatggttttgtcgccttggatttgttctttttcccaaagaaatgtcctctgttcaaacagatctgtaactcggtttgcagattggtgcatcgattatattgttaatctggtggaatcagactcactgcaacaagatttgtcctgagcaggtacaaggtgtcgggccctgacggaagccaatactgggttccacaagatgctcacttgggcggaagcgacgccgatgacatataaaacacgatccaacaagctcaagcctgtcgttgatcccctgtanaataacctggtggcgttgctctttaggcagccgacagccggggattgctccattgaaataattcngccgcgtaaattgttgctgntncaggtgacatgatcgt

SEQ ID NO: 11927 - DNA, 588 bp, Zea mays
  unsure (1)..(588): unsure at all n locations; Clone ID: LIB3279-193-Q1-K6-B2
gccggcccgtccgcctccctctccgcctcccgtccccaaggccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccagagcctttggggcccttcaatgtctgttagcggtggcatcaatgtcccagtgatgcagaccccgctctgtgctaatgctcctgctgagaaaggaggcaagaacttcatgattgatttcatgatgggcggtgtttcagctgctgtttcaaagactgctgctgctcccatcgagcgtgtgaagctgcttattcagaaccaagatgagatgattaagtctggtaggctatcagagccgtacaagggtattgttgactgcttcaaacgtnccattaaggatgaaggtttctcttccttgtggaggggtaacactgctaatgttattcgttacttccctactcaggctttgaactttgcatttaaggactacttcaa

SEQ ID NO: 11928 - DNA, 628 bp, Zea mays
  unsure (1)..(628): unsure at all n locations; Clone ID: LIB3279-193-Q1-K6-B3
nncgtccgagtcatctctgctgagaaggcctaccacgagcagctgtctgtggccgagatcaccaacagcgccttcgagccatcctccatgatggccaagtgcgatccccgccatggtaagtacatggcctgctgcctcatgtaccgtggtgatgtggtccccaaggatgtgaatgctgctgtggccaccatcaagaccaagcgcaccatccagtttgtggactggtgcccaactggctttaagtgcggcattaactaccagcctccaagtgtggtgcctggtggtgacctggccaaggtgcagcgcgctgtgtgcatgatctccaactccaccagtgttgtggaggtgttctcccgcatcgaccacaagttcgacctcatgtacgccaagcgtgccttcgtgcactggtatgtcggtgagggtatggaggagggcgagttctctgaggcccgtgaggatctggcagcgctcgagaaggactacgaggaggttggtgctgagtttgatgagggtgaggaaggtgatgatggtgatgagtactagaagtatcctgatgcggtcatcgtcaggcttgtgtgctgctcttgtccncgttgtggtttgcaacacctgatgttgtaagactttc

SEQ ID NO: 11929 - DNA, 594 bp, Zea mays
  unsure (1)..(594): unsure at all n locations; Clone ID: LIB3279-193-Q1-K6-B4
gcactggtggcgcccgtggtgctccacagagtgaagcgatagccaggagaggcgacgatgcgcaagtgggcgctctttctcctcaccacactccccgacccagctaagaagctacaagtgaatgccgaggagagcagcgatgacttggctaacccaccgaaggtagaggagaagtttggtgctgtccctcatggcctgtccaccgactctgaggttgcccagagggaagccgagtctatctctaggaagactctcaggagctcagccgagaagtttgagttccaagctgaggtttccagactcatggacatcatcatcaactcactctacagcaacaaggatatcttcctgagggagctcatatctaatgcctctgatgcgttggataagattaggttcctttctcttactgataaggaagttctaggtgaaggggacactgcaaagcttgagattcagattaagttggacaaagagaagaaaatcctctccattcgggataggggtnttggtntgaccaaggaagatcttattaagaaccttggaacgattgctaaatctggcactntcagctttgtggaaaagatgcagtct

SEQ ID NO: 11930 - DNA, 559 bp, Zea mays
  unsure (1)..(559): unsure at all n locations; Clone ID: LIB3279-193-Q1-K6-B6
ccggngtcgacccacgccgtccggnaacataccangnnataattgaatctcatgctctagtgagccctagaccaccaaagtggtnccaatgatcacttgatgattagtggtgagtaatttgtgaagtacttatattagttataccactatctttggctcttgctctagatttaggcctagtgattagaagtgaggtcaggcgcacctcttacgcgttgatgcttgtgcgcgtcattgtaataggtgtattgggaagggatgcaatgatatcatattggttgtgtttgtggtgtggccgctatcgagtattggtgggaatggggttcgcgatgttttgaccaaaactcgataaggagacgatggaagcatccggaagaggccacaaccggagcaccacttacttgtggagaagagctagagctatctacggagttacctaatcacaatcttgggtctcgtgtaaacattcccttgcttgggtcttaaacgagaattagggaaaagcttgggcgcttttcgatcccttaataaaaataccaacgcgtcaacatgagtttat

SEQ ID NO: 11931 - DNA, 523 bp, Zea mays
  unsure (1)..(523): unsure at all n locations; Clone ID: LIB3279-193-Q1-K6-B7
ctgccctagccgcaggaggagcgttcgccgccccgccccgccctccgtcttccgttggcttgccccccgggcttcgtctggcggcccttttcggagaaatgtttgagcatttttttgaggacacctttgtcggcactagactcgacccttgtgggaaaaaggttgatagagtttcttgtggtggaggtcgcagtgagcacgtttatatgtttatgcagcttgatgttgccacagatgtttattctatgcctgctggtgagaaatttaacatgggtattgcgcctactctgaatttggatggcgccccagatactggcgtctatactcaggctggcggaaaaactctggcggacaattatgagtacgtcatgcaagggaggcttgtcaaaatctctgaagacacatcatccagccaaaacgctcaagtggaaatgtatgcatcgttcggcgggcttcttatgctgctcaggggtgacccttccactgccgctngctntgagcttgttcagaggctctttctgct

SEQ ID NO: 11932 - DNA, 362 bp, Zea mays
  unsure (1)..(362): unsure at all n locations; Clone ID: LIB3279-193-Q1-K6-B8
aaccccgggncgacccagcgnccggnncaccaccggggcgccnncgaccctaagaacgggggncactanggccgcaaagaggggggaaggggagggacgccaagaagccaaaccccaanaccanagcaggggccaagggngcnggccccgaccgccangacgggggcaaaggagcccgcaggaaccacaacnacaccgaagcagcgggggggggcaacgccggnccagncgccgcaaagggagcgcngncgggggacggccacggcgggggggacaagaacaccangggcncngcagnaccgcccaagggcccnncgcccccgccgccgccggcgccaaggaaaccgcgacggcccgcgggg

SEQ ID NO: 11933 - DNA, 56 bp, Zea mays
  unsure (1)..(56): unsure at all n locations; Clone ID: LIB3279-193-Q1-K6-B9
cggtcgaccacgcgtcgtagnctncgggcgcgtgggcggggcgtgggggggcgcgc

SEQ ID NO: 11934 - DNA, 452 bp, Zea mays
  Clone ID: LIB3279-193-Q1-K6-C1
gccagggtggccctgcagagcgacgacgtcgagctcgtcgccgtgaacgaccccttcatcagcaccgattacatgacctacatgctcaagtatgacactgtgcacggacagtggaagcaccatgaggtcaaggtgaaggactccaagacccttctctttggtgagaaggaggttgctgtgtttggctgcaggaaccctgaggagatcccatggggttccgttggcgctgaatatgttgttgagtctactggtgttttcactgaccaagagaaggctgcagctcacttgtagggtggtgccaagaaggttgtcatttctgctcctagcaaggttgcccccatgttcgttgttggtgtcagcgtgaaggagttcatgtctgacatcaacattgtgtctaatgctagctgcacaaccaactgccttgctccgcttgctgtggtcgtcgatgacaa

SEQ ID NO: 11935 - DNA, 592 bp, Zea mays
  unsure (1)..(592): unsure at all n locations; Clone ID: LIB3279-193-Q1-K6-C10
ccggngtcgaccccacgcgtccgcccacgcgtccgctccacccaactcgccgccgccgctgccaacgccgcctgctgccgcagccgccatgggggcgtacaagtatgtgtcggaactatggaggaggaagcagtcggacgtgatgcgcttcgtgcagcgcgtgcgctgctgggagtacaggcagcagccgtccatcgtccgcctcaccaggcccacccgccccgacaaggcccgtcgtctcggctacaaggccaagcagggatatgttgtctaccgtgtccgtgtgaagcgtggtggcaggaagaggcctgtgcccaagggtattgtctatggcaagcccaagcaccagggtatcacccagctcaagttccagaggaacaagaggtctgtcgctgaggagagagctggacgtaagcttggtggactgagggttcttaactcctactgggtgaatgaggatagtacctacaagtactttgagatcatccttgtggacgttgcccacaaagccatcaaaaccgacccgaggatcaactggctatgcaaccctgtgcacaagcaccgtgagctccgtggcctcacctcagcaggc

SEQ ID NO: 11936 - DNA, 198 bp, Zea mays
  Clone ID: LIB3279-193-Q1-K6-C11
tttaggacttggtatgacgttttatgttaagcgttgtcaggttttgctattcgtgttatgctgaattgttggaactcctagatgcagaatcttacgtattggttttggttccttcgagaagtgcaaatgcaagacgcatctattcccattgagtgaatacaggactaccacatgaagtatgggggtgaaaatttgctt

SEQ ID NO: 11937 - DNA, 614 bp, Zea mays
  Clone ID: LIB3279-193-Q1-K6-C12
gcgtgaaactgttcgcaagtctttggtacttctgaaaaatggcaaggatcagaaggagccattccttccattggccaaagatgcaaaaagaatattggttgcaggaacacatgctgacgatattggatatcaatgtggtggctggacgatagcgtggcctggagacagtggaaaaataactgttggtacaagcatattggaggccatacaagaattagtgggagtgcaaactgaagttgtgcatgagaaatacccgaccaaagctatgattgaaactggggttttttcctatgcggtggtggttgttggagaggttccatatgctgaatggataggagatagaactgaccttagtatcccgtttaatggctctgaccttatcatccgtgttgcaagtaaaatccctaccctagtgattgttatttctggaaggccattgattattgagtcacaagtattggaaaagatagatgctctagtcgctgcctggctgcctggaagtgagggcatgggaattaccgattgcctctttggagatcatgattttgtgggcacattgcctgtgacatggtataagtctgttgatcaattgcctataaatgctggagactcta

SEQ ID NO: 11938 - DNA, 454 bp, Zea mays
  unsure (1)..(454): unsure at all n locations; Clone ID: LIB3279-193-Q1-K6-C2
cggtcgcgtgggcggcgatggtgatgcgctcccttcgctgcctacaccatacatccccgccgccgtcccggctgctcatgcntcgtctgcatcccacccccaagtgggaagggtccaaagcacangcagacatgcacctgtaacgtttgtttgacggttcgccgccgttttgggacggtggtgcttcggcgcgagaggaaggtgacaagagattcctctcgtctgaaagagacgggcctttccagtgagaaggtcacacatcaagccgtgtccggtccgccaggagccaatggcagtncaaccagctccccccngaatgcagatggaaatgctgttgcgcccggttacatggctgtcgatctcaaggtggcgttctctcccgtcgngaactcctttgncctgtccatcctacctgnacgggtcgacgagcagtcaccgtngtctagtgcggctg

SEQ ID NO: 11939 - DNA, 514 bp, Zea mays
  unsure (1)..(514): unsure at all n locations; Clone ID: LIB3279-193-Q1-K6-C3
caggagacccgggcaaagaagagaggctggcgagcaagaagcgaagaagccccgccccgcnngcngaaggcaaggncnggcgaaggaaggatcaggcccttccgaagggggctcgcagcngacacactacaggttgaagaagcaggctcggtgcatgccatccccattgggccggggtgcagggacccgaatgccttcttccagcngaaacccaaaccttgacttaaatcaagattctgtcctgaacgatgtggggaatgattgccaggggcaacatggccctccagaagttgaaaagttagatcaggtcgaggtgaatgaagataccatgacacctgctgtcaaattatcagtttgtagggatacaggagagtactctcctgtcagtgaaggtgagagggcgggtccatggcaagaccggctcgcgttgaagacctaggccctcagccgatgtggctgagaaataagctgcttctctgacagctagggttgctactgtgtccctcaaatgctc

SEQ ID NO: 11940 - DNA, 646 bp, Zea mays
  unsure (1)..(646): unsure at all n locations; Clone ID: LIB3279-193-Q1-K6-C4
cttacctccaanaatttatgagcgcaattctcgtgaagtattggctcatcaagtggaagctaatgctgcctctggtcccaatctcaacggggctgatgagaatgatctggcaactctgttcaacttgtgtatcagtagggaggttcaacttttgaatctgctgaagcgccgtgatcaaaaacacaatgttgatgagatcagcctgaatgaaaagctcaccaactgtgcccgtcagataacttttgtggaatatgctggttttcctttccccagtgttgccttaaagtgcatcatggcggagtctgatctgttgtgcatgttgctgatgtgtgggactggaatgatatcccaagtcaacatttgctccaggattcgaaaggtggccttcagatttatgacctacaaaggacctggatgttttgctgctgctgccaccatgatggccaccacaaaggaggccaagttgatgagtggactgctgaggaacagatgtagggaaaataatggtccattttcaaggagtgtctttatcaggaaatggaccattgcagctatgttcagaatatgtgaggaatgttctcctgtggaagagtctacagggggctacactgctactaaattgatacttgatggatctgatgacaag

SEQ ID NO: 11941 - DNA, 155 bp, Zea mays
  unsure (1)..(155): unsure at all n locations; Clone ID: LIB3279-193-Q1-K6-C5
gcggttcccccttttatcctagctttggcaagctcggtnactgtctggataatctgttttccctgggggtagttgttttttccgtacccctccttcttnnnggggcggccgctcttgcgggtccctgcttcccttccctttcgtggggggggggg

SEQ ID NO: 11942 - DNA, 387 bp, Zea mays
  unsure (1)..(387): unsure at all n locations; Clone ID: LIB3279-193-Q1-K6-C6
gcggcggccatggcgaggggcggcggcgatcggagtcgggaggatgaccccttctccgacggcggcaccaccggaaccgactcggacgagtcctctccgcgtggggtgggggcccgcggccccggctccacctccaacccgatcctgacccgcctcgcggtgtctcggnacccgtgggggggggctggcggccccgcggcccctggggtctgcctcctccgcttcgcctgggagtccgccgcgggctccctcgtcggcgccgccgttggcttcggttaaggtttggttccgntgaaggggtttcagggctcctttgctgctgctgcgtcatctgctgtgntgtttgctgttcttgctggtgttctttgtttggtggcctgctctttg

SEQ ID NO: 11943 - DNA, 641 bp, Zea mays
  unsure (1)..(641): unsure at all n locations; Clone ID: LIB3279-193-Q1-K6-C7
ccaaaaaaaatttacacatctttgcaatcttattacaaacaacacctagtgattcacagatcccaccctctcacctgccttcacagttcacgctccttgaatctaaaccggtgtttcccagattgaaaacctagaccagtgtgaccctacacagtgcatgccaaatgggcgaaaggcaagcaattacacacgaacaaccacaataaaagcgcatcaaacaacaacgaccatgaccgacaacgacagttagggggacttcagatcggatggttgagataagacgttggggttcggcgttgcacacacgcggaaaagaagaagctcgattcgctgttttctgccagagcacaccgtggacgccgtccccgctcaagtgaggttcggagctcagagccttgcgatctctcggctgcgcgcgcgcaagatggctgacccagaattggaagctatcaggaagagaaggatggaagaactaatggcaaaacacggtggcggtggggcaaatcaacaaaatgcaagccaacaaaaagctcaggaagacgcgaaacaggaagctgangaacgccgacagatgatgcttgctcagatattatcttctgaagccagagaaaggatctnccgcatagctttggtcaaacctg

SEQ ID NO: 11944 - DNA, 589 bp, Zea mays
  unsure (1)..(589): unsure at all n locations; Clone ID: LIB3279-193-Q1-K6-C8
ccatgctaagttctgtcatatatgcacgtgatcattttctaaaacctggtggtgctattctcccagatactgcaatgattcttggtgctggcttcgggaaaggtggaactagcttgccattttgggaaaatgatatggctttgatatgtcatgtattggcaaagaagtaacttcaactgcgagcgggatttcctgtagttgatgtactgtcttctcaggatattgtgacagagactgctgtactccattcctttgatcttgcaagtttgaaggaaagtgagatggattttactgcaagctttgagctgatgctcagtgaaagtagtgccactgtgtcaggagtgacctggtgctatggcattgtcttgtggtttgacacggggtttaccgacagattctgcaaggagaagcctgttgtcctctccacctctcccttctctacaccaactcactggtcgcagacaatcttcacctttgaagagcccattgcaatggcgaaggaggaatcaaccctgggttcatctgcattggctgcacagatgagtgcccagctacngcgctcaggtctcgggtcagcatcgtgagggca

SEQ ID NO: 11945 - DNA, 485 bp, Zea mays
  unsure (1)..(485): unsure at all n locations; Clone ID: LIB3279-193-Q1-K6-C9
cccaanccaagccggccccaaacccgaaccccaaggcgccccggaacggaggggcccaaggccgagaagaagcccgcggcgaagaagccggcggaggaggagcccgccgccgagaaggcgccggccgggaagaagcccaaggcggagaagcgcggcccagggggcggaggcgccggcaaggagggcggcgagggaaagaggggccggaagaagggcaagaagagcgcggagacccacaagagcnacaccnncaaggggcngaagcaggggcacccggacancggcagcnccncnaaggccagggccancangaacnccnncancaacgacancnncgagaagcacgccgccgaggccgccaagcacgcgcggnacaacaagaagcccaccancaccncccgngagagccagaccnccgngcgccncgnccnccccggggagcgcgccaagcacgccgncnccgagggcaccaaggccgncaccaa

SEQ ID NO: 11946 - DNA, 545 bp, Zea mays
  unsure (1)..(545): unsure at all n locations; Clone ID: LIB3279-193-Q1-K6-D10
ggntttcgtaagcgatccagggtgtcgtgcaattcgataccacacggaacaggtttttggccgctggggatgaattcatgattaagatatgggacatggacagcacgggtcttctaactaccattgatgcagatggtggcttaattgcaagtccacggatacgcttcaacaaggaaggaactcttttggctgtctctaccgttgacaatggcatcaagatcttagcaaatgctgatggacttcggttgctgcgcacgctggaaaatcgttcttttgatgcttctcgtaatgcatctgaggctgtaacaaagcctctaataaatcccttgactgctgcggcaaatgcagctgcagcaagcagttcaggagctggtgctccgtcagctgtaactgcaatgaatggggataccagaagtttggttgatgtaaaacctagaatagctgatgagtcactggacaagtcaaaggcgtggaagcttatggagataactgagtcaactcagtgcagatcaattaaactggcagacaacatgagaacgagcaag

SEQ ID NO: 11947 - DNA, 509 bp, Zea mays
  unsure (1)..(509): unsure at all n locations; Clone ID: LIB3279-193-Q1-K6-D11
ggnacactaaatatncgggnaagggaatgcacttaaaacttcagagttgtttgaaaagtagagaagcctcaagaaaatcaaacatcctagtggtagatcggaaggatcctaacaaagatgagccagacaaagtgaaaggaatccaagatgaagttatgaccaaagaagagggagtgaaaggccatacctgtgaaggtcgtgcgacgtgttggagttgtcttaagcaggcgaacaccacaaagacaaatgatgctccaaatttaggttcattgttggttggtaacgaacacatgcaaggcctcatgagtaatttgagagataattcatcccatttgtttgaaaagaatcattcaagacaccaaagggatgatccatgtgaatatagagaaacaaacttgaagtttcctaataggatccaatcagttggaggcaatgggaaaaccaatgatgtcacatctaggaggaaacgactcttgttagaagaaaaggctagcgcacacgtgcaaaat

SEQ ID NO: 11948 - DNA, 574 bp, Zea mays
  unsure (1)..(574): unsure at all n locations; Clone ID: LIB3279-193-Q1-K6-D12
ctcacgcagtggnaggaattctgggtcgaactataacccctacttttacgggaacctggggaaccccaactggggcctggagctggatggagcgctggatgacagcaagaccatgggagagccggttggcggcggcatcggacaaggaccctaaagaacgtgctgtgacaaagaatgcgagcacgaggggtgttcgagcacctgtatcccgtgccatctcgattcagagaccagcaacaccaaacaagtcgagccgcccaccaagccggcagtcactttcaaccccgccatcgaagaccccgtcagcctcaggaaaggccaggccggcaagtccaaggaacagttggctgtacaaggaggatgacctgaggagcatcacgagcatccgctccgagcgcccaaggaggcagagcacgggtggaggctcggtccgggacgataccagcctgaccagcacaccacctctccccagctacatgcagtcgaccgagtctgcacgggccaagtctcggtaccgcagtctactactgactgagaagcttgaggttcctgagagagcgcctctggcccactc

SEQ ID NO: 11949 - DNA, 654 bp, Zea mays
  unsure (1)..(654): unsure at all n locations; Clone ID: LIB3279-193-Q1-K6-D2
cttgcctggtttggtngtcacctttggtccaactggcctgactaccgaggtgaagtctgttgagatgcaccacgaggcacttcaggaggctcttccgggtgacaatgttggcttcaacgtgaagaatgttgctgtcaaggatctcaagcgtgggtttgtggcctccaactccaaggatgggcctgccaaggaggctgccagcttcacctcccaggtcatcatcatgaaccaccctgggcagattggcaacggctatgccccagtgctggactgccacacctcccacatcgctgtcaagtttgctgagctcattaccaagatcgacaggcggtctggcaaggagcttgagaaggagccaaagttcctgaagaacggtgatgctggtntggtgaagatgatacccaccaagcccatggtggtggagacattctcagcgtatcctccccttggtaggtttgctgtccgtgacatgaggcagacngttgctgttggagtttcaagagtgtggtgaagaggacccaaccggccccaaggtgaccatagctgctgccaagaagaaagatgcgatcctgcgcctgctntagcaactcctaggtttcatcattacaagttttgtttgtggtcgttgctggttttgtgtgagctgttgagctc

SEQ ID NO: 11950 - DNA, 392 bp, Zea mays
  unsure (1)..(392): unsure at all n locations; Clone ID: LIB3279-193-Q1-K6-D3
tttttatttgtagccctatggccacacgcatacttccaacagctagctgagacacacagtaatggtaatgcaaactcaatcaacataagacctacagagtttgaagatgaaccagatgaccatggtgacattgtcctgagggacaccagccctatcttggagtcaatggagtctgggggggggccgtgaagaagcatgccactgggtttgtccaaggtgccctgaagcgtgatgagttttgtggtttcatcatgtngccgtccaacgtaaaaacagtntggaggtttatctaccaccacctgatgatttgntgaaccacagactgtcgtggttggctgttaatgacagcgaatgtttatgtttctagtggcantgtgaatatttggttttgc

SEQ ID NO: 11951 - DNA, 382 bp, Zea mays
  unsure (1)..(382): unsure at all n locations; Clone ID: LIB3279-193-Q1-K6-D4
ccgggtcgcccagcgtccgcactcactagtctcaccccgcaatcagggacaggtagctcggcgcgcgctcccctgctccgacgcgatgcgggccaagtggaagaagaagaggatgcggaggctcaagaggaagcgccggaaaatgaggcagagatctaagtaggcgcatcttgtgacgaggatggcgagcttgtcctgcatcatggctgaggctcgttgggatgatggtctccctttgcagacgtcctttgctgtagacgtaggcgatgtaaaccgtcctttttgattcattctagcatgttctgagactgggtttatattgtaatttgaggataattatatgatgctctaagttaaatcnngnnnnnnnnnnatnnnnaat

SEQ ID NO: 11952 - DNA, 630 bp, Zea mays
  unsure (1)..(630): unsure at all n locations; Clone ID: LIB3279-193-Q1-K6-D5
tcccgcgtccgggagtgctcatggcgagggaagagctttcttcccagatgaaaatgttctagctactgcagtgaagtctaatctggcncctgtgcgatattgcgatgattttaacaacataactgagacctaccccttcaatcctaatggttctccactaggtattggagccctttgggggggggtgggaggcaccttgctatgatgccacatccggagcgttgcttcatgatgtggcaatttccatggtntcccaaggaatggcaggttgagaagagtggtcccagcccttggctgcggatgttccagaatgcangggaatggtgttcatagtgcagggcagtgcccagctgttgcgatgcggatggttgttttcatctgatgaccccttccttttgcggaataaagaggtgttcggcctgcggtgcgttntccaagctgntnacagtcgtgtcaaatttgaagttttttcatagaaaactgccaggtttttgcgttgcctgtgccgatggtgtgttatctgtgccgccccttagtgactttccattcacgtgnaaatgctgctgcgttctcaatccgtgctttgcctgggcgttttggctgcttgctgtgtgggtggtttaattcatc

SEQ ID NO: 11953 - DNA, 321 bp, Zea mays
  unsure (1)..(321): unsure at all n locations; Clone ID: LIB3279-193-Q1-K6-D6
gcgagcaggnnanccaggggcaaggaanncaagggggngaacgcnggggggaacacaaaagggccanggnngaaaaccngggagagaaanaggggcaacnncnccagaaagacgggagagcnggccagnngaagnngcaaacaacagggagacaggggggggggggcacnncnannagagaacagaaccggcagncagggaagggagngagaaaggaaannncaccgaacccnanncnnngcncgaagaaagaaancagagcagggggccaaggcnggngnaccaccaacnggngngncngcaacangggccncgangaag

SEQ ID NO: 11954 - DNA, 626 bp, Zea mays
  Clone ID: LIB3279-193-Q1-K6-D7
ccacttcgcaccgccaccgtctcccgaccgcgacgccggcgacctccgcaccgcatcgctccagccgatcgttccgagatttgttgatcaaagaaccatggaaggatcgttccagttgaatcccaacgccagtcctttcatacctggattgctgggttcatctgcacaaaaagccccagaagagacaaggagggtcatcatcaaagggagagccttctggtagcacctttgatccttctgagtatgaggaaaatgacatggatgaacttgctctagtcaaaatggtcttttcaatgttcccaaatgtctccacggacttcattgatgagttaatcaaggcaaatgattttgacatgaatctgactgttgatatgctttatgagctgaactcacaagatatggttcatgatgattctgaggttatcaatcattttcatgatgattctgaggctaccaatgaccttcatgatggcaagggcgtacctggtgctgattaccacaagactgtggtgcccgagagtagcagcaacatgaatcaagacctgcagaacgaggagtcagcaacaacttctgatgtgaaatctgtgctgccaaagttctcacagatcaatttgcttcacaatgac

SEQ ID NO: 11955 - DNA, 426 bp, Zea mays
  unsure (1)..(426): unsure at all n locations; Clone ID: LIB3279-193-Q1-K6-E1
gggagggntatnggnggaaacngngcctcaaannncaaagaaaccccanaaaggggcggagacacatnactnngnnncaagaggccnancnncagcaacttcatcagcatcacagggtccatcttctgcaatttcaccagcatcccttgggccatcttctgcaatttcctcagcattccagggaccatcttctgctttttcatcagcatctctgggcccatcctcatccatatcatctgtcccaanaggtngatttacaaggaaggccaatgatgatttgccggacactgcaatcctggactcgagaaatgctaaaaatgcagctagatctgttatccttngctcgcnnttgagtgtgaagatgagtccgatgattcatttgctgatcttgggccctgtgatgaagcctcagcgtcacttgatcgc

SEQ ID NO: 11956 - DNA, 629 bp, Zea mays
  Clone ID: LIB3279-193-Q1-K6-E10
cggagtcgcgccgccacgctcctcggacgacggcatcaaggacgccgctgccgaccgccacggtgaccgcgacctctccatccccaagatcttcaccggagacgtgctggacctgctcgacgatgctgcgaggctggacctgatgctggcgctgacgggggacggcggtgcggcgtgcatgggcggcttctccgcgcgcgggtggtgggtctcgaaggaggatggcgacgcggtgcagctgaaggtgccgatgccggggctggggaaggagcacgtgaagatgcgggtggagaaggacgccctggtgatcaagggggaggccggcaaggacctcgagggcgacgacgacaagggcccggcgcggtacagctaccgcatcggcctctcctcccaggctttcaagatggaccagatcaaggctgacatgaagaacggcgtgctcagggtcaccgtcccgaagatcaaggacgaggagcgcaaggacgtcttcgagatcaagatcgagtagggtgtgtgcatcggatgggtcctcccaggtctcctagttgcagtccatatccataccgtagttgcagtccatatccatatcgtagttgccatgagctagtcgtattagtagtttcaattac

SEQ ID NO: 11957 - DNA, 286 bp, Zea mays
  unsure (1)..(286): unsure at all n locations; Clone ID: LIB3279-193-Q1-K6-E2
cccgggncgacccagcgnccgggnagagggcngcaagggcggggcgcgcagcggcgggncggngacgcgggcgcccggcggggaggngcggccggagaacnggcngnggnngnacaagcangagcacgccaggggcnngcngcncccggngcccaagaacngaangaaacnanngcngcngnagcnnnagcnagcggagggggggcgggcngcaccagcngnngnancncccagcncncgaagacncgnngcancacccagggccgggcgagnggccagnanccag

SEQ ID NO: 11958 - DNA, 592 bp, Zea mays
  unsure (1)..(592): unsure at all n locations; Clone ID: LIB3279-193-Q1-K6-E3
gccggnggcgaagaagaccctgagcaccaactccaccggtggtctccacgtcgcccgcttctgcgagaaggacctgctccaggagattgagcgcgaggcggtgttcgcgtatgccgacgacccctgcagcgctaactacccactgatgaagaagcttcgcaacgtgctcgtggagcgcgccctcgccaacggcgctgccgagttcaacgcggagacatccgtgttcgccaaggtcgcccagttcgaggacgacctgcgtgcggcgctgcccaaggcggtggaggctgcacgggcggctgtcgagaacggcacggcagggataccgaacagaatcgccgactgccgctcctacccgctctaccgcttcgtgcgcgaggagctcggagccgtgtacctcaccggcgagaagacgcgctctcccggcgaggagctgaacaaggtgctcgttgccatcaaccagggcaagcacatcgacccgttgctcgagtgcctcaaggagtggaacggcgagccactgcccatctgctgaacagagaaaatacaggagcagaagactggtttttagctaatatgcttttattcccaattatta

SEQ ID NO: 11959 - DNA, 626 bp, Zea mays
  unsure (1)..(626): unsure at all n locations; Clone ID: LIB3279-193-Q1-K6-E4
cttccagnaacctcagcgncaaggatctgcgctggctctcaggtacagttacgttacgtaccctgttaccgttaattgccttagcaatttccacgggctttgttcgttacacactagattccacttcagttcgtacactgtactatatatatctatcatcgacaggcgcccacgcgatcggggggtggcactgcccgtcgatcgccaagcggctgcgcaacttcacggcgcaccgggacagcgacccgaccctggacggcgcgtacgcggcggagctgaggcggcagtgccggaggcgcagggacaacacgacggagctggagatggtgccggggagctccaccgcgttcggcacggcctactacggcctggtcgcggagcggagggcgctcttccactccgacgaggcgctgctcaggaacggggagaccagggcgctcgtctaccgctatagggacgcgccgtccgaggcggcgttcctcgcggacttcggggcgttcatgctcaacatgggcagggtgggcgtgctcaccggcgcccaggggagatcaagagaggtggcctttgtcaactagctgcgatattgctggttgtcctttgtccctctcgccttatttaaattaaat

SEQ ID NO: 11960 - DNA, 605 bp, Zea mays
  unsure (1)..(605): unsure at all n locations; Clone ID: LIB3279-193-Q1-K6-E6
cggtcgcgtgggaccgcacgcccgcacaagctgctccgggctccgctgctaggctagggtttggactttggattggagccgcaccgccgcaccggcaccgcagccgtcgcagtgccgcacagccaccactcccatcttggtcttgcggccagtcgccctcggacctcggccatcgacccgtggcccgcttgccgagacgccgagtaagcgtcgaccgtcgtcgctgtcgtcaccgaggtccagcgcccaacagcccagcttcaagcctccagccatcggcgcccgccctcctccgccgagacgccgagtgccaagcgcccaagcaccccagtccccagcgcccaacaggctagcaggctgcaggtatgcactctttgttgatgcgtccaaggagttgagctcaatgcccagcaggctgcagaaactgaaggaaaaggcggcnttcaggaacccggatgagttctattttaaaatgatcaacagtaggactgttggtgggattcatagacctaagcctgaagataataagtatactgaagatgaactncttctgttgaaaaataaagatatgggatatatccttcagagcgctcaaagtggaaaaa

SEQ ID NO: 11961 - DNA, 332 bp, Zea mays
  unsure (1)..(332): unsure at all n locations; Clone ID: LIB3279-193-Q1-K6-E7
gngnagtccgcgctcgaggtcgaagagatccgcgtcgacaaggagaccatggagatgctcgctgccctcggcatggccgacctgcccggcgttgagcgccaggctgaggtctccaacgcccccgcctacggccgcccgcagtacggtggtccccgccgtgaccgcgtttagacttcgcggggggtgcctcttgatcgcactgctattcgtagttgttgtcctactatgctaaacttcttttagatctttggttgcatctgtggcggttaagttttgaacttgcctgttntggtataaattctgaagtgtttggttccnnnnntannntatnt

SEQ ID NO: 11962 - DNA, 346 bp, Zea mays
  unsure (1)..(346): unsure at all n locations; Clone ID: LIB3279-193-Q1-K6-E8
gaagaagcncaggcaagaagggggacgaagnnagcagagnngcggagcccaaggaggagcaaagaagnagcgcngaagaagaagagcagnccccgacanggcgnnacaacagnnnnggncgngaagcacnaaggnangcngaggagggggcaccancannagaggggganangggggcaangcaagcncnncaagaggcngcnaacagggnnaananggccaagagaggnannggacaggnagcaccannagcggngangccaanggcngcacagccaccagagagnngngcaananancaggagaccagnncnagancgcgagcggccgnncnagagggaccaag

SEQ ID NO: 11963 - DNA, 512 bp, Zea mays
  unsure (1)..(512): unsure at all n locations; Clone ID: LIB3279-193-Q1-K6-E9
ggnagggncaancctancacgcagggaaanaccccnaacctaccaacaacnnacctnccaaccaagcccttcgatctcgcgctgctgctagacatctcggttttttcgcaaattaacatgaatcggagatccgatcgatgaaccagaagcgcgatgacaaagctctcgtcgagccgggcatgagggtggtctacgttgtctcagaagatgaatggacggtgacaaattaactcatcggagttgtcgctagagttggggagggagtcgaactttgacgagatggtcatggtggcttatggcagcgagcttagttggctgcagactgttgtagcttggatggcagcggcactgctgcgaggctgtagaggagataagtctatggttgatggcttgaggtgttatggtggcatgtntttatataggctggaaggtgtgcgggtntatgattattctaatatgggaacctagtcctataataatgtaactctgcttaagtattagaaacctatcat

SEQ ID NO: 11964 - DNA, 600 bp, Zea mays
  unsure (1)..(600): unsure at all n locations; Clone ID: LIB3279-193-Q1-K6-F1
cggccgcgtgggnggcaagggcatacaatggaacggntatcgagttttcggtgttcttgcaatgtcgcgatcaattggtgacagatatctgaagccatggataattccagtcccagaggtaacaatagttccgcgggctaaggatgacgagtgccttattcttgccagcgacggcctctgggatgtaatgtcaaatgaagaggtntgtgaaatcgctcgcaagcggatacttctgtggcacaaaaagaacagcacangctcatcatcagccccacgggttggtgactccgcagactcagccgctcaagcggctgctgaatgcttgtcaaagcttgctcttcagaaggggagcanagacaacatgtctgtcgtggtngttgatctgaaagcacagcgcaggttcatgagcaaaacttanccgtgacaagcgttgcaacaagttgctaagaacctatagattcggacagtcccaagttcggtctttttcgttcgctgctttcgtgcgttgcttagcccagcgccttatttttctcagttcttttttagccgtgccaggggctgtgttccccgtgttcggtgcgggtcgcgaaatccctatca

SEQ ID NO: 11965 - DNA, 666 bp, Zea mays
  unsure (1)..(666): unsure at all n locations; Clone ID: LIB3279-193-Q1-K6-F3
ctctgctccaatccgccgctccactccaagtcacacggaggcagccatcgtagcctcgcccgactccgcttcccctgttctttgggcatggagctgatcacaaatgtcaccgagtacgagaagctcgcgaaggagaggctgccgaagatggtgtacgactactacgcctccggcgcagaagagcagtggacgctcaaggagaaccgggaggccttctccagaattctgtttaggccacgggtactgatcgacgtctcccgtatcgacatggccacaaacattctgggcttcagcatttccatgcctatcatgatcgctccttcagccatgcagaaaatggctcatcctgatggagagcttgccacggcaagagctgcagcttccgcaggaacaataatgacattgtcctcatggtctacttccagcgttgaagaggtcaactcagttgggccgggcatacgtttcttccagctctatgtctacaaggacaggaatatcgtacggcaactcgtgaaaagggctgagatggctggcnttcaagccattgcactcacngtngacactccaatncttggccgcagggaagctgacattaagaacaggttcgccttacctccacatcttgtgttgaaaaactccaagcgctggatcttggcacgatggaca

SEQ ID NO: 11966 - DNA, 364 bp, Zea mays
  unsure (1)..(364): unsure at all n locations; Clone ID: LIB3279-193-Q1-K6-F4
tgtcgcgtgggcgaagccgccgccagccgggtcctcccgcgttgctagcgtgggcgtgggcgtngccgtagcagcgtgtgcgagaggggaagaaatgctggaggggagggcgcgggtggnggacacggncatgccggcgcggatgcaggacgcggcgacctccgcggcctcgcgcgcgctggggctcttcgtcgtcgccgtctgccgcgccatcgccggccacatcaagacggagttcgacaagcggtacggcgtcnggtggcagtgcgtggtgggcgccnncttcgggtgcttcttcaccctcagctgcggcgccttcatctacttctccatggggcgcctctccttcctcctcttcaaggcc

SEQ ID NO: 11967 - DNA, 512 bp, Zea mays
  unsure (1)..(512): unsure at all n locations; Clone ID: LIB3279-193-Q1-K6-F5
cccacgcgtccgcgcacgcggccgcccgagcggccaggcacgcgcgcggcagcaggaagacacccncaagagccacagagatggaaaccncgacgcggctgaaaagcatggggaagctactgaatacaacggccctataatgacacatggtggagaggagcggggcgtcaccttatggtgcgggggaggttgtggaaaattgagtatacctgccatagaaatgcctgggctgggaagcttctgcctcggtgttgggctcccaggtagcgcagagggaagctttaatcagagtgagagtttgtaattcttggagaacaagctggtcttcgttgcgtcgatactgtcaggggcttccaaaggattttcattgacttcgaaagatgagctcaaggctgaaggtacctcacgttcgggctctgctgtgccttcactcaaagtgaatcttgtgcaagcgttgggatctgactgtccgtcgtcaccagcgagaacgagggagctaaatccgaccttgc

SEQ ID NO: 11968 - DNA, 484 bp, Zea mays
  unsure (1)..(484): unsure at all n locations; Clone ID: LIB3279-193-Q1-K6-F6
gcaattngagttttatcaagcggatggactgacaaggttcaacccatcggatcccagcaggcttctaccaagctatgtccctgaaggctcttttatcgcaagagagcacacaccgatgtccaacttattttcctgcctgtggtacaatgaagttgatcgattcacacctcgtgaccagctgagctttgcatatacatacttaaaactgagaaggacaaatcctgacagaccattccgtctcaatatgtttaaggattgtgagagacgatcaatagcgaagctattccatcacaggacagaagagagacacaacagtgcacaattaacaagatgacacatccttcctagtgatggagggcagaagagagaggttagggattgttttctttgatatagctcagctatccacaagactctccattgaaactttatgcccctgtctaggagtttgtactttatttaatgcaagccttctttcctttgt

SEQ ID NO: 11969 - DNA, 616 bp, Zea mays
  unsure (1)..(616): unsure at all n locations; Clone ID: LIB3279-193-Q1-K6-F8
ggnagtcagagacaggnaggagggcggcggaatcggcgccggcgggaggcaggcatggaggacctgagcgtggaggagctcgcctccaacctctccacctacaaagagcagctacgcgaggtcaagaagcttatcaaggagaagaaggatgatgctggaatttctgaatatattgatatggggaaggagcttcaagaggtcataacgttaaccgaagagattttggcaactgcaaagcaaactgagagtgcccagaatgttgcaggtctatcaccgccaagctattcagctggagtgcagtctgagggactggatgacctttcacattcccataagtttgccgttggtactagagttcaagctgtgtggagtgaagatggagaatggtataatgcaaccgttgaagctttgacaccaaatggatactatgtagcctacgatggctggggaaacagtgaagaggtggacccagataatgtgaggctgcttgaggaagaagcagctgatgccttgggacaagctgaaaaggaagctgaagcttcccaaaatggcatnaagaggaaaattgaaccaagcagcacatctgantttcaggcgcgtagcttgccggccaaac

SEQ ID NO: 11970 - DNA, 600 bp, Zea mays
  unsure (1)..(600): unsure at all n locations; Clone ID: LIB3279-193-Q1-K6-F9
ggagatcttcctcaggnagctcatctccaactcctccgatgccttggacaagatcaggtttgagagtttgacggacaagaccaagctggatgcacagccagagctgttcatccacattgtccccgacaaggccaacaacacgctgacaatcatcgacagcggcattggtatgaccaagtcagagcttgtgaacaaccttggtaccattgcgcggtcaggcacgaaggaattcatggaggcacttgctgctggtgctgatgtgtccatgattggccagtttggtgtcggtttctactctgcctaccttgttgcagagagggttgtcgtgaccactaagcacaatgatgatgagcagtacgtgtgggagtctcaggctggtggctccttcactgtcgcacgtgatacctctggggagcaacttggcaggggtacaaagatgaccctctacctcaaggatgatcagttggagtaccttgaggagcgccgcctcaaggatctgatcaagaagcactccgagttcatcagctacccaatctctctctggattgagaagaccactgagaaggagatctctgntgatgaagatgagggagataagaa

SEQ ID NO: 11971 - DNA, 570 bp, Zea mays
  unsure (1)..(570): unsure at all n locations; Clone ID: LIB3279-193-Q1-K6-G1
gtnaaaatccttttgaaatgttcactgaccgaccgaaaactgntttgttntcctgtggtgcgnaagttgataattagcatttcatctataacaacgcattcgctgcttatatgatagataactttgtggtctgtctttcaatgtgntagttctcaaattataatntgttatagtttgatcgttggatactgaaattgttttcttgtttctttttttcttgccatggcggtgcatctgctaccaacaggagacccttcgtgttaaagacgacgaactacaccaattattgcaggatnttcgtgcacgcgattctaccatcaatgaaattgcggttaaattacaggagactgcagaagcagctgaaacagctgcttctgcngcacgttcaattggtgaagagagtagatgttntacgttagaacttgaacggctgtcacaagaccacgtgaaacaagttgaagcctctctgcttaggttttgggaatcggttgagaaagcatagcttcttgttgaagagagagatcgcttgcttacagngagagattccgctctttcagaagctcagatgtg

SEQ ID NO: 11972 - DNA, 502 bp, Zea mays
  unsure (1)..(502): unsure at all n locations; Clone ID: LIB3279-193-Q1-K6-G10
cggagcgcctgatacgatagtagcagcacagctagctctcctccccagaatctcgccggattccgccccccgccgcgccctcgcttccgccgcaggttcgcgtctgtgcccgcgcgtgttgtactaccggcggacggcggtgttggtggtggttggtggagttgccgacgacggtaggctatggactaccggccctccgacagcagcggaactgatgatgatcttccacaatttccacataagagtatcagaggcagcggacgtgtcagtggtaatgggcgagctgttgttcctgctggttcatatgctagggcaccaactgatatggtagcacaagttcaacaacttgagcaagaagcatatcgctcagtccttcgtgcattcaaagcccagtctgatgccattacatgggagaaggaaggtctcatgactgaacttaggaaagagctaagagtttctgacaaagcacacagggaactgttnaatagagtcaacacgatta

SEQ ID NO: 11973 - DNA, 366 bp, Zea mays
  Clone ID: LIB3279-193-Q1-K6-G11
cccagcgtccgcccacgcgtccgactagttctagaggcgagcggcaagcacggcatgtagacgcaatgcaagcacaacgtacgtcgctacagatcacgtggaagcgagagcgcggactgcagatctatatacaatgttggatatacgatttgcaactgataaaacccattgaatcctgctagtgcgctgacagcagaccgatgccctaaactgatacacaggcattagtgcactaactaatacaggttgataaacttctgagcatcagtgcactataaactgataacacgggcattgggaggcttgccagcatgaataatagggaactcaacgactaaacattgtaaatctcgacacatgaatttg

SEQ ID NO: 11974 - DNA, 557 bp, Zea mays
  Clone ID: LIB3279-193-Q1-K6-G12
tgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggggaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactg

SEQ ID NO: 11975 - DNA, 582 bp, Zea mays
  Clone ID: LIB3279-193-Q1-K6-G3
gcagcggcggcgtatccctaatcccacctccagtctctgggcaccaaatttccggcggcgatggcggcggctgtggcgaggtcagggttccggcgcatgttctccgtctctgccttcgcgccgccgaaggcgcccgccgcgcgccccaaggccgacccatcccccaacctcttcgtctccggcttaagcaagcgtaccacaagtgaaggacttagagaagcctttgcggagtttggtgaagttttgcatgctcgagttgtgaccgatcgtgtcagtgggttttctaagggatttggctttgtaaggtatgctacgaccgaagaggcagccaagggaatagagggaaaggatggaaagttccttgatggatgggttatttttgcggaatacgctaaacccagaccaccaccggaggaaacagggatgaattcgcagccccagcagtcatggggagctccatcaggttcctggggtgcacagtagatgaagtgatattgtgagagcccctccctgtcccagccctagggctcgtagcggatcgtgagggatgattttgtgtggtgtgtcgcaggtgtgaaatgc

SEQ ID NO: 11976 - DNA, 438 bp, Zea mays
  unsure (1)..(438): unsure at all n locations; Clone ID: LIB3279-193-Q1-K6-G4
acaacccacaacccgagccccccaaacccgaagcagcaggagcnccccggaccnngcnnccgcccccgacaaggaaaagggaagagagcnaccacggccagcagccccccggcggcggcccgccgcagcaaggcgacccggggaaggacggcnacccgccagcggggggccgggcgggcggcnaccccccgccggcgcagggcnacccgccgcagggcgacccgcagcagggggacccacagcagggcgacccgccgcagnacgcgcagccgccnccacagcagcagcagagcagcgggcccccccccanggaaggangcnnggcggcccncngcngcngcngccnccnggacgccngcnncngacggaaccanccgngccggggccaacacggcngcaagngaagcaaccagcnnacggaagagcnggaacngggcc

SEQ ID NO: 11977 - DNA, 431 bp, Zea mays
  unsure (1)..(431): unsure at all n locations; Clone ID: LIB3279-193-Q1-K6-G5
cgggtcgaccccgcgtccgttgttcccctccgtctctctgttcggcgcggtggtgctggctcntntgcttggtggtctgctcatgtctgcttcgtgttcncctctgtctgtcttcctngctttcngctgcatgtcctcatccccgctttttgttggcgggctttcttctggttccgttgcttccagtctctggggcggttgtcggggttgtggtcctgttgttgttgctgtgcctttccttgctcgtgcgtctgggtggtccgggggttttggctttgtgccttacacgtcttctgtggcggcttcggctgccgtctctgccatggttggtcttgctctggttggtcggtgcttgcgggttcttcctgctcgcgtgcggcctggtggctttctctgtttcggtggttctggtggtggcggctttggtggtg

SEQ ID NO: 11978 - DNA, 456 bp, Zea mays
  unsure (1)..(456): unsure at all n locations; Clone ID: LIB3279-193-Q1-K6-G6
gcagtcatgtntaactgagacatgataacataacaaccacaaggcatcggtctggcaccacccccagaaccttgctgagggcagcctgaatggcttccaggtcgcaccgtctcagccgtctcatccgagctggcagcatcagcacacctactgagcattgttctcccttgttgtgggggggggggggcgccgtcacaagccaagtttcgcgtgcttgtgcccttactcgatgcagagtaagctgctcggattttagctgagcttgtcccttgngcgctgngaagggtccctggctttcaacagttaagagcgttttaacatgctgcgtgcgtgcgtgcgtgtgtgttgcctgaccgntgccttgtggtttttctgtggcgtgttttgtgtgcgggggtgctgtcgtgtttgtctggggcctgttggcttgtctgccggtcgtttcgcttgcctgtt

SEQ ID NO: 11979 - DNA, 525 bp, Zea mays
  unsure (1)..(525): unsure at all n locations; Clone ID: LIB3279-193-Q1-K6-G7
cccgggncgacccagcgnccgcccacgcgnccgcgcaccacacgcgaccgaaccgcacaaacgcgcncggcgcnnccccacccaaaaggcaaaccaaccaccaggcccaccacccnccgcccccgcccgcgccacagcngccganncgaaagcccccggcccgaccccncgcaaaacccnagccccaaccaccangaagggggggggcaacgccnccaagaaggangagggcaggccccgggccggcggcggcggcgccggaaagcgcaagaaggccgccgcgagcggcaagcccaagcgcccncccnccgcccccnncgncnncagggcngaanncaggcnggagnaccaggcgcagcaccccagcaacaagagcgnngcggccgngagcaaggcagcnggggaaaagnggcgcncnnngncagagcaggagaagcaacccnangnggaccaagcnngggcagagaagcagggcccngagaagaccaaggcccccnnngcgaaggagagcccacgcccaaagaa

SEQ ID NO: 11980 - DNA, 615 bp, Zea mays
  unsure (1)..(615): unsure at all n locations; Clone ID: LIB3279-193-Q1-K6-G9
ggcagcccggcttgtcgggagcgcgaggggcgacatgggggcggaggccggcgagcccagctccatcctcagcttagcttccgccttttcctatggagtcgcatctatggcaatggttttcgtgaacaaagcgggtcttatgcagtatgttcactccatgaccctcctcactttacaggaaataggaacagcacttctgatacattttgggcaagttctaggaatgtctaaacgaaaagactttagctgggtaaccgcgaagaaacttcttccagtgtcaattttctacaatgcaaatgtgggatttgctctatcaagctcgaaaggggttaacatcccaatgtgtattgcaatcaaaaggatcactccccttgctgtgttggtggctgggtgcatgcggggaaaggggaagccaccgacacacgtcattctttcagttatctgcaccgccactggtgtcctcattgcagcacttggagattnttcctttgacctatatggatactgcatggctctaacatcagtcttcttccagactatgtatttgattctggtggagaaataagcgctgaggatggtctttcctcantggactngatgttttacaacagcata

SEQ ID NO: 11981 - DNA, 230 bp, Zea mays
  unsure (1)..(230): unsure at all n locations; Clone ID: LIB3279-193-Q1-K6-H10
cggccgcgngggaaaaaaaacngnnncagacaggaggggaggngcngangaggaggaagaagaggaagcannggaagannnngggnnnncngagganganngaagagaagacgaagggagaagagaggaggnggcncannnnggcnnnngagggganccaanagnnacnnngnnggggggggggggggggagnccananggggggcnacccgcngaagnggaangaagaa

SEQ ID NO: 11982 - DNA, 336 bp, Zea mays
  Clone ID: LIB3279-193-Q1-K6-H12
tggccgcgtgggggactgttgtctgtgtctctattggtgacaaatgggctaccgtcgcctcaggggttctaccccatgtgttgaggtctcaggccctgttgccgtacctagtactctctaccagcatatataatggaagctatgcccatggcagctctggacgacacactagtctgggggggggaggcatttgctaatatcccggtggatatgaaaggaaggaggccggttatgataagcgccatcgatggagtacatactggtgtaccatagacctgccaactgggaaaagacgcgacaaatacactgcagagccacgaacgaaaagactaacac

SEQ ID NO: 11983 - DNA, 450 bp, Zea mays
  unsure (1)..(450): unsure at all n locations; Clone ID: LIB3279-193-Q1-K6-H2
cccgggncgaccccgcgnccgcccggctcccggccgccacgcggaccacaccggcgncccncgnggnnggccccggcccgcgcggcgccggcgcggggcccancngcgcgnccccggccaggncccccnccaacccgccctacgaccngncggccgnccggggcagccccancaaggagnccagcgngncccgcgggaggaccgggcgctcangacggacangancaccnacgccgacaccgacgncgncnncgngggcgccggctccgcggggctgnccngcgcgnccgagcncgccaagggccccgccgngngcatncgccccgnggagcagncggngncgccgggcggcggcgcggggcngggcgggcagcnnggcncggccccgggggggcgcaagccggcgcnccnnggccgggacgagcngggcggggcgggccgacgggccgg

SEQ ID NO: 11984 - DNA, 491 bp, Zea mays
  unsure (1)..(491): unsure at all n locations; Clone ID: LIB3279-193-Q1-K6-H3
ccccgcgtccggctgaaggaggcaaagcagaggattccaccggtgttggcggagctcaacgatccattggatgatgaggaaataattgccaaggagagtggtgtcaaaggttgtgcgtattgtggtgggcttggccatcgtgtcagtgactgtccgaagttggagcaccaaaagtccatgggggttgctggctcgagaaaagactactttggcggcgggggttaccgaggagaaatatgattgctctaggttgatgcttgcgtgtggttatcaggagctaagatgctgcantttcaggtcatacatgtcacatgtatcagctagccaaggctcctcccccatcgttgaagggagacggtttgcgttaacgaacttgtgatatgctgctgggtttgaactgcttgctactgacctaccatgtntcttgtttgaaggacgcangttgattatcctgccctgttgtnaaatggtaccagaacaattgctggcgt

SEQ ID NO: 11985 - DNA, 481 bp, Zea mays
  unsure (1)..(481): unsure at all n locations; Clone ID: LIB3279-193-Q1-K6-H6
cgggtcgcccagcgtccggttctagacgcggcgatctagaaccgacagtacatcggccatgcccgcgcatacgtagcctttgcgtcgtctacaggtacttgcgctatttggactatgaagttcgctatgttcggaacttcaccgacattgatgacaagataatcgcaagagcaaatcagctgggggaagatccggggaacttaagtaaaaggttctctgatgacttcttgttagacatggccaatcttcaatgtttaccaccatctgtggagccccgtgtttcagatcatattgatgagattataaatatgattaaacagatccttgataatagttgcgcatatgtagtgggtggggatgtttatttctctgtngacagttttcctggcttcggagaattatctggtcgnaaattngatgattatagagctggtgaaagggtttctgttgttgaggggaagagaaatccagctgattttgc

SEQ ID NO: 11986 - DNA, 321 bp, Zea mays
  Clone ID: LIB3279-193-Q1-K6-H7
ccccgcgtccggggccatccaaagggatgactcactcatcagtgaagaggctcaggggtgggaataaagggggtaagcgccttgaacccaaagggtcaagttcccggggtggttttttttttcccccggtttcctgagccacaatgcctgggaggggaccccatccactttgggggggggtgggttattcggtgactggtgggggccaagaagggcaagttaaaccggttcacccgagggttaacacccttgcttttctctttctgcatctgaggtgattgccaacagttttgggttttaaaattaagaatcttgaatcgt

SEQ ID NO: 11987 - DNA, 594 bp, Zea mays
  unsure (1)..(594): unsure at all n locations; Clone ID: LIB3279-193-Q1-K6-H8
tgttgatctggctaatgacgaccagagaatctccatacacagtggcggatgcaggacaaaaatcatggggggccaaaaagaccacatgagagctatggttttctagttcgtcaagcctgccgaccccaggggaagtcatatcgttgcaacgagggagatctatcttgtcgagtggattgacatcacgattaaaacaggacaggggacagaggcgtcaggaagggatggagtcgggtggcgtcgcatcgggaatgggtcaacaacggaaacggggcagcgagcagactggtttaggtggtgtcggaaatgttgggcgccttcggcttccgaaggtcctcaaaaacatgatttaacaatgcctctggagtataatgtgtggacagggatcttcgaacaagagcccacggtntgaagaagcacgggaataatacgaaagatggagcagagccgaagctgcgcagaagggagcttcggcatgatggcggaaaagaggaaacccgcttaaagaggagaagactatctagacccagataaattactattgagttgttgtcatatgcaaagggcctggatgtaatttttcatgggctgcga

SEQ ID NO: 11988 - DNA, 517 bp, Zea mays
  Clone ID: LIB3279-193-Q1-K6-H9
cggtcgcgtgggcttccgacaccaacgaggacggcggggatgagatcaaggaagcagctgctgcccccaaagaatccgcccccgagggccagtaagacggatccgatctcccgacctgatgcgtgtctgctgatgtcggggagtttaccaggactgtgccgttcttgatttctgatggcgggggttgtagtacacctcgtgttgttctcttcgtcacggcgccggtgcgcgtgcgctgaagctgcctgccattgccattgcctttgccgctgtttttaattaagcacacactctagatgttatgcccgcatgctatgtttcgattctcaagttgataaatgatggctggatgctggttttcgtgctccaagcctgctgcttcttccagggaaaaaaagacctgcccttgttgcagcgttgttgtttagaatgacctatatttgactggtattctgttacggtggctttgcaaagctgtttgtttggtttatgtctcggaatatatgaattggctgcc

SEQ ID NO: 11989 - DNA, 528 bp, Zea mays
  Clone ID: LIB3279-194-Q1-K6-A10
cccacgcgtccgcaattctctggtggtgaattatactttcgaggtattcggtgtgagaatcatgtgaattcagagacacaacatgaggaaatgtatgactacacacatattcctggttgggctgtactccaccatggtcgacacaggcatggtgctcgagctacttcatctggtctcagaatagaatctgcttttgtggtgccggagagagatgaagaaataccagaaggattttccgagctggtgtggtgaatgccagcgcgaaaagagggaaaggcagagtcagtgtgttaaagcaacgaagatggcctttctcaggggttctggaggtgcagcgatttaatttgtacgtaggtcatttatgttatatactgttttgcgtcatactgaacttcatcgtttaggacttgacaggggcattgtatcgatggccagctttgtgctagtgcgtttattggtgcgatcccagttgtatgtaaatgtaaacattgaccaaatgcagccgaaagaaatgtaatagcgggtcat

SEQ ID NO: 11990 - DNA, 400 bp, Zea mays
  unsure (1)..(400): unsure at all n locations; Clone ID: LIB3279-194-Q1-K6-A11
gacgcnnccgccccccacaggccccaggaggagcccganncagacgnnnggccggggaggggagagnnaagagagggangaccngcananccagggagggcagngcgggaaccagancggcnccaagnncngggagggggngngcgangagcacggcancgacccgacgggggggggcagggggacgncggacgngcagcnggagcgcgncaacgncaaccacaacgaggcnncgngnggnaggnncgngccgcgcgcggngcncanggaccnngagcccggcaccanggacgccgnccgcacgagccccnacggccaganncgccgcccagacaacngcggcngcggccaggccggcgccggcnccacccgggccaaggggcacnacaccgagggggcg

SEQ ID NO: 11991 - DNA, 270 bp, Zea mays
  unsure (1)..(270): unsure at all n locations; Clone ID: LIB3279-194-Q1-K6-A3
tttcggttcatggttnggtnnttggggtgtgtgtttcacctncggggccttcttttcggtgaaggttttgtcgcttctggtagagcgtgcatgatctgcccttgctttcggnttgcntgccncttcntgttgtcgaggctgctcagtgctggtggttggggagaaagcctgtgggtgtgtggggcgaggtgtgtgttagtctcaggggtggccgtgctcacgctgtgtttgccgcctgggcattgctcgctttagtttatgctgggctgt

SEQ ID NO: 11992 - DNA, 470 bp, Zea mays
  unsure (1)..(470): unsure at all n locations; Clone ID: LIB3279-194-Q1-K6-B10
cgcggcgcgccgcccgnggcgccggggggcgcgcagngcgcggcggnggggacccggcnggccgngcngggcggcngggacccgcngagcnncgagcccgnggcggacgngcacgngcnggacgcggcgacggggcgggggcggcgcggcgcgcccangcggncggcgcgcggggggggggcgngcgccgaggccggcggcaggancnacgnggcggggggccacgacaagcacaagaacgcgcncaagacggccgaggccnacgacgcggaggccgacgccggggacccgcngccggacangncggaggagcgcgacgagggcgacggcanggccaccgnggccggcgaccggnnccgggccgncagcgggnaccgcacggcgcggcagggcgggnncgagcgcgacgccgaggggnncgacccggcggcgcgggcccggcgcaggcgggagcgcgngcgcgcgccggc

SEQ ID NO: 11993 - DNA, 568 bp, Zea mays
  unsure (1)..(568): unsure at all n locations; Clone ID: LIB3279-194-Q1-K6-B11
ccgacgcctcgctcaagaagagatggcgccgggcgcgctcgncatgttcagcccgctcgtcgccggtacgctcttcggggtcgagacgctcgcggggctcctcgccggcgcactcgtctccggcgtccaggtcgccatctctgcctccaacagcgggggtgcatgggacaacgccaagaggtgcatcgaggccggcttgtcggaggaggcgaggtcgctggggcccaagggatcggaggcgcacaaagcggcggtgatcggggacaccatcggcgacccgctcaaggacacctccggaccgtccctcaacatcctcatcaagcttatggccgtggagtcgctcgtcttcgcgcccttcttcgccgcgcacggtggcatcatcttcgaccacctctgatcaatgcatgctgctgacgttccatggcaaaggcgccggctgtcgccgcaagccgcctctttgaatttgccgtgatcagttagtaagaataatcgtcgtgtatgtagcctgtaacaagtaatgccagaccaccagagttggaggcttattcatgtctggccctcttatctt

SEQ ID NO: 11994 - DNA, 388 bp, Zea mays
  unsure (1)..(388): unsure at all n locations; Clone ID: LIB3279-194-Q1-K6-B3
aaagcccacaggnnagacancggnncccgacggcggaaaaaccgaccccagccgcaaaagaaccncnncaggggagnngncnccacangcgcgncagaanncnccngnngaaaggaaaagacggagagagncncgccanggngaagggncaccgggggagagancngcnncnccccgaagaagaacnacacccccncgaagaagaacnananccccncgaaganccccacacangaggagggaancaccaagaaggggagacncaccnaggaggaggcccccaccnaggaggagggagncaccaaggaagagagacccaccaaggaggagngacgcaccaaggaggaggggnncaccanngaggaggagggcccccccaaggaggagg

SEQ ID NO: 11995 - DNA, 361 bp, Zea mays
  unsure (1)..(361): unsure at all n locations; Clone ID: LIB3279-194-Q1-K6-B4
ccccgggnncgacccacgcgnnccggcgggggccgcggcagngaaccccgagcgggaggcgggccgcgcnccgccggcgccncgnggaagagccgccggccgancccgagccccgcgncaaggacagccgcgagaacgcccggcccggccccgcgccaccgccaccngcggcngagcnaagcggcgacgangaacgcgnccacggcgcggggggcggcgnngnggnaacgcngagggggaaganggagggggngncaaagggcaggcgcgngcgggnggcggngggcagccggcgacgggaagccggcgccgccggcgaccccgcnggcgggggcggccngncaaggaaaggcggcggccg

SEQ ID NO: 11996 - DNA, 79 bp, Zea mays
  unsure (1)..(79): unsure at all n locations; Clone ID: LIB3279-194-Q1-K6-B6
agaaccggggggcaccgccagcanngggaggggggggggcagcccccnagcccggagaaaacgaggcaaaggcnccaag

SEQ ID NO: 11997 - DNA, 531 bp, Zea mays
  unsure (1)..(531): unsure at all n locations; Clone ID: LIB3279-194-Q1-K6-C11
gtcgcccagcgtncgccagcgttcgcccgcgttcgccagcgtcggcagactgtgtgatgcaaatgttatgcttaatggttttggagctgtggtaatgcacttggcaaagagttaagccttaccttcctcagatttgtggtccatcaagtggcgattgaacaataagagtgcaaaattaggcagggggtgctgatctgatctccagatagccattgtcatgaagcagtgccaggagagcagctatgggacacttggtgttggctgttgagtcttagagaggagatcctgagggtgggttcaattctggaccttgaaggcttcgtcaatgtcatcggttgactaaaatgactctccaatcaagtcttcttctcgttaccccctcttgagaacagatgagaaggtcagagactgattgtcttgtggtggatgtgtcgtgagcgaattgtgccacagggatggtgagatttgttggctgctcggatgtgaggctctagaagtttggagagcactgtaatcattggtttttgcaag

SEQ ID NO: 11998 - DNA, 302 bp, Zea mays
  unsure (1)..(302): unsure at all n locations; Clone ID: LIB3279-194-Q1-K6-D10
gaacagcacnagcannggccnnggggaaagaaccgggacannccncccnganngagggnnncaccgccggnggnnncanggacggggggggcgcgggagncccaccacangagaacgaccagaaaacaacccncaagagcncaggagcncagcngacccccccggcaanggggaggcngggcgcncnaggcannncncngggggaanaancngaanccccannncaccacnngcagcgnnagggccaaccgcaggnaccccaagncgannnaaggcncnagcagcnccagaccagaagcagg

SEQ ID NO: 11999 - DNA, 486 bp, Zea mays
  unsure (1)..(486): unsure at all n locations; Clone ID: LIB3279-194-Q1-K6-D11
cccacgcgtccggcgcngaacgtcaccgggaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtggcctacacggagcacgcccgtcgcaaaaccgtcaccgctatggacgtcgtgtacgccctcaaacgccagggccgcactctctatggcttcggcggctaggttaggtgtgggtaattgcctgtccaggtgtctcggatctgtggtactagtttggctgccttcctgtgttcgtattgtagcagttgtggtagctggttgctttgtcgtcctgtagtcgtgcttctttgggtctgtaagaaccgctggttcgatgggattggattggacggtgaagtaggaatgttggcatgttagacttttctcc

SEQ ID NO: 12000 - DNA, 593 bp, Zea mays
  unsure (1)..(593): unsure at all n locations; Clone ID: LIB3279-194-Q1-K6-D12
ccggnngtcgacccacgccgtccgggtgccacnngccgccaccaaagggaaacgagaagacaaggcctccgcccccgatgcctccgctcctcacctcacccgcctccctcccctccgcctcccctctcctcgcctcctgcatcggcgctctccaccgccccggccccttcctccaccaccgcgccgccgcctcggtccacttcctcgcgccgggcaggaagacccgaccgccccccgcgatgagctggcttgggaagctgggcctgagcgggcttggaggcagcccgcgcgcgtcggaggcgtcggcagcgctggcgcaggggcccgacgaggaccagcccgcgccggggaacgagttcgcgcaattcggcgccggctgcttctggggcgtggagctcgcgttccagcgcgtgccgggagtcacgcgcacggaggtcggctacagccagggcaacatccacgatccgacctacgaggacgtctgcaccggccccacaaaccacaacgaggtcgtccgcgtgcagtacgacccggccgcctgcaagtacgacgacctcctcgacaccttctgggcgcgccacgaccccacttac

SEQ ID NO: 12001 - DNA, 554 bp, Zea mays
  unsure (1)..(554): unsure at all n locations; Clone ID: LIB3279-194-Q1-K6-D7
ttttgccggaccaaaaaccccggggcgacccagcgnncgcggncgcgngggcggacgcgngggnccggaggagagggaggaggngcgcncggcgnacnnggagacgccgacgacgaacaagagcacggnggcggggancanggggnngccgcgcagggagcagaagaaggagacgcaggcggagaagagcncgaagaggaggccgangagggggcgggggggagggcgnngnccnccagcgaggaggcggnganggggnccgggccgcccaggnggagcagcaggaacggcgnccagaaggcgaagaaganggggcngcngcngcngcnggcgncgnngnngccggcaggggcgcccgngccgccgcgcnggaggccgaagcnggagcnggacgaggagcngccnccnncgccgnnggggcccangcgggggcggaggnggccgngggcgaggncggcgacccagncggcgnggggggggcngggccggacgncgaagcgggggaacgggggggcggaacggcggcgccnggggcccgcgcggggccggaacac

SEQ ID NO: 12002 - DNA, 322 bp, Zea mays
  unsure (1)..(322): unsure at all n locations; Clone ID: LIB3279-194-Q1-K6-E1
gtggacaacgagtccaacctgcaccagctgatactctcngaggccgacgacgacccggtgatgggggccgnggncccgggggtgtnggtgncgtgcncggacatgaacctggtgcgggaggccttccagctcgcgctgctgngcaccaagcgccaccccgcggaccggccgaccatgcacgagggcgcgagggtgctgctctccctcctgccgcccgccgccaagcctcccgcgttctgtgcggcggcggcttcggcggtggtcggcgactccacgcgctttctcgcgacggcggccgacctgtggcgcggcggcgtggccg

SEQ ID NO: 12003 - DNA, 630 bp, Zea mays
  unsure (1)..(630): unsure at all n locations; Clone ID: LIB3279-194-Q1-K6-E10
tcccgcgtccgccccgcgtccgctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttgggggggtgcggcgagatcctcgactccaaggtcatcaccgaccgggagacggggaggtctcgcggcttcggcttcgttaccttctcctccgagaactccatgctcgacgctttcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctactgcggtcggcgcgagggtggtggcggctgcttccgnggcggtggcggctaccgcggtcggcgcgagggtggtggnggctgcttccgcggcggcggcggctgctggggggactgttgtgtggcccctcctggcttcggcgggtttcttatctgtctatagtgtcgggtaccgatcactat

SEQ ID NO: 12004 - DNA, 572 bp, Zea mays
  Clone ID: LIB3279-194-Q1-K6-E11
tcctgctcggcctcttcaccgttgccatcagctttgctgtgggcatgacatgtgccttcaccagtggcaaggtcattctggagtctgcaattctgacaacagtggtcgtgctcagccttaccgcatacactttctgggccgtgaataggggcaaagacttcagcttcctgggtcctttgctgggcgccgccctcatagtgctgcttgtgttcgcactcatccagatcctgttcccactgggcaagctctcccagatgatctacggcgggctggcgtcgctcatcttcagcgggtacatcgtctacgacacaaacaacatcatcaggcgctacacgtacgaccagtacgtctgggccgcagtctccctgtacctggacgttatcaacctcttcctgtccctgatgaccctcttcagggcagccgactaggcgctctgctctcatcctgtctatctacgagtcggtgcctgaatgctcccgtggttaagctccggtccccagaattccagttccaagaatagagttgtatatagctacctgtgttgcctttctactagtatggtcttattcggc

SEQ ID NO: 12005 - DNA, 473 bp, Zea mays
  unsure (1)..(473): unsure at all n locations; Clone ID: LIB3279-194-Q1-K6-E12
ggccagacaagccaancgaagccgaggaacgaccanggacnccaccggcaccggagcaggggggaaggggaagaagggagcggccgggcgcaagggcggcgggccaaggaagaagncggngncgagggccgngaaggccggncgggggggggggggggccgcancgggcgccacnngaagaagggccgcnacgcgcagcgngncggcaccggcgcccccgncnaccncgccgcngnccnncgaaaccncgccgcngaggggcnggagcncgccggnaaggcngccagggacaacaagaagacncgcannannccgcgccacgngcnncnggcganccggaacgacgaggagcnngggaagcngnngggcggcgngaccancgcncacggcggngggcnccccaanancaacccngnncngcngcccaagaagacggcggagaaggcgnccagnggcgggagcaaggaggcaaa

SEQ ID NO: 12006 - DNA, 509 bp, Zea mays
  unsure (1)..(509): unsure at all n locations; Clone ID: LIB3279-194-Q1-K6-E3
gngcaatttgcctctgtnttcaatatagaggattacaaagctgctcgtgagagatgttacaagcaaattgctgctgctgttgctaaataccgggagtttaagaagaatattaacgagggcttaaacttttacgtgactctgcaggaagcaattggcaaaataaaacagcagtgcagtgacttcataatgacccgaaacattcaatgccgtgaaatgatcgaagatgtgcagaggaagctagcgggtttcagcttctcgtcctccagccactcctctatgcagaggaatgcttctgttccacctgatcagagcagcccgtcaccaccaccgcatgctcaggctccctatgcctctccacctggggtggactcaagacttgggtnttctcaaacggagccaagacctgcttactcacagccgtaccccccatcctgtggcgctccaccgcaacagccttcatttggcgcgccacaccctggtcggtaccaggcggcagcgcaccagccacc

SEQ ID NO: 12007 - DNA, 488 bp, Zea mays
  unsure (1)..(488): unsure at all n locations; Clone ID: LIB3279-194-Q1-K6-E6
cccgatcccaangcagaaatgcccaagcgaaagactgacagagcacatgnnnnagacaaggcnaagcanctnncaaggctaaatgttaaggaggcaggaaagtaatgttgaaacgtggtgaaggaaagcttgaaaagcagtttcgcatgagctgtgtgggatgtgacctttttgtttgttaccgatcagaagaggatctggaggttgcccctttcatatacgttattgacggagcactgagttcagttgctgctgngacaaatccacatgatgctcctgtacctccttgcatcacacaactggaaggtggagttgtccaagtngccattgaagtggaaggccggtcncaacgttcagcggtnacaagagtgaatgctgatgacgttcgagtnacggttgctgcccttgctgctcgaggggaagctgncagtgngttgctttgatttttgggcanggttcttggcctaagattgacttngatgaccctt

SEQ ID NO: 12008 - DNA, 437 bp, Zea mays
  unsure (1)..(437): unsure at all n locations; Clone ID: LIB3279-194-Q1-K6-E8
ccccnccggnncgggngcgggnncgngaggggcnccggggnncggnngcgngggngagcgnngacgagaggcggcgnncggagnngagnaccgcngcnncgncggcggccncgccggggccacggacgaccacncccnccacaacgccnncagcaccaacggcggggggggggggggcaagancanccncgancgggagacgcagaggncccgcggcnncggcnncgncaccnncnccacgggggaggcgangcggaacgccaccgagggcaggaacggcaaggagcnggacggccgcaacancaccgncaacgaggcccagncccgcggnggccgnggaggcggcggcggcggcgggnacggngggggccgnggaggcggcggcnacggcggnggcgggcgccgnganggcggcggcggcnacggcggcggcggcg

SEQ ID NO: 12009 - DNA, 405 bp, Zea mays
  unsure (1)..(405): unsure at all n locations; Clone ID: LIB3279-194-Q1-K6-E9
aagggccccacggncnncagggggcgcaacannggggaagacccccggggccaggacacaggggaccagganngccccnggagggccgaagcacagaggccnngagggnnggcnagcggggcggcagggngaccaggancaggcnnacaggaaaaacaggccccgcgccgaagaagngcaaggcaggaangggcccacaaaccccnggggcangaannnnaccaccgacaagcgcagaacccnaggaaagaagnggcagacacngagggaagcccacgnngagggcaagacaaccgacaacnacangcngcgggngnncngcangggnggnaccaagaggcgcccaaaccagggcaagagaaccngcnnngcncaggcanccccagancggcagaaacgccgcaa

SEQ ID NO: 12010 - DNA, 78 bp, Zea mays
  unsure (1)..(78): unsure at all n locations; Clone ID: LIB3279-194-Q1-K6-F1
ccgggtcgccccgcgnccgcgttcgcgtgggtgntgcttctgttgctccttcgctctggcttgccgggtctggtgttg

SEQ ID NO: 12011 - DNA, 415 bp, Zea mays
  unsure (1)..(415): unsure at all n locations; Clone ID: LIB3279-194-Q1-K6-F7
ccgggncgacccagcgnccggnnctagnacgcgagcggccgcgngacgngcgngaggagncnggagncggacgggaacgaaaaggcgaaaacccagnggcncgaggnnccccggagcggaggcganggcngggaagggagggaaaggcnngcncgccgcgaagaccacggcggccaagnccgccgngaaggacaagggggagaagggcccaancncacgcnccncccgcgccggcccccagnncccnngggggcggnnccaccgncagcngangcaaaggacgcaggcaaangggcgcgnnggggccaccgcagccgncnaccccgcngcccccccggaggacccgaccgccgaggggcnggagccggcggggaaggcnngcaaggagcngaaggggaagcggggcaccccncgc

SEQ ID NO: 12012 - DNA, 618 bp, Zea mays
  unsure (1)..(618): unsure at all n locations; Clone ID: LIB3279-194-Q1-K6-G10
ccccggngtcgacccacgccgtccgcccacgcgntccgcccacgcgtctcgagcgaggcttgcgagagcggagagagagagtgagggaggcgccgacgccgagtcctttcttcatcctgcatctgccgctgtttccgacaggatgtttctcacgaggacggagtacgaccgtggggtgaacaccttctctccggaggggcggctggtggagggggagtacgccatcgaggccatcaagttgggatccactgcgatcggtttgaagacaaaggatggtgttgtcctcgccgttgagaaacgtgtgacctcaccactgctggaaccaagcagtgtggaaaaaataatggaaattgatgagcacataggctgtgccatgagtggacttattgctgatgctagaacactagtggaacatgctcgtgttgaaactcagaatcataggttctcatacggagagccaatgactgtagaatcttcgacacaagctatctgtgacttagctctgcgttttggcgaaggtgacgaagagtcaatgtcacggccatttggagtctctctcctaattgctggacatgatgagaatggacctagcctgtactacactgacccatctggtac

SEQ ID NO: 12013 - DNA, 490 bp, Zea mays
  unsure (1)..(490): unsure at all n locations; Clone ID: LIB3279-194-Q1-K6-G3
cccgggncgacccagcgtccgatccccctngcaaggatagnctcggcggctctagaagacgangggcaaggacgacgngatcgagagcggcgctggcggcggcgagttcgctgccaaggactacacggaccctcccccggcgccgctgatcgacgcggctgagctggggtcctggtcgctgtaccgcgccgtgatcgccgagtgcatcgccacgctgctgttcctgtacatcacggtggccaccgtgatcgggtacaagcaccagacggacgcgtcggcgtcgggtgccgacgcggcgtgcggcggcgtgggggtgctgggcatcgcctgggccttcggcggcntgatcttcgtcctcgtctactgcaccgccggcatntcggggggccacatcaaccccgccgtcaccttcggcctcttcctggcgcgcnnggtctccctggtgcgcgcgctgctctgcatcgtggcgcagtgcctcggcgccatctgc

SEQ ID NO: 12014 - DNA, 581 bp, Zea mays
  unsure (1)..(581): unsure at all n locations; Clone ID: LIB3279-194-Q1-K6-G4
gttcgcaccgccgncggcccaccgcttcagntggcagttgcgacttgcgagtggctccaacaaggcaacacaatccaccggcaccaacccagcgcggcgccaccggcgacccgtacccccttccccggagagcgatggcgacggagctgacggcggcgcagctgcgcgcgtacgacgggaccgacccgtccaagcccatctacgtctccgtccggggcaaggtctacgacgtcacctccggccgcggcttctacggccccggcggcgcctacgccgtcttcgcgggccgcgaggccagccgcgccctcggcaagatgtccaaggacgaggccgacgtctccggggacctctccgggctcaccgacaaggagctcggcgtcctcgccgactgggagaccaagttccaggccaagtaccccgtcgtcgcccgactcgccgccgacgcctgaactcggcagtctcggtgtaaatttactctgtcctgcctcttgcggtgttcagtgttgtgcttgcttgcttgttgcttgttgctttgcttcccaataatctgaatggaaagacgtatgtgatgtgcctgctga

SEQ ID NO: 12015 - DNA, 645 bp, Zea mays
  Clone ID: LIB3279-194-Q1-K6-G5
aagaaccccccgcttctggccgccgccggctcaccggtgacggcatccaaatccatggcctcccgccaggcgctccacatcttcacgccctcccggcgggcgatgcacatcctcacgtcgtcccgcggcatcgcctcgaccccgcacctctcgtccttcggctggtttgataagatcaagtccaccatcactggcaagaagcccgaggaggcctccgaggcatcctccttcaccctcatccagttcgcagacacgatggagaaagcgaggaagctggggacgttcaagaacttcgttgccgggcgggccagcgaggccaccgtcgtgaacgtcttcgagaagcactccgctgtgctgcgctacctcggtgccatcgaccccaccggcgagaacctccgaaacactgacaaaattaacgcgaccaagcactgcaactgcacaattgctgacgtggagcacattctggccaagtacacatgggctaaagaggctcagaagaagattgcaaagctcaaggaagaagggaagccattaccaaagtcatttaacgaggtccaaaatctaatgggttctacaccagtggatgtcggcagaagtaatctggcaaagagtggtcagataagtaggaatgctttctgcccatgt

SEQ ID NO: 12016 - DNA, 442 bp, Zea mays
  unsure (1)..(442): unsure at all n locations; Clone ID: LIB3279-194-Q1-K6-G7
ggtcgccccgcgtccgtatcttcgngggtcgaactnggcccgtcngagaatcagagctctgnggctgctcacatcaggccaccaccaacccctcacgtcggcggtggcgtcgtcggcgaaggcagagatggcgtccgtggccgcggcgggggtcgcggcggcggcgctcctgtcggtgctgtcncgcgcgcgggggggggcggcgcgggcggggcgcgcgccggggtccctgcgcctggtggcggtgtgcaagacccagcccgtgcctgtcttccggggcgtcttcgtctcgggcctccgctgcttcggcgtgaacttcgtcctggtgctcatcgtcctggcgcctctgcttccttcggctcttgcgtggcgcttcattgggaatcttccttgcctctnctccgttgccctncttgctggcgtgccnctccttgttctggtt

SEQ ID NO: 12017 - DNA, 425 bp, Zea mays
  unsure (1)..(425): unsure at all n locations; Clone ID: LIB3279-194-Q1-K6-G9
cccgggncgacccagcgnccggcctcncgccncgacgccgncgnggcccgccccgacacgcaggccaagaagcagggcaacggcaaggccaagcaggccaacggcaaggcgcncgaccccccgcccgccaccgggaacccccagaaggaggccgagaccaaggacaaanncgagcgccaggncggcaacaaggagggccagggcggggncaaggagggcgccaagggcgggnccaccccccncnccacgccggagaccgagggcaacagccccaagcagcagggcgcggacgacaaccggcncgagggcnccgccgggcggccgcaggcagccgcccacgccaccccngccgccaaggagaaggagaaagacgacgaggaggaccacncncgccgccccgccgagcnnaaggcccgcggcngaga

SEQ ID NO: 12018 - DNA, 263 bp, Zea mays
  unsure (1)..(263): unsure at all n locations; Clone ID: LIB3279-194-Q1-K6-H10
cgcgcagccgccgngcgccgnnnccccgnccccnncgccnccgccccggcccccgcngaggcnccccgcagnnncnccgccgacgcgggaccgccnccggcgggcccggccgggcgcngcagcccgncgncgagccgcccacgncggngggcgcgggngccncgnccgccnccaccaccgcnggngccggnggggcccacaggncggcgccgggagccgcggcgggggcgcggcgccngggnggngcgggcnncgnggaggag

SEQ ID NO: 12019 - DNA, 178 bp, Zea mays
  unsure (1)..(178): unsure at all n locations; Clone ID: LIB3279-194-Q1-K6-H2
ccgcgccgncggcnccgcccggcggggcggggcgcgccgccggnccaccccgcggggcccgcgcgcgncgcggccagggggcgccnagggcgcaaggccgnccgcgccnccccggcggggacgncgccnncggggngcgccncagccggcgcgaccnngcccccgggggggggcgggg

SEQ ID NO: 12020 - DNA, 563 bp, Zea mays
  unsure (1)..(563): unsure at all n locations; Clone ID: LIB3279-194-Q1-K6-H3
gcagatgnncgnncaccagcgaacctgcagctgccgaatctacagagaccagaggtgagcaacaatgtagggaaatagggctggcgggggcacgtgggtaacttggtcttggagcagtggagaaggagcatnccacannggaaaccaacacggtcagtcaaaaccaaatctagataatcatgatgctacttctatgttttatgtctgtttttgtctgctatcaattgttcatgcaagtgttatcaagtgttcatccatgctaagaggggttgaatacgactcaaatattcttttcgcgttttctctcctggctgntcttttcctgcactttccatctgatatttatcagcttctcactctagcagagttccttgcttcctgaaaagcctcatagctcaggtggtgttaaggtttttatcctaaaatcttattgctctactcctacatttttgtttggtntagttgnngtccatatgaaatngttgactntttaaaacatgtgtngtgtgtgcttacagggnggcatatcattctttngtttggtcgncttgatgtcttagtgt

SEQ ID NO: 12021 - DNA, 295 bp, Zea mays
  unsure (1)..(295): unsure at all n locations; Clone ID: LIB3279-194-Q1-K6-H6
gcgnncgggcgcagcccggggagccgnnaccgcaccgcgggcgcgacgaccnccncgcgggggggcaggcgcccngcgncgcagacancaagaacggcgccancacggggccaccgagnncgccggagcccnacancgccaagggccncgccaaggaccgcgggaccacgagcgnncngcggggaggggggggggccggcgnccgngncgncggccccgagggcgccgnggggcggncggggcgcccggaggggaaggccanggacaccgccggcgnccgccgcgggccccggcg

SEQ ID NO: 12022 - DNA, 589 bp, Zea mays
  unsure (1)..(589): unsure at all n locations; Clone ID: LIB3279-194-Q1-K6-H9
ctcccactggcccccgggggcgtgctttcttctcccttcccaccctccccgcttccaccagagagagaggtccgagagcagtgagtgggagaggaagagagccagccacagaatagtgagtgagagagttgagtgctcattcatggtgcggcaagaggatcagtagcattaggaactaggaacaccacacgttgcattgcattgcattgttaacttgttagttagatcgtcttcgtcatcccctgattcctggtttcttggaaaggttttttcttcttcttcctcacttcttttcgtcgtttgggcaatggaggtggtgctgggttccgccgctcgccgctgcctggcttccactgccgtcgccgccgcgcgggctctgctgcagagggtgagccgccccggcatcgccgcccggtttttctagatgttttaggcagcttctccttcttcctatactacattctttgattcttttgtactactgatccncattgtttnctgcatatacagcataacatacacatacccatctctggtagtcatagacattgatttgttcttctttcttttatacacaaagaaagtaact

SEQ ID NO: 12023 - DNA, 639 bp, Zea mays
  unsure (1)..(639): unsure at all n locations; Clone ID: LIB3279-203-Q1-K6-A1
ncagcttcgacctggnagacctgctgcgcgcgtcggcggaggtgctgggcaaagggagcgtggggacgtcgtacaaggcggtgctggaggaaggcacgacggtggtggtgaagcggctcaaggacgtggcggtgcagcggcgcgagttcgacgcgcacatggaggcggtcggcagggtggagcaccggaacgtgctccccgtccgcgcctactacttctccaaggacgagaagctgctcgtctacgactacctccccaacggcagcctctccgccatgctccacgggagccggggctcgggccggacgccgctggactgggaggcgcggatgcgggcggcgctgtccgccgcgcgcgggctggcgcacctgcacacggcgcacaacctggtgcacggcaacgtgaaggcgtcgaacgtgctgctccgcccggacgcggacgcggcggcgctctccgacttcgggctgcaccagctgttcgcggcgtcgacggcggcgcgggccggcgggtaccgcgccccggaggcggtggacgcgcggcggctgacgtacaagtcggacgtgtactcccttggcgtgctgctgctggagctcctgacggggcagtccccctcgcacgcgtcgctggagggcgacggca

SEQ ID NO: 12024 - DNA, 632 bp, Zea mays
  Clone ID: LIB3279-203-Q1-K6-A10
gcgagagcttatcgtcgtcggcggcgaagaggtgtcgctgaagctgcagaagcggctcgccgcgagcgtcctcaagtgtgggaaaggcaaagtctggcttgaccccaatgaagtcagcgagatctccatggctaactcccgccagaacatccggaaattggttaaggatgggtttatcatcaggaagcctcagaaggttcactctaggtcccgtgcaagaagggcacatgaggccaagcagaagggaaggcactctggatacggcaagcgcaggggtaccagggaggctaggctccccaccaagattctgtggatgaggaggatgcgtgttctgaggcgcctgctccgcaagtaccgtgaggccaagaagattgacaagcacatgtatcatgacatgtacatgaaggtcaagggtaatatgtttaagaacaagagggtacttatggagagtatccacaagtccaaggctgagaaggccagagagaagacctttcagatcagtttgaggccaagcgtgcaaagagcaaggcaagccgtgagaggaagattgctaggagggaggaaaggctggccccaggcccaagagaccaacagcacctgtcgcagccccagctccattctacctgggtgcc

SEQ ID NO: 12025 - DNA, 342 bp, Zea mays
  Clone ID: LIB3279-203-Q1-K6-A11
cactgacatttatatgtggcgacattcaattcgacccgatgctccaatcgacataaaaggtcttaatactggtcattttgctctgcacattatgtagtggtgggatagtggtataaaagcacaacttagtatggatggtgcgactctgcgtaggaatttatttattaatctgttgacatacgaggggaacacatatcgatttaacattcctggacatatacaagagtaccttgaccgcattatggaaaaaattagatgaaatagatagttatgtttatgtttattttgtatttattgatttgaattttcgccattaaaatttctttttaaaatgtatataat

SEQ ID NO: 12026 - DNA, 358 bp, Zea mays
  Clone ID: LIB3279-203-Q1-K6-A12
cggtccggatccccgggtcgcccagcgtcggtccctgactcagaagagtttgatgatgaaatccgtaacgataactggggatattgaagagattggagagaactcttatgatgccatttccatgtccgtgaagaaccaataagtttcctgtggcctgaattgggtggtttccatagcatgtgcacggggtttgggtggaatgcctacagatcgactgtgtcaagctttcttgattccgtagaaacatgttttgtttgacctcatcatagaggatctccccttttatcgtacaaagattgtgatatgttcttagcttctttctacttgaataagaggatttctgcagacccttttcctc

SEQ ID NO: 12027 - DNA, 619 bp, Zea mays
  unsure (1)..(619): unsure at all n locations; Clone ID: LIB3279-203-Q1-K6-A2
ngatgaaattcaatggtttatttccaatgaatcaggaggcgatcagtcttttgaaccattggcaacccagtgttctcgctcatacaaagtgcgctttgaggatattggtcgttgcctgaaatgcgaatgctttgtcactgatgtatttggacgatctagtgaattggtatccgctgtgactgctcctattttgccaggaaggcctaaaattgaaaagctggagattgaaggaagaggtttccacactgacctatatgccgttcagggtacctatagcggaggcaaagaaggcaagagtaaaatacaatggctcagatcgatggttggaagccctgatcttatctccatacctggcgaaactggaagaacgtatgaagctaatgttgatgatgtagggtataggcttgttgcaatttatacacctgtaagagaggatggagttgagggacaacctgtttctgtttcaacagaacagattgcagttgagcctgaactttacagggaagtgaaacagaagctcgatgatggttcagtcaaatttgaggttctgtgtgacaaggaccgaacacccaaaaaggcacaagtaatgngccatttggagcggnaggttttggaagtc

SEQ ID NO: 12028 - DNA, 629 bp, Zea mays
  Clone ID: LIB3279-203-Q1-K6-A3
gcccgcaggcgtccgtcgtcctcctcgccggcctccgccagcgcttctgccagcaatgcagccggtaagccccgcctgcctgcttgctcggaggcacatgcacatgggcgcagtgcagtgtgcagtccggccggcgtgcgtgactcgtacgtgagtgagttcgtgacatgctcaaaggcaccgcccgctttcagttcgtacggctactactactactaaactaaacgagcttaattcgaccttgaaaagtaaacttgcttgcctgaagcgcatcgggtcccttgagaaagcttgcagctttttttcttgggtcatggatagcacggtgagctgctggattggatcctaagctagctaggttgctctctcaactcaagatcttgcagaagcgtctctcagtctcatgcaacctctttggaggttattaatcaaaccgtgctagctcctctgcctggagcttctctccgcctgtgtcactctttcttgacccccggccctcgtctgctcgcaggttccacgagctgtcgcacttcgacgacaccaagcgcagctgccgcctgcgcctgggcgggcacaacgagcggcgccgggagaacccggcggaggcgcaagaccagcacggcgggcgg

SEQ ID NO: 12029 - DNA, 237 bp, Zea mays
  Clone ID: LIB3279-203-Q1-K6-A4
gtccgttataggggagtccggtattattattattattgtttcatcttcttcttcgccctttctctgggtaataattgggttacttggaaactgttgatcagtgggtcagttagaatgtgaactggttgttgctgggtaagtatgtggtttgttggtatattgagtctggggacagagagtgaggtcctgatctgcttgtaacagtacctgctttggttttgtgattgctatatactg

SEQ ID NO: 12030 - DNA, 609 bp, Zea mays
  unsure (1)..(609): unsure at all n locations; Clone ID: LIB3279-203-Q1-K6-A5
cgtccgcctcacgccgtccgtnaaaattgccattcacttgatcatgagnaagaaaagnaacatttgtcgtgaccaaagnaagggcnnttcctgatgnnctgttgtnnttggaaccccttgggnacaagnaagggcaaaagcaatngcaagaattttggnnggatgcagaatacaangagcatgncttgtgtgnntggagcctgcagctttgttgagaggcgctattactttctgaaacctnnggggaagagtggaaaggaaggggcttgtgctttcagcttgttcctttcgagttactttgtagcggacagttangatccattcgaaggtcccttcagnnggttgaaaatcctcactttttctgcatcttgtancagaagttcattgccncttaatatttgatgctgggctggcgtcaacgccgcatgttccttttgccatttccaccccctatatttctggtcccttttgtatctagaatttgagtgataggttgattccgaataacagtctgtgatttgagcttaggattgggtcatctcatcgatgaatgataccgctggacaaaatgctggcgtacgtgtcagtttcataaatcattcttctcat

SEQ ID NO: 12031 - DNA, 571 bp, Zea mays
  unsure (1)..(571): unsure at all n locations; Clone ID: LIB3279-203-Q1-K6-A6
ggnaccttgtgcaaaacaatgcataggcaaccagaacatgtgatgatgttcttgcttgctgagatgggaacaagtggatccctggatgggcaacaaaggttggttatcaaaggaagatttgcaccaaaaaatttcgaagcgatacttaggagatatatcaatgaatatgtcatatgcaatggttgcaagagtccggataccattctttttaaagagaacaggttgttcttcctccgatgcgagcagtgtggttcatcgaggtctgttgctcccatcaaggctggattcgttgcccaagtgggccgtcgtaaggctggatcttaagctacctactacttgcctgaagtcgcttcccgatgaagacaatgcaaactagtttgctggtccacaaaaatcattgttgcactttcccttgtgcctacacagttcactggatttctgctgttcgctatacttggattggtgctgtgaatttatttcgtgtgatgagaggatttgtgtttgcggctcacttgtgtttactacctttgttttgctcgtgattttgctgtggaaggcactgtcgggagct

SEQ ID NO: 12032 - DNA, 645 bp, Zea mays
  unsure (1)..(645): unsure at all n locations; Clone ID: LIB3279-203-Q1-K6-A8
cgcctactctggngcgtacaagcacctgctcgagaccatcgtctggcttttgccctcggacaaggggtcttcggggatctcctgtcgtttcttcctgaagctgctgaaattcactgtcctcgtcggcgctggggagctcctgaaggaagagctcatggacaggactgtgttgcagctccacaaggcctcggtcagtgatctcctgatcccctccaggcctccggcgcagaccgtctatgatgtccagctggttcagacactcatcggcaggtacatgagccatgccggggtatctcaaggtgggatttttctcaacgaccttgaccaggagatgtttgagacgaacgtggacggtgaatctttgctagcgttgtgcaagctggtcgataggtacttggctgaagttgcctctgatccaaatctctctgtttcgagctttgtggatttggcgacttccatgcctgaaacagccagaccgacacatgatggattgtacactgccattgacgtatatctgaagttgcatcccggcctacccaagatggagaagaggaagatttcgaacctgatggacgtgaggaagctgtccaagggggcgtgcatccacgcggcgcagaacgaccgactcccgctgcgcgtggtggt

SEQ ID NO: 12033 - DNA, 625 bp, Zea mays
  unsure (1)..(625): unsure at all n locations; Clone ID: LIB3279-203-Q1-K6-A9
acgcgccgtcactgaatcctcagnacacggctagccgtaatcacgccactctgctgactcccggcgagcagtgtaacattttccttcagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaaggccgagcgtgagagaggtatcacaattgatattgctttgtggaagttcgagaccaccaagtactactgcactgtcattgatgcccctggacaccgtgacttcatcaagaatatgattactggcacttcccaagctgactgcgctgttcttatcattgactccactactggtggttttgaggctggtatctccaaggatggacagacccgcgagcatgctctccttgctttcacgcttggagtgaagcagatgatttgctgttgcaacaagatggatgccaccacacccaagtactccaaggcccgttatgatgagattgtgaaggaagtctcttcctacctg

SEQ ID NO: 12034 - DNA, 630 bp, Zea mays
  Clone ID: LIB3279-203-Q1-K6-B1
ccgagttttctccccaccctcctccgtggctgccagtcccgcgggagcgcagcgcgcgctgctctacggtcgccgcgcgccgttcgcgggagcgctcctgtttttcagcatcggcgccgtcagcgctgcggtcgcgttcaggacagggtgcgccatctcacaccgacgtccccccttcctcggggcaagaggtctcagttccactagaatggagtcagcttcgaccacagtgccatccattgtcgtgtatgtgacagttccaaatagggaagcagggaagaagctgtcacagagcatcatcagcgagaagcttgctgcttgtgtcaatatagtacctggcattgaatccgtgtactggtgggagggaaaggtacaatctgatgctgaagaattactcatcatcaagaccagggaatcacttctggatgccttgactgcacatgtcaaagccaatcatgaatatgatgttcctgaagttattgctctgcccataactggtggtaacaccaagtatttggaatggatcaagaacagcacccgggacaagtgatctcttttttttttggagctcgacataatgcgatgatcgaagtgcccatggctccttacctcttccagtggcttgcacac

SEQ ID NO: 12035 - DNA, 619 bp, Zea mays
  unsure (1)..(619): unsure at all n locations; Clone ID: LIB3279-203-Q1-K6-B10
attagcttcactgtctgggatgtcgggggtcaggacaagatcagacctctttggaggcattacttccagaacacccagggtcttatttttgttgtggacagcaatgaccgtgaccgtgttgttgaagccagagatgagctccacaggatgctgaacgaggatgagctacgtgatgctgtgctgcttgtttttgccaacaagcaagatcttcccaatgccatgaatgctgctgagattactgacaagcttggattacactccctgcgccagcgacactggtacatccagagcacttgtgccacaactggcgagggtctgtatgagggcctggactggctgtccagcaacattgcgagcaaggcttgaggcctaccttgaatatcaactgcgaactgactaggagctccggatgtatcatggaaactcaggacagaatcgcagttgcaatctgttagatgtcttctaccggcactatatatttttttttgtttgatgtgtaatgatgttactgttcaacgcttattaccctactatactgttggatgttctttggacctgtttcatttcgcacaaagattggacttccaatatcaagctacattntacannnnnaaaanna

SEQ ID NO: 12036 - DNA, 601 bp, Zea mays
  Clone ID: LIB3279-203-Q1-K6-B11
cccacgcgtccggagggatccgagccgcatgcggccactttattcacggccttcatctgtatttgctgtgttgttattggaaacttggatttgattacacccacgatcacaatgtttttccttctgtgctatgctggcgtgaacctgtcatgctttctgcttgatctccttgatgctcctagttggcgccccagatggaaatttcaccattggagcctttcacttgttggggcattgttctgtgttggtatggttcttaatacttttaccattttattttgttttatcacaatcttcagcatgaacagttgatacttgagttaggtccttggtttgagactttgtccacttctattatttttaatctaaccaccttctcttcacctacaatactcaattattatttatcatgttttacaatagcaaatatctaactgaaacagccatgaaagcatttataattataagtgttgacatgaatctttgtatcaatttcagtgattatgtttctgatctcctggtctttcactgttgtctcccttgcccttgcaagcctcatctattactttgtgagcataaaaaggaaagctgggaactgggg

SEQ ID NO: 12037 - DNA, 413 bp, Zea mays
  Clone ID: LIB3279-203-Q1-K6-B12
cccagtgtccgcccacgcgtccgggaaatgtgaatattttcacatatgacgaattgagcgcagccacaaaaaacttccgaccagatcaaattcttggagagggtgggtttggagttgtttacaaaggtgtaattgatgaaaatgttagagcaggtttcccatccaggcaggttgctgtgaaagaactaaacccagagggttttcaaggggacaaggagtggctggcagaagtcaactatcttgggcaacttagtcatccaaatcttgttgaactgattggctattgctgtgagggttcacatagactgcttgtgtatgagtacatggcttgtggaagcctcgaaaagccctttttctgcgggtttgtcttaatatgccatggtcaacacgcatttaagattgtatctggtgct

SEQ ID NO: 12038 - DNA, 651 bp, Zea mays
  unsure (1)..(651): unsure at all n locations; Clone ID: LIB3279-203-Q1-K6-B2
gnaaaaggagggcctctcttttgtgccaatagtacacaaagtattatctcgaccncacctggaaagtgtctattcttaatgatggatctgttgctgttgaagttggaggcattgagttaggccaggggctttggacaaaagtgaagcagatgacagcttttggtcttggacaactctgtcctaatcgaagtcaagagctgttggagagaataagagttattcaagcggatacattaagtaacgtacagggagggtggaccactgggagtaccacatcagaatcttgttgtgaagcagttcgtctcgcatgcaatgtcttggtcaacaggctgaagccagtcaaggagcaatctcaagaaaagcaaggcaatgtttcatgggatgaacttatttccaaggccataatgattggtgtagacttgtcagcacgagaatactacattcctggtccttctggttcttacctaaactatggggctgctgctagtgaggtagagattgatcttctcactggagcctccacaattgtacgaagtgatcttatatatgactgtggccagagcttaaaccctgctgtggacttgggacaggttgaaggggcgtttgttcaaggataggctatttcatgagtgaggaatatgtcaccaactc

SEQ ID NO: 12039 - DNA, 645 bp, Zea mays
  Clone ID: LIB3279-203-Q1-K6-B3
aaagccaagtcaggctactggttcaaagacttttttgttgggaatttagcctacagtatagagcgtgaacaagttaaggaattttttgaggaggctggtgaagttgttgatgttcgtttggctacttttgatgatgggagtttcaagggttttggacatgttgaattcgctactgttgaagctgctcagaaggctcttgaatttgttggtcatgacctgatgggacggcctctaaggattgacatggctaccgagaggggtgcatacactcctagcagcgggaaggacaacggttctttcaagaagttcgctccaaggtcaggcaacaccgtgtttattaagggctttgacacctctggtggagaggaccagatccgcaccgctcttgaagagcattttggatcatgtggagatatcactcggatttcaattccaaaggattatgacactggtgtaagcaaaggaatggcgtacatggatttcaaggacccagattccttgaataaagcatacgagttgaatggaaccgaccttggtggctacagcttgtatgtcgatgaagccaagccgagacctgataacagcggtggcttcagtggcggcttcagtggtggcagagggaggagtggcggcttcagtggtggc

SEQ ID NO: 12040 - DNA, 627 bp, Zea mays
  Clone ID: LIB3279-203-Q1-K6-B4
cgcagccgccgcctgctcgctcgcctccgctccggcagcgagctctatctcccgcgacgagcagcagctgccaccgacgcacgcagaccggggaataaatattggtattggtagtgtgatatctataagaagtcaagatggtgaagttcacagctgaagagctccgtgccatcatggacaaaaagaacaacattcgtaacatgtctgtcattgctcatgtggaccatggcaagtctacgcttacagattcccttgtggcagctgctgggattattgcccaggaagttgctggtgatgttcgcatgactgatactcgtgcagatgaagcagagcgtggcattacaatcaaatctactggtatatctctttactatgagatgactgacgagtcactgaagaactacaagggtgagagagatggtaaccaatacttgatcaaccttattgactcgcctggacacgttgatttttcttcggaagtcacagctgctcttcgcatcaccgatggtgctctggttgtggttgactgtattgaaggtgtctgtgtgcaaactgaaactgtgcttcgccaagcccttggtgagaggattaggccagttctcacggtgaacaagatggacaggtgct

SEQ ID NO: 12041 - DNA, 602 bp, Zea mays
  Clone ID: LIB3279-203-Q1-K6-B5
cgctcttgttgtttccgatcccaaaccccaaacacgctccaccggcacctccgctcccacaccacaccgatggcccgcacgaagcagacggcgcgcaagtccaccggaggcaaggcgccgcggaagcagctggcgaccaaggcagcgcgcaagtcggccccggcaaccggcggcgtgaagaagccgcaccgcttccgcccgggcaccgtggcgctccgcgagatccgcaagtaccagaagagcacggagctgctcatccgcaagctccccttccagcgcctggtccgcgagatcgcgcaggacttcaagaccgacctccgcttccagtcctccgccgtcgccgcgctgcaggaggccgcggaggcctacctcgtcggcctcttcgaggacaccaacctctgcgccatccacgccaagcgcgtcaccatcatgcccaaggacattcagctcgcccgccgcatccgcggggagcgcgcttaggcgtttacggttgattgtcactactgtagatgtttaggctatgttctcgccatgtcctaggtctgctttgttcttatttggttttttggtttcatcctgtgcgttgatggttgtcaatgagc

SEQ ID NO: 12042 - DNA, 587 bp, Zea mays
  unsure (1)..(587): unsure at all n locations; Clone ID: LIB3279-203-Q1-K6-B6
agtatttttagcagttccagtttccaaagggagaaaagcgagatggaaaaattgcaggtggcctttataccaccagcgttgaggccttcattccaaacactggtcgtggcatacaaggcgcaacctcacactgtcttggtcaaaactttgccaagatgtttgatatcacttttgagaatgagaaaggtgttagggaaatggtttggcaaaactcttgggcctacacaacccgctcgattggagtgatggtgatgacacatggtgatgacaaaggcttagtattaccaccaaaggtggcgccaatccaggtaattgtgattccagtgccttataaggatgctgacacaactgccataaagggagcctgcgaatcaactgtttacacactcgatcaatctggaattagagcggatcaggacacccgtgaaaattactctccaggttggaagtattcccactgggaaatgaaaggtgttccattgagaattgagattggtccaaaagatctggcaaacaaaccaggtgcgtgttgtccgccgggacaacggtgcanaggttgacatccctgtgaccaatttggttgaaga

SEQ ID NO: 12043 - DNA, 588 bp, Zea mays
  Clone ID: LIB3279-203-Q1-K6-B7
gccgcgcgcgtcgcgtggacgcgcacgggtacaagctggtgtcgatgatacagaatatgaagtgggatatggagtgcgcgatgttcttgcctatgtagaatcatgtttatctaaagggtgattctcatggggaagccctgccaagatagcggcttggagtgacccattggatgactatcaagttctgtacccactctgggaagaactgaaatgtttcctgaaagagtcactccggatgacattaggactcctctcaagagaatgccccttagatctatccttaaaaggacgatgatccaaaggaaggaccacatgtaatgctacctttggcaccatcattgaagaaaccatcactgatgctgccgccatgtcttgtgaggcgttagtaaacgagattatagactcaaagatcgcattagaggactcactggaagcaagaggtgcaacagatgctactgctgatgccctggctgcttacctaagcactcttgatggcacatgacatgcttgtcgtgatgaattgcgtgataaagtgcccagagctggagccagatatggcgcttcattctacatctcgattgaacctgc

SEQ ID NO: 12044 - DNA, 586 bp, Zea mays
  unsure (1)..(586): unsure at all n locations; Clone ID: LIB3279-203-Q1-K6-B8
cacgcaccacacggggcgcaggctgcaggagacaacagaatcggatcgtcccatgggcgatcggcgggttcggagggccggcgggnggaggcgccggggagcatgtaggagcgtgctcggtgacagggcggcgcgggngttcatctggcaccgcacacaggtgctgtcgcctgctgtgagcaggggcttatcgtcgtcacacgtcgtcgacaactttctcacaactctcgtccccgnagcgctctgaccgcgtnccgcctcaatctgccggccccgcgcttctcctacccgcctcgacttcattccgcgggngaccctgaggagnncaccgaggacttggagaaggtgtntcgcttgccaggaggtacgaacgccgtcattccactttcgccgggcttgaaggccgtgggnggagagcgtcgcgcacccggnagatgtactacngagaacaacctcatcggcaccatcaacctctacaagagcatgaaggagcacggctgcaagaagctggttttctcgtcatccgccaccgtgtacggctggccggaggtgatcccatgcgtcgaggactccaagctgcaggccg

SEQ ID NO: 12045 - DNA, 471 bp, Zea mays
  Clone ID: LIB3279-203-Q1-K6-B9
cccacgcgtccgggcagaggagccgtgccgcgctcaccatcgctcatgtccaaaccatcggcgtcccggccatgtatcaagattgcgatccgtttccgagcttcgaggaatcgaagatcaagagttggcgaccaagtgatctggttcttcgagttctatgaggctagagatcctgagcatctgtttggtgaaggttgcctttggtgcaatctatgctcaagtaaagaagaaggcgttgaggcggatctccaggagttccaggacttttgacgagttcgaggattaggctagcgaccacccccagtcagctgcctgtggtgggtttatttacgttggctacgtttctattctgtgtactttgattatattatgtaaatgactctagtctttatattattacttactctttattgttattcgaagcattgtgctatgatgagtcatttatgtaatcgccgtgtacgtgaaaaa

SEQ ID NO: 12046 - DNA, 641 bp, Zea mays
  unsure (1)..(641): unsure at all n locations; Clone ID: LIB3279-203-Q1-K6-C1
gctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcaagggtggtggcggcggctacggaggcggtggcggctacggcggtcggcgcgagggtggtggtggcggctactgcggcggcggcggcggctggagggactgatgtgtgggcccatcctggcttcggccgagttatcttatctatctatagtatcgngttaccgttcgcttctgtcaccgtgttagtgtccgttctacct

SEQ ID NO: 12047 - DNA, 657 bp, Zea mays
  Clone ID: LIB3279-203-Q1-K6-C10
cggacgcgtggggtctacatctccgcgctgtggcacctcgccagtgtcatctccgtgctcgagccgctctgcggactcgccgccatggccaagagcaaggatctgctccagggccgcaccggcaccgcagctacgcttgtggtctcctacttcgcggtctgcggcgtcacctccgtgctgttccgtgccgccgtcgttaaggggcgcgccgaggaggggagcttcggtctggccttgcccgggcggctgcttgtcggcgccgtgctgctgtgcgttcttgtctgtgtcaatttgctgggactgctcgtgcagagcgtcttctactacgcctgcaaggccttccacaaccagcagattgaccggactgcgttgtatgagcaccttggagggtaccttggggagtacgtgccactcaagagcaatatccagatggagaacctttgagattgaagcataggacaagggtaagttactcacctcattgcttcatactagcagtttaatgtggatctttatcagaatatgagtatggcttacaaggggctatctggtcttgttgattctagtaccatgtagtagtttataatctgtataagtggtaatgcacagtatggaaccaatctgtggaatggaagtatggaacagagatgcatgaac

SEQ ID NO: 12048 - DNA, 489 bp, Zea mays
  unsure (1)..(489): unsure at all n locations; Clone ID: LIB3279-203-Q1-K6-C12
tgatgaggaggtggatgggngaggagaggaggcggcaggggttgtggagatctccgacgaagacgacgacgacggtgacggggaggcggacgacgacgacgacgatgacggggatgacgacgacgacgacgacgaggactcagacgacgaggaagaggtcgacggtgaagacgatcaggaggaggagctgggaaccgagtatctggttcagccttttgggcgggctgaagacgaagagcactcgagcgactttgaaccggaagaaaacggtgagggtgccgacgatgaggagatcgatgaagaggacgatgacggtgaggactctgtgaaggcgcagacctttaccaagaggaagaggtcaggcgacgaagaagaagaagaccacgaccatggggatgatgatggtgacgattatgacgatgggagggccccatctaaaacgatagtatggttagcctctagtttttgtagctgtgtcctttggggtgt

SEQ ID NO: 12049 - DNA, 642 bp, Zea mays
  unsure (1)..(642): unsure at all n locations; Clone ID: LIB3279-203-Q1-K6-C2
ccgtttcatnntcctcaagaaagnaacttgaaagtttatggcacggtgtaatgatgctgcagcacaaaaggctaccaaagaagccgctgagaaggctaagattcaggcggacaatattgggcacaaacttttatctaagatgggttggagggaaggcgagggtcttgggagcgagagaagaggccgtgcagatcccgttatggctggagatgtgaagaaggatcatcttggtgttggggctgtccagcctggtgaggtcacatctgaagatgacatctatgagcaatacaagaaacggatgatgcttggataccgctataggccaaaccctctgaacaatccaaggaaatcatactactgatgcgggggagttcgtctgaggggagatgtaaggcgctgctttgctgcaattttgctcacagaactaatggttaggggatatcactaacagcattgaaagtttttgttcatcaacagaaatgtcaagaagttcgttattcagcatatttcttggaatgccacagatgcaaggcttccgggggttctacaaagctttgttctttgtgtagtgtgtttatctttgtggatttaaatgtctgttcaaacgtgtatcatgtttcagacaatgatgtattggcttct

SEQ ID NO: 12050 - DNA, 624 bp, Zea mays
  Clone ID: LIB3279-203-Q1-K6-C3
gcggtggcggcggcttgtgtgtgcaaactcctgtacggcgtctcacgcctcaccccaactcgctcccttccccgtgcttcccgccgtcgtggagaggtcacgcggctggttcccgccgcttccggacgggttccgagggaggaggatcagctgccgcgatgttcctcaggatctctcgtctcggggcgcggcttctgcgcgagtctggagcggagacgagagctggaaatttgctaagcagtccaggcattttgtatcaagctcatcttaaccagcattcgaccagagtgcggaatgtccttttctcaactgcaacaagtggtgatcaggatgaaagcagtcaggcaaaggataaaatctcggtaacatttgttaacaaggatggctcagaaaagacaatacgtgttccagttggaatgtccatgttagaagctgctcatgaaaatgacatagagcttgaaggagcatgtgagggttcacttgcgtgttctacttgtcatgtaatagtaatggatgtaaactactataacaaattagaagatccagcagatgaagaaaatgatatgcttgaccttgcatttgggctcacagagacatctcgcctcggctgccaagtgatcgcga

SEQ ID NO: 12051 - DNA, 619 bp, Zea mays
  unsure (1)..(619): unsure at all n locations; Clone ID: LIB3279-203-Q1-K6-C4
gcctcacacaccacagcctacagcgcttctgctccagcgcccgcctcgcctcgcctcttctcctcgttctgccgcccgcgcgcgccagcctggtgctcgttccccttcttggctcgtcgagcccagaggttggtggcgtcagggatttgtattggagcggaggagaagggggctttgccccgaggagatcggggacgcgggagggcgcggcgctcgagccgagctcggttcagcgggatcacttggcgtggccggtcctccggggcccatgccgtgagcaaagccaggctttgttgcccgggggagagatcttgcgcttgcaagcggcgcccgcccaccgccatggccggcagcgacgaggtcaaccgcaacgagtgcaagggtgcggtgccgatccacacatgggtgctcatctccaacttcaagttggcgtacaacatgctccggcgggccgacggcaccttcgaccgcgacctcgccgagttcctcgaccgccgggtgccgcccgacgcacgggcccaggagggggtctcctcgtccgaccacgtcatcgacacgtccactggcctggaggtccggatctaccgcgccggcgctaacacggcngcgcgggcgcggc

SEQ ID NO: 12052 - DNA, 574 bp, Zea mays
  unsure (1)..(574): unsure at all n locations; Clone ID: LIB3279-203-Q1-K6-C5
cgnaccacgtccacacgacacgaaccaccaccaccaaccagcagccgcaccacgcacccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgccgacggacgccgcgccgtcatgctcgcggctgctgcggcggccgtggcagccatcggcggcgccggcgccgccatggcgggccccaagaacgggacccccgaggcgaagaagaagtacgcggccatctgcgtcaccatgcccaccgccaaggtctgccacaactgagcacgcccgcgttgcatgcagctgccgggccggggggtggtatataattaatgtacgtgccacggtgttgttgtccctattgttggttcgagctttagatgcatgcctgacgtgaggccgcttaattgctttctgacggcctcggagctgtaagaatatcaagtgcactgcaaaactgaattcggttgg

SEQ ID NO: 12053 - DNA, 644 bp, Zea mays
  Clone ID: LIB3279-203-Q1-K6-C6
cacccacccactcgcttcagccgcctccgccgcgcgtaccaagcaggtggagacaggatgccggctggccacggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgaggtcaacaagcaggtcaatgggcgcatcatcaggaagcgtatccatgtccgtgtggagcatgtgcagccgtcccgctgcacagaagagttccgcctgaggaaggcgaagaatgaccagctgaaggcggatgccaaaaagtgcggcgaggttatcagcaccaagaggcagccattgggtcccaagcccggcttcatggtcgagggcaccaccattgagaccgtaactcccatcccatatgatgtggtcaatgatctcaagggtggatactaggttggtttggtccatctacctgcagtacccagttctacatctgtgttactctagtgcgtgcaactttgctcactctgagcagtagtatgaac

SEQ ID NO: 12054 - DNA, 644 bp, Zea mays
  Clone ID: LIB3279-203-Q1-K6-C7
cggtcgcgtgggtgttggcaagcatagcatcattggagcaagcggagagttcagcgatttccaggagatcctgcgctatctggatgaactaactctttctgatcatatgtgggatgatggaaattctctgggccccaaagagatccacagttatttgacaagagtgatgtacaacagacgcaacaagtttgatcctctctggaactcactcgtacttggtggagtgaaaaaggtccaaagggtgatgagaagtatcttggcatggttaatatgattggtacccacttcgaggaaaaccatgtcgcaactggatttgcaaatcatctggcgatcccgatactccgtgctgaatggcgcgaggatatgacttttgaagaagctgttaagctggttgagaagtgcttgctggtcttgctgtaccgtgacaggtcatctatcaacaaattccagattgccaagatcacaactgaaggatcaaccatctacccaccatattccttgaagacctactggggcttctctcactttgaaaacccagcccagggcgctgtgggatcatggtagattaatgcgccgcgcacgccgcatatcatgccatgaacttagttgaggccaatctgtgctgctgaaatcaaaccttatga

SEQ ID NO: 12055 - DNA, 589 bp, Zea mays
  Clone ID: LIB3279-203-Q1-K6-C8
tcttagtggaatcacttggttacaatttgctttctgtaagtcaattatgccatatgggtcataattgcttatttacaaacattgatgtatatgtctttagaagaagtgatcgttcattagcttttagaggtgtattagacggtaagctctaattggttgattttctaaagagaatgctgatctagatgcatgtctaattgctaagattaacttgtgctggctctagcaccgccatctagcacatgttggaatgaagaatcttcataagcttctaaaggaagaacatgtgttaggactaacaaatgtttgtttttgaaagaaagaccttgtgccgcgtgtcaggcaggaaaataggtgggaacaaatcatccaagcaagaacgtgatgataacatcaagaccactagaacttcttcatatggatatcttcggacccgttgcttaccttagcatcggggaaagagcggtattcagctacaaattgtctcgtgggctacgggctacattccatctagccagcccaatccacatcaccagcccacctcgtcgaactcgtcgtcttccgtccatccatcgtcctcggcggcggc

SEQ ID NO: 12056 - DNA, 561 bp, Zea mays
  Clone ID: LIB3279-203-Q1-K6-C9
atttgcgccgccgcagcccgcagtcgcttgcgcgcagcagcacttcgcaccgccgccccatcccatcgccgccagtgtctgctcgaccgtggctccccgaagaagtcgaagaagagcacagagagcatcaacaacaagctgcagctggtgatgaagagcggcaagtacaccctgggctacaagaccgtcctcaagacgctgcgcaactccaagggaaagctgatcatcatcgcaaacaactgccctccacttaggaagtctgagattgagtactacgccatgctggccaaagttagcgtgcacccactttccacggaaacaatgttgatcttggcactgcctgcggcaagtactacagggtgtgctgcctcagtatcatcgacccaggtgactcggacatcatcagtaccacccctggcacccagtgagccagccccggcacccattgcagctgcttcgcctttctcaaaatgagatgagatgtagcgctccggccctatgtccgtttcctttttttatcttttagctatgtaattttgctaccatgtgtccatctaccat

SEQ ID NO: 12057 - DNA, 655 bp, Zea mays
  Clone ID: LIB3279-203-Q1-K6-D1
aacgtggaatgcccatgaaggttgcacaaagaatcgatgtttcaaagtttatgtcatacatcaaagttagtagaacacagctcaaccatataaagagactgaagcaatctggggatggtattcagaccaagcatgtttcacgtgtaattggcggccttgataaatctcatgtgaaaccttatggagctttattagaggatgaacagaggagactgcgcgagcattggctggaaatgtcttgcaatgatttacctgctgcctttgaggttcttagggaaaggaaggtgctgatggagaaatcaataaagttattaggccttgagcttcagcagaagaatgtatctgtcttgagaaaggttcgctgtgacttgtccttcaattctttttcttaagtctctaatttttgtcttgagggaagtgatttacttgaatgtataaaaaatacagtggatgagaataccgttgtatgcttacttctgttatgtatcttccccatttacaatgtatcatagcattcgccactatagatgagaataccatgactataaagatactgaattgtaatagaggcatctagtatgaaagccataggcagtatttcattatgaatggtgaattgccctgcagtgttatcttatttgtataagctaatata

SEQ ID NO: 12058 - DNA, 576 bp, Zea mays
  Clone ID: LIB3279-203-Q1-K6-D10
atgcacgaattgagttggttgcatgagttatacattcagtacatccttcaaaatttaccaagtgtgttaaaaaactgtgtaaaaatctgacaatgaatttgtggtatatttgattatatttctcagtgtaattagagctactagaagatttgctcttcacatcattgcttgccagtggtttatttagcaatttataacactcaaagatccatttatgatcatgaaggttatttgtgccttacgaatcctctaatacttaatatgctgatcggttgatgagtaactgattagcaattcagtgggacctctctcttgcaaagtaaacttctgctattttatttgttcagaactgttcctccaaaatccaatggtgtgcttatttcaactatcatgtctttaaaaaatccccatatcttgttgcttctgattatcagagttaaagttttgcttccaacatctttttgcagccaccttgtactcggcactgccatgactgtgataaatgcgtccttcaatttgatcatcactgcatttggcttggaacatgcattggcaaaaagaaccattggcggtttt

SEQ ID NO: 12059 - DNA, 594 bp, Zea mays
  Clone ID: LIB3279-203-Q1-K6-D12
gcgccggcgtgctcgtgatctcaacccaggcgtgcctccgctccggtcacccgtcactccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgcgccaccggaggcaacaagaccaagacccctggacctggtgcccagtctgccctcagggcgcttgctcgttccggaatgaaaatcggacgcattgaggacgttaccccggtccccactgacagcactcgcagaaagggcggtaggaggggaaggaggctgtaagctctgcgtgccatttgccggctcttggttggtggccattatgaagttagccctctctgggaggtgttggctg

SEQ ID NO: 12060 - DNA, 520 bp, Zea mays
  Clone ID: LIB3279-203-Q1-K6-D2
cgctagggcatgttcggccagatgccatggccggtcatggcggacaggagtgattagtggggactcgcctgtgactaatttctagccttgggcggtggtcgtgggtgtctctggcgcgcgtggtgcttcgtcggagcactcaacgggggttgcgctcttgccgggcgagcctagaaggcggggaactcttgatgcctcggcgacgtggggatcagaggccgtgcgttcctgttctcggcggccggcgtcgtctgcacctggatcaccgcgatgaggttacgagtcacctgaagatcatcctggtacctggaatctcaagtcccaggtcaagaacaggtaccacaggatgaggcgcatggaggatgctgcgatgagttcgtgagagagatctaggtcatcgtctctcagtcaactttgggttgctggaccgttgtctccttataatgtaattatttatttattttgtacagaactcctgttatgtagtaaagatgtgacattcgatcctgtgccatgaatc

SEQ ID NO: 12061 - DNA, 568 bp, Zea mays
  Clone ID: LIB3279-203-Q1-K6-D3
cggccgcgtgggtccacagctcctcatccttctgcgttgccgccctcgctgtaccctgctgcttacccttcaagcctgccgaccatcgcatcatcactagctttttttcttcacttctgctcggcgtctcttgtttgctgttggctgttggcttcataagcgcaaggaaggacgagagatagagcgacgaagtatcttgctcggaactctcccacagctgggctctgagatgagtaatgggttctgaggatagagccgcgcgagcttcctcccgttctgcgtccctgcgacgtatgggcactgcccgggggctatgacctgtaaccaaagaagagggaaaatgcgagataagcagcggctggaccatgataaccagggatgcaggtatggctgttgatttgcttcgtgttcacagaatcctctccaccctgttggagacaaaggggataaccgtcacgagatatatagaaggtagaggtaatacccagaaaacaaccgaattgttgctggaagctggtgagcaaagagctttacgcacctgggaagacccaatggacgagcagtgcaa

SEQ ID NO: 12062 - DNA, 620 bp, Zea mays
  Clone ID: LIB3279-203-Q1-K6-D4
tctattcgttccccgcctcaccccgagccagccgtctcgctagggtttcgccgccgccgccgccgccgccgccgctatgcctcgccgcagctcaggaaggtctgccccacgcccagctccccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgacgcttgcagcatccattctaaggctttccaagattgtctcaacaactatggcagcgagatcagcaagtgccagttctacctagacatgctgaacgagtgccgccgtggtggtgtgtctgcctaagctgcttctggggttattcgtggattttctttcggtgatgctatctcattaataagataccgtgaaacttttgtctccacagcttgaagctaaacttcctgggattaatacattttgttatcct

SEQ ID NO: 12063 - DNA, 532 bp, Zea mays
  unsure (1)..(532): unsure at all n locations; Clone ID: LIB3279-203-Q1-K6-D5
cgtcgccgcagnaggagacgcatcgaggagagcaagcgaggaagcgaccatgagggccaagtggaagaagaagcgcatgaggaggctcaagaggaagcgcagaaagagaggcagagatccaagtaggcagatcgagatggattgtggacctgatgacatgcgtgggtacatacatttcttcggatgcgttggtgtgcctgtggagagatgtcaacctgccatggtgtcacggtccgccatcagttgaacgtcttgcctgcacttcagtaggccatttttcatggttctagttgtatttgaatccagcgtttgccactaagataaatcagacattcgttttgtgaacctattatgatggagctttatttgctgataatatctacctacctatttgagctgagtgatccctgcacttcattatggttggcaactatgtttcttaaaaccatatcagggcaataggtttggctagttccaaaaatatctttgttttgcgaaataataaactttattattagaaaaagctaaccac

SEQ ID NO: 12064 - DNA, 446 bp, Zea mays
  unsure (1)..(446): unsure at all n locations; Clone ID: LIB3279-203-Q1-K6-D6
cggacgcgtgggtccttgccagcagcgtttttcaaaagtgctcgcagcttactacactggatctccatggcacagaaatcacaaatgatgttcttcgacaggtggaggggtgggaagagttcgaccagcggcggaggcagaaacatcagaagcagctcgacttccgtgttggctcatctggtgtgttcgatgaaggcgcggatgatgataataggcgaaggtgactgcctgaaaattgtgagcataatactttgctacgatatttctcccaaagaaccgtagaaatgtacaactgaaaactacttctatggagcccgagatgtacaacctttttcattcagtcacgtagatagacacgtncaggaaaacaacatccttggaaagccatggcagataatgaggtaataataacaacgccgcactcatgcgacgcccccattgaccct

SEQ ID NO: 12065 - DNA, 617 bp, Zea mays
  Clone ID: LIB3279-203-Q1-K6-D7
acttatgttcctatatgactactagctagaagttagagcctagatgatggctgcttctgttggcgtgcaagctcgagtgctcctaaatggtcgtcgtattagctgatacgacatcgacccgatgcaatagataatattttttacacgcgcgagtccaaaattgttggctttgggtcggagcagttaacgagagaagtgtattttatcacttctgagtgcaaccttttttatttttccgagcttctgcctcttgcatatgttgtagattctcgccgagaagggagtagtagtattacctgatatctatgctaattcaggtggtgtggtcgttagctactttgagtgggttcagaacattcaaggtttcatgtgagctgaggagaaaggaacgatgaactagaaaaggacatgagcagtgcttttcaacacatgaaggccatgtgcaaatctttggtgctgccgaagtgtgtcgtgacattggaattgcgggtctagaaaaacagctcataagatttctgaaaaaattgggagttattagattggtagcatttttttaagatttaaaattttatagaagtcatcattttcgtttattggaagaaaatttttggaagttg

SEQ ID NO: 12066 - DNA, 658 bp, Zea mays
  unsure (1)..(658): unsure at all n locations; Clone ID: LIB3279-203-Q1-K6-D8
cggacgcgtgggcggacgcgtgggcgnaagcacccgcaccaatctctgcgtctcttcgtcttcggctgcgcggcgggcggcagcagcggaggaggttgaggagatgctgtccggcgacatccccccgaaccagaccatctacctcaacaacctcaacgagaaggtcaagaaagaagaattgaagagatcgctttatgccttgtgctcacagtatggaaggatactggatgtggtggccctngaaaacacaaaaattgagagggcaagcatgggtggcgtttagcgaaattacagctgctaccaatgctttccgtggattgcaagatttcgatttctatggcaaaaaaatgcgagtacaatatgcaaaaacaaaatcagactgtattgcaaaagaagatggtacttatgcacctaaggagaaaaggaagaagcaagaggagaaagctgctgagaaaaaacgacgaacagaagaggcacaacaagctggcctcaatgctgctgctgcccaaagcaatggaactggctatcaagcgtctcgtctgggcaaggcctcacaggagccacctgcgcctccgaacaactcctcttcatccagaatctgccagaccagaccacgagcatgatgctccagatcctgttccagcagtaccctggcttc

SEQ ID NO: 12067 - DNA, 650 bp, Zea mays
  unsure (1)..(650): unsure at all n locations; Clone ID: LIB3279-203-Q1-K6-E1
cgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaacccaaggccaaggccaaggccaagcctgtcgctcctgccgccgcgtcgcccaagccccgcgggcgccctcccaaggtcgccaagacctncgccaaggcctcccccgccaaggcagccaagaaggcggctgctcctgccaagaagggaaaggcagcggcggctcct

SEQ ID NO: 12068 - DNA, 558 bp, Zea mays
  Clone ID: LIB3279-203-Q1-K6-E10
ccccgcgtccgattcacaaaaaaggaaaacacaggtggtctagaagaccagtggaagaggcgtaccgtgctccagacagagggttcctttcctgctttggtgaaccgtctgctagtcaccaaatctgaatctctggagttctctcctgttgagaatgcgattggaatgatcgaaacaagaacagctgcattgagaaatgaactagaagaaccacggagttctgaaggtgatcaactcccaaggcttcaaagcttgcaaaggatactccaaggaagtgtggctgtgcaggtcaacagtggggtattaagtgtgtgcactgcattcttatctggcgagccagcaactaggctcagatcccaagaactgcagcagctcatcgccgcattgcttgaattcatggctgtctgcaagcgtgcaatccgtgtgcatttcagattgataggggaagaagaccaggaattccacacccaacttgtcaatgggttccagtcactcaccgctgagctatctcattatatccctgctatactctccgagctatgatagaactgtaacaag

SEQ ID NO: 12069 - DNA, 621 bp, Zea mays
  unsure (1)..(621): unsure at all n locations; Clone ID: LIB3279-203-Q1-K6-E11
gcggagcaatgtgctgncaacgcgaggtctcgccactgccggttgagatggacacctccgcctccaaagtgctcaccaacgacgatctccttcacgacatccttctccgcctaggatgcccgagctgcctcgtcagtgccgcgctcaccagcaagtgctggctgcgtggcgcctccgatcaggtcttcgcgcgcgacttctgcgcggaccaccagccgcgcctacttgggatctacgtctccagcggcggcatctctgggtcggagttcatcccattcaggcaacctgctggtggctctaggccggaggtgagtactgtcctcaaccatgccgatttcggtttgggcgacctgccggcgccgagcgtttgggactgccggaacggcatggtcctcttccagttcggtggcgagacctttaaccccgctggtctcgctgcgcgttccccgctgctgtatcctaacatgcacgagagcgtggtgctcccgccgtcgccgcagccgtcctacttcccggagtaccctcacgcgatgctcctccctaccgacaaaggcgacgacgccttgtgctaccgcgtcgacgtccgcatctggggagtcgcacaacaaggccgcggcactg

SEQ ID NO: 12070 - DNA, 603 bp, Zea mays
  Clone ID: LIB3279-203-Q1-K6-E12
cggacgcgtgggagcctctctacctctacctaccggagcagggagcacgccgcacgagccctttccgccgccgccaaaatggtgaacgttcctaagaccaagaagacctactgcaagaacaaggagtgcaagaagcacactctccacaaggttactcagtacaagaagggtaaggatagcctgtctgcccagggaaagcgccgttatgaccgcaagcagtcaggatatggtggccagaccaagcctgtcttccacaagaaggccaagaccaccaagaaaatcgtgttgaagctgcagtgccagagctgcaagcactactcacagcacgcaattaagaggtgcaagcattttgagattggtggagacaagaagggcaagggaacatctctcttctaagtttctcatcacccatctcgatgttggatcgaagctgtgggtctactactgttctaaaaactcgtcaaatttcaatgttactagtagttctgaaagcaggtcatgctgtgtatcaaattccaatgcctgacatttgcactgagtgtgggttgtcttttggctaaatgaagttttgcaccctgaatcttcattgatgtgctgggagtt

SEQ ID NO: 12071 - DNA, 368 bp, Zea mays
  Clone ID: LIB3279-203-Q1-K6-E2
tctttctgctccctcgcgggctcctacacgatctacatgaagattgtcggggacgacaacgaggagctgagctgcatctcgttcgggttcagcatcggcttcgtcgcgtccagctgaacgcgtccgagcctgggcacgagaggcagccagcccatggatgattctgatgaggacgagactgatgattccgatgaggacgagacagatgaaaccaattgccttttaatggtctatgttatcattcaaaattgccttatgttgacactatgtatatatgctattcacaataatagagccattcatactgttgggcgccttggatgaactatcttttcttcaacaaagatggagctcatgcagattgattt

SEQ ID NO: 12072 - DNA, 525 bp, Zea mays
  Clone ID: LIB3279-203-Q1-K6-E3
ggagctctgagcatttaggatgttttatcattaactggcgccaggtggggaggtggggctggtgtggctgagacctgtgtaaacagctgttggaaccactagttttttgagcgttgtcagagtgctgatacaccgggacctctgtcaccctcgtggatctccgtggccggctcggcagcctaccggggctagctgcagctggctggtcttggctgtctggccgacatgcagacatgactggttatggtggtctgcggtgcggggcgcccgacgcacacactaatatatggtagctgatctgtgttttaaaaaaatgatagctacattctatcctcattgcggttatatgtggtctgggagacaaattcattgtgttgggcattgaggatgagggctgctctttatgtggcacaagcgttggactactgcagtagccaatggagggcactgtcatcatgacctgaatgcatacagggttgtatttgatgttgatggtaacccaagattatcatgttttggtctgat

SEQ ID NO: 12073 - DNA, 541 bp, Zea mays
  unsure (1)..(541): unsure at all n locations; Clone ID: LIB3279-203-Q1-K6-E4
ccggtccgaaaccccggtcgaccccgcgtccgcacattacagctagctgcaaaaacgttcatgaattataagcatcaggcagacttaaaaacatggtagtcttagaacattgttctatatccttgcagagcaanctagaaaaaactctcaacacagcacattcagaggatttatgcgttggcagcagcctgggcagcggcatcccgcttcctttgctcttctatgatgctcagcttgattcccttgcccttgggcaggctcacccacggcttattacccttgccgatggtgaacacgttgcccatacgggtggcgaactggtggcccagggagtcctccacgtgaatggtctcaaagctgcccttgtgcttctccctgttcttgataacacccacacggncagtgttccttccgccagtcaccatgacaacgttgccaacatcaaacttgatgaagtccacaattttgttggtcttcagatcgatcttgatggtgttgttggccttgatgagcgggtcagggtaggggatgggggggggcg

SEQ ID NO: 12074 - DNA, 471 bp, Zea mays
  Clone ID: LIB3279-203-Q1-K6-E5
gccacgcttccgatacgttggaatacaggcgctgtcgggactctactgcacccgctccatctaggaaaggaaaccgaggaaactacaggcacttgggactaccagatccgtatgagccggttgggaatgccaaaatacggcccttctacccgcagatgcccggcgatagccaataacttggagacgaggagcacctagggctgcttggatattctaacccgctgcatgggaaggattgtgaaaaaaggatggtacccgcaattcgtccggacgaactcttcgctgtacctgggcgcacagctatcataccttggtcacagtgttctgtttctggccggacttgttgcaccagctaccttgatgactatggtaatgcagggcgacgtgcttgttaggatccgcattgatgaggagattgggaaccttctgtatctcgtgggtatcgcacatgttgatgttctcaatgactat

SEQ ID NO: 12075 - DNA, 506 bp, Zea mays
  unsure (1)..(506): unsure at all n locations; Clone ID: LIB3279-203-Q1-K6-E6
gtccgcttggtgaacgaaactccggagggtggtcctggagggtaangaaaaattaaataattatgttaataagtcatgagtacataaatattacattgtgctgtggtgaaccagaaacatattaggtcaactggcagctgctatgccgcaatcggtgacagttaccccagaggaacgagaggccatccagcggcttgagggaatgggcttcaaccgtgagcttgtgctagaagttttctttgcatgcaacaaggacgaagagcttgcagccaactacctccttgatcatggccacgagtttgacgagcagcagcaatagtgggtgatatggtgntggtggatgcaggaaaccgaggcagtagcagaacagcatagtgtcgttctgatgacctccgcctgatgagagatacttggttgtttatgctatgctgctgaccatcttttattttcatgtgttcggaatgctttctaagtacatattaattcaatatctgttacaccgtgtc

SEQ ID NO: 12076 - DNA, 576 bp, Zea mays
  unsure (1)..(576): unsure at all n locations; Clone ID: LIB3279-203-Q1-K6-E7
cccccgnaaaacaactcctccccaaatccacgctgccaccaactcgccgtcctccgcgccaagcaccaaagctccgatggcccgcactaaacagacggcgcgcaagtcgacgggcggcaaggcgccccgcaagcagctggcgaccaaggcggcgcgcaagtctgcgccggccaccggcggcgtgaagaagccccaccgcttccgccccggcaccgtcgcgctccgggagatccgcaagtaccagaagagcacggagctgctcatccgcaagttgcccttccagcgcctcgtccgtgagatcgcgcaggacttcaagaccgatctccgcttccagtcctccgccgtcgccgcgctgcaggaggccgccgaggcctacctcgtggggctctttgaggacactaacctctgcgccatccacgccaagcgcgtcaccatcatgcccaaggacatccagctcgcgcgccgcattagggggagagagggccctgagcgaggcgagctcctctcaccgcaggcggcggtcgttgttgctttcggcctgcttggaggacttgggcttctcttgggttcctttct

SEQ ID NO: 12077 - DNA, 391 bp, Zea mays
  Clone ID: LIB3279-203-Q1-K6-E8
ccgcccttttttttttttttttaaaagaagaaaatcaaaccaccagggcgtctgactttaattcaaagcactataaaccagtacatccagagtatttgggctaaatagttcagaagtacaactcaagcaaaatgttccaatgttctagcttatcaggttcttgatagcaacatccagacttagttggcagcggcagcactcttcttgggagcagcctcagtcccttctctgaagttgctcttgaaacggcgaggcacgtggcgcatgtacctcatccttccggtaccggttgtcttgcgcctgatggccttcacactccagttatacttgcggatgcgggcggcggggtaaccgcaggaggagcaggtgctcttctggaggtggaagctgc

SEQ ID NO: 12078 - DNA, 672 bp, Zea mays
  Clone ID: LIB3279-203-Q1-K6-E9
tgcaacccgaatccgagtttgacaggaccgagagacgatgatcgagcaagtgatgtgatgccaaccacaagatgcagttggtggacgatctgaagagatgatagacttatccagtggatgctcgccaagcgagtacctcccccagcaaacactgtctaagtgttaaattaaaggtactccttaggttgaattgattgatggtgtgacttggcctccatccctgccaccaggacagacggtcgagtgggttactgcttccgcaggagaggactaggaggagtagcgtggccaggcttcgccatgttactcggttttctccgttagttatttccgctgcattaaaatttatggttattatttctgaaactccgataatgtaatcactaataatacttattaaatttgtggtattatgttttattgtatttctctgtgcctcaccttcgtgtgagctagtggtattcgatcctggtaagtggctttatcggactagatccgagggactgatgggttattcctgtttaagtgtgttgctgcccttaagggtgcgacttggacacttaagctgggataattcggggcggttccggcacagctggtatcggagcgaatacccatcacagagaatcaataagtcatgattaccaaccttttctaaaagtaaaacttgct

SEQ ID NO: 12079 - DNA, 654 bp, Zea mays
  unsure (1)..(654): unsure at all n locations; Clone ID: LIB3279-203-Q1-K6-F1
ccccgcgtccgccccgcgtccgggatctcgcgcccctgctccttctctcccagctgctgctgcttccggtggtggcggttgtctccggcgagaccgccgcgcacccgggctacacgcacgctgaggaggcatgcagcggtgtgctagaggcagaggcggagaaagcaacggtgctggtgcctgcgccagagcggcgcgaagagttcgacggcgggcggatcgtggacatcagccactactaccgcgaggacatgccggagtgggagtcatcagagggctccggcgagttcctgcagctggcgcggtccatgcgcaacggctccgacatcgctaacttctcggagctccggctcactgcgcactccggcacccacgtcgacgcgccgggacacgtcttcgagcactactacgacaccggcttcgacgtcgacaccctcgacctcgctgtcctcaacggaccagcgctgttggttgacgttcctagagataagaacatcacagctgatgttatggcatccctaaacttcctaaaggtgttcgatgtgtactctttcggaccctaaatacagacagaaagcttatgtggaagnaagaatttgatacaagttatgttggcttcatgaaggatggtgcacaatgggttgttgataatac

SEQ ID NO: 12080 - DNA, 554 bp, Zea mays
  Clone ID: LIB3279-203-Q1-K6-F10
gttcccccggcgggtcggactgcggagcacgggctccggcgagccgctgacgagggcctgtgcggcgaccgagctcgtggcgggagaagatggacgaagcgagcacctccgcgtccggcgccgcgacgaggcgcggcttcgtgcctgcgagatcgggagttttctataggttcacccagcagaacctcccagcttggaagccagcaatgacacctggatgtataatagcaatgttcttgattatcggaataattttcatacctttcgggcttctttgtctccaaacttcaaatcatattgcagaaatcatctaccgctatgatgttgactgtgtgcctgatgcttacagaggaaataggcaagcttatattaaggacagctcgatttctaagaactgtactctggaagcgaaggtagatcgttatgtgattgttgttagactacccgtctagggtttggggtgttccccatgtaattaccgttttacccctcactgtaatgggcctggcccagcttctaagcctattaatactactccccatccctggttaggg

SEQ ID NO: 12081 - DNA, 605 bp, Zea mays
  Clone ID: LIB3279-203-Q1-K6-F11
attagatcttgtttcccgtcttcttcagtattcgccgaacctgcgttgtagcgcacttgaggcgtgtgctcattcattctttgacgaattacgagaatcacatgcaagactccctaacggacgcccatttcctccactattcaactttaagcaggaactagcaaacgcaccaccggagcttgtcagcaggctattaccagagcatgctcgacggcattcaggattcggttccttatttgggagtggaccgtagcccgtaggaaaatctcgttttaatgttgggctgctgtacgctgtcagagggcaatctgcatatcctaaatctaagttttagaacctgaccatcttgttgaaaagttgccagccttagaaaaacccgaggtggcctcttgtgtccatgctctgccagtagcggcacataatgctggggggatggttaggtgtattgttaagcacagagggtgactgagctaatgtattttcacgtttcatgtctgtatcgaacttgtacctgtgtaccctgtaccaatcgcagctggtgtaatcatgtaaatgcttctaaaactcttcaagctttcatgatggccaattcccaatttttacac

SEQ ID NO: 12082 - DNA, 639 bp, Zea mays
  Clone ID: LIB3279-203-Q1-K6-F12
agaaggagggtgctctgccggcggcggagcggagatgtccgagaggaggcgcggcgccggcaccggcacccgcaaggatgaggtggtgacccgcgagtacaccatcaacctccacaagcgcctccacggatgcaccttcaagaagaaggcaccgaatgccatcaaggagatcaggaagttcgcccagaagaccatgggtaccaccgatgtccggatcgatgtgaagctcaacaagcacgtctggagcagcggtatccggagtgtgccgaggcgagtccgtgtcaggattgcccgcaagaggaacgacgaggaagacgccaaggaggggcagtactctctggtcacagtagctgagatccctccggagggtctcaaaggtttgggaactaaggttgttgaggatgaggattaagtcgaagggttcaatcatctagcacttaaatgcataccatgagagcaagtttgataatgctgcttcagcttgttatctatgccggatgacgtgtgatagaagtttcgagacgttgctcctttcaagttttgaaattttgactatatgccatgccaagtctgggttatctttaccatttcgagcatctgtatttattatgctgagacagactcatcaatttttgcttg

SEQ ID NO: 12083 - DNA, 425 bp, Zea mays
  unsure (1)..(425): unsure at all n locations; Clone ID: LIB3279-203-Q1-K6-F2
ccggngtcgacccaacgcgtccgggnaaccgccgccgacgccgcagnaggagacgcatcgaggagagcaagcgaggaagcgaccatgagggccaagtggaagaagaagcgcatgaggaggctcaagaggaagcgcagaaagagaggcagagatccaagtaggcagatcgagatggattgtggacctgatgacatgcgtgggtacatacatttcttcggatgcgttggtgtgcctgtggagagatgtcaacctgccatggtgtcacggtccgccatcagttgaacgtcttgcctgcacttcagtaggccatttttcatggttctagttgtatttgaatccagcgtttgccactaagataaatcagacattcgttttgtgaacctattatgatggagctttatttgctgataatatctacctacctc

SEQ ID NO: 12084 - DNA, 650 bp, Zea mays
  unsure (1)..(650): unsure at all n locations; Clone ID: LIB3279-203-Q1-K6-F3
atttccagccatgtggctggttcggggctggccggtatgaggtagatgggtatgtgtacagtgcagcggaagaacccaaaataatgattacaggngaaatggaacaagtcactgagctgccaaccatgtgaccaagaaggcgaccctcttccaggcacggagctgaaggagatctggagagtcgcccctgccccacagaacgacgggtatcagtacacacactttgcgcacaaaataaacagcttcaacacggcacctaagaagctgttggcatctgattcccggctgaggcccgatagatatgccctcgagaagggcgacatgtccaagtctggctcagaaaagagcaggctggaggagcagcagagagccgagaaaaggactcgagaggccaagggcgagcagttcactccgcgatggttcaacatgacggatgcgatcgcctccacgccgtggggtgacctggaaatttgtgagtacagcggcagatacacggagcaccgggctgccatagacagctccagcaccaccgacgacgacgagacagacgtcacttcggtcgagttcgacccatggcagtatggtggtagctcgtcatctccccaatgattcttcgcgtccggaagctgccgtgcctgtgctccttgtgt

SEQ ID NO: 12085 - DNA, 582 bp, Zea mays
  unsure (1)..(582): unsure at all n locations; Clone ID: LIB3279-203-Q1-K6-F4
cccccgcggccccggaaatttcccccttccccgtagcgaaaccctagccgccgcgccaaaaccaaatcccgccacgcccngaaaatttccggtggtttccttgccgcgaatcgatcgattccgagcgattcggttgatttgatcgatttcgggtgcttcgcgattgattaggccggcaaagccgccaatccttgtgatctctcgaaggggtagagcgcggtcgaccgtcggtcatgtcgaggtgcttcccctacccgccgcctgtgtacttgggaaacccagtggccgtggccgaggcggagtcgaccgctaagcttcagaaagaaagggaaagggctcacaagaagaaagataaaaggagtgacaagaaagctccccaactgggtgagacgtccaaacattcaaagcacaaccataagaagagaaagctcgaagatgtcagcacaggtgatcaggagcccaaaaaagtattcaaagaatcagctgagctattggagaagagtggactctcagaagagcatggagctccttgttttgtacagatgtttcgtgactctcctgagagctcgcaggacagcagca

SEQ ID NO: 12086 - DNA, 476 bp, Zea mays
  Clone ID: LIB3279-203-Q1-K6-F6
ggtggctcaaaagatgatcaaacaaactccagatgtttctccaattgatgacaatatttattgttttaattggatataagttggaaagagaagcaagtagttttgcaaacacaattatttccatttgctaacccattctgtcgatatttctgactcagagcagtccattatgagtctgcaaaatgttagcaacgaaagactattgaaacaacatgtcaaagaagtcgttgaaaatctatgagttatgccaacaagacgacatcgtaaaaaatgttatttatttgataaatctgtttaaatctacctttagaaatcattcccttttagacactataaatataaaaaatcgtgtatataaatatgattttcatggaaagtttgtggaattgttatgtttatgtagatgcattttagggggcgtatttatttagtcaactgtacctaaatacaatttctaagaatattttgtaagataa

SEQ ID NO: 12087 - DNA, 661 bp, Zea mays
  unsure (1)..(661): unsure at all n locations; Clone ID: LIB3279-203-Q1-K6-F7
ccccgcgtccggccaatttcgtcacctcctcctcctcctcctcctcgcccctgtgcctcgacatctcgcatccgctccatctatggaaggccaccacgcgccatggatcgccgctctctaccgccacctcaattgaaggttcaccgctctctacgtggatccgccacctcctcctcggccgccgtcaatggaaggtcccagatctcctctcccattacttctctccccattaccgcgctcgaggtctgccatttttggaggtccgccacctccgcctctgctcgccgtcaatggaaggtcctagatctcctctccctattaccgcgctcgagtcagtgggaggtccgccatttttggaaggtccgccacctcctcctcgacccgcggcaaaaatggcgtgggagatccgccacctcctcctcggcccgcggcaaaaatggtgtgggagatccgccacctcacctcctcccattctcacgcccgcgcctgatatggaaggtccgccgaagggactcggacgtcgaggccatggctgagccgcaccccttctncccctgcctcgcgcgtggcggctgagatggtgttggctgggttgttcgggatggtggtcctacctgccctncctgctatcctcgccccaaatcgacgagaatcatgcagc

SEQ ID NO: 12088 - DNA, 628 bp, Zea mays
  Clone ID: LIB3279-203-Q1-K6-F8
ccttgatctccgatccctaccttcattaggagagagagaggagaggagaggagaggaggggcacggagatggagagagcggcccccgtgaggagctcccacacctcgacggctggcctgctcgcgtggcctcaccccgatggcgccgggtcgctgccagcacgccggcctaaccagccgacggaggaattcaggaatgtggtgtttggggggcagctcacggagggggccgacggcctcaacaagacgaagaggaagacgggctcctcgcccaaggggaaggagacaacagggaccgggatatccaaggccgagagcgccgccgccgccgtcgcaactgcctcccgtgatcgtcaggctagccagatcaccttttcccaggacgggaccgttcctaccaggaaggcaacttcagtggctggggtggcaaggcagcgtgagcttagccataccgtcgagagtgagggggacagtaagatgaagaggcaggtgtccagtacgaaatccaaggagctcagtggtcacgacatctttgccgatcacgaagatcccaagcccaacaggtcaaggagatcagactatggcagctctgctgctcagtcaccagtgaaaaatgcaaacgtgagctc

SEQ ID NO: 12089 - DNA, 527 bp, Zea mays
  unsure (1)..(527): unsure at all n locations; Clone ID: LIB3279-203-Q1-K6-F9
ccgtctccatctccgtctccgtctcccaccgtgccgtagctgctgctgtccgtgtccctcgcctcgaagaagacaactccaacactgttgctgcgtgactgctgaatcgctccacacacgcgcgaacccagcaaggcaagaacacgaacgagagagagagagagagagacagggagggatcatccatccatcagaccatcacccatggacaaccttaaggagcagcggggccacgatgccgcgggcgccaacagcggcgtctggatgacggtgccggcgttcggggactgggacacgaagaacggcgcgctgccggactactccatggacttctccaagatccgcgagatgcgcaagcagaacaagaaggagctctcccgcgccagcctcggcggcgacgacgacctcttngnccacgcccacgcccacgcccagaagccgcaggccaacagcgcccagcccaagctcggncgnccctgccccgccgncgaccgccgaccgctccacgcccgcgaccactccccaac

SEQ ID NO: 12090 - DNA, 646 bp, Zea mays
  Clone ID: LIB3279-203-Q1-K6-G1
ccccgcgtccgccccgcgtccggcgacggctggtcgagttgcggcgctctgttcagtgttcattgtgcccttcgccacgacgattatcctccagtagtaagtcaccatgtcttcgtccatgcaatcttcataccttcctgctaccactgagtccgtagccaaggctcaggaggccaaggacgcttctgagtccatctcaatcctctaccacgtgcttgaggatccctcttcatctgcggatgcactgagagtaaaagagcttgccatcacgaatctcacaaactacctcacaaaagagaacagagctgaagacctcaggaaccttttgacccagctcaggcccttttttgcattgatccccaaggcgaagactgcgaagattgtgcgtggcatcattgatgccgttgccaaggtgcctggaacatctcagcttcagatctcactgtgcaaggagatggtagaatggacccgtgcagagaagcgaaccttcctcaggcagcgtgtggaagcaaggctggcagcccttctgttggagaatcaggagtatactgaggctcttacactcctttctggactcatcaaggaagttaggaggctggatgacaaagttgcttcttgtggacatcgaccttttggagagcaagct

SEQ ID NO: 12091 - DNA, 546 bp, Zea mays
  unsure (1)..(546): unsure at all n locations; Clone ID: LIB3279-203-Q1-K6-G10
ngntgatggagctccggnaccggttttcagagtatggggtcttttgagatcctcaaataactttgatccgagccttttgcagccaatcgttcaggttctacaagaaccagaggcccgtgtcttgggttctcgtgtcgcaggtggtgtaacacagcgccttgcggcacgtctgctgcaacagcttctcaggacccctcctgctcctggatcttcttagcagatatatagatataggctcgtatgattgtatgaagcatgtaaattgacacgatatttttcacaggaaatgagaaggaagcacaacccagaattcgagtatatagctagtttcttggttctaagtggataaagacattgtgcatcgagctttgtccagcagaccgtgtatatagttgtgtaaaaaacattgttttgtgctgtagattacactgtttacggagtgaagattgaaatgataaaacatggacgagtgagctgctaagatgtcacgcagcttttttggaaaaagagaaaataataagtttttagaaggatataaggaagaag

SEQ ID NO: 12092 - DNA, 640 bp, Zea mays
  Clone ID: LIB3279-203-Q1-K6-G11
ctcagttgtcgcctgtcgtcgtcttcgtctagcccggcccgttccaaaacctccgtagccgccgccgccaccccggcgaccgaagatgatctccccggacgcagcccgcaacgtagtcggcatcatcggcaatgtcatctccttcggcctcttcctgtccccagtgctgacgttctggcggatctacaaggccaaggacgtggaggagttcaagccggacccttacctggcgacgctgctcaactgcatgctctgggtgttctatggcatccccgtcgtccaccccaacagcattctcgtcgtcaccatcaacggcatcggcctcgtcatcgaggccgtctacctcactatcttcttcctctattccgacagccagaagcgcaagaaggcgttcgcgatcctggccgtggagattctgttcatggtcgccgtggtgctcggtgtgatcctcggcgcgcacactcacgagaaacgttccatgatcgtcggcatcctctgcgtcatcttcggctcgatgatgtacgcctcaccactcactatcatgagtcgagtgatcaagaccaagagcgttgagtacatgcccttcctcctgtcgctggtgagctttctcaacggctgctgctggacggcctacgcgctc

SEQ ID NO: 12093 - DNA, 547 bp, Zea mays
  Clone ID: LIB3279-203-Q1-K6-G12
gttggctgggaccctgacacgacctgaccgacatctgcccaggctcctcgggttgtgtcatcgtgccgttcacactggtgcgtccttgctcctcgttggctgcaactccaacgccaaatcgctgtgggtaaagcactcgtgcgccggacttatccgcttgcttatatgtgcggaatggacaccctgggccgtggcctccgctgctgcggcgagctgatcaaggatggtaccctaaatgctctggcccggaggcggcaccacagcttgactagcacgatcgcggcctagatcaacgatggtaaaggagactttcatgcgctggataagaaggtccttgagtggggtgagcccactgcaccgtccggcaagcaagaactggcggacatgtctgatacactcttgtctctaaattgatccatgttcgaagcgttcgctcctgcgataagcaagcactgagcctgcacgcctcccaacgcgcgcggttgccctcaccagtcaccaccacgggaatgattctacttgccctcgatgaaccatgtacactaca

SEQ ID NO: 12094 - DNA, 126 bp, Zea mays
  unsure (1)..(126): unsure at all n locations; Clone ID: LIB3279-203-Q1-K6-G2
cccgggntncgnaccccacgcccgtccgctcaaacatnccctnnactctcctnngctcctncttnncttccctcctcctnctncgctnnctcaagncgcccgtcttcaccctccggccctagctcg

SEQ ID NO: 12095 - DNA, 647 bp, Zea mays
  Clone ID: LIB3279-203-Q1-K6-G3
gggcggccgctcgcgatctagaactccagccgtccgcccctgaaccctcagccttctccgtcccgcctcggcactcgacggccgccggcacacaccgcgcagtctcgagacaggaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgctccctggccttatccggacgctcaagatgtgcggcacctacggggccaccttcgccaccatcgggggcctctacatcggcgtcgagcagctcgtgcagagccagcgcaagaagcgcgacttcgtcaacggggccgtcggcgcgttcgttgccggagcctctgtctgcggctacagaggaaagagtattcagtcagccctcatcggaggctcctgtctggctttcacatctgctgtgctggacattggcggcaatacgaccagagttgacaacggcaaagagtactatgcctacacaactgagaagaagcctgcaaattgattccaagtctgcacttctagcaaacaatcttgcacgccatcaactcagtgaatttgaagctgatgtgcag

SEQ ID NO: 12096 - DNA, 364 bp, Zea mays
  Clone ID: LIB3279-203-Q1-K6-G4
cgtaaattgcccccgttgctattgtgattgggatagtggtgatgctcttctgggtgaagaacaagatatggtgactggtgccatcttgcgatttcacagttatcatgctggaaccagctgagttgtcttgtcttccctcgtgcaaccatatgtttgatcgtggtcccaaaaagaaaagaaaagatggctcgatggtttatcccgcatctgccgattcaagcgactactttagctatcaaaagcaaaaccacggtagtagagatagccttggaactgcacatttctattaactggacatgtataaatagttctcgtgagcgcacaccatgtaatcgtcgaaattcatccatgtgttgtgacccca

SEQ ID NO: 12097 - DNA, 649 bp, Zea mays
  Clone ID: LIB3279-203-Q1-K6-G5
gcgccgccgccgccgcagactcctccttttcgatcccttcgcaaagcgccgccgtcgccccatccggcatggctccgaagaaggataaggccccgcccccgtcgtcgaagcccgccaagtccggcggtggcaagcagaagaagaagaagtggagcaagggaaagctaaaggagaaggtgaacaacgcggtgctgttcgaccaggctacctacgacaagctgctctctgaggtgcccaagtacaagcagatcaccccctccatcctatccgagcgcctcaggatcaatggctccctggctcggagggctatcaaggacctgatggcgcgtggcctcatccggttggtctcggttcactcaagccagcagatctacaccagggcaacaaatacctaaggatgggattcccttgtttgccctctctgtaggagctcgtcttctttagaacagttgccatctctgtcaagagtttgctaatgctatgttagatgagtttctcacgtggctgaaacgtttcagagagtttgcgttagtttggcttgcctattataccttatctggcctcaatagcttttttctatggaaatctgccttgaaacgtctgatccgtgattatgcgactctacctaaactactgttatgctgcaatt

SEQ ID NO: 12098 - DNA, 563 bp, Zea mays
  Clone ID: LIB3279-203-Q1-K6-G6
ccccgcgtccgccccgcgtccgccccgcgtccgcccacgcgtccgcccacgcgtccgcagcgaggcagccgcctcccccaagttccaactcgtgctctcacctcggatctctccatccctttcgtccaaaccaccgaccacaatcagaagcgttggcggcggcgcattccatggcgccgctggggtcaaagctggcgcagctgcagtccaaggcatgcgaggcgacgaggatcgtggccaagcacggatgctcgtaccacaagacgctcatggagaagaacaaacactatgtcgtcgaccctcccaccattgacaagtgcaaggacctctccaagcagctcttctacacccgactcgctagccttcccggtcgttacgagtcgttctggaaagaggttgatggtgcgaagcttctgtggaagaacagaagcagtctgaagggtgaggatgctggtgttgcggcgatgtttggcatcgagttgtatgcgtggttctgcctcggtgagatcgtcggtagaggttttaccgtcacgggctaccatgtctgaagcctgaatgcctgc

SEQ ID NO: 12099 - DNA, 555 bp, Zea mays
  Clone ID: LIB3279-203-Q1-K6-G8
gtcgtcgtcactctctccctctcgccctcgccatcgccctcgcggtctcgccgcggcataaacaaaacaagcaaagcaaggcaaaggcaaaggcaaaaccccacctcctcgctccgcacctcgtcgtctgcttttcctcggtgcggaacacaagcccctgccgcctccattaccgggctgtgcctgtgcgaggctgcgagcgtggtggctgtgtctggctttgcggcggcggcggtgatggtggtggagatggacggaggcgtgggagtagcagcaggaggaggaggaggagcgcagacgccggcgccggcgccgccgcggcggtggcgcttggcggacgagcggtgcgacctgcgcgccatggagacggactacgtgcggcggttccaccggcacgagccccgcgaccaccagtgctcctccgccgtcgccaagcacatcaaggcgcctgtccactttgtctggtccctggtgaggcggttcgaccagccacagctcttcaagcccttcgtgagccggtgtgagatgaaggggaacatcgagatcggtagcgtc

SEQ ID NO: 12100 - DNA, 526 bp, Zea mays
  unsure (1)..(526): unsure at all n locations; Clone ID: LIB3279-203-Q1-K6-G9
ngactcctcgcatttcttcccatccgatccccccttcgcaaccaaaaccccaactcgccccgcatcgatggcgcccaagccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctgaggccgccaagctcgcgcgctataacaagaagcctaccatcacctcccgtgagatccagacctccgtgcgcctcgtccttcccggggagctcgccaagcacgccgtctccgagggcaccaaggccgtcaccaagttcacctcggcctaagctgcgc

SEQ ID NO: 12101 - DNA, 637 bp, Zea mays
  Clone ID: LIB3279-203-Q1-K6-H1
cacccgtcggcgtcgagcagcggcggcgatgacgacgagcctgaagaagaaccggaagaagcgcgggcacgtgtcggcggggcacggccgcatcggcaagcaccggaagcacccgggaggccgcggcaacgccggcggcatgcaccaccaccgcatcctcttcgacaagtaccacccgggctacttcggcaaggtgggcatgcgctacttccacaggctccgcaacaagttccactgcccgtcggtcaacgtggagaggctctggtcgatggttcccgccggcaaggccgcggaggcggtcggcgcggaccaggccccgctcgtcgacgtgacgcagttcggctacttcaaggtgctcggcaaggggatgctgccgtccaggcccatcgtcgtcaaggccaagctcatctccaaggtcgccgagaagaagatcaaggctgccggaggcgccgtcctgctgaccgcttaggtccttttgcatcttgtttcaactatctgcgctaagaaatattctatcttttttgggtggatttatgaggccctggttttgagcacttggtaacgaatatgagttcgattatatcgatgctccacatctcttgctgcatgtattattcattctatgcagttcatgttt

SEQ ID NO: 12102 - DNA, 545 bp, Zea mays
  unsure (1)..(545): unsure at all n locations; Clone ID: LIB3279-203-Q1-K6-H10
gccgcctcggtgcctcctcgctntcgagtgttcgtgcgaaggcgaccctccctccttcgctccttccgcgccgcctcccggccgtcgccgccatggtgaagtactcgcaggagccgggcaaccctaccaagtcggctaaggccatgggcagggatctgagggtccacttcaagaacacaagggagacagcctttgcgcttcgcaaggtgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggcttggatgtggacaacctctatgttttacacatccaggtgaatcaagcccagaagcagaggcgccgcacctaccgtgcttacgggcgcatcaatccctacatgtcctcaccttgccacattgagctgatcttg

SEQ ID NO: 12103 - DNA, 599 bp, Zea mays
  unsure (1)..(599): unsure at all n locations; Clone ID: LIB3279-203-Q1-K6-H11
ccggnngtcgacccacgccgtccnngcgtcttctcccttcccttagtcgnnctccccaaatcggnnatctccagnngccggcagnaagnnttgagcggacctgacnntggtcacctggtagtttcgatcggaatcccgaggtaggggctggataccaagttccgatatcgggcggggagggcatgggcggttcccgaaaagcaccttcaaggtaccgtcattccttcgggcgggcgggcgtccgcgggcgggggtaccgccggcgccgggagattcgccccaacaggggagttatagacctgtgggagacttgcgaatcactctctcaagggaggcgcgctgggtctctctacagagcgctcctgcgcctcaagcacaaggtgtatcctcctttctctacgcaatgcgtgtcaaggactctccagggattttatagtattgtgtgggaaagtgggtggaggagaagctatatgcctcgagtggtgctcactagaaaggcgattgagactgatctcttagtacatgaaattgtcacaaactgtatctttttcaccaaagactcttgactaagtgcagcctggtaggcaaacttttacata

SEQ ID NO: 12104 - DNA, 583 bp, Zea mays
  Clone ID: LIB3279-203-Q1-K6-H2
cggacgcgtgggtgccgccgccgtttctgcatctcccatcttcgcaacgccggcgctccatcttgcgctccctccctcactcgctctcggtacgcaggcggcggcggcggcggcggtggcggctctcagattcgggctctcagcgacggcgtcagcagcttccactcccgcctctcgccagttgcctcgcgccctcgcctccggtcctccgcacaccgccggttacccttctaaaacacctcatccccaaatgaagcacatattcaagattgctgcaatactggtagcaatctctgctatctggattgctctccttgaaacctccactgttcctcgaagttatacttggctgcttcccatctacttggtagtggctcttggatgctatggcctttttatggttggatttggacttatgttcttcccaacttgtcctcgagaagctgtactactgcaacaggatattgtggaggcaaaggaattcttaggaaagaaggggtgttgatgtgggctctgagtgagatcaattttaagtggttgacatacatgtctgttttgaaagatcaccattctgttccttgga

SEQ ID NO: 12105 - DNA, 582 bp, Zea mays
  unsure (1)..(582): unsure at all n locations; Clone ID: LIB3279-203-Q1-K6-H3
cacaagnatgctattcttgaccttcagtggactactgatgggacccagatcatctctgcaagtcctgacaagactgtgagggtctgggacgttgagactggtaaacaagttaagaagatggctgagcactcatcattcgtcaactcatgctgcccagcacggaagtggccacctcttgtggttagcggttcagatgatggtacagcaaagctgtgggacttgcgtcagagaggtgcaatacaaactcttcccgacaaataccagatcacagccgttagcttctcagaggcagcagataaggtattcactggtggcctggacaacgatgtcaagtggtgggatcttcgcaagaatgaaacgacagaatatctcaaaggacatcaggacatgatcactgggatgcagcttagtcctgatgggtcttacctcctgaccaatgcaatggacaatgagctcaagatctgggatctgcgcccttacgcaccagagaaccggaacatcaagactcttacaggtcaccagcataactntgagaagacctactgaagtgtagctggtcgccagataaccgcaaggtcactg

SEQ ID NO: 12106 - DNA, 633 bp, Zea mays
  Clone ID: LIB3279-203-Q1-K6-H4
cgcgcattttccatctgttgtgctcatcctcatatccatggtgtcgagtgctgaatcctcctttcaggagctgtttggcttcatcgcctccgcgctagccaagtacgtcgccgcggcgggcgaaggggacggcaggcagagagagctcgggttcaccttctctttccccgtgcgccagacgtcgatcgcgtcaggcacgctcatcaagtggaccaaggcgttttcggtcgacgacgctgttggtgaggatgtcgtcgccgagctgcagacggccatggagaagcaaggcgtcgacatgcgtgtggcggcactgatcaacgatacggtcgggacgctggctgcgggccggtacaacgatgaggacgtcgtcgtcggtgtgatactaggcactggctccaacgccgcgtacgtcgaagaggccagtgccatacccaagctcaagctggagggcggcgaattgcccaagtcagggaacatggtgataaacacagaatggggtaacttctactcgccctgcctccccatcacggagtatgaccaggccttggatgaggagagcttaaacccagggagcagatcttcgagaagctggtttcgggcatgtatctcggcgaggatgtgaggcgggtgctg

SEQ ID NO: 12107 - DNA, 636 bp, Zea mays
  unsure (1)..(636): unsure at all n locations; Clone ID: LIB3279-203-Q1-K6-H5
cagctattgtggtcgtccctcagccgcgtcgcaccgcatcgcattctacgattcgaagctctctctgctcgcagccatggcgaagaattacccaaccgtgagcgccgagtacagcgaggccgtcgagaaggccaggcgcaagctccgcgccctcatcgccgagaagagctgcgcgcccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgatttctaccagcttgccggagttgtggccgtcgaggtcaccggtgggcctgagatccccttccaccccggcagggaggacaagcctcagccgccacctgagggccgtcttcctgatgccaccaagggttctgaccacctgaggcaagtctttggcaagcagatgggtttgagtgatcaggacattgttgccctctctggtggccacaccttgggaaggtgccacanagagcggtcctgtttttgagggggcctggactacgaaccctttggtctttg

SEQ ID NO: 12108 - DNA, 278 bp, Zea mays
  unsure (1)..(278): unsure at all n locations; Clone ID: LIB3279-203-Q1-K6-H6
gngggacagnaatgatgatatgggagatggataaaattgggtgcctgaagatgcgcttgttgttattaggatttgttgtacgtaggagagtctcgtgtactatgttaagaatagtcgaataagttgcttttcatttaattattttgcacattgtcctcaagatcacgatcagaaagtgtgctgttgtcggtaggttcatgcagaactaataagcttaagatctccattggtattgtacttccatccatttgttgagcaagtttccagtttcagcattc

SEQ ID NO: 12109 - DNA, 262 bp, Zea mays
  Clone ID: LIB3279-203-Q1-K6-H7
ccccgcgtccggaaaatagccaagttgtagagtgatctgtcttgtatagtaaagcaggcacaaaagctccaatgtatatgtggaaggtagcatcttcagttgtgctaggcctccattcctctttttttttcttgtttggatgggccttttgcttcttcgtagctgctgtatcatgtatgctcccattgagccaggagttgtaaaatattaaattgaaggtgcttcttccataaaatgatgcatacctgtaaatctttgttgc

SEQ ID NO: 12110 - DNA, 504 bp, Zea mays
  Clone ID: LIB3279-203-Q1-K6-H8
gggaagggatcgagagcgcggcggaggcgatggcgagcggagggaagggactcaacgcgactggggagttcttccggcggagggacgagtggaggaggcaccctatggcggggaaccagctgcgccacgccacacccgggctcggcatcgccatcgtcgccttcgggatctacctcgtcggcgaggccgcctacaaccgcctctaccgcccctccggcgacaaccaccactagatcgccggcaggatccgtgactcggtcaagaagctggagccaactttaccaagcactggtgctgttgatgtttttacagttttgagctcataaggtcagccatgaccatattgtaatctgtgaccaggtagacttgcccactggtccgtccaactattgtcttgggaccctgtgttaatccttgctatatggatctgacagtgctcatgtaattcaagaatcctggactatcttttatgtgcttatttgagtttgcaagtgcgtttccgtt

SEQ ID NO: 12111 - DNA, 406 bp, Zea mays
  Clone ID: LIB3279-203-Q1-K6-H9
ggtccctgcattctcgtgcgcgcaccactgtgatgcctgagcggggcctgttctctcatgcgtataagaagtactcatcacttgtggagccgcttaatgaagcacaagtttggtttgggtgttcaacaagccttgttgatgcagctacacttggtttgcgtgatgattatactattatcaagcacccaatggatcttggcacaataaggaggctggtgacccgctggctgaccatgaaccctcacgagttagctgaggatgtgcgcattactagccataacgggaggacatataatcccacgggtcctgttgtacattttatggtgaaacaaaagttatgaatctttgacgcacagtggatctgagaattgaggctgacgttaactacctattattatgttctcca

SEQ ID NO: 12112 - DNA, 156 bp, Zea mays
  unsure (1)..(156): unsure at all n locations; Clone ID: LIB3279-204-Q1-K6-A10
gggggggggggggggtttttttgtgtggtttgggggggttgtggggtggggngggggtgtgggggggggggggggggggggggggggggggggggggggggggggtgggggttgtggggtggtgggttggggttttttttgttgtttttttttttt

SEQ ID NO: 12113 - DNA, 623 bp, Zea mays
  unsure (1)..(623): unsure at all n locations; Clone ID: LIB3279-204-Q1-K6-A11
tcgaacccgcgnaactgaacgactagtcngaggcggcggcggcggcggcgatggggagcgacctggagacggagaagaagaagaccccggtggcgctgatgcccatcgcgaagcccctcgctggaaagaagctctgcaagcggaccctcaagctcgtgcgacgagcctctgaggccaagtgcctcaagcgcggagtcaaagaggtagtcaagagcattcgccgcgggaacaaagggttgtgtgtgattgctggaaatatttctcctattgatgtgattacacacgttccaatactatgtgaggaatctaatgttccttacatatatgttccatcaaaagaggatcttgcgaccgcaggaaccactaagaggccaacttgttgcgtcctggttctgaccaaaccaaacaagggggagctcagtgacgaggtgaaggataaactgaagtcagactatgaccaagttgtaacggaagttgctgaggctacatctgcaatgttctaaggaccattcagggaccacatcatctgagaatcatgcagctacattcttggcgtactatgtaacctgatccctgtcagtctgccctgcttgcgtgaaccgcaccagtatgctttgcatggt

SEQ ID NO: 12114 - DNA, 597 bp, Zea mays
  unsure (1)..(597): unsure at all n locations; Clone ID: LIB3279-204-Q1-K6-A2
cggccgcgtgggnacgacaggcaattcgaggcgggcaatctaatcgtctgccatcccgtctcatcgttctcccaaatctgagagcgttcccaggacctagggttcttgagatccagccccaggatggatccgaaccctagagctcccctcctcctcgccatcgtcgttctcgcgcttggcgtatccgtggtggccagcgccgaggacgacgcgtcgggggtctctctgggccgccgcgccggggggttcttgcacggcctgaagaaggatgcactggcggagggcgatcatggggtggcactagacgaggttggaccggggctgttcgacgcactctttgccagcctctccatgatactagtcagtgagattggagatgagaccttcatcattgctgcgctgatggcgatgcggcaccccaagtcaattgtgttgtctggtgcactatctgcgctttatgtgatgacagtattgtcaactggacttggcagaatagtgcccaacttgatatcaaggaagcacactaatagtgctgctacagttttgtacttgttctttggactacggttgctgtatattgcatggaaatctgaccca

SEQ ID NO: 12115 - DNA, 490 bp, Zea mays
  unsure (1)..(490): unsure at all n locations; Clone ID: LIB3279-204-Q1-K6-A5
gcncaacatgctgccagacatgctgctaggcatgttactgcgtatgctgttacgggtactggtgagggaaagtgtgctagcagatgtacttacagaggcataaattgaggcatttgttgtggaccaggctatagtacctgaaaaactacatacacctttgtatgacgatttctacaacagtagtcaccaaagtagcaagcaaactttcaaagtaaaatcacaaatgaccccaaaatggacccctcctggaaagtaaactacaagagagacatgggaaggtgcatgtaacacttttaataacacatgtaccaagaactgcactaagcactttgctataaacagcgtgctggttagcagacaaattgttagagatatagttaatgcttaacttaatgaacttgatgatgaactccatcatgatgcccacgatagcccaaccatcaggttcaccaaatggcaaaagaagtggaaacaagagcttgaccaggaa

SEQ ID NO: 12116 - DNA, 590 bp, Zea mays
  Clone ID: LIB3279-204-Q1-K6-A6
caccagcctgttgggcactatctatattcaagtggttttcgtacatcggatgacacgattccttctgacagctatgcaagttatggcggctcccaggcacctggaagaggatatggggcttacagcgggtacagtgctcgctcctctaatagtgggttatctggtcatagttctcttcactatggaaagcgtcatggttattaggatttagattgcttgataaagcagctatctgatggacctgttattttcacctttgccacccctgctcccctcacgtactataaaaacagccaagacattgaagtttggagcctgcttattggagtcccttcccaaaccagatgaccaagagagcccaacctggaagctttgcttaagaggacccgtgtggatgccatagaccaccttatattcctcactacattactttgtcttcctgtgggcctatgtttttagccctgccgcaaatgttctgaacctatgtattgaaaggtcgcatttgagactgcatgtatttgcttgtttgaaacctgattcagtttagtgattttgttgaaaaaaaaaaaaaaaaaaaaaagggcggccgc

SEQ ID NO: 12117 - DNA, 574 bp, Zea mays
  unsure (1)..(574): unsure at all n locations; Clone ID: LIB3279-204-Q1-K6-A9
ctcgcgccgctccgcgccctctcctccccctccaccagccgcgccgccgcctaagagaagaggtccggccgtctccttgccccgatggcgtccgagaagaagcagtccaacccgatgcgggagatcaaggtgcagaagctggtcctcaacatatccgtaggggagagcggcgaccgcctcacccgcgccgccaagtgctggagcagctcagcggccagacccccgtcttctccaaggcgaggtacacggtgcgctcgttcggcatccggcgtaacgagaagatcgcctgctacgtcacggtcaggggcgacaaggccatgcagctgcttgagagcggcctcaaggtcaaggagtacgagctgctcaggaggaacttcagcgacaccggctgcttcgggttcggcatccaggagcacatcgaccttggtatcaagtatgatccatcaacaggcatctatgggatggacttttacgtggtgctcgagcgtgctggctaccgngttgcgcgccgcaggaggtgcaagtcccgtgttgggattcagcatagggtgaccaaggaggacttcatgaagtg

SEQ ID NO: 12118 - DNA, 609 bp, Zea mays
  unsure (1)..(609): unsure at all n locations; Clone ID: LIB3279-204-Q1-K6-B1
ttgnatttacttgagnataggggaccatgcaagtatcggtgcaacagttttatttcagttgctagtttgtacaaaaatcagttatggtggatataatttagggtgttgagactaaagctcgacaaaaaaaattaatacagtaaaattaattaaggagatgtttgcgactactccgatccaccattttaagttctgctccaccaactccaccatgaagttgctccatgatcgaagtttttagagttttcaaactgcttagcttatagggggacttggtgggtggagaatgacttattataggtcgaccacgcgttcttcttgtttgacacaggtgacatgaggacgctgctttctggaggcgacgacgtcgtcgattttgctgtcttctcgggattcgtgacccgacacttcttgatccccgggaccacgatcattgcaacttctatggtattgaggcatctcgagctccgtgctaaaccgcatggcatgcttaatgaccgaagtcaatgtatgctcagtcatggaagttaagcggcataaaaacaagatgaccaagacttcagcataatgttgtgactaaggtcaaggcgactatggtcatggatgtac

SEQ ID NO: 12119 - DNA, 623 bp, Zea mays
  Clone ID: LIB3279-204-Q1-K6-B10
cccgcgcgtccggtagtctgtaccccaagcaccggcgcggcggcggcggctaccatggcagtcgggaagaacaagagatctccaagggaaagaagggtggtaagaaaaagacgttgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagctgatcttcagggtgacgaggatcaggcttacaggaaaatcaggctccgtgctgaagatgtgcaaggcaggaatgtgctcacaaacttctggggcatgaattttaccaccgataagctcagatctctagtaaagaagtggcagacattgattgaagcccatgttgatgtcaagacaaccgacaactacatgctgcgtttgttctgcattggttttaccaagaggcgcccaaaccaggtcaagagaacctgctatgctcaggcatcccagattcggcagattcgccgcaagatggttgagattatgatcaaccaggcttctacatgtgaccttaaagaacttgtttctaagttcattccgg

SEQ ID NO: 12120 - DNA, 625 bp, Zea mays
  unsure (1)..(625): unsure at all n locations; Clone ID: LIB3279-204-Q1-K6-B11
cggccgcgtgggcgggngtcagggccgtataaaaaactcgcgcccccaatcctccgcaccgcacccagaggaggcaaggagcccatccacctggtcctgctctcaccacaccgccgcgccaatggcggctcgccggcagcaccgccgcggcttcccgctggtcccgctcctgctctccctcctggccgccgccgcgtacggccgcctcatctccgacgggggctcgtccgcgcagctcctctcggtgatccgcctctcggggtcctcgccggccgcgggggcggccaacaaggccgaggagaagtgcgagcagtcctacgggttcctcccctgcaccaccaccgtgctcgggaacctcttcctcgtgctgacgtacggcttcctcatgtacaaggcggccacgtacctgtcggcggggagcgagctgctgctcgagatcatggggcccggcctcgtcggcggcctcctcctccccatcctcggcgccctccccgacgcgctcctcgtgctcgtatctggcctgtccgggagtaaagaggaggcacagagtcaggtactgatcggaatggggctgcttgctggttccaccgtcttcctcctcaccctgctttgggggacctgtgtc

SEQ ID NO: 12121 - DNA, 585 bp, Zea mays
  Clone ID: LIB3279-204-Q1-K6-B12
tgtcagcaagcgccggaaccaaaccccgccgcctcggctagctaacacgtacactagcagtgatccccatggcaatgctgccgcgtccaacagcgctcgtcgcagcggtggtggtggcggcggcgctggtgctcgggatggcgtcggcgcaggggccggccgccgcgcccgcgccgggcccggcgcccgggatcagcgacgagtgcttcaacgcggtgctcaacatgtcggactgcctgacgtacgtgacggcgggcagcaaggcgcggcacccggacacggcctgctgcccggagctggccgggctgctcgagtcccaccccgtctgcctctgccagctgctgggcggcggcgccgagtcctacggcgtcagcgtcgactacaagcgcgcgctcgcgctcccggggatctgccgcctcaccgcgccgcccgttagcgcctgcgcagctttcggattccctatccccgagggattggtgcctactgcggcgcccatggcaggcctctctccatcttctatcggcccagatgtgcctgccaacacgccgacgggctcagccaagtcccccgcgggacgcgtcaccg

SEQ ID NO: 12122 - DNA, 566 bp, Zea mays
  unsure (1)..(566): unsure at all n locations; Clone ID: LIB3279-204-Q1-K6-B2
cccagcgtccgnaccgatgccatcaaggagnacaggaagttcgcccagaagaccatgggtaccaccgatgtccggatcgatgtgaagctcaacaagcacgtctggagcagcggtatccggagtgtgccgaggcgagtccgtgtcaggattgcccgcaagaggaacgacgaggaagacgccaaggaggggcagtactctctggtcacagtagctgagatccctccggagggtctcaaaggtttgggaactaaggttgttgaggatgaggattaagtcgaagggttcaatcatctagcacttaaatgcataccatgagagcaagtttgataatgctgcttcagcttgttatctatgccggatgacgtgtgatagaagtttcgagacgttgctcctttcaagttttgaaattttgactatatgccatgccaagtctgtgttatctttacacattccgagcatctgtatttattatgctgagacagactcatcaatttttgcttgtacaacctgatatgactgatgtagccatgtgttttaagattttttgacgcatgaaagacacttgt

SEQ ID NO: 12123 - DNA, 367 bp, Zea mays
  unsure (1)..(367): unsure at all n locations; Clone ID: LIB3279-204-Q1-K6-B3
ccgggtcgcccagcgtccggtgcagtctggtttggttggacagccccacccagggctctcgcactgcgaggttgcccatagctgtggagcagttcctgctggatgaaggcctccagtacacgcagcctcaggcgggtctgctccgagtgatggtgtactaacatctcttaggtgagaaaaaaaaacctccaaaaaaaagagaaaagagatgtactaaanacgcaggggaaaaaagcgtcgttggagcacgcactgttattccgtgtagctgtatattaaaagaggcagcaggagaatagcctgacaacaggatacagtgtaaaattatacgtagcttccttcattcaattcacattccttttccatc

SEQ ID NO: 12124 - DNA, 624 bp, Zea mays
  unsure (1)..(624): unsure at all n locations; Clone ID: LIB3279-204-Q1-K6-B5
ccccgcgtccgncacaagcaggaccagctagctagctcctcccactgctatcacccgggccccggccagccatctcgctgaaagagaaaagcgcagccatgaagactactagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaatccatacgacgggatggtgatgttcagtgccctgctagcagtaggctgcatctgcactgagtgactagaataaaggatttggtgatgtttgtgctgattggtgtgttcgcctgtaatcgtgtgatgccgtcgttggcttctt

SEQ ID NO: 12125 - DNA, 341 bp, Zea mays
  unsure (1)..(341): unsure at all n locations; Clone ID: LIB3279-204-Q1-K6-B6
tgnaggtgtaccccgnaagccacggggnaggagttcgtggagatcggcgcgggagaccttgtcgtcttccccaaggcatgagctgcacctgggacgtcgccgaggccgtcgacaagcactacaacttcgagtagccgccgccgccgactagccctgcggcgctcgatgtagacttgctgtgctcttgtactctgaaccaccgtgtaataaagctccggattagggtactacaatactgtactatctgtttcagatcccgttcggttagctgtgattaagacctgaaactattccagctgatcagttttaatacaaataaaactatggaacagttttagagg

SEQ ID NO: 12126 - DNA, 607 bp, Zea mays
  unsure (1)..(607): unsure at all n locations; Clone ID: LIB3279-204-Q1-K6-B7
ctggntctcctagggtggacgccgagnccgtgatgagaggagatcaagnagtcttagctacagcaggagcgcaagccctaggcgttctgtgtcacctgcaaaggaaaaggagcgcagccgcacacctgatggcagtaggagccccagcccaagggacaaggtgagcccaccaccaaaggataatggtgcccacaatggctcggaccgtgaagacagccctgggggcagggagatgagcaagaggagtcggagcccgtctgatggctaccgtagccctgtgggcaatgggcgcagcccgagccgtagcccaagccccaaggtcaacaatggtgatgacccaagccccaagggcaacaatggtgacgacccaagccccaagggcaacaatggtgatgacgagcaccgcggttcaccaagaggaagtcagtccccctgaactgaaaaactccccgtgcaatttggggagcagtgtgcctgatttgagaaaacaaactgtattttgccatttctcagacttgtgatctttttgagcaagaaaactcggtgtaagaatttgttgccctcgggtgtaagacagatttgtggtatttgagcttttcatcctgcc

SEQ ID NO: 12127 - DNA, 626 bp, Zea mays
  unsure (1)..(626): unsure at all n locations; Clone ID: LIB3279-204-Q1-K6-B8
ngttgccttgnaaagttcgttaacgaccctcagccagnaagtattgttctcattggtgaaattggaggtacggctgaggaggatgctgcgacattcatccaggaaagcaaaacacaaaagcctgttgttgcattcattgctggacttacggcacccccgggccgtcgcatgggtcatgctggagctatcgtggcaggaggaaagggtactgcccaggacaaaatcaaggcactcagagaggcaggtgttaccgttgtcgagtcaccagcgaagattggctctaccatgtttgaaatcttcaagcagcgtggaatggtagaatagacgatggagacattgagaaaccgcattttgatgctcatgggcaattgcgagcaattccttccatggcctcaaacaaaactaatgaggctaccttttcttacgtgccttctgtttggaagatggcctcttcacctggatcaccttccaatgagctcatttccaataagacgtttcagagccatggacatgcttggagtcaatgtgaatgcctaatttcgaatttttattgtttacacatgtcaatctaggtttaccaatctgtttccttgtattatattgtgcggtaaattgccccacagctg

SEQ ID NO: 12128 - DNA, 485 bp, Zea mays
  unsure (1)..(485): unsure at all n locations; Clone ID: LIB3279-204-Q1-K6-C11
tcgatcaacccaatgaanaacacatatccaagcgccaggagaagaatatcatgaaactggtagttgatgctgaaactgacaaagtacttggtgcatccatgtgtggaccagacgcacctgaaattatccagggcatcgctattgcggttaaatgtggagccaccaaagcagacttcgacagcactgtcggaatccacccttccgctgctgaagagttcgtgaccatgcgcaccgtgacgaggcgcttgagcccgacatccaagccaaagacgaacttgtaagcaagaaattggtattctggggaaatgttacaccggacaaatactctggtttcatcacgttggtaatttttacgtcattggaactggaaccatgtatattgaaggaataagttgtttttttcatggcaacacaccgaaaataatgagaccgtggactttcttgatacaaataatgagctcaagcagagaacgtttatggttggt

SEQ ID NO: 12129 - DNA, 633 bp, Zea mays
  unsure (1)..(633): unsure at all n locations; Clone ID: LIB3279-204-Q1-K6-C4
tcccgnggtcgcccagcgtccggggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccct

SEQ ID NO: 12130 - DNA, 509 bp, Zea mays
  unsure (1)..(509): unsure at all n locations; Clone ID: LIB3279-204-Q1-K6-C6
gcttgaattgagctgattatgattcagnacagnatgtcnattgctgacatctgtaatgagactaacgctgaagaagagaaagaagaattatcaggagtacattgtgagaagctagcaattgcttttgcaatttcaaattcccctcctttcagaagcatacggataataaagaccttaaggatgtgtagccattgtcacatctttgccaagctagtttcagaaaaatacgagcggcagatactaatcaaggattcaaattgtttgcacaagtttgaggatggaaagtgctcttgtgaaggttattggtgaatacaactaatataagtgcaccaatggtttctgttcatttatgcgtggtccatactggctttttcatgtatgagtgtagtgttatcagttcatagttgtattggtacggaaaattactgtagccagttttgctcataaaaaacctaatgttgtcttattgctatattttagttggaagtagtagatatctttatcttctt

SEQ ID NO: 12131 - DNA, 623 bp, Zea mays
  unsure (1)..(623): unsure at all n locations; Clone ID: LIB3279-204-Q1-K6-C8
ggtatgatgcctnganaggaggtcaaaccaacattgctagctatgagttgctattgaaggcatatattgatgctgcaaggttggatgatgcgattaaggtcgccaaatgtatcctgttagatgagagtgtcgtctttagtgatgaaacgaaagcacttctggaggaggcactagacaaagagggtagaaatgggcaaatgacaaagttatatgaagatgttgagatggagaaagcagaggcggctgcacgtgcagctgaagagaaggctagagcagaggcccttgctaaagaagaagaggagaggaagaaggccgaggcaaaggctaaggaagaagctgctgccagggctagccgagcggctattgaggcagtgctgggtcgcaagagggaagcagaaaaacaggaaccagttgatggactgaacgttgaggatgcagaggttgtggaatccaagaatgacaccagcgatgtttctggagaacagaatgaaggcgatgagcacaaaaagcaagagccggctgaagcatcatcgtgttcttagcttcgttatctttataagttccttactagttactatcatgagtgatctttagatccatttcagtagtataatgtgcttggg

SEQ ID NO: 12132 - DNA, 620 bp, Zea mays
  Clone ID: LIB3279-204-Q1-K6-D1
cctcactcgcgctgcccgtcgcccccaacctcggttccgccggcgcgcgaggggattcgagctgggtcttgggtagcctctcaccgtctcacgatgccgccagcacccaagtccggcgacgccctcttcgccagcgtggatcgcgtcaatgcggagctgttcacgctcacgtacggcgccatcgtgcggcagttgctcacggatctggaggaggtcgaggaggtcaacaagcagctcgatcagatgggttacaacattggaacacgattggttgatgagttcttagcaaagtcaaatgtatcaaggtgtgttgacttcaaggagactgccgatgttattgcgaagcttggcttcaaaatgttcttgggcgtgactgcaaccgtgaccaattgggatgctgagggtacaagttgcagccttgtcctggaagacaaccctcttgttgatttcgttgagctccctgacacttgccaaggccttcagtattgcaatttgttaagtggagttattaggggggcattggaaatggtgtctatgaaggcggaggtgacatgggtgcgtgacatgcttcgcggggacgatgcctatgagatgcgggtgaagcttatcaagcaagtccc

SEQ ID NO: 12133 - DNA, 628 bp, Zea mays
  Clone ID: LIB3279-204-Q1-K6-D10
gtgggttggcttctcctcccccccggttcgtgttcaggttctggttcgtgggcgagagggaagagaggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggcggtggcggtggaggctacggcggtggtcgtggaggctacggcggcggtgggggatacggtggtgcaaaccgcggcggcggctacggcaacaacgacgggaactggaggaactgagcggtggggtccgctgaggcctagttatcttgttcgcttctgctaccgtgttcaccctagtctagagggggtttatcttcgtctgtggtcgtcttcgtgtccggttgtttcgtttcggggtcggtt

SEQ ID NO: 12134 - DNA, 612 bp, Zea mays
  unsure (1)..(612): unsure at all n locations; Clone ID: LIB3279-204-Q1-K6-D11
ngtcccccanaaaacaactcctccccaaaccagctgccaccaactcgccgtcctccgcgccaagcaccaaagctccgatggcccgcactaaacagacggcgcgcaagtcgacgggcggcaaggcgccccgcaagcagctggcgaccaaggcggcgcgcaagtctgcgccggccaccggcggcgtgaagaagccccaccgcttccgccccggcaccgtcgcgctccgggagatccgcaagtaccagaagagcacggagctgctcatccgcaagttgcccttccagcgcctcgtccgtgagatcgcgcaggacttcaagaccgatctccgcttccagtcctccgccgtcgccgcgctgcaggaggccgccgaggcctacctcgtggggctctttgaggacactaacctctgcgccatccacgccaagcgcgtcaccatcatgcccaaggacatccagctcgcgcgccgcatcaggggagagagggcctgagcgaggcgagctcctctcaccgcaggcggcgtcgttgttgcttcgggcctgcttgtaggacttgtgcttctcttggtttcctttctggtggcagtggcatcttggtaccattgtgcttgttctt

SEQ ID NO: 12135 - DNA, 423 bp, Zea mays
  unsure (1)..(423): unsure at all n locations; Clone ID: LIB3279-204-Q1-K6-D12
ngcgatcccgtgtctggttcgcgcgatggcgngagagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtcaagggcgtcgttagccccgtctacgaccgcttcggcggcctgccgctcgacgtcctcgccttcgtcgaccgcaaggtggacgacacggtgcacgaggtggacaagcacctcccgggcgcgctgaaagcggcgtccgcgcatgtctacccggtggttccggggcgtgcccgaagtggcgc

SEQ ID NO: 12136 - DNA, 622 bp, Zea mays
  unsure (1)..(622): unsure at all n locations; Clone ID: LIB3279-204-Q1-K6-D2
ncttacgccgccgctcgctccacgcgcaggagctgctgctgccgctcacccacccccgctcgcgcagaaggccgccgcagctctcactactggtgccctaaacgccgatacccctcttcgcctccctttccccacccaaaaccccggccttcagggttccggcaccatgccgcagggagatcacatcgagctgcaccagaagcgccatggcaagcgcctggaccacgaagagcgcaagcgcaagcgcgaggcccgcgaggtgcacaggcgctcgaaggatgcccgcaatttgattggtgctaagggcaagaggttcgccaagaaacgctatgctgagaaggcacagatgaagaagaactctgaaaatgcacgacgaatcaaataaacgacagaaggttgatgatgatgtccaagagggtgctcttcctccgtatctgctggatcgtgatcagacacagcgtgctaaggttctcagcaacacaataaagcaaaagaggaaggagaaggctggcaaatgggatgttcctctgccaaagtcaggcctgtagctgaagaagaaagttcaaggttctacgaactggcaagcgaaaaaccaagcagtggaagagaatggttactaaag

SEQ ID NO: 12137 - DNA, 618 bp, Zea mays
  unsure (1)..(618): unsure at all n locations; Clone ID: LIB3279-204-Q1-K6-D3
ccgggtcgcccagcgtccgggcgctggcatcctggcgggccaccgttcgaacgtgcggagagccgaanaacgggagagatggctcgtaccaagcagactgctcgcaagtccacgggagggaaggctcccaggaagcagcttgccaccaaggctgcccgtaagtctgcccccaccactggtggagtgaagaagcctcaccgctaccgccctggaactgttgccctccgtgagatccgcaagtatcagaagagcactgagctgctgatcaggaagctgcccttccagaggctcgtcagggaaattgcacaggacttcaaaactgatttgcgtttccagagccatgcggtgcttgccctccaggaggctgctgaggcataccttgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgagtagggtttgttttgtggatcgcaagtttctcttctgctactgttgctgct

SEQ ID NO: 12138 - DNA, 637 bp, Zea mays
  unsure (1)..(637): unsure at all n locations; Clone ID: LIB3279-204-Q1-K6-D4
cccgggntcgcccagcgtccggtcgggcttggtgagcctctgctccaagctcttcgcgttgctccgcaagtcccgcgccctcgccaccagcaccgccgccgcagccgccgcgacaacctccgcgacggcgtcggccaacgggatggaggaggctgtcgccgcggcgggcccgctgcgcacgcgcgtctgcatcatcggcagcggcccagccgcgcacacggcggccgtctacgccgcgcgcgccgagctcaagcccgtcctcttcgagggctggctcgccaacgacatcgccgcgggtggacagctcaccaccaccaccgacgtcgagaacttcccgggcttccccgacggcatcctcggcgccgacctcatggatcgctgccgcgcgcagtcgctcaggttcgggaccaagatcctcaccgagaccgtcaccaccgtggacttctccgcccgccccttccgtgtcgcctccgacgacaccgttgtgcacgccgactccgtcgtcgtcgccacgggcgccgtcgcgcgcaggctgcacttcgccggctccgacgccttctggaaccggggcatctccgcctgcgccgtctgcgacggggctgcgcctatcttccggaacaagcccatcgccgtcgtc

SEQ ID NO: 12139 - DNA, 653 bp, Zea mays
  unsure (1)..(653): unsure at all n locations; Clone ID: LIB3279-204-Q1-K6-D6
cccgggntcgccccgcgtccgccccgcgtccgcctttctctcagtccaacgaaccctcggnggcacggttcggttcgacgacatgctgtctggcgtgaagctggttccgcgagaccagatccagtctgatcagaagcgtaggggtgaccagggctccgattccgactcctccgacggcaagaggccgtggaagcacagtaaaagagggcgggacaagaaagagaagaagagacgaagcagccggcggcagcggaggcggagcaagaggtactcgtcggaagattctttggggtcagacaccgacgattcaatcggagaggaagaggaggatgatgtcagtcggagcaagcgtcgcgggaaggacaggaggcggcgacgcaacttctctgacgacgatgattccgaatccggcgaatctgaccggggaagagcctctcgcagggggaagcagagacgtgatgacgaggatgaggaggaagagactgaaggtgatgggcttagggcaagtgaggtggtcaggagggagatggggcttgaatggatgctcaagccagcaagcagcagccaaactgagggcaccggtgttcgtaaggttgataatgtcgagaaggatgaatctgcacatgaagagattatgagaccgaacccaaggc

SEQ ID NO: 12140 - DNA, 614 bp, Zea mays
  unsure (1)..(614): unsure at all n locations; Clone ID: LIB3279-204-Q1-K6-D7
cttcgccgccccggtccctgtccagcggnacaacggcaagtggatgcgggtggacaacgtgcgtagcgcggtccccctcgtgtccttcctggagcacggaagctgcaacaggacgcggggggcgccggccttgctcataaggtccgtcgtgcaagagccggtcgaggacgaggacatgcagccgggcggcggcgctcgggccacggccacggccacgacggcggcgtgcggcctgccggccgagccgacggtgcgcctcgtcggcccggaagggaggtgcgtggacgtgccttacggctactactacaacggcaaccaggtgcagctgtggagctgcaagtccaccagcgccgtgaaccagctctggacgctcaagagggacggcaccatccggtccaacggcaaatgcctgaccagcagcggcgacgcggccggcgcccgcgtggtggtcgacgactgcccgcgcttccccacgggccgcgtcgtctgggaggtgcgcgtggacggtaccgtcgcgctcaagtggtcccgcggcctggtgctggccgtgacctcgtcgacgctcttcgcggggctcacggtgcggcaggacgaccgcggcaccggccagtcgt

SEQ ID NO: 12141 - DNA, 612 bp, Zea mays
  Clone ID: LIB3279-204-Q1-K6-D8
cggccgcgtgggccgccgccaagccgaagcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggcttcgtacaagctctcggacgccgccaagaaggcatcccccaagaccaaggctaagccggcaaaggccgccgctgccaagaccaccgcccccaagccggccaaggccgccgccgccaagtcaaagaaggcagcggctgccaagccaaagaaggccgctgctgctgggaccaagcgcaaagtgcccgagaagaaggtcgtggcgaagccgaagaagtcccccgccgccaaggccaaggccaagccgaagaccgtgaagtcccctgcctccaagaaggcacggaaggcctccgcatgagatgggttgctttaggtctaagctctgattgtggttggtgtcagttaggtactgtacaaactaagtgtgtgcccaaa

SEQ ID NO: 12142 - DNA, 595 bp, Zea mays
  unsure (1)..(595): unsure at all n locations; Clone ID: LIB3279-204-Q1-K6-D9
ccccgcgtccgcttccaaaaggcanagcagagcccgcacgcggagaggctacagaagggtatgggtcacctccgcggcctcaccgccgcgcggctcctcgcggcggccttcctgctctccgttgccgtcccggccgccagagcccaggaagaaaccgagcacgaggaggagttcagctacgtcgtcggcgacgagaacgggccggagcactggggcagcatcaaggcggagtggggcaactgcagcgccgggcggatgcagtcccccatcgacctctcccacgagcgcgtctcgctggtgcggtccctcggctacctcacccactcctaccgccccgccgaggccgccatcgccaaccgcggccacgacatcatggtgaggttcaagggcgacgccggcttcctggtgatcaacggcacggcgtactacctgaagcagatgcactggcactcgcccaccgagcacaccgtcgacggccgcaggtacgacatggagctgcacctggtgcacgagagctcggcgaacaaggcggcggtgatcggcatgctctacgagatcggcgccgaggacccgttcctgcaagcgctggagccgt

SEQ ID NO: 12143 - DNA, 617 bp, Zea mays
  unsure (1)..(617): unsure at all n locations; Clone ID: LIB3279-204-Q1-K6-E10
tccgcccacgcgtccgcccacgcgtccgnaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctncccgtgctactacgacggccgctactggaccatgtggaagctgcccatgttcggctgcaacgacgccacccaggtgtacaaggagctgcaggaggccatcaaatcctacccggacgccttccaccgggttatcgggttggacaacatcaagcagacgcagtgcgttagttttatcggctacaagcccccgggcagcgactagaccgggcccggcggccgccccccgc

SEQ ID NO: 12144 - DNA, 629 bp, Zea mays
  Clone ID: LIB3279-204-Q1-K6-E11
gcgggtcagcggcttccattgtagtcccaagccggcgtgaccattccaaatcttccgcacccatctctcgccgcctcgcctgcaccggagactggccctagtgcccgcgcgcctgcgaggtatcgaacacccaaagatggcaatggcaaccttcacatcatccccagttctctgcagcttcaggaccatcgaacagaagaaggcccctctgctgaacaacagcacaaaacggccgcttcacttgggcttcccaaggagcgtgccgacgtcgccgagcttcagagcgaggctagacctgcgcgtcgccgctgtctacaaggtgaagctcatcggccccgaaggcaggagagcgtgctcgacgtgccagaggacagctacatcctggacgcggccgaggaggccggtctcgacctgccctactcctgccgcgccggcgcgtgctccacgtgcgccggcaagctcctggagggctccgtcgaccaggcagaccagtcgttcctcgacgaggcgcaggtcggtgccgggtacgcgctcacctgcgtcgcgtacccgacgtccgactgcgtcatccagacgcacagggaggaagacttgtactagcccgggctggtccccgtgcatggatcaac

SEQ ID NO: 12145 - DNA, 625 bp, Zea mays
  unsure (1)..(625): unsure at all n locations; Clone ID: LIB3279-204-Q1-K6-E9
tgcccagcgtccnganatttccacaccttgncatcataaacgacttgcttgaggaggaccagatcaacggcagtataccggagtcgtttcgtcaagactacaacgtgtttggcctgccgttttcaccgagaggaaacttgtcagacatggaaatggcttctgttagaagtcccgctcggttcaattcacccaagtacgatggtggattgtcgggggcttatgacatgaatgctgtcaatgggttgagggaacggcagtttccctcgttggatatctactctaatggcctgtctgacgtgagtgcttctaagccttggctgaatggctctgccagtccatcggtgagccttggggtcaacacaaatggataccacccccaggtgggtgagtacctgggaggtggggtgaacggggtctccttgtggcgccgccatgccaacggccgctggtaatgcgaggtgcctgtatacaatcatacagtcggaataatgttttgttgtaacagatggtttcgggcctgagctgatgcgccatgtaattaaaagtttttaagttttaaaagggaaaagaagagatacaccctgtaaagtctgcgcctttattaggataatttgagtgcttttct

SEQ ID NO: 12146 - DNA, 633 bp, Zea mays
  Clone ID: LIB3279-204-Q1-K6-F10
agcgtccgcccagcgtccgcccagcgtccgctggtcctgcaactaatagatcttccaagttagatatgctttttgctaacaagctgcatgctttcgtggagtacgaaactcctgaggatgctgcgaaggctattttggagctcatgatgagaaaaatggagaaagggcttagagttcggttgctgaatacttgcacggtgaagggagcaggcaaaggaaaaaacggaatgaatgaaactgatggaaatagtgaggaggatgtctccactttgaaccattctaacgagaaacagtttgaacaatcctctcaactgttagatgtactgccggaacacttgtttgatgagaatttcaacaaggaagttcccaagcgcggcaaagggcgcagtcgcggtggcagagggcatgggcgtggcaaccatcaatataacaatcaccatcacaataaccagcaccaccagaacaaccagccgcagtacaataaccatggcaacaaccaccttggtgggaaccgtggcagccttcactctgttggaactacaccgaataacctgataaccaagcttgagccgcatccgcagctgcctattggggccaacaagcttccaccaagcccccgcatgcctgatggca

SEQ ID NO: 12147 - DNA, 636 bp, Zea mays
  Clone ID: LIB3279-204-Q1-K6-F11
cttattgcttggtcctctctttcgcagttcgatgccattcctccagagattggcatttcacggaattcaggcagtaagaaaactaagaagaggaaggagcaaggagaaaagctggagcagtgaaaatcagtacatggacattggcgcggcttaatgcagaggaagtctcaaaggcagccgcggaggcaaggaagaaatccaaaatcctgaaaccagttggaaaacatggcgccccagagaacagcagcaaaccagaccatttgcctagctacaagagacggctagacaggagaggtttccctgctgaactctctcttgacccacttgcaactctatccgcaagcggcaccgaaagcaactacagcgacgcagcaacagaaatctgtggcagtctagccccgttacagctcgaagcgagaagtgctttccaaccgagtactgcagcgtccacaagaaatgttgcttcatcgcctgaaagtagctttgactcaccaaatctccaccccttccgcacttcctcggccacagctgatgagatgcagggagccatgatgcatacagctcacaggggcatcgagtttaaaagatcgtcaagcgatgggttatgaagcatcaggaggtgaagatagtgaccgc

SEQ ID NO: 12148 - DNA, 557 bp, Zea mays
  unsure (1)..(557): unsure at all n locations; Clone ID: LIB3279-204-Q1-K6-F12
tcagggggaggccggcaaggacctcgngggcgacgacgacaagggcccggcgcggtacagctaccgcatcggcctctcctcccaggctttcaagatggaccagatcaaggctgacatgaagaacggcgtgctcagggtcaccgtccctgagatcaaggacgaggagcgcaaggacgtcttcgagatcaagatcgagtagggtgtgtgcatcggatgggtcctcccaggtctcctagttgcagtccatatccataccgtagttgcagtccatatccatatcgtagttgccatgagctagtcgtattagtagtttcaattactggagtgcagtagtcgtttctgttgcagagcagtcgtagtactagtagctttctggtggtgctccgtctctgcctgatctgaggcagcgtttacctttctgttggtcttgcaaagttcagttccctggatggcgacgatcactgacgatcttgtgatgaacttcaaatggtaatggaatctgcagttaataatcgacatctatatgaccttcctgtgatcgtaaaaaaaaaaaatat

SEQ ID NO: 12149 - DNA, 597 bp, Zea mays
  unsure (1)..(597): unsure at all n locations; Clone ID: LIB3279-204-Q1-K6-F2
cccagcgtccgcggccgcgtgggcggncgcgtgggcggtactgaacagggctctcaataaagagagttgcaagccgaagtcggattgcctgtggactcgagcatccctgttatagttttcgtcgggcgtctcgaagaacagaagggtccgacatactcattgcagccattccagagttcgtgggcgagaatgtccagataatcgttcttggcacgggaaagaagaagatggaggaggaactaacgcagctggaagtgaaatatccaaacaacgctagaggcatagcgaaattcaatgttccattggcacacatgatgtttgccggggctgacttcattatcgtcccgagcaggtttgagccatgtggtctcattcagctgcaagggatgagatatggagtgattcccatctgttcatccactggaggacttgtcgacacggttgaggagggtgtcaccggattccacatgggttctttcaatgtcgagtgtgaaactgtagacccagccgacgtgacagcagtagcgtaagccgttacgcgagccctgaagcatacgacaccccggcatttcatgagatggttcaaaactgcatggg

SEQ ID NO: 12150 - DNA, 603 bp, Zea mays
  unsure (1)..(603): unsure at all n locations; Clone ID: LIB3279-204-Q1-K6-F3
gtttcacanagcaaggcgatgctattgtttttgaatcagaagttgacaaagtttaccttgctgcaccctccaaattgctatcattgatcatgagaagaaaagaacatttgtcgtgacaaaagaagggcttcctgatgctgttgtttggaacccttgggacaagaaggcaaaagcaatgcaagattttggggatgcagaatacaagagcatgctgtgtgtggagcctgcatctgttgagaggcctattactctgaaacctggtgaagagtggaaaggaaggcttgtgctctcagctgttccctcgagttactgtagtggacagttagatccattgaaggtccttgagggctgaaaatccttactttctgcctattgtacagaagttcattgcccttactatttgatgctgggctagcgtgtacgccggatcgtgcttttgccatttgcaccacccgctatatctctggtcctttttgtatctagagtcttgagtgataggatgattgcgaataacagactgggctttgagcttagccttgggtaatgtgattggtgaatgctgaatggtacaaaatactggcatacgtgtcagttttataaatc

SEQ ID NO: 12151 - DNA, 567 bp, Zea mays
  Clone ID: LIB3279-204-Q1-K6-F5
ctcccacatccgatcacggaatccttagttcatgcgatgatccgcgagcactcataaagtgtggcaagggcgtggatggaattgtgcaacagtgacaccaagcgtaacacgtagagctatccgttacaacattcattgcataacctaacactggaaacagactctgtcaaggtggggcaaggttataatcatttattggctgatctaaaacaatacctgaggaccgctagatacttaattggtacaaacaatcaaaggatcaccaacatacacaatgctcgccctaagcaaacacccaacagtcatggacctaacatacaccataaaccaccaactatttatcctttaccgttactgaagctcaaaggttctacactcaatggacagcggatccaaagaaaaacttaaaattcaagaaatgaactatatccaggttcaattgatgatgtacgctgtattattataaatagtcattatatgtacaatatgttacttctgactactataagccaatggcaaacacttatatatgaatgcagaatcttcctgttgcctgatgagcaaggt

SEQ ID NO: 12152 - DNA, 614 bp, Zea mays
  Clone ID: LIB3279-204-Q1-K6-F6
acgtgctctcttgtctgcggccaacatacagctcactggcgagccgtggacgctcggccagctctgctggccgactaaggagggcgtcgtgggcctcaccgccggcgagtccgtccctgcgggtgggcgcactgccgtcggtcgggtccgtcggttgtccagcacagctacaagttgaggagctctgcagtaaaggaagtgtgtagtcaccatggtccatttcaagaataggtatatggtggtggagatctttatagatgcaggcagaggtgaacaggaccctgtaatcctcacccaatttaatataacaaaagttataaaagacagcattcagctcaactttggtgagtgtggcctagctggatctcttggatcattgcaagttaagtatgttaatcctgtaacgaagctctgcatcgtccgcgtgtctcgcgaagaccaccagaaagtttgggctgctatgacgatggtgcggtgcattgggaagatccccgtttcgttcaacttgctcgacatgagtggaagcatcagggcttgcaagaaagctgcactggagtgcgatgaagcgaaatttgagcaatacaagctggctgcaggtgattgtatcacggcag

SEQ ID NO: 12153 - DNA, 629 bp, Zea mays
  unsure (1)..(629): unsure at all n locations; Clone ID: LIB3279-204-Q1-K6-F7
ccncccgcctccgccgccgccaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaacccaaggccaaggcccaagccaagcctgtcgctcctgccgccgcgtcgcccaaccccgcggg

SEQ ID NO: 12154 - DNA, 446 bp, Zea mays
  unsure (1)..(446): unsure at all n locations; Clone ID: LIB3279-204-Q1-K6-F8
gcatacagctctttggcgccacaatcatggtccatgttgtgcgnaatgttgcctgtggtggttgttgtgaagaactgaatggagctcctagtggtgatgctacggctgatggcagtgtcggaaaagagtctaaaccatgcacctgtacttgaagatgccttttaagtctgggagtgtgggtttctactaccaaagtacaagtgttggtgcatgcagagtttatctgtagctacatttagtaggctgtggggggagtattaccgttgcaagttgcaacccatggctgtagtttagttaacagaacacttcatattgttggttggttggttcaattctgggagtttggtcgtatcactttcttctgctctgctgttgcaattgcattgcgcgcaactatatgtgggtttaatttggtaatgatatgggtcaatgacccttcccccgct

SEQ ID NO: 12155 - DNA, 622 bp, Zea mays
  unsure (1)..(622): unsure at all n locations; Clone ID: LIB3279-204-Q1-K6-G10
gttctaggacgcgagcggccgcccgcgnactaggtctaatctctgtgtaacgactaacgacttgcgcctttattacacactatgatttttaggaacaatcggcacatattagtacttagattatgctctatgaatttttgcagtgttaggcctgtttagaactttagatcttcaagtatgaacagaacaaatatatgctagaactgtacaataacttcaactggaaagaaaaacaagatctgaattttttagctgtccgttttccaagaataaagtttttgtttttttaaaaaagggaagaaaacagaattcttagctgtcacaagagtataaatgtgtttgtctttcttctgctagaaaagaagctgatgagctgtaacacgctcaaaacatctccacatgcatgtgtggtgttccgctcctttggcataactatgggtccgcaaccgcaacatttttgtttgccagcaaagaatcctcagctgttatttccaatcacctttgtatctttgcgagtgattgcatggcatgtgcgctacaaaacaatctagacagaattatatataggagtgaagagaaacctgaatgctagccaacggttcggttctttaaccatcgcctg

SEQ ID NO: 12156 - DNA, 644 bp, Zea mays
  Clone ID: LIB3279-204-Q1-K6-G11
tcgccccgcgtccgcggccgcgtgggatccaaagccaaaaccccaatcgcacaggagagaccgagagagaggttttccatccatggctcccggcgtcgcttccgtgctggtcccgcaggagcccgtcctcctcaaggacatcctcgcctcaccgtccccctgcgggaacaccgctgtctccgcccgccacctcttcggcaacggagtcgcgccgccacgctcctcggacgacggcatcaaggacgccgctgccgaccgccacggtgaccgcgacctctccatccccaagatcttcaccggagacgtgctggacctgctcgacgatgctgcgaggctggacctgatgctggcgctgacgggggacggcggtgcggcgtccatggccggcttctccgcgcgcgggtggtgggtctcgaaggaggatggcgacgcggtgcagctgaaggtgccgatgccggggctggggaaggatgcacgtgaagatgcgggtggagaaggacgccctggtgatcaagggggaggccggcaaggacctcgagggcgacgacgacaagggcccggcgcggtacagctaccgcatcggcctctcctcccaggctttcaagatggaccagatcaaggctgacatgaagaacggcgtgctc

SEQ ID NO: 12157 - DNA, 672 bp, Zea mays
  unsure (1)..(672): unsure at all n locations; Clone ID: LIB3279-204-Q1-K6-G12
tctcgcccacgccgtccgcccaaaccctnnaacagcccaccncncnnctccgcgacgaggnaggcagnagtgggggcnnttaaaccctaccgccnncccgaagcccagcnnggcggccatgaagacnngctgtgccccaagcccgngaaaggggcggcaaggatccacnnccttcgcccgccgaggaccccaccgcggnncggcattccgcctcctcccggccccgccatcctcgtcctcgtcgccgggcttgtgcccncgaggaccagcgggtgnctggcccacctcgtcacgcgctcgttcctgctgggctgggacaccatcacggcgccgccgccggagcaggcgcgcgggggcccgcgtcgcaggcgcggccacccgcccaccgtcgggtgcctgtgcttccagtgctacggcagcttctggtcgcggtgggactgctccccgcagcacgaccgcatacacgccgtcctcgacgccttcgaggagcacctcaacgccgccgagtccgccgccgccgccaccgccacccctccctcctccaagcgccgcgacaagggaaagcgcagcagggctcctgccgctactacacctncgccacagccgccgacgcggggcagccccngatcccaggagcccccatccgaggtggcgcatgaaccctcggcgccg

SEQ ID NO: 12158 - DNA, 640 bp, Zea mays
  unsure (1)..(640): unsure at all n locations; Clone ID: LIB3279-204-Q1-K6-G9
ngatcgnttcagttatatcatgatcaaaagacacgttagnatatctattagtataatgttttatctaaatacgaggaataccatccggttggcgcgtcgatgtcgagcgcttgtgccatgtatgcaacattctagtggccaatgccgtggacacgagtcacgtcatgacagagatgcactctcggccatagctcaagacgacgggatgaagaacctcatgagcgagatgataggagtactgattgacaagcccaagagcatgacgctcagtagggacatacctcggtcacccccaacaggttcaatactctgttgttgacgcgtacgtgtcctaaaacattggccggctagcgtgcgcaaaatactgtcggtgcaatgatctcgcaatatactatgatgcaacatcggccccgtttaaatgctctagagctaatatatactatgacgtgacttaggcatcgtttaaatgcatagagttaatagttagttaggtacaaagttgctagtggaattagctaactaacaaatagctacctaagtgttacacccggttttagaaggtaaaccaaatgcaaaccatgtacattacaggattagcaattcatgtacacaacaattacatagctggacatcatcacac

SEQ ID NO: 12159 - DNA, 624 bp, Zea mays
  unsure (1)..(624): unsure at all n locations; Clone ID: LIB3279-204-Q1-K6-H10
gggnaatcgttcagggttcagcaagtaagacaaagcccggttcctccagttcgtcactggcacttcaaaggtccgttggaaggttttagtgcacttcaaggatctctgggccacaaaggtttcagatacataaggcctacggcagcacgaaccatctgccttcagctcatacttgctttaaccaactagacttgcctgagtacacatccaaagagcagctccaggagcggttactgttggcaatccacgaagcaaatgaaggtttcggatttggctaatcagttatactcgtttgtccgtgccctgagaactgcaaataggcgagcagcacgtgtgtggctgatctcattctgaactccacgtgtgtgatgagagatggccggagagaacatgtccaggatagacgaatgcccgtgggagaggtactactgttaagagagagagcgacgattttgtgtttataatctttgtccgtttgtagtttttgccttacattggtcgttgctccgaagtttttccccttcttttcgttcatagactggtgtaagttgtaaccgaacttatgtcaaatgcaggtcatcttacgctggaatgttatacctcccataatctgttaaaacaact

SEQ ID NO: 12160 - DNA, 632 bp, Zea mays
  unsure (1)..(632): unsure at all n locations; Clone ID: LIB3279-204-Q1-K6-H11
gnacaccaggctagttctctacttcagcagctgctgtctctctgctgctgctcctgctgccctctcctcttcgtctccgggagcatctatcaggaaacaatgctgtcagcgccaacaacttccaccccatctttctggtagctgggatgagctgcagcgacctggaggcacgtctcaccgaggagtaccggccgtcggtgccgcattgcggcgccatgaagggcaagcggtggttcggtctgtggaagaacagttcggagctgctgtctcgtgactacatgcagtgcttcgaggagcagatgagcctcgtctacgaccctgacatcaacgagtaccggaacctcgccggcgtcgagacacgagtgcccaacttcggctccacaagagccttcagctacaagaaccctctcaagtcagactggtgcctcggaaagctgagagccgcactggaagacatgggataccgagacggagacaccatgttcggagccccctacgacttccgctacgcgccgccgtcccccggccagacgtccgaggtgtactcccgctacttcaaggagctgatggagctggtcgaggccgcgagcgagaggacccggaagaagccgtcatcctcggccacagcttcg

SEQ ID NO: 12161 - DNA, 479 bp, Zea mays
  Clone ID: LIB3279-204-Q1-K6-H12
tccgctaccatctagggtttctagggttttcgaggagggaggaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatacggcggcggcgaccgcggttacggcggcggcggtgaccgcggctacggaggaggaggcgaccgtggctactgcggcggcgaccgtggttactgtggaggtggcgaccgtagctacggcggtaaccgtggctacggaggaggctgtggttttggcg

SEQ ID NO: 12162 - DNA, 467 bp, Zea mays
  unsure (1)..(467): unsure at all n locations; Clone ID: LIB3279-204-Q1-K6-H2
gngactcacaaccgnaanaaggacgtgagnacaaccggtcgccgactccaggttatgataatatcaagcgccctgcaccccagcaaggctgactgccgccgtcgagcagtatctcatggaacacggccttctgtacacgcaggtgcaaccaggcctgctccgcatcctgctctagtaatggaactggtcgtcctagctgttgttcacaactggatcagatgaaaaagaagggaaaaagaaaagaaaagaaaagataagttgacctgtacttttgtatatggcagagattgctagcaggatagtagcgttaagaacttaagatagctcatgtaacattcatgtcaggctttttgtcagcaaatgtatacgtcttaaaaaaaaaaaaaaaaaaaaaaaaaaaaaaaaaaaaaaaaaaaaaaaaaaaaaaaaaaaaccaaaaaaaaaaaaaaggggcgggccgttttaaa

SEQ ID NO: 12163 - DNA, 503 bp, Zea mays
  Clone ID: LIB3279-204-Q1-K6-H3
cggccgcgtgggtttctgctgaaagcaggcagatgattttcttaagaaacggagaagagctccaagagtaacacttaaagttgaagaagaactcaggcagctgctaaggagctgctggagcttcttgattccatggctgaacataaagagttcatggaaacaacaattgctcagaggaggaaggacctctatgaaactgcagattatatagcatctgtggcatccaagacagtcatcacccaagtacccaaccctcctgaatcctgatacctgaattatgcagtgatcttttcgcatagaaagttgatcatagcaggcctgtggcagccttctctggcatgtaatataagtcaaagttgtcccacttgaagctctggtctttttgtccttggactttggtttgcgttctggtgaggtagtagttggtatgttcgggcttcaatcctagatgtcatgaaactgttgtaatttcattgcttcagtaatgaactttggattggtcc

SEQ ID NO: 12164 - DNA, 621 bp, Zea mays
  unsure (1)..(621): unsure at all n locations; Clone ID: LIB3279-204-Q1-K6-H4
ctttccataattatggnaaaagggatgatgatagatgtataccttttgcttcattcattgcttaatgtgtgctcgtagaaatgtagagtctatgtgataccacaacatgatgggttttgagacatttcatacaacaacaacaacatagccttttagtcccaagcaagttggggtaggctagagttgaaacccaacaagttatcaccaaaaggataaagagagagaaaggggaggggaaaagcttttgagagcactaaaagaaaaaagcctaatcacggttcagtctcgtggatagcttctttccaagcacttctatccaaacacaactccattgggatattccatccttcaagtcccttttgattgcctcctcccatgtcaagtttggtcgacttttacctctcttcacattattgtcctgtcttatgatgtctctatgtaccggtgcctctgagggtctccggtagacatgcccaaaccatctcaaccggtgttgaataagcttttcttcaattggcgctactcctagccgatcgcgtatgtcatcgttttcttactcggtccaatcttgtgtacccacatatccaacgcaacatacacatctctgcgacacttagttgt

SEQ ID NO: 12165 - DNA, 339 bp, Zea mays
  Clone ID: LIB3279-204-Q1-K6-H5
gcctcggccagccacctccccgtcgctctcacgctcttcgtgcccgccgcctcccctcttcccctccacctcactcctcccgtctgacgcacatggcctccatcgccggatcttccgctctctccttcgccatgcctgtcaaggcaatcaactcaaattctctagccttctccccggtgaggaagggtaacacattcctccgcctgcaaccagtgcctatgagatctgtttcctgcgctgccaagaaggatacggtggacaaggtttgtgaaattgtgaagaagcagcttgctcttcctgaccacactgaagtttgtggtgaatcgaaattctctgaac

SEQ ID NO: 12166 - DNA, 600 bp, Zea mays
  unsure (1)..(600): unsure at all n locations; Clone ID: LIB3279-204-Q1-K6-H6
cgcggngccgccgcaacccagcgtcccccgnagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcggccaggtgtgccaggtgatcggcgccgtcgttgacgtgcgcttcgatgagggcctcccgcccatcctcacggcgctcgaggtgctcgacaacaacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgcatcataaatgttattggtgaaccgattgatgagaagggtgacataaag

SEQ ID NO: 12167 - DNA, 477 bp, Zea mays
  unsure (1)..(477): unsure at all n locations; Clone ID: LIB3279-204-Q1-K6-H7
gngnatttaggnagccatcccgcttcagttctagnaacagcaaggnaacaaaacaatgataaagtgaaaggtaccaaatcctcctgaaagtgatggcaaagaaccaagnaaannncacagaagctctggtnnagaagtggacattcgtcaaggnaaaacataagcatagagaaaagtctagtactcagcctgatgctatacctcaagctccagtcattcaagatttccttctgtagcatctgagagactcatttggtacacttgagttacccaatatatgtgttttttttgttccttaaagtttatgaattttcattctattttgacctgtggtgctgtttagtctttgatctgttgctggtcgtgctgtgccatactgtcataacacttgatgcaattgctctttgataggtctattgaaatatgttagttcatatgtcatactttagagggccaaacacagttttttatttagcc

SEQ ID NO: 12168 - DNA, 636 bp, Zea mays
  unsure (1)..(636): unsure at all n locations; Clone ID: LIB3279-204-Q1-K6-H8
nttcaccaaaatagctaataactaaactattagctagggtgtttggatgtttcaactaattttagccactaactattagctctagtgcattcaaataccccctagatctgtttatctgattactgacctaataaccccatgcttcctactcctatttactattgtgactttttacaagaggagtttgaaagcacatctcaatttgtttgtgcagattgttcattagtgttattgtttataaaatggtcaataaagaattgctattaattgagaagagaatctactaatggatgggccatgaaattgcatggtttttatttgcctgaaaagaatggagcctttcttgttgttttctgaatgatataactggacactgtagttgaagggcaagctttgaaaatgtcatccactgtgccgaagtcatcaaatatcttctggcatgattgcctagttggcaagactgatcgccagaaactactcaaccagaaaggctgtgttgtctggatcacaggccttagtggctcaggtaagcaaaccttgtttttctcgaactggtttgttgtgtgcttcttgctttgttgatgcaattgttaaaaaagttaagctaaaactaagataatgtcaactgcagttggt

SEQ ID NO: 12169 - DNA, 610 bp, Zea mays
  Clone ID: LIB3279-204-Q1-K6-H9
cacagctcaaggtccatctcaccaaattccccagccttccgccctcatttgagcagacacctaaagccgtggaggagctcaaacttgcaagggacatttatgagcatgctgttgttttgagtgtgaaacttgaggaccaagatgcatttgaacgtgatttctgtcagctaaagccttattacatggatacatgtggcataattcccccctcaccagaggagtacccaattttgggactcaatcttctgaggctgttggttcagaatagaattgctgagttccatactgagctggagcttttacctgtcaaggcacttgagcacccttgcatcaagcatgctgtagagcttgagcaatccttcatggagggtgcctacaaccgagtgttaagcgctcggcaagctgtgccacatgagacctatgtttacttcatggaccttctcgccaagacagttagagatgagatcgctgggtgcagcgaaaaggggtatgattccctatctgtaagtgatgcaaaacaaatgcttatgttcagttctgaccaagatctgcacgagtacatcacagaggagcacccggaatgggagcttaagaacggtgccgtcttctt

SEQ ID NO: 12170 - DNA, 525 bp, Zea mays
  Clone ID: LIB3279-204-Q1-N6-A1
aggagaaaatagaaccaaatgcttgtattattcttcttttttgactaattaaacagttctcaataaactaacacagctgacatctaacatcaggatgaaatataacaattgtgggaaaagatcttcctgcagtgctatcgattttaatgggaaaaatgactaagcgctacgacccatactgtccctcagcttcttaacaatgtcctaaagtttctgataacagaaaaggagaacaaaatggaagagctgataaatccaggccaacggcaccaatgtcagtggccacctctatcatactcatcatctagagctcgtcgtgctcctcagagtccttgtcatcctcggcatcagagtcggccttgtcatcgtctgccttgtcatcgtctgcctcatcctctaggtcatcatcgtcatcatcgccacccttggcggcttcctcttcttccttctttttctcagcctcatcgaaagcagtcttctctgcctccttgtgcttgccccatgtctcctctgcaaaagtcttgg

SEQ ID NO: 12171 - DNA, 604 bp, Zea mays
  Clone ID: LIB3279-204-Q1-N6-A11
acgccaacaaggatagtccataatatataggtaaactcatatagtcatatccctccagccaccatgcaaagcatactggtgcggttcacgcaagcagggcagactgacagggatcaggttacatagtacgccaagaatgtagctgcatgattctcagatgatgtggtccctgaatggtccttagaacattgcagatgtagcctcagcaacttccgttacaacttggtcatagtctgacttcagtttatccttcacctcgtcactgagctcccccttgtttggtttggtcagaaccaggacgcaacaagttggcctcttagtggttcctgcggtcgcaagatcctcttttgatggaacatatatgtaaggaacattagattcctcacatagtattggaacgtgtgtaatcacatcaataggagaaatatttccagcaatcacacacaaccctttgttcccgcggcgaatgctcttgactacctctttgactccgcgcttgaggcacttggcctcagaggctcgtcgcacgagcttgagggtccgcttgcagagcttctttccagcgaggggcttcgcgatgggcatcagcgccaccggggtcttc

SEQ ID NO: 12172 - DNA, 617 bp, Zea mays
  unsure (1)..(617): unsure at all n locations; Clone ID: LIB3279-204-Q1-N6-A12
aggcatgaacattatttttggaaaggtgttattacaaccgacaacgagcactttcttgccttggaaggcctcccttccctattgtagtcactcgagtgcataacttgcccttaaagctatcgattcactaagtgccagacaaaataggctatacattctctctagtggcaacaattagccattttggttggtgtggtactctattattgagtttttggcacggtacttccttgtagagtagaagacaaactcttcaccattgtagtcgttgatggggctagtggtgatgaaatccttggtgtggatgcaccggggaatcactattgtactcggcggcaatgacattaagactgaagaatgggcggatgtcgaattgaagcttagccctagagataaagttaacctacgagcataccaacaatttaaaattaagtagaaagtaaatatgaatactaataacatcacgaatttgctcaacaatggtcgtagaaggacgagcaacaaaacccatcactttcatgcaaagcttccccatctttttcctacttctataatctttntcaaaaactctctacgttctttttaggtttctttggaatttcctacctttttccgga

SEQ ID NO: 12173 - DNA, 537 bp, Zea mays
  Clone ID: LIB3279-204-Q1-N6-A2
cctggggaacgagattggagcagcgtatagtataagttaatagtttggatacaagcaataaaaagtcgaccatgctctcaatgagacatcttctacatacggacttgaaggcagcatggcagagaacattgttgtcaggaatgttcgaatgtgtctgtacattacacgaagcccgcgactcgaggcgtgctgttacgatctgggttgttacgccatctatgtttcgatcaggcagccttttcatcacaacggagggtagaagtaggatgaaacagaaaaccctaggaagagaacgcctccgatcgtcgcaaccgttcgctgcgagatcttggacgccagcatgctccctcctaccacggcgagagatgtgcacaccgtgtgccccagtgacgctcccactgcgactccgattgcgttcttgtgtgttgccagcgcgattgtcgctatttggctccggtcgccccattcagctaagaaggttaagatgaaagcctccaaaaagattggtgtacaaaatcttgcaaagaacctacggat

SEQ ID NO: 12174 - DNA, 515 bp, Zea mays
  Clone ID: LIB3279-204-Q1-N6-A3
atcaatcatgcgatatatgcgttcattacaacataacactgttcattacaacataacactctgaacatatgcaagccatcagttttcaccgtttcaccatcctaatgtggtcttttattgacccgagtgtactggactaaggtgcatcaacgtgcggcagaaccgcagaactacattcactgcctcaactgaagctagggcagataggtcccttggacaaaccaaggcgaacctccattccgtggtgcatgtcaggttgacggaaaccttcagaatcttgaggcatgttaagataatcttcaaaaccaaaatcatctagggaacctgtcagtgcctcatatccaagcagagatgatggcaaagcaccagggggcctttggaaccttgagaggatttgggcatcgagatccttgcggatgttcaaggcggatccgtagatggcctctgtcccaaacttcttcttgtccgcccagaacttggcctccgattggatgctggactggagcgggtgctgc

SEQ ID NO: 12175 - DNA, 499 bp, Zea mays
  Clone ID: LIB3279-204-Q1-N6-A4
agcaaaacgggatgaagaaatgtttattcaacaacgtatgatccatcagtccccctattacatactcgtggacgttatcaagggccaaaaaaaatgagtaggcttggagattacatcctaattagtacctccaactcgcagcaaagggaatatacccaaatgaatctgtaaaaaagtaggtaacagtacatcttcacatccttctgcgcgggtgggaatcctctctcccagggaaaggaaggtcagctttcgacaattgtcgaatgttttggagtaggagtcggcaaaagggtagtcagtcttgcaaatcccatcgttaatcgccctgtagacagtagagctggcggatattgcccgaagcgtataaccaatccttgaactgaacgtgaagggcagttgccaattcccttttccggttctcatcaagctgcaactcccgaatcatcttttggatatcttccagagcagaacgctttttgctttgggatgtccgataaat

SEQ ID NO: 12176 - DNA, 425 bp, Zea mays
  Clone ID: LIB3279-204-Q1-N6-A5
gattgaaattattaattacagaagatcagttgtagcttcagaaaagctcagattcattctgcaagcagaaatgcagaatgacccgtatctcgcatcactatcttattacacactttcgcaaacaagctccctacaaaaccaagccccacgccaatctgggcttacaaacacaaaattttggcaagaccgttttctcaacataaaccatacataaccgaagccggacgtatagcactgcatcaaaaagaatgataaatgcggccttaaaatcaggaaagtgtcagcatgacgtccttctaggcagcagcgacaatgatcctgatttgagggtgaatgggtgatgagtgcccccatccacttcaacgtaactgtcattttgtacaggacggttctgcgatcatagcttggctaacaccgcaaatgat

SEQ ID NO: 12177 - DNA, 540 bp, Zea mays
  Clone ID: LIB3279-204-Q1-N6-A6
caacaaaatcactaaactgaatcaggtttcaaacaagcaaatacatgcagtctcaaatgcgacctttcaatacataggttcagaacatttgcggcagggctaaaaacataggcccacaggaagacaaagtaatgtagtgaggaatataaggtggtctatggcatccacacgggtcctcttaagcaaagcttccaggttgggctctcttggtcatctggtttgggaagggactccaataagcaggctccaaacttcaatgtcttggctgtttttatagtacgtgaggggagcaggggtggcaaaggtgaaaataacaggtccatcagatagctgctttatcaagcaatctaaatcctaataaccatgacgctttccatagtgaagagaactatgaccagataacccactattagaggagcgagcactgtacccgctgtaagccccatatcctcttccaggtgcctgggagccgccataacttgcatagctgtcagaaggaatcgtgtcatccgatgtacgaaaaccacttgaatatagata

SEQ ID NO: 12178 - DNA, 545 bp, Zea mays
  Clone ID: LIB3279-204-Q1-N6-A7
agagacagaaacacgcatctacaagctttacatggtcagcgttctgaattacaattgtaaaaaaaaaagcatcccaaagcaaaagagcctacagagacctaaatccaggataaatattaggcgatggattgtacaacaggcagttattttatgttgtgcatgcgttcatgcagtgtttacatggcaccagctctgtcaccgacgggcatggcaccaacgtagcttgcttgatgctggttagcagcatacaagttccttcgcccacgattgtgcccgtcactttcaccatctgatgcctcagcaagccttgctatggcgtcaatcaacgactgttcttgctccttcagtgctttctttgccttttctacttcctgtggatcaggattgctaacgctaaaaactttccccacctcttttattaggctctcggtatgaaggatatcaatgtcatcggaacttctcttgccaacaccattttgtggaggtggaaaatctttcttaggcatgtttttctgtaatcctcttcctcttacagaacctggcat

SEQ ID NO: 12179 - DNA, 532 bp, Zea mays
  Clone ID: LIB3279-204-Q1-N6-A8
aaaatgattagtcttatatattaagattgagtgagtactactgatttctacttgctgaacaccctggatgaaaacagctagggaaccattcatacgtacaatacaatacaataaaaaaaagggccagatcatcggatttacagcctcataagatgacccatgtcttacgagtaggagggccttattgggacctccagaaaaaaaaaacgaaactgaaattttaagtagctggctacaaatccaaatgggcgaagatggccggcaccaagtcaaccacggaccacgcgaggctggcgtactggacgaacctgatgccggtgtccacgtcgtacgccttctgggggaagtgagagagaaggcgctggaggtgcccgccggcggcctgcctgctcttgctgctgccgccgtcgactttcagggcggggacgtagcaggacgacacgatggggatgcccagggtgctgcacatcacgggtagcagccacctggagagcgccttgctgcacgatttcacggccaggatggtcgggat

SEQ ID NO: 12180 - DNA, 435 bp, Zea mays
  Clone ID: LIB3279-204-Q1-N6-A9
aggacagactaataacatattctcaagcaacagcagagtatggtaagggcacaaaaaataattcatatagtgattatagctctgctagtagactaaaagtcgggccagaggatacaactcaaacaaaaaccttggaaggtgatcttgcgttcacatggagatgaagcgagagctgagttgcccccacaggtgaggtttaaatcgtgctggcctgagccttgttgaggatgacaccttcatacttgacctggaaccacttcatggagtcctccttggtcaccctatgctgaatcccaacacgggacttgcacctcctgcggcgcgcgacgcggtagccagcacgctcgagcacgacgtagaagtccatcccatagatgcctggtgatggatcatacttgataccaaggtcgatgtgctcctggatgcccaacccca

SEQ ID NO: 12181 - DNA, 505 bp, Zea mays
  unsure (1)..(505): unsure at all n locations; Clone ID: LIB3279-204-Q1-N6-B11
gatggcggcgcccagcagcagcagcgccacggccttggcgatgcaccacccggggttctccacgctctccaccgcctcatcggacctgtcaaccagctcgttgtgctcctgcctcgtcctctcgtggtattcattgatgaacttggtggagaaggcgccgcccacgggcacgctgcgcttggcctcgttgagccatttcttcatcccctgcacaaactcctcctgctcaacgacatcgttgcgggacgtgtcgaagtcgtccatgaccttgtccaccgcatccgtcctgtcaaagtcaacctcctcgaagttgataccgacgatgagggcgtgcagctcagcacgggacagggattcgctctggtccatgtcgatcttgcggaacagctntctgatgacgtcgtcattgggcgtgccatcgtcgtttagcagcccgccgagtgactgcatctgggcgtgcctcagtatcccagagattacgtgcttgtgctttgcgtatgcaagc

SEQ ID NO: 12182 - DNA, 570 bp, Zea mays
  Clone ID: LIB3279-204-Q1-N6-B12
gaagaatctcgtgcctggaacagctagctgtttgtacgtgaattaacgaactagtaccataatgcacaaacatgtgtgtgctgtaagaagaatgatgacgaagaaatcacaaagtctaagacgaccggtagatgctctagaacatgatcccggccgcgacggcgacgggtagcgcggcgagggcgacgaggcctccggcggcggtgacgcgtcccgcgggggacttggctgagcccgtcggcgtgttggcaggcacatctgggccgatagaagatggagagaggcctgccatgggcgccgcagtaggcaccaatccctcggggatagggaatccgaaagctgcgcaggcgctaacgggcggcgcggtgaggcggcagatccccgggagcgcgagcgcgcgcttgtagtcgacgctgacgccgtaggactcggcgccgccgcccagcagctggcagaggcagacggggtgggactcgagcagcccggccagctccgggcagcaggccgtgtccgggtgccgcgccttgctgcccggcgtcacgtacgtcaggcagtccgacatgttgagca

SEQ ID NO: 12183 - DNA, 572 bp, Zea mays
  Clone ID: LIB3279-204-Q1-N6-B2
acaagtgatctttcatgcgtcaaaaaatcttaaaacacatggctacatcagtcatatcaggttgtacaagcaaaaattgatgagtctgtctcagcataataaatacagatgctcggaatgtgtaaagataacacagacttggcatggcatatagtcaaaatttcaaaacttgaaaggagcaacgtctcgaaacttctatcacacgtcatccggcatagataacaagctgaagcagcattatcaaacttgctctcatggtatgcatttaagtgctagatgattgaacccttcgacttaatcctcatcctcaacaaccttagttcccaaacctttgagaccctccggagggatctcagctactgtgaccagagagtactgcccctccttggcgtcttcctcgtcgttcctcttgcgggcaatcctgacacggactcgcctcggcacactccggataccgctgctccagacgtgcttgttgagcttcacatcgatccggacatcggtggtacccatggtcttctgggcgaacttcctgatctccttgatggcattcggtcggacgcgtgggcgga

SEQ ID NO: 12184 - DNA, 356 bp, Zea mays
  Clone ID: LIB3279-204-Q1-N6-B3
gatggaaaaggaatgtgaattgaatgaaggaagctacgtataattttacactgtatcctgttgtcaggctattctcctgctgcctcttttaatatacagctacacggaataacagtgcgtgctccaacgacgcttttttcccctgcgttttagtacatctcttttctcttttttttggaggtttttttttctcacctaagagatgttagtacaccatcactcggagcagacccgcctgaggctgcgtgtactggaggccttcatccagcaggaactgctccacagctatgggcaacctcgcagtgcgagagcccttggtgtggtggcctgttccaacgcaaaccatgacttgcatc

SEQ ID NO: 12185 - DNA, 526 bp, Zea mays
  Clone ID: LIB3279-204-Q1-N6-B4
ggaggcggatcatttctagctttgcgcatacattagctgatcttacagacatgtgaattatcttacaggaatgagattagattccaggaatgcgctagcgaagacataaaaaaaccttttaacaaaacaacaactggtggaacctttaccaacatcaaagggttgatttcgcccttgggggcttaaggtaaccgccaggaaaaaaaaaaggggacgtattcctcaaaatttttttacatgccaacttttaagttgaaaattaagtaagttggttggatggagtaaacgctttttaaaaactgcacgggtggatttttttccaaggccgacgcgtaaataataaatttttgagtaaaactaaagggggggccccatcaactaatataatatgccaaaaaaaaacccggcaagcctttttttaaccaacggatggatgtaatgctaactgctggatcaaaaactcgaggtgcaaaaacaaatggaggcttagtccatgtaaagcttggggcctaaaaaactgcaacca

SEQ ID NO: 12186 - DNA, 487 bp, Zea mays
  Clone ID: LIB3279-204-Q1-N6-B5
ggaaccaatggcaagcctgataaggtggcctttttaaagggtttggtgcaaacaccagcccttgggagatttgaccccggttttaaaaggccacggcgggattacacggtttccggggaacaccccaattaggacaaaccttacccaattctttatttttggcacttaaggcaaattccaccttctggttgcaggggacttaacattaccattccggtgtatggattttgggaagggaaccatattcctttatttgaactttgcccaatccattttcggggggaatttttaagacaaccaaaggccccaattccccggcaacttcttggccccggaaaggacaacgtggaccttaacctaaggcccctttagggacccggacctgggcttgcttttgggccttgggttcccccccccgttcaagggccttaacccctcccaacactgggtggtgctctcccttgggttggcttgcttgcccttcaag

SEQ ID NO: 12187 - DNA, 341 bp, Zea mays
  Clone ID: LIB3279-204-Q1-N6-B6
cctctaaaactgttccatagttttatttgtattaaaactgatcagctggaatagtttcaggtcttaatcacagctaaccgaacgggatctgaaacagatagtacagtattgtagtaccctaatccggagctttattacacggtggttcagagtacaagagcacagcaagtctacatcgagcgccgcagggctagtcggcggcggcggctactcgaagttgtagtgcttgtcgacggcctcggcgacgtcccaggtgcagctcatgcccttggggaagacgacaaggtctcccgcgccgatctccacgaactcctccccgtggccttcggggtacaccttca

SEQ ID NO: 12188 - DNA, 468 bp, Zea mays
  Clone ID: LIB3279-204-Q1-N6-B7
ggggggggggggaaaaggtaaaaaacccaaaattttgtttccccccggggggaaaaaatttttaacccgggtttttttgttaaaaaaaaaaaaaaatctgaaaaaggggaaaaaaaatttttttttttaaaaaaagggacccttcccccaaaaatggggggggggtttttataaccaggggggacgttttttttttgggaaaaacggggggtttaaaaaaaaaatttggccctgggggggggggaaaaaaaaatttggcccctgggggggtgggcaaaaaccatggggaaccttgggggtgggggccccggtggggccgccccccttccccaagggggtttgggggcctaaaaaggggtgtcgctttttttgttatattttttgtccccaaggggttttttaagggggggggcctttgggggcccacatttttttggtggggggggacaaaaggtccctggggggggg

SEQ ID NO: 12189 - DNA, 571 bp, Zea mays
  Clone ID: LIB3279-204-Q1-N6-B8
caatcagggccaaataagaaattttttaaaacatgacaccgagcaaagcaatcgtcctaagttggggggcattttaccgcacattttaatccagggaaacagattggtaaacctagattgacatgtgtaaacaataaaaattcgaaattaggcattcacattgactccaagcatgtccatggctttgaaacgttttattggaaatgagctcattggaaggtgatccaggtgaaaaggccattttccaaacaaaaggcacgtaaaaaaaggtagcctcattagttttgtttgaggccatggaaggaattgctcgcaattgcccatgagcataaaaatgcggtttctaaatgtctccatcgtttattctaccattccacgctgcttgaagatttcaaacatggtagagccaatcttcgttggtgactcgacaacggtaacacctgcctttttgagtgccttgattttgtcctgggcagtaccctttcctcctgccacgatagctccagcatgacccatgcaacggcccgggggtgccgtaagtccagcaatgaatgcaacaacaggcttttgt

SEQ ID NO: 12190 - DNA, 403 bp, Zea mays
  Clone ID: LIB3279-204-Q1-N6-C1
ctcaaagcagctgtagagcatgtagcttccttcatcgtttcaaaagcattacataagcagcaaaaccagaaataatcctctaggtgaataagcagacacaatacgaccccgcacacgtaccacttattaggacagtgacagtacagtacaaatgataagcaaggggcagatcaagaatcacaacacgtaggagccataaaaaagcatgatagagcgcaggcagaccagaccaaaagcttcttccgaaacagaggaggcgcctcatgcagaagacggcttctccgccttgaggggcttcaccacctcccaggtgaagtcggggtcgtccctcccaaagtgcccgtaggccgccgtcttgaggtagcgcccgttgccgcctttcttgaggtcgaggttgatgatg

SEQ ID NO: 12191 - DNA, 489 bp, Zea mays
  Clone ID: LIB3279-204-Q1-N6-C11
ggagaaccaaccataaacgttctttggttgagctcattttttgtttcaagaaagtccacggtctcatttttttcggggtgttgccatgaaaaaaacaacttattccttcaatatacatgggtccagttccaatgacgtaaaaattaccaacgtgatgaaaccagagtttttgtccggtgtaacatttccccaaaataccaattttttgcttacaagttcgtttttggcttggatgtcgggctcaagcgccttgtcacggggcgcatggtcacaaactttttaacagcggaagggtggattcccacagtgctgtcaaagtctgctttggtggctccacatttaaccgcaatagcgatgccctggataatttcaggggcgtttggtccacacatggatgcaccaagtactttgtcagtttcagcatcaactaccagtttcatgatagtcttctcctggcgcttggatatgctgttcttcattgggttgaat

SEQ ID NO: 12192 - DNA, 475 bp, Zea mays
  Clone ID: LIB3279-204-Q1-N6-C3
agactataagtgttcttcattgattcatggttgtataacaaactaaccatcctgtcaaaaaatatagcagtcaattttgcttaattgcagcgtacatatccttcagagagcgatttggagcatcagtacgggcgataatctcaacaactttgtaggaagactctggacacacaagtgcttcaaccgctacttcagcaacctggctccgagatatggatcccgaataaagagtgtcctcaggttccatgactatattctctgttgggggttgatctgtcagccctccaggccttacgatagtgtaatctattcctgatttcctgatgtgattctctgcctgtagctttgcgaccagtgttaagccaaatagattgagcacaatgtaggctggattcagaagttgacccatggcggccccatttactaaaatggagctgacgagtacgaatcttgctacgccagcctttctgcatgc

SEQ ID NO: 12193 - DNA, 626 bp, Zea mays
  unsure (1)..(626): unsure at all n locations; Clone ID: LIB3279-204-Q1-N6-C4
gcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgccgtagccgccgcctccacggccaccaccgtacccgccgccgccgccgcctccacggncgccgcgggactgggcctcgttgacggtgatgttgcggccgtccagctccttgccgttcatgccctcgatggcgttccgcatcgcctcctccgtggagaaggtgacgaagccgaagccgcgggacctctgcgtctcccgatcga

SEQ ID NO: 12194 - DNA, 596 bp, Zea mays
  unsure (1)..(596): unsure at all n locations; Clone ID: LIB3279-204-Q1-N6-C5
ccaaacaagaagctttatttgacatgacagcaaagcagagttacaggcttacagcaaaggggtcggtgacacagagaggaagggagcagaccataatacttgctgatcccctcctccagtcctcctgaaccttacacaaccaagcgctcgacaaaacggcacaagcttacacaacacactgatcaaacaacagaaacttaagactaaccagcatcaccaaccgcagtcccggaggctcttccttaaaaaaaaccgtagtaacctcctgacagcagccacttaaacccaaacaaaacgagaccaaaccaaaccaaaccaaaccagagtcaccagatcggaaagcaggggcacgagaagaagcacagcacagaccancaagaccgtggacggatggatggaccagcgcgtgctctaatatggcaaccgaccgatccatccgtgaccaacagacacccccacaaatacttcaaacacagaggagagattcacgagagcttcatagttaaatatttggccctctgccagccctctaccgcgtgcactaaaatgagcacatgatagcagcagaggagcgagggcatcgggcggaagggaaa

SEQ ID NO: 12195 - DNA, 512 bp, Zea mays
  Clone ID: LIB3279-204-Q1-N6-C6
aagaagataaagatatctactacttccaactaaaatatagcaataagacaacattaggttttttatgagcaaaactggctacagtaattttccgtaccaatacaactatgaactgataacactacactcatacatgaaaaagccagtatggaccacgcataaatgaacagaaaccattggtgcacttattttagttggatttaccaattaccttcaaaagaacccttttcatccctaaacctgggccaaacatttgaaattcttggtttagaattttgccgttcgattttttttaaacttagttgggcaaaaatgtaacattggttacacatccttaaggttttaataatccgattgcttttgaaaggaggggaattggaaattgcaaaaccaatggttagcttttaacaatgaactcctgataattcttctttttttttttaagcgtaagtctaattacagatgttaagcaatgacattctgatctgaatcataatcagcttcaattaagc

SEQ ID NO: 12196 - DNA, 329 bp, Zea mays
  Clone ID: LIB3279-204-Q1-N6-C7
ctcaaaaaaactcttaacaaactaactggtaaccttcctagataatctcaactaatctcctaaataatctcaactaatcttctaatcttatctctaactatcattatctaatcccccttggagggcccatggttgctgctgccgtagccccttcgtgggccttcttaggccatgacactacacccctcctggacaagcagctcgtcctcgagctgcaacatgacgggtgcttaaagaccaagtctacttgacccaaaatcagacacctagaagacaagccttttacatctcggcttatcttattattccgaatttggtttttttgaccc

SEQ ID NO: 12197 - DNA, 581 bp, Zea mays
  Clone ID: LIB3279-204-Q1-N6-C8
ataacttatatttatctcttatctaagaaatgctagatgtggtacacaagattgcaccaatgattcaatgtagcaaacaatcagcacgacttgaaaccatgtaagttcatataaaagcattgagccaaccttctcagatagcctctcccaagcacattatactactgaaatggatctaaagatcactcatgatagtaactagtaaggaacttataaagataacgaagctaagaacacgatgatgcttcagccggctcttgctttttgtgctcatcgccttcattctgttctccagaacatcgctggtgtcactcttggattccacaacctctgcatcctcaacgttcagtccatcaactggttcctgtttttttgcttcccttttgcgacccagcattgcctcaatagccgctcggctagccctggcagcagcttcttccttagcctttgcctcggccttcttcctctcctcttcttctttagcaagggcctctgctctagccttctcttcagctgcacgtgcagccgcctctgctttctccatctcaacatcttcatataactttgtcatttgcccattt

SEQ ID NO: 12198 - DNA, 481 bp, Zea mays
  Clone ID: LIB3279-204-Q1-N6-C9
aaactcccaaccaaattatgactttccgccagtaagtgccgtttcaatttccaagcaatttgtttcaacaaaaaaaaaacaagctgactgaaccctggtccaggacatttgcaagtaataacatttgtttttatgaaagcaacggttttagacataaatccccagactaggaaacatgtccgaagcaaatgacagctgcagcacaactgaagcgttggcttattccttccttaggtcgatgtactcgcgcttattcccaacttttttgtgaactacattttcaaatttggttccagggtaattttttttttaagttgcgattgcaaacccttctttaattgaatcgatggcttttgattccaacattggtgtgacagcttccttggcagggagcattaaaggacttggggtttttagttgtttgcccagaattggcttattaaaagtaaatccctttccttgagcattttaaccagttttt

SEQ ID NO: 12199 - DNA, 391 bp, Zea mays
  Clone ID: LIB3279-204-Q1-N6-D1
agatcgaaaatactttaattctagataacaccaatttgcatagcgaatccagcaggctaattcaaagccgcaactcaggaaagattatgtatgatttctacaatacacaagcaaaacagacgcagctttcctcctatgatatcaggttatagcagaactactgaccatcgacgaaaacgatgtcaaaatccaaacaagcaatcttgcactaaaatagaactagtcatcatccttgtaggggtattcctccgggacttgcttgataagcttcacccgcatctcataggcatcgtccccgcgaagcatgtcacgcacccatgtcacctccgccttcatagacaccatttccaatgcccccctaataactccacttaacaaattgcaatactga

SEQ ID NO: 12200 - DNA, 570 bp, Zea mays
  unsure (1)..(570): unsure at all n locations; Clone ID: LIB3279-204-Q1-N6-D10
ggcaacaacaacaacgaacacgaaacgaaacatacggacacgagacgaccacagacgaagataaaccccctctagactagggtgaacacggtagcagaagcgaacaagataactaggcctcagcggaccccaccgctcagttcctccagttcccgtcgttgttgccgtagccgccgccgcggtttgcaccaccgtatcccccaccgccgccgtagcctccacgaccaccgccgtagcctccaccgccaccgccgtagccgcctccatcacggcgcccgccaccgtatccgccaccgccgcctccacggccgccgcgggactgggcctcgttaacggtgatgttgcggccgtcgagctccttgccgttcatgccctcgatggcgctgcgcatcgcgtnctccgtggagaaggtgacgaagccgaagccgcgggacctctgcgtctcccgatccaggatgatcttcgactcgaggacctcgccgtaggtgctgaaggcgttgttgagggagtggtcgtcggtggcccaggcgaggccgccaacgaagcaacggtactcaacgtccgacgccg

SEQ ID NO: 12201 - DNA, 596 bp, Zea mays
  unsure (1)..(596): unsure at all n locations; Clone ID: LIB3279-204-Q1-N6-D11
aaaaagcaaatatcatttccattaagacagcagacaaccattacagaggcaggaatgcaagataaacaatcaggttacccagcaactgaacaactctctatccctaagattctaagaacaagcacaatggtaccaagatgccactgccaccagaaaggaaaccaagagaagcacaagtcctacaagcaggcccgaagcaacaacgacgccgcctgcggtgagaggagctcgcctcgctcaggccctctctcccctgatgcggcgcgcgagctggatgtccttgggcatgatggtgacgcgcttggcgtggatggcgcagaggttagtgtcctcaaagagccccacgaggtaggcctcggcggcctcctgcagcgcggcgacggcggaggactggaagcggagatcggtcttgaagtcctgcgcgatctcacggacgaggcgctggaagggcaacttgcggatgagcagctccgtgctcttctggtacttgcggatctcccggagcgcgacggtgccggggcggaagcggtggggcttcttcacgccgncggtggccggcgcagacttgcgcgccgncttggtcgccagctgcttgc

SEQ ID NO: 12202 - DNA, 539 bp, Zea mays
  Clone ID: LIB3279-204-Q1-N6-D12
gcgacatcgaaccacttcttttatacaaaagcacgcagcagagagctaaatggaacacagcgtcatcatcatggtccgtaaccatcgtcccatcacgcatctagtacaacgccggtaccataccataccaccatctttaactggcccccggattcacgcttccttattttcagttcagttcggaaggggatccaaatccagagtcaccaccggcaaagacgagcttgggcgcgcgcgcacacacacacacactactggccctctgccagcggctcggcctctggcgccgacgaaaacaccttggcgatgcgttcggtggggatggcggggaggtacttggcccccgcgtagccgtgctccgcggcggctgcgaccgccctgttgtacttgtcggcccactgcgcggcggtgggcacgacgatctccgcgacgtgcgggaacaccggcaggccgttcagcgagcgccaggcggagacggccaggtgctccgccgcgggctcgtaccgcacgtagaggtccttggccacgggctccacgcg

SEQ ID NO: 12203 - DNA, 560 bp, Zea mays
  Clone ID: LIB3279-204-Q1-N6-D2
gtagctcaaaaaaaaatactgctaatttatattactccatatatgtttgtagcacacagcgagaatacagaatgctcattatgcccatggtgcacaacaaactactgggattagccatgacatggtcaaaaaatagcatatcggagcagatacaaatgggacgattcaccaccatcaacaaaatctcactatggatctacactagcaaaacagcattgatacagccatcgttctccgggttgtttgtaacttgagcatatttcccccaaacaacttttccagcgggagttaccagaccaagctcactgacatttacctcaatgatcgttccccttgtcataacaccaagagaagtgtacattggaccatttgggtttttcttcacagaaattatgtcaaggttgaaagtgcacttcagctctgggtgagtcacatgagctttggtgaaacgcagaccagttggccgaatgaaccgttcatactttggtggtttccttgtaaatccagctccaacaaaggtggctttagtaaccattctcttccactgcttggtttttcgc

SEQ ID NO: 12204 - DNA, 408 bp, Zea mays
  Clone ID: LIB3279-204-Q1-N6-D3
gcggcgacacacatatatacacgcactgtaacacaattcttgacattaacgaacaaatcggccacagcattgcgcgcaaggtccagcagcgcacataacactgctagtccagactgtcagcgcatagttaacttaagtattcgaccctagcaataacaccagcaaaggtagcagcaacagtagcagaagagaaacttgcgatccacaaaacaaaccctactcatatgtccttacaatggcaccagattaacaataaccccaggacttcatgtttttgtcacgatgtttgaggtggcgattaggccctctcgccgcggatcctccttgccagctgaatgtcctttggcatgatggtcacacgcttagcatggatggcgcacaggttggtgtcctcaaacaggccaacaa

SEQ ID NO: 12205 - DNA, 502 bp, Zea mays
  Clone ID: LIB3279-204-Q1-N6-D4
aatgtatacaagcttgcgcacgctcatataaatcaatttccaatgtaacgtaatttgaggcctaaaaccaaataataatgtgctgtttacaccactagagagcggctttcggagaagttttccttggcccaagagcagcttggcccagacatagtcaatcggtcttcccttcctgtgctccaacctcctgcaggtagtgctctgcatccagagcagccatgcaacctgatccagctgcagtaatggcctggcggtacttcttgtcctggacatccccagctgcaaagaccccctgcacactggtgtgcgtggaaccgggcttggtcaccacatacccatcagagtcgagctcgagctgccctccaagaaattttgtcgccggctcgtgaccgatggcaaagaagagcccggcccacctggagatcagagacctcgccggtgacgacgtccttgaccttgacgccggctagcgggccgccatccgcaccgccgtaggcctcga

SEQ ID NO: 12206 - DNA, 359 bp, Zea mays
  Clone ID: LIB3279-204-Q1-N6-D5
gctggtagccgagttatgttgctgtgcaaaagcacgagtccgaagtacaacagggttcactcatagcatttacatcagttttcatgctgcgactatatcagctgaaaaataaggattcactgcgacttggcaactggctccagtgcctcgatcatgacaacactgtttcccctgataaccaccattccaatatctgtcttgtcatttccattgacctccacagtgttgtcgatcaccagattcatgaactggtcgaatccccgaagtgtgccaataacaacacggtttgcattcagcttaatctgaagcttcttgtccatgtacttcttgagatccggaggctgccccgagcggcttat

SEQ ID NO: 12207 - DNA, 532 bp, Zea mays
  Clone ID: LIB3279-204-Q1-N6-D7
agtagtagtagcaagcatgcattattgtactggtaaaatagctaatgcttgctttaacaacctagctcgccagatatatacacaaaacacaccagctagctgttgcagtgcagtactgccctgcccccacagtcatgactcatgagccgtagatgagatcacagcatgagcgtccactgctgggtgggactcccagtggcgggcgacacgatgacttggctagcagtagcattagcccccgcagatggcctggcgtccaagaccatcccggtgccggtgttgaagatggtgccgtcgttgcggaacacccagcgctcgcaagacgatccagccccgtcgcagagtttcaccgtcacacccccgctggcatcagcagccaggcactgccattgaaggaggagccacgcgggcgggcgtacggagccgtcggggtagagcgaccactgcaagccgtcgcggcaggcagcgacggataccgcccccgcgtagtccgcctgcaggcagaggtcgcggaaccccacgatggcggcgt

SEQ ID NO: 12208 - DNA, 602 bp, Zea mays
  Clone ID: LIB3279-204-Q1-N6-D8
cagaaacctgactacaaaagccagaggtaaaaccattgttaaactaaaacactctgatagatagaacttgctaagcacataacacaccgcctgagacactttgggcacacacttagtttgtacagtacctaactgacaccaaccacaatcagagcttagacctaaagcaacccatctcatgcggaggccttccgtgccttcttggaggcaggggacttcacggtcttcggcttggccttggccttggcggcgggggacttcttcggcttcgccacgaccttcttctcgggcactttgcgcttggtcccagcagcagcggccttctttggcttggcagccgctgccttctttgacttggcggcggcggccttggccggcttgggggcggtggtcttggcagcggcggcctttgccggcttagccttggtcttgggggatgccttcttggcggcgtccgagagcttgtacgaagccttgaccttcacgagcttgcccttggctgcggacccacggagctggatggaaagcatcttcttgaagttgggccgcagagacgcgccgtgcttgtcccccacatacttggcgatcgcttgcgagctggg

SEQ ID NO: 12209 - DNA, 488 bp, Zea mays
  Clone ID: LIB3279-204-Q1-N6-D9
gcgaatcgacatgttctcttttcctttttttttgttcttcttctgaagagtggacctgaaggtgatcctcgtctgtttatttagtcctataacagagatggaaagaattacaaaacaaaaccgtaaccatatacagcagacacctctccccaacactgaaccgcgtcagctagctcgtgcatcactactgatcgataccaactacgcgcgctgctggactgtgcaacctatagcatagctagtactagtagtgcttgtgtggctttgggcggaagatgctgatgtccctgtcgttgacgtcctgaaccggcctcgcgttcttctccatgccgtcgtgcacggcttccctgagcagctccagctggtgcctggacacggtgcggaccctcttgacgacggtccagatgaccccctcggtgcagggcggcgtggtgagggagcccacgtagcggtagtagacgctggccctgccgcgcgcgcgccggggg

SEQ ID NO: 12210 - DNA, 421 bp, Zea mays
  Clone ID: LIB3279-204-Q1-N6-E10
gtagcagcaggtatagaggtagccaatgcaaggccatgcttgcaacaatggatacatcacatccagcagagaaaactggaaagcaaaggaaccatggccggggaaaagaaaaaaaaaggaaaaaggaaagaagaaaccaagcaagcaaagggtacggtgacccgaagcaaaacctaacgacagagacggcgcatggcactagctagctactagctcacgcaggagctagctactaactcggcggggggcggccggcaggcccggtctattcgctgcccgggggcttgtaggcaatgaagctgacgcactgcgtctgcttgatgttgtcgaagcctattacacggtggaaggcgtccgggtaggatttgatggcctactgcagctccttgtacacctggggggcgttgttgcaacctaacat

SEQ ID NO: 12211 - DNA, 542 bp, Zea mays
  Clone ID: LIB3279-204-Q1-N6-E11
atcacaagaacctgcacttggtcatcatgccaaattatctggacgacgattagttctagcaagctgcaaccgcaacagcgtgtgccaaggacagtgtcaataactcaaagatcgaatctgaatggaagtgcaaggttgatccatgcacggggaccagcccgggctagtacaagtcttcctccctgtgcgtctggatgacgcagtcggacgtcgggtacgcgacgcaggtgagcgcgtacccggcaccgacctgcgcctcgtcgaggaacgactggtctgcctggtcgacggagccctccaggagcttgccggcgcacgtggagcacgcgccggcgcggcaggagtagggcaggtcgagaccggcctcctcggccgcgtccaggatgtagctgtcctctggcacgtcgagcacgctctcctgcccttcggggccgatgagcttcaccttgtagacagcggcgacgcgcaggtctagcctcgctctgaagctcggcgacgtcggcacgctccttgggaagcccaagtgaagcggccgttttgtg

SEQ ID NO: 12212 - DNA, 517 bp, Zea mays
  Clone ID: LIB3279-204-Q1-N6-E12
ggccatatctgaaacatagcattatccacaatggaattacaatgttttaacatagcccttgaacaaaaaaaaagggacaggggcttagggcaatgctactataaaagacagactttacctaaacttttcctcaatatcaaaggaagggggaggtggaaaccaaagggagcgcaacaacggggggaaccaacttcataccaccagcaccgtggggaggaccccctgtagtctttttcgggcgctttgctttaaccagcttcacatgggcattaacgaaattttccatgcgtttcacctccagttgcttcaagaattcaattcggtggggctccatttccaccacatgcttttggttaacactttccacacgcttatacattttcgaaaaagctttgatcgcccttgctaactttttgaaacctttgtaagcactggtggcagccttatttttgcaaggctttttgttactggcagagagtgaccacaccgagcgcgaaggggaccggggcaatttgtg

SEQ ID NO: 12213 - DNA, 637 bp, Zea mays
  Clone ID: LIB3279-204-Q1-N6-E3
ggcattcagacatttggttcattaaggtggactcaactctgaagtccgaacaaaagagcaggaacgcagctaagctcgatgagttcgaaggaagcaaaaccggaaacaactaaggagtacttgaagaactggtcctgagtctctgaccatcagaaagacgcactaccctcgatcagtttcaacgaagcagaaaacaaaatgacgaaagaatcctagaagaacatctccacgaactgacccagttcgagatcgccgcacacaggacgtgctgtgtcaacaccgtcccatccaggcttgatcacgcacgcgtgtctactgcgatgacggcgcctcaggtagtatctcgtcgtccgccggaagcggcaacacctcctccttgtccgacgtcgacgtccgcgggtggcgccgatgcagcgatgctgatgacgacgcttccgctagtttctggatttgctcccaacgcagcagcgcctcgtccaaatcccgcgtcgacaacgggagccgcaaaggtggtagcgctgccgccaatgctccctgtgaaggtgtaggtgctggtggcgaacggtggcggtgtccgcttccagggcacgggatggggaacccggtcacaggtcgggcagcgctccatcggtccggg

SEQ ID NO: 12214 - DNA, 573 bp, Zea mays
  Clone ID: LIB3279-204-Q1-N6-E4
gaatggaagaaaagtaatgaaacctgcgatggctactaaataacctccttctattttattaatttgaaacccttttacctttttcttcgttcgccaaatcttcttcagttctatccaagctcggttttgtctgaatctttgtggaagaagaagcggttcgccagccgctacatccagggatcccacaaaatcattaaacccggcggctgctcgctctttgatcagtgattcaccggccactagatcgatgaagaatctctcaaaaatccgctttttgatcagtgattcaccagccactacattcttgaatcccaccttattctcaaacctggtggctcgcttgattggcagtcctgtaagctcatcttgcatacaaatttttggggtaccaaggcctgcatccaccaagaacatttcttcccttaagcgtaagcgtaaaactgaagattgtaaggcgtttccactacataataagaaactcgaattagatcttggaaataatcgactccaatagatgctcatcataagcttttttttcctcctattcctattgatcagaagtatccagcagcg

SEQ ID NO: 12215 - DNA, 629 bp, Zea mays
  unsure (1)..(629): unsure at all n locations; Clone ID: LIB3279-204-Q1-N6-E5
gtcagaacaaaacataccataccagataccacagtgaaagatgggacgcaaactgtcgaacaaaacatatcatacaaatccacggggggttttgttagttccaaatttccgaattccagtcacttcacccacagcagcgaggaagtaaaaactttttccacgacttatctagcaaaacaacggggcaagcctttccccaaaaagtccatgtgcgggaggattaaantttacctttgcagtgctacaccaaggcccgaaacaagatgacacgcanagctggcagaacctgagtagcagcagcagcagcggatctaggcgtcatcgagggcaaggacaccaggtagagtcttgccttccaagagttccaagctcgcaccgccgccggtcgaaatgtggctcatcttgtcggccagcccagccttctcgacagcagcaacagagtcgccgccgccgatgatggtagtgacacccttcgtggttgtaagctcagctagcttcttggcaatcgcctcagtgccagctgcaaacttctcgaactcaaacactccncatggggccgttccaaataacagtcttgggtggtgtcccaatgcttcgttgaatgtntttggtggcatcagggccaacat

SEQ ID NO: 12216 - DNA, 339 bp, Zea mays
  Clone ID: LIB3279-204-Q1-N6-E6
aggaatacaattgaagaatcaaccggctatagcaggtccagggtacaacggaaacttcctcaagccgaacacaaggggcctgaggaattgtacatctacagacgtcctccgatacgaaaacaccaaacagcagggaatactagcagcccgtccaacctttttttatgcctgacacaagagaaaatcggtagcgtagcctgcaaaaacaaactgtaataaagaacggtcaaccagcttctctcctcttccttcccggaatccaatccatgggtgaggggggtgggattaggcgaccgcgggcatgtccttgagccaggcgtcgagcggcccacgcgtccg

SEQ ID NO: 12217 - DNA, 512 bp, Zea mays
  Clone ID: LIB3279-204-Q1-N6-E7
ggaagcccaatgcccaaattcagggggcttgttagtcggccccttttccaaatgtccattttaagggattatgctttgacaaaaacgtgcagttgaaagcatagccccacacaagcaagttttaagaagtggcaaaaagagagagcaaaaaacccctttgtttacagcttttcttgggatatccaacaggagcccgggttttcacttcaaaaataccccaggggccaccctgggagttcatttacatatgtatatgggctatgtgaacacctgccccgcataacgggcaagacccctgcccgaagaaccaactgtcgatgcaccgcacgtggaatatgtgttggcactgaggcagggccctcacaaattgccgtgctccaaaatcctggaaacaaactgggcaacaactttttttaatttcctgatcacagttgctcgcaacactgaaccttgtttttgggatcctattaataaaatcccttgacatgccttctgtactgccggtttcaaaa

SEQ ID NO: 12218 - DNA, 457 bp, Zea mays
  Clone ID: LIB3279-204-Q1-N6-E8
agagagcagcagtaaacttacagctgcattttgttatattttttgggcatttttttttttacttgcttgctatacaaaaggaacttttacagttgagccacactatccactagctcgaaccaccgttactttgacttgaaagagcagaccacgagtccacgacagcggcggcagccaggaacaaggctgcaagaggggcaacagccttcctgatgagttcccccagcgaacctagcgaggctggtggatcacccggggggcgcttcttttggggctgccggcgtacttggtcggcttctcggcgttcctgggtttctcccggaacccccgcggggcgtcgccgccgcccttcggggaggtcatgttcagcgccttgagcaccgaatctggcggagaaaaacgcaccaacgtgagctcactacgattcgtccttcaggcaaatctaaaatcgagggga

SEQ ID NO: 12219 - DNA, 444 bp, Zea mays
  Clone ID: LIB3279-204-Q1-N6-E9
aacaaagttaggtcagagttcaacttcaaccagaaaagcactcaaattatcctaataaaggcgcagactttacagggtgtatctctttctttcccttttaaaacttaaaaacttttaattacatggcgcatcagctcaggcccgaaaccatctgttacaacaaaacattattccgactgtatgattgtatacaggcacctcgcattaccagcggccgttggcatggcggcgccacaaggagaccccgttcaccccacctcccaggtactcacccacctgggggtggtatccatttgtgttgaccccaaggctcaccgatggactggcagagccattcagccaaggcttagaagcactcacgtcagacaggccattaaagtagatatcccacgagggaaactgccggtccctcaacccattgacagcattcatgtcataagcccc

SEQ ID NO: 12220 - DNA, 584 bp, Zea mays
  Clone ID: LIB3279-204-Q1-N6-F1
aaaaatcaagttcaacagatttaagatcaataaatggcttgttcaacatcacagaatctgaataagctaataaccttgttgggtgtcctataaccacacttctagtgcttctttgcagatacacgtcgaaacaaatatcttttgggacgtttctatctccttacaccatactccaacccaacatcaaacctgcattggcatcttcactcactaatcttacacgtagcttgggctcccgttctttaataatttctaattgccataactcaactcatggacccattggaggcaggacatgttctacagctaggcgccaaactagcgtcaactctatatttgcaggtgaccaacattctaacagataataaggggttggctaatgctgctacctccggcttcgtgctccgcaacccagccattagtgcctcggaccaacccttgcggcactgattgatgctacaccaggaaggaactactaagtgctcaagatccaaagagagatgaacaaagttgcagacagtttaacaaaacaggcaaggcagggcatcaattacaggagattgtctttattcttgtcaagcttt

SEQ ID NO: 12221 - DNA, 542 bp, Zea mays
  Clone ID: LIB3279-204-Q1-N6-F10
accccgtgccaaccgaccaaattgcccagatacacgattacaaagcgattgtgatatactggttttgacagctcgccgtgtccacaaagtgtgacgcacaaatactcaccacaaagatatacaatacaagcatacgagcagcaatctgcatgcctcactcaacaccaacagcacacaacccaggtagcacagcctgtggcttccccctgcccatggtgaaacccctggtgccatcaggcatgcgggggcctggtggaagcttgttggccccaataggcagctgcggatgcggctcaagcttggttatcaggttattcggtgtagttccaacagagtgaaggctgccacggttcccaccaaggtggttgttgccatggttattgtactgcggctggttgttctggtggtgctggttattgtgatggtgattgttatattgatggttgccacgcccatgccctctgccaccgcgactgcgccctttgccgcgcttgggaacttccttgttgaaattctcatcaaacaagtgttccggcagtaca

SEQ ID NO: 12222 - DNA, 534 bp, Zea mays
  Clone ID: LIB3279-204-Q1-N6-F11
ggcgtcaaattcacattttgccgaaggcgacaatggaatgccaaaaaagtggcaccagcaagaaggcagttttacagacatgtaatcggcccctagaactaatccaaatccccgcatgtaatcagacaaattaagcgcctaaacctaaacctaatgccagatactagtcaatgtgttgtcaacatcgctctgtcatacccagcaatgcctgctctaggaaccagagtcgttagctacaaaaccttcagctgatgtcgtcagcagatcagctggagggtctccctgaccagaatgcaaaaagacactggcccagtttgacgacctgtgcacgatccttgaagggatgcggtcactatcttcacctcctgatgcttcataaccatcgcttgacgatcttttaaactcgatgcccctgtgagctgtatgcatcatggctccctgcatctcatcagctgtggccgatgaagtgcggaaggggtggagatttggtgagtcaaagctactttcaggcgatgaagcaacatttcttgtgga

SEQ ID NO: 12223 - DNA, 332 bp, Zea mays
  Clone ID: LIB3279-204-Q1-N6-F12
caggggcaggggggggggttttgttggtgtttttttaaggggggttttttttaaatttgggggggtcaaaaaaaggatggaggggattggccttttcggggtatttttttttggggggcccaaatggggggggggggttttttaattgggggggggggggggccccccaaaaaggtttttttttttagcgtgggtggggaaaaaaaaaatttgtgggccgccagtatttgaaattcttttgatggcgttttggggggaactaaatatggtgtgggggagggaacttggggggggtttgggacgcaaaattgggacttgggggggggattttt

SEQ ID NO: 12224 - DNA, 600 bp, Zea mays
  Clone ID: LIB3279-204-Q1-N6-F2
caaacaattccatcgtgaccctaccacttgggatgattcgagctgcccgctagcattcgctatatttacataaccgttgtcgaccgaacgggagcgagaagtgtatgttcccgaagaacaagagaattagaccaggcttgggcttttttaaaaaggccagggatttttttacaaggaagtagtaggggtcctggggtagtaaaggcaaaaccgggtttgactggacacctaattccaccagccacaaggccgcccaggaggatcctaaaaaacgcttcctatcaccaacgcgtgtttccgagtccgaggcaccaccaagccctaacggagtggctacgttttccttggcaagtggggcgatctcctttgcgtcgtcaataccagttcgactcccttcgactccaaggcccaaaagcacctcctcccactttttcgcaggccccttccaggacaggtcttgcgccatgcagttctgaaccatctaatggaatgccggggtgtcgtactgcttcagggctcgcgtgacggctgacgctactgctgtcacgtcggctgggtctacagtttcacactcgacattgaaagaacccatgtggaatc

SEQ ID NO: 12225 - DNA, 622 bp, Zea mays
  Clone ID: LIB3279-204-Q1-N6-F3
gttaaagaatctgtgctgcccagaaatgatttataaaactgacacgtatgccagtattttgtaccattcagcattcaccgatgagatgacccaaggctaagctcaaagcccagactgttattcggaatcaacctatcactcaagactctagatacaaaaaggaccagagatttagcgggtggtggaaatggcaaaaggacgatgcggcgtaaacgctagcccagcatcaaatagtaagggcaatgaacttctgtacaagaggcagaaagtaaggattttcagccctgaaggaccttcaatggatctaactgtccactacagtaactcgagggaacagctgagagcacaagccttcctttccactcttcaccaggtttcagagtaataggcctctcaacagatgcaggctccacacacagcatgctcttgtattctgcatccccaaaatcttgcattgcttttgccttcttgtcccaagggttccaaacaacagcatcaggaagcccttcttttgtcacgacaaatgttcttttcttctcatgatcaatgatagcaattttggagggtgcagcaaggtaaactttgtcaacttctgattcaaaaacaatagcatcgccttgct

SEQ ID NO: 12226 - DNA, 534 bp, Zea mays
  Clone ID: LIB3279-204-Q1-N6-F4
ggcagaacacggaatggggcagcctaccccttaccgtcttaataggtagtagagatatgaaaagagtgttcacaccacccgttcacaccgctagtagtacatgttgcttgacagcatgttcagagggtcccagagtccttatctctcaaccagactttgcttgtacctctcggttcagctctcccggatcacgcttagttcctgttcctcctcctcgtcgggagatttccagttgggcgcgagcatgtggaacagtgtcccgtcgtagacgcttctcgcgacgtccttgcggaggaggccgtccttgtccttgccgaggctgtagagggtcttccactccgcttctgcgccagcccatccgctgtagtccccgggctctctgttcgcctgcagcagctggtcgatctcgtccgacgtcagggcgtcggggacagtcttggcgtgcttggcgaatatctcttcgaacttgtcaggaacaaaccttccttcggcgtcgtatgaccctgaatcgcttccatgtttccctttctggat

SEQ ID NO: 12227 - DNA, 335 bp, Zea mays
  Clone ID: LIB3279-204-Q1-N6-F5
aaacacggaaattcggtactcatatattactgtttgacagtggcttatagtggatggacccaacgaccgttcacactaggctctaggggttataatactcacgaaactgagcccgttttacaaaattctcgtcgatttcttgaccgagacccaagactttggccacggccaccagaggtggtagcaactttaatacgacgaatccgtatagggtgcgaccctggcgcttgatggcgtagacgacgtccatggtcagaactgtcttgctgcgggcgtgctccgtgtaggtgacggcgttatagatgacattcttgaggaagatctagatcacgccg

SEQ ID NO: 12228 - DNA, 569 bp, Zea mays
  Clone ID: LIB3279-204-Q1-N6-F6
acgaagcaaactctatataataaattttatgtatatatgaattctttctgaaagtgtggagccaacggcaaagagcagctgcataacatttgtttggttgcagacttcaaccaacggcaaagagcagctgcagaacacttgtttggttgcagacttcagacttttccttggagaggagagctgatggaggcacggaggctgctggcagcaagtggcgagaggccgttgccgtggtgggcgctggagccaggacacacagcttgtggtgtgacgtgatcacggatgcggtgcagggtcagcaggttttaggatccgagggtgggtggacgtgatgtcaattcttctgcttagctctctagtcctctgatcttctcaaagcacttctctacagactggatgatctctgccgtgatacaatcacctgcagccagcttgtattgctcaaatttcgcttcatcgcactccagtgcagctttcttgcaagccctgatgcttccactcatgtcgagcaagttgaacgaaacggggatcttcccaatgcaccgcaccatcgtcatagcagcccaaac

SEQ ID NO: 12229 - DNA, 132 bp, Zea mays
  Clone ID: LIB3279-204-Q1-N6-F7
ctcttgcacacgtacctacacttgttattttctagcacgtcaggctctcattacttgttattatgatcaccctatgatcggtggccttcaatatagacatttttcgagattgactgctgatacacaaacaat

SEQ ID NO: 12230 - DNA, 420 bp, Zea mays
  Clone ID: LIB3279-204-Q1-N6-F8
agcgggggaagggtcattgacccatatcattaccaaattaaacccacatatagttgcgcgcaatgcaattgcaacagcagagcagaagaaagtgatacgaccaaactcccagaattgaaccaaccaaccaacaatatgaagtgttctgttaactaaactacagccatgggttgcaacttgcaacggtaatactccccccacagcctactaaatgtagctacagataaactctgcatgcaccaacacttgtactttggtagtagaaacccacactcccagacttaaaaggcatcttcaagtacaggtgcatggtttagacatcttttccgacactgccatcagccgtagcatcaccactaggagctccattcagttcttcacaacaaccaccacaagcaacactttgcacaacatggacca

SEQ ID NO: 12231 - DNA, 106 bp, Zea mays
  Clone ID: LIB3279-204-Q1-N6-F9
acaggtgagtaaaatgtttatatactcttcagaaagaaaaatcgatccgtaaatgctcaaacaaaccagaaacacttctaacaagaaaaacgctcccaattacagc

SEQ ID NO: 12232 - DNA, 404 bp, Zea mays
  Clone ID: LIB3279-204-Q1-N6-G1
gaaggaaactgttctacccttttaattgacttttttttaaaaaaactacttcattatgtacatacacaacacagcaccggtatcaggataaaacagacgaacaggacagttccgaccgacccctaaccaaagagtttgcggtttgtcacatctcccagaataaaaacctttagtatcccatgacgatattagacggtggacaccccattacttattactatctaaatccagaacttaccactagctgcatgtttagaacaagctggcaagtcatccctaaggaatcgaccactgaagcagaagcagaagcagaagaagctaattccttcatccctgtataagatcattatggtcagtgcaaaggttagctgaccccaggctgcaccaccgggtggaaagaccag

SEQ ID NO: 12233 - DNA, 450 bp, Zea mays
  Clone ID: LIB3279-204-Q1-N6-G10
aaacatgaagcgcgaagcgggtcgatggaagcacgggggagccagctaaaccagtccatacaacaccacctctcaagtgacaagagtatcgcaagaacacagcaacagtggcgactgcacaagcacaaacgcacgcgcagccgcgctccacaagttaacttgaatcgtcacatacatagaaataggtcactcagcctagacggcagcagcagcagaaggaaaccctcaaaagaggtagcagcagtagtaggcgagcaggggagccgccacggcagccaacagggcggtcgccgtcatcggaggagagctcgccgccgcggcgcgcggtgaaaatgccgccgcgccaccgctcgatgaccccccggcggcggacggtgcaggtgctgcgaatgacaacagcttggtggtcagaaactcaaaacccaccacagctttattacaggtggatca

SEQ ID NO: 12234 - DNA, 584 bp, Zea mays
  unsure (1)..(584): unsure at all n locations; Clone ID: LIB3279-204-Q1-N6-G11
attaactgcagattccattaccatttgaagttcatcacaagatcgtcagtgatcgtcgccatccagggaactgaactttgcaagaccaacagaaaggtgaacgctgcctcagatcaggcagagacggagcaccaccagaaagctactagtactacgactgctctgcaacagaaacgactactgcactccagtaattgaaactactaatacgactagctcatggcaactacgatatggatatggactgcaactacggtatggatatggactgcaactaggagacctgggaggacccatccgatgcacacaccctactcgatcttgatctcgaagacgtccttgcgctcctcgtncttgatcttcgggacggtgaccctgagcacgccgttcttcatgtcagccttgatctggtccatcttgaaagcctgngaggagaggccgatgcggtagctgtaccgcgccgggcccttgtcgtcgtcgccctcgaggtccttgccggcctcccccttgatcaccagggcgtccttcttcacccgcatctttacgtgctccttccccagccccggcatcggcaccttcagctg

SEQ ID NO: 12235 - DNA, 555 bp, Zea mays
  unsure (1)..(555): unsure at all n locations; Clone ID: LIB3279-204-Q1-N6-G12
agcaccaagtgatgtccatcttgtttcagttgcagttgcaccatcattagttgccataattaccaacaaaatacagtagctacccgcgcttgcagatcaccatttccctgcccccaacagaggagagaaaagagttaccagcgcttctctctctctctctctctctctacctctgctgctgcgtgcgcagtccgatctattgccaaaagtaccctagacaggcccagcatttacaggaatgccattggccgcctgccgcacctaggtggcgccgctctccacggcggggctccaaatcccccagcggcgcaggttcagcaccccgcccatcacgtccgcccacccgcgcttcctctcttcatcggcctccgccgccacctcgccgccgcattgctccgctttggcctccgcgccagtctcttccgggacattctccttgttctcggagaggcacgccgcgggggccggtggtggcggggtacaagggcaggaagggaggagcggcgccnagggttcatgcgccacctcggatgggggctcctgggactcggggct

SEQ ID NO: 12236 - DNA, 530 bp, Zea mays
  Clone ID: LIB3279-204-Q1-N6-G2
gggggggggcggggggcaaaaaaaaaccctggaaaccttttttttaaaaagtttaaaaaaggggggggggggcaaaaacatttaaaacttgtttgggaaaaccccaaaccgggttcatattgttttccccggaaaaatacgggggcaccaccgagagggacaatttggggtttcccttggccccccccctgggggggggatttttccggggccttggcttgggccccccacttggaccccaaaaagccccccccccactttttgcgggccctaaaaaaatttgggtaaaaaattgccttaaaagcccccaaaaatttggggaacacaaggttttccttgtttttgaaagggggaaaaaccaaaaagggtcctttttttttgggaaaaaaggacccaaggggggccttttttttaaaaaaggaggagggggcccccttttttccccaaggggggggggaccaccccccccggttaagggggcccccgtatgggggggagaccaaaaggtggaccctggtctgccaaaaggg

SEQ ID NO: 12237 - DNA, 398 bp, Zea mays
  Clone ID: LIB3279-204-Q1-N6-G3
ggacagaaaagctgtgatatttcataaccctacagagacaaccagaagattaaaaaaaacaatcatatagcatgtatctgtgaaaataaatagctttgtgacactgacacgcaccagtgccaaagccaaacaacacagaacatcccaagatgccaacttgttctagcaactactacattacattttcatctttctaaaatggccacttgggtcaggccagcaaaggctgatcagccaaacctgccccagcgccggtaatccttactgaagtccgtcattagctgtgttctttactttcgtacaacctatttatccatgcgaaaaaaaacccggaatgataggggcccaaaacagaacacttccacacatggctgttgagtatcgcagttttgaagatg

SEQ ID NO: 12238 - DNA, 602 bp, Zea mays
  Clone ID: LIB3279-204-Q1-N6-G4
aaacacaaaagcaccacaattatatattcacaaaaaacatcacaattataatatcattcacaacaagatcatttacagatagctagctagatcattcacaaaagctcaagagatgatcagtcacaaaagcatccaacattgcttgaatctcaagtaaagcaattctagatctatcttgtataattaaatccgcttcaatcagatggttgcactttcagatgttgcaatggcatcctattgccagtaaggtaactgaattaggagtaacacaacacctgcagaatcttgagactcttcttcaaatcgagagtgatagtaggcacggggcatgtcgaacctcaccgctgcactgaacttaaattgatgaaggtgccaatggtcctactgccacctctgacccattacaacaaaaccaccgctgcactgaactttgtttttgatggatggatcaaaggtatgaatccttgagctcaaggaatccactcatttcaattgctccacaaaacgaaacttcaccatcgccctgagagaagtgcatatcaccggtgctaagattcgctccttcgacaaatactggcagataaactttggaacctctgctt

SEQ ID NO: 12239 - DNA, 240 bp, Zea mays
  Clone ID: LIB3279-204-Q1-N6-G5
aaggatgtcctctccgttgccttctccgttgacaaccgtttttttttaaaaccaaacaagcgaatttaatatacttcattaacacagcttagcttagtcgttgggcgaccataaagtgccatgcgggcgatggtactcacataaaaaaaactatgttccgtattgcaattgtttagacaaacaagacctcctaaacccttgagtggattgggacctctaggctgggtagtcatatctaaa

SEQ ID NO: 12240 - DNA, 570 bp, Zea mays
  Clone ID: LIB3279-204-Q1-N6-G6
cgagtataattacagacatattaagccacaacatagatatatacatatacaatgaagtagcagcaatattagttggaccacagtgcagccattaaaggttctgtttagccacacgttacattaagcgtctgtgatttatgcctgccaaaacattatcgttgctagttcaaaatataactgatccaaaagcagcatacacacatggttcattagaaatccgaacagactattagcgagtattgcttgcacacaaaagcacagagttcgtttgtccagcggcaatattagcagaagacaagtgctattctcgttggacagaaaaatgacatgtcccttcatttccaacgatagaccattttggagagtctcttcttgcccttggtgttcttcttggcgagcaagtgttgtttcccggcgcaccgccgaacgatcttgtccttccctgtcactcgaaaccgcttcaccgacgccatgacgagtgatgacacacataaccgaatgagacatgaatcagtagaaggcatcgaacaaccaaaggactcaaaagaactaaggacgagctagtaggaa

SEQ ID NO: 12241 - DNA, 596 bp, Zea mays
  Clone ID: LIB3279-204-Q1-N6-G7
agcaaaatactattatagcttagcttgttcatagagactggaggagcatgacggctgatcacacgcgatcaactatcccaagtttttacaggcacagaactaccaccgacactcatgctggagctaccgacgaatctagagctactgacaatattacgattggatcaaaatccatgaaagaggggaatctataggcggaattgagggggggatctcgccagcgacaaggcaggcagactacttcttggccttcctggccacgcccttcctggccggggcggcagcagcagcagccttcttcggggttgccaccttcttaggagccgccgctgcctttcccttcttggcaggagcagccgccttcttggctgccttggcgggggaggccttggcggaggtcttggcgaccttgggagggcgcccgcggggcttgggcgacgcggcggcaggagcgacaggcttggccttggccttggccttgggtttgggcgacgccgccttgggcttcgcagcggtcttggccttcgccttcggcgagggcttgggcttgggcgcggccttgggtgccttgggcttggcggccttgggcttggcgt

SEQ ID NO: 12242 - DNA, 483 bp, Zea mays
  Clone ID: LIB3279-204-Q1-N6-G8
aaaaaaaaaatccctaaggctgggttcaccattcaacccccttttaatcatgtcaatccaaaacttcaacctagttttttggtttccttcagggaaaaagggcttgttgctcctaaaatgacccctaagcaaaccttgtttaaaatcccttagccccttccatttactcatgtttagctgggcacaaacatcctttaagggcatcctatcctttaaaggaatgttccccaaaacttccaaataaataggaattgttttacaaccaacttttcctttttttagactagcaaccacaaccggccccgagtttgcaagttgttttttacctttgttccataccccctgcactgaccgaagggggaaatcaaattggttggcaacaatttgggttttttttttggggagtctcccgtttttgtttttagccaacaacgctgggaccacttggttcctcatatttttgggcatcttttttcggggggg

SEQ ID NO: 12243 - DNA, 535 bp, Zea mays
  unsure (1)..(535): unsure at all n locations; Clone ID: LIB3279-204-Q1-N6-G9
aaacacaaacaatacctgaattgcatttatanccttcggcttgacaaaaggcaaaaacccgagtgtgacgtgcaagtgaatacaagtcagcgtgaacagtacggggttactgttcatctatttataggcaagggacgcaacccggtagagattacattcatgccctcgacaagtgactataatcatgacacaaactatcctggactgatcagtcttttcctctttaggtcggtgcagcccttcgtctcaaggcctgtcactatgtcgaagctccctggatcgcagcttcggcctgtaccttcatgctatgtctgcttgtgccaacttgcttagaggaccttcggcaatgaagcaggcccccaacaataacttgagtttaatgctaaaacatggctctctactagtaataattacctaaccaactaaaagcaactgctctgagcttcaccccacatacaactagtccactttagccaaacaggacaattgctgagtacattgatgtgtactcacccttgcttaaaacaccaaaaca

SEQ ID NO: 12244 - DNA, 514 bp, Zea mays
  unsure (1)..(514): unsure at all n locations; Clone ID: LIB3279-204-Q1-N6-H1
caagatctatgttttatggtattcccagtaatcaatagttacagcacatccaaactcaaatccttgtaatggcgctagcggctagctactgcttatcaacagcaactgtggtcggcacgtcgaccctgaccctgtacttgtaccgcttggcaaagaagacgaaaacgagcaggttgactgtgctgagcacggcgagcagccagtacaggtagtcgaacctgcccacgttgatgttctgcgccagccacgacggccgcccctcctcatcgtcccgcgtcgcggcgtccaccgcggtgttgatcgccgacgccacaaagcagccgagcccgccggcgacggcggcgtacgcggacccgacgctgcgcatcgcgtcgggcgcctcctggtacaggaactccaggagcgcgacgaggcanaacacctnggccacgccgatgaggcagtactggatgagcagccagtaggcgctgaggtcccgcatgggcttgaggaaaaggcctaggtatccgtggcg

SEQ ID NO: 12245 - DNA, 490 bp, Zea mays
  Clone ID: LIB3279-204-Q1-N6-H10
gggagagcgaaagagagaattttcactctaataatattagaaataaatagtccttcggaatttacagttgttttaacagattatgggaggtgtaacattccagcgtaagatgacctgcatttgacataatgttcggttacaacttacaccagtctatgaacgaaaagaaggggaaaaacttcggagcaacgaccaatgtaaggcaaaaactacaaacggacaaagattataaacacaaaatcgtcgctctctctcttaacagtagtacctctcccacgggcattcgtctatcctggacatgttctctccggccatctctcatcacacacgtggagttcagaatgagatcagccacacacgtgctgctcgcctatttgcagttctcagggcacggacaaacgagtataactgattagcccaatccgaaaccttcatttgcttcgtggattgccaacagtaaccggtcctggagctgctctttggatgtgta

SEQ ID NO: 12246 - DNA, 582 bp, Zea mays
  Clone ID: LIB3279-204-Q1-N6-H11
aggatggaatcttctgattattggcctcaacgatttcttgaatgaccctgtgcagggcaaaatcatccgtgacgatcgtagaatgctgggccttattgatcttgatggatttgaactgcttcttctgctccggctgccgacgcatctccttctcgaacgccaagacgctgatcaaattgatcttgccatctccgtccccgtacgccaccgcctccggggccgcgtcgatgtcgtcgccccagaacaccagccgcagcggcgtcctgttgccgaccccgctgatgtacgtcatgggcaccatcggcgccgcgaagctgctcatcttggggacggcccgtctcctgaagggctccgcggcctcgccggagccgacggcggcgaggaagcgctccatgtcttgcgcggacgcggagtagttccgctccctggtgaccacgagcggcgcctgcaggcgcccgaacacggccggcgacgggaagttcacgatggcgctctcgaagctcctccacatggctcgcgtggccagcggcgtcgtcgctggcacgtagaggatgtccgtcccggacgcgaagttgcgcaccg

SEQ ID NO: 12247 - DNA, 588 bp, Zea mays
  Clone ID: LIB3279-204-Q1-N6-H12
gtcgccttcccctccgtagccgccgccctgggagcagtcccttgccatgtggccctcctcgccgcacttgaagcagccgcggccgcctccaccgccgcctccaccgtacccaccgccatagccgccgcctcccccgtagccacggtcgccgccgtagccgcggtcgccacctccaccgtaaccacggtcgccgccgccgtagccacggtcgcctcctcccccgtagccgcggtcaccgccgccgccgtaaccgcggtcgccggcgccgtatccgcctcgcccaccgccgttgccgccgtcgggacgttccccgccggcaagcgggccgccgccgggcgcggtgacatcgagggccttggcgcggccgtcgttgccgctgccgacggtgtattctacggcatcgccggcgttaagactgcggtagccgtcggacttgatggaggactggtggacgaataggtcctcgctaccgtcgtcgggggtgatgaaaccgaagcccttggttccgttgaaccacttcacagtcccgagcaccctatcagacgccatttgctcctgctagaaaaccctagaaaccctaaatggtag

SEQ ID NO: 12248 - DNA, 372 bp, Zea mays
  Clone ID: LIB3279-204-Q1-N6-H2
aagacgtatacatttgctgacaaaaagcctgacatgaatgttacatgagctatcttaaggtcttaacgctactatcctggtagcaatctctgccatatacaaaagtacagggcaacttatcttttcttttcttttctttttcccttctttttcatctgatccaggtgggaacaacagctaggacgaccagttccattactagagcaggatgcggagcaggcctggttgcacctgcgtgtacaaaaggccgtgttccatgaaatactgctcgacgggggcagtcaaccttgctggggtgcgggcccttgatattatcataacctggagtcggcgaccggttgatctcacgatctttcttcggttggtgagctc

SEQ ID NO: 12249 - DNA, 508 bp, Zea mays
  Clone ID: LIB3279-204-Q1-N6-H3
ggaccaatccaaagttcattactgaagcaatgaaattacaacagtttcatgacatctaggattgaagcccgaacataccaactactacctcaccagaacgcaaaccaaagtccaaggacaaaaagaccagagcttcaagtgggacaactttgacttatattacatgccagagaaggctgccacaggcctgctatgatcaactttctatgcgaaaagatcactgcataattcaggtatcaggattcaggagggttgggtacttgggtgatgactgtcttggatgccacagatgctatataatctgcagtttcatagaggtccttcctcctctgagcaattgttgtttccatgaactctttatgttcagccatggaatcaagaagctccagcagctccttagcagctgcctgagtttcttcttcaactttaagtgttacatcttggagcctcttctccgatttcttaagaaaatcatctgcctgcttttcagcaaaaacccacgcgtccg

SEQ ID NO: 12250 - DNA, 500 bp, Zea mays
  Clone ID: LIB3279-204-Q1-N6-H4
ccgcgaccacactacagtatatatatagtatagggtacacgcatttcccagttcaacccatcataatacacgtttcctaccttacgtagttacgtttctccatttaacatcgggaaatcaatcgacgcatgtacatcagagcacaccactgcgtaaaataattttactgctacgctttaagcgtatccgctgctaccttgcccatgcaagaagtgcacgacgacgcaagttatgttgtcactgctctccctcttgtacgcctcttgcaagagcatctttgcagcctcttctgggtccttaatggatctagtcatcgcaacagcttcctcgttagagaccacatcccacagcccatcacttgcaaggataagaaactcgagtgtgtaatcaacaacttcctctcggatctccggatccacaaccacatattgctttaagagtttgtcaccaaaagcacgcgaaacagcaagtacaccaccaacgcgccatgttcctgccca

SEQ ID NO: 12251 - DNA, 268 bp, Zea mays
  Clone ID: LIB3279-204-Q1-N6-H5
catacaacaatgcaccttaccagtaacagattacaccaccgtgtgttcagccgcttaaaacatctcgtattattacgacacgggaatagcaacagcagtgcggagaaaatcacaagtcttcagaccatagaaacctagagtggtaagacaatgatagaagagatgcggcctatgccttcacagcaacaagcttgtcaatgaggtcagcggcgtcttcaacggtggcaattgtctgcgcgctggactcctccaagctaatgtcgaaagt

SEQ ID NO: 12252 - DNA, 290 bp, Zea mays
  Clone ID: LIB3279-204-Q1-N6-H7
ggaaaataaaaaactgtgtttggccctctaaagtatgacatatgaactaacatatttcaatagacctatcaaagagcaattgcatcaagtgttatgacagtatggcacagcacgaccagtttcttttttttgactaaacaggaccacaggtgaaaatagaatgaaaataaataaactttaaggaacaaaaaaaacacatatattgggtaactcaagggtaccaaatgagtctgttagatgctacagaaggaaatcttgaatgacttgagcttgacgtataatctcaggct

SEQ ID NO: 12253 - DNA, 316 bp, Zea mays
  Clone ID: LIB3279-204-Q1-N6-H8
gccccaagctgttatcagaattgcattacagggaatctattccagaggtcaaagaaattaggaaccatctaggctcatttgaatggaacttgtggtaaagcaagcgcggaaagaaaaatactgggcatccagatcaatctatgtaaccataccggaactggcagcgcttttgacttattctgcgcttgtctgattgaaaccttcccccaatgtagcttcgattcaacctactcgggcaggaagccttttttcctaagggaagtaaccactttcccccccatgttaaaaagggaagggccttccccctctatttttc

SEQ ID NO: 12254 - DNA, 621 bp, Zea mays
  Clone ID: LIB3279-204-Q1-N6-H9
cgatgtaataattcaatattaagcccatcaaaagttaacagcagcaatggatgacaggcatctttcaagcaatgcagttaatgtggtgaaacaatgccgcagagatcaagcccttcagagattgatcagagctgacatgagctgcgatcagagctgatctcaaatgtaaaggacagtacatgccatgccaagtgaccacagaaataaacatcaaccagggattactgtgaaattaaatcatacaatacgctccagctccctcgcatagctgagcgtctggttgatgagctgcaaggatgggatctccttgtagggctgtgactcctttgccttctggaagaagacggcaccgttcttaagctcccattccgggtgctcctctgtgatgtactcgtgcagatcttggtcagaactgaacataagcatttgttttgcatcacttacagatagggaatcataccccttttcgctgcacccagcgatctcatctctaactgtcttggcgagaaggtccatgaagtaaacataggtctcatgtggcacagcttgccgagcgcttaacactcggttgtaggcaccctccatgaaggattgctcaagctctacagcatgcttgatgca

SEQ ID NO: 12255 - DNA, 350 bp, Zea mays
  unsure (1)..(350): unsure at all n locations; Clone ID: LIB3279-205-Q1-N6-A1
aagaaaagcaccgcaaatgtgactttcttgtgttccttcctcacttcacagacaagcatggtgttcaaatacaagcacagctgactgaatcgcacgctgacaaaacctaggcttctaagggtagtcaagtacacctcgatggcattcttgatactccctccgtttctttttagtgtggcngggcgacnntgcctccttgctcccgccactggaccccttctccgccgtcttcttgggcagcagaacagggttgatattggggagcacacccccgggagcgatggtcaccccgcccaacaacttcccaagctcctcctccttccggatcgccaaaagcacctggcgcggaa

SEQ ID NO: 12256 - DNA, 491 bp, Zea mays
  Clone ID: LIB3279-205-Q1-N6-A10
gaaaaattccaacaaaactcaggcactggtaacttcgattgtacctaggaatgttcataaaattgtctcagacttaaagcatgacaaagtttctaagcaaaactccgctgtgataacttccatagttccacgtccacgtccacccccacctcaaataaatatgagaaaatctaggcagagaaaatggcttcagcagcaaagataacacagtcctggacaccaatccttcttaagcggacgggatctccacctcgccgtcgtcaatctcctgctgcaggtccttggggtccttgccgtcgacggtgcacccgacgctgacgcaggtaccgaggatctccttgacggtgccggccaattccttggccatggacctgtgcctcatggtcctggcgatctccatgacgtcgtccaggctgatgttgccgctgtgcttgatgttcttgaccttcttgcgggccctctctggctccttgagcgccttgatgactagc

SEQ ID NO: 12257 - DNA, 597 bp, Zea mays
  unsure (1)..(597): unsure at all n locations; Clone ID: LIB3279-205-Q1-N6-A11
gctgccacaaaacacaatttgacatccccaaaggcagacagaccactatttgtgcgggggcaaaggatgatacattgtccaaggcataccagtgtcttctatgattattaaaaactcgccttgattaatgtaaaaaaggacaagccctgatcatggtttcatgtcctcataaaaacaaggcttaattaaggcgatggtactctggtacaaataggcatgtgaaaaactgcatcggcagtttcccattacagatactctggttgacgaggcgccaccggatttcacttcttttttcctgcttttccatcaggcaccaaagacctgacacaaaggcgaggtttggtcgagatgagttcggctgggagaacagacaccccagccaccgaagatccaagaggtaccccggaaaccgggagcatctcaacgagtaccgcaacctggacatttgagcaagcataataaaagcttgtaagtaggctaaatgctgaggtggagaaaaaagaanagagagaggggagaagtgggttgtaaacttacaaacggcttagacacaaaaaaaccaaaccggcttagtgtaagtgcaattaaccctaactg

SEQ ID NO: 12258 - DNA, 621 bp, Zea mays
  unsure (1)..(621): unsure at all n locations; Clone ID: LIB3279-205-Q1-N6-A12
acaaaaaaaaattgtcaaattgcgtcggaaaagcacttggcatgtaatacagccatgaaatcagtcttgaggtgttcggctacgcccactcttcacattgtgagttgctagccctgcccgctaaagattctccactaacttaaattgcaagaataatgatttaggatgatatcagtttctagtgtggtatctgattacgggtggacttaaacaaacatgttttaacattatcggttaccgttcacgttacaaatatgtgaaccatagtccatacagcacctaataacgaagtttatatatggagcgcctgttatctatattccctacctaagattctcctccaattcagtattcacttgcacagaggtacctcacagaaaaatggccaactaacattgtgcaaggcaaacagatactcattatcagctcttgcaaccactaaaagaatcttgaagtacattgatatccagattgcggcctatgacaactatcttgttcatgcgagactctgtctcagaccattttcgagccggcacaacttcatagacctncctcactgcctgtaatgtatgaacttggtctgaatcatggatatataaaatccctntacagcgatatatg

SEQ ID NO: 12259 - DNA, 309 bp, Zea mays
  Clone ID: LIB3279-205-Q1-N6-A3
gcataaaatcatataatatattagatagacgtgtaatttctcgggtcaccttgctatctatatgtaatcattaaaaatacgggcgtgctcaccatgaataccacaagtaaaaaaactttaagcctacggtgtgcggattcggttatcagcgttagtgctattttcacctgtggtgccttaaaaatccgctagtaggaatcaaatttctataggaggttcgttaagaaaacgcatgtagaaatccatgatttctacagacgattttcttaaggaaccgcatgtagaaatcgatttctatagacggatttc

SEQ ID NO: 12260 - DNA, 536 bp, Zea mays
  Clone ID: LIB3279-205-Q1-N6-A4
atacacaactccggacttccggaggcgcaccgacattcaaatggtcacaggtcagagtgtttcacatacaatcgagcattgtttgctgttttgctcggcataagcaaatgatcaaacaaatgtctcaaatattctgccatcagtgtctgacattttctaaagttacaatcataaaacggtcctacaactacccaccaaattcacatttcaactacaatgcacatcaaaacgagcaacatgatcgtgctctactgccgtcttttaaacctggctgaagagcctcctgtcaaccggctcgatggagctttcgtattgcttggagtcttagcatcctttgggttcgatctagacatagatggctgcccgttctttgtgagagtgaacctgcttattcttgatggaaatctatgcagccgttccgctgtcatctcagcagctgaattatcattctcggtttcacccgataaaccatcatccgatgcattggtctcatatcctgcttcatctatgctcactggggcagtatccatcacatg

SEQ ID NO: 12261 - DNA, 389 bp, Zea mays
  Clone ID: LIB3279-205-Q1-N6-A6
ggtagcaaacagaagtgcatacaaagcacaatttgtatatgagcaaagaattggggttaaaaacagatcagtcgagatagacgctacaatatagtcgtatttaccctccaccatgcaaaccgaaaattatacatataggcggacttaccctccacaatgcaaacggaaaaatatacgttgtcctaacatacaaaaccacatggcaatcagatcagatggtagttggttgactattgcaagtgcttccatagcctacttgtgccctctgaagtacatgtatactttctgaagaacccatatgctcacaagtgtctccaagcaaaacaaggcaaatccgacaaagtaaaagatcccaactattgcatgatcagaaaaggtgtcgatcgctg

SEQ ID NO: 12262 - DNA, 610 bp, Zea mays
  Clone ID: LIB3279-205-Q1-N6-A7
ggttcaactgtcgataatcactatgcctaggtattcttgttgggtgattcaaaagctcgacctttcgatagtgtgttgaagatgaatagtttcaacaactaccaccatctgagccatgtgccacattcttccatgatgtgccaccatgagctccttttccacgacgtctggtacatccatgaccatagtcgccttgaccttagtcacaacattatgctgaagtcttggtcatcttgtttttatgccgcttaacttccatgactgagcatacattgacttcggtcattaagcatgccatgcggtttagcacggagctcgagatgcctcaataccatagaagttgcaatgatcgtggtcccggggatcaagaagtgtcgggtcacgaatcccgagaagacagcaaaatcgacgacgtcgtcgcctccagaaagcagcgtcctcatgtcacctgtgtcaaacaagaagaacgcgtggtcgacctataataagtcattctccacccaccaagtccccctataagctaagcagtttgaaaactctaaaaacttcgatcatggagcaacttcatggtggagttggtggagcagaacttaaaatggtggatcggagt

SEQ ID NO: 12263 - DNA, 521 bp, Zea mays
  Clone ID: LIB3279-205-Q1-N6-A8
ggtacaatgtaaaaccgtttaattccgtctcaacacgtctaaacagtgaatagagctttatcgtttacgttaccattgatcaattgtaaccagaagcagccaagtcagcttgatcgatccctctgcgtcttattgcttattggtactaccacgcactcacgaattgaagaaactagccatacacacataaaggctagtttggcaaccacatttttctatgggattttcaatttcccaaggaaaaatgaactaatttcccatgaaaaaatgaaaaacccttgggctacgagtgaggagtactgatgagtagcaggggagcttgtctcgtcaagttctgacagccgcgacagacagagcagagatggatgataatggattcatcaatcatcagttggtgtagttgtcgagggaggcgtgcggctcggcggccctggcggcgggggtgggctctactgtgggcgaccgcgggactggcgtgcagagcaggtcccttggcaggtcctggattccccggaggtaga

SEQ ID NO: 12264 - DNA, 322 bp, Zea mays
  Clone ID: LIB3279-205-Q1-N6-A9
ggaagcacaaaacaaattttacacatctttgcaatcttattacaaacaacacctagtgattcacagatcccaccctctcacctgccttcacagttcacgctccttgaatctaaaccggtgtttcccagattgaaaacctagaccagtgtgaccctacacagtgcatgccaaatgggcgaaaggcaagcaattacacacgaacaaccacaataaaagcgcatcaaacaacaacgaccatgaccgacaacgacagttaggagcgtttcagttcagagaggacagagagagacagtgcatcagcattgccagggacctacgaggc

SEQ ID NO: 12265 - DNA, 415 bp, Zea mays
  unsure (1)..(415): unsure at all n locations; Clone ID: LIB3279-205-Q1-N6-B10
ccccccccccaaaaaaaaaaaggggccccccccccccaaaaaaacaaaaaggggggggggggggaccccacaccacaacttttttaaaaaaaaaaaaaaaaacccccccccccccaaccccgggggggggggggaaaaaaaaaaaaaaaaaaaaccccccccccccccccggggggggggggggttttataaaaaaaaatactccccccccccccccccccccccccccccccccgaagaaaaaaaaaaaaaaaaaacccccccccccccccaaaacaaaaagggggggagaaaaaaaaaaaaaaaataaaaaattgtggggaaaaaaaaaaaaaaaaaaaanaaaaacccccccccccctttttttgggggggggggggggcccccccccccccccccccaccccccccccccc

SEQ ID NO: 12266 - DNA, 439 bp, Zea mays
  Clone ID: LIB3279-205-Q1-N6-B11
ccaagggccaaaatggggggtgtcaaattccaatttttgggggcaaatgcaaaaaaaaagaaaccccaggggccaaaaggggggggggaaactaccaaaaaagggggacaaaaccgggggggggaaggacccctgggaaaaaaaaaaaaagggggtctggaaaaaaaaaacaaaaaagggggggccaaaaacccattctgaaaaaaaaaacacacccccgttttgaaaaaaacgcggcccaaaaaccccccgccccccggtttgaaaaaaaaaacgcccccgcaaaattgcctgggggggggggcaaaaactttgggggaggggaattgcaccccccccggttaaaaaaaaggggaaaaaaaagggggggcggccttccgggggaagggatccaacacatgggaaagccctcaaaaaggggccccccggaggttggacc

SEQ ID NO: 12267 - DNA, 548 bp, Zea mays
  Clone ID: LIB3279-205-Q1-N6-B2
gtacaaaatcatgccaaatggctgcagtaaggattcaatttcatgcacggatagaggttcacattctaagaatttgaagcagaaacacagagtccatgacgaattgctggaccaaccattgccaaaccactactacgacttctagcatgacatactagtttctgaggagaccaaagtagtttccaacgtagaacacgcaaggattatttacattttgtttccctgagacgatcataaccccttcaggtcttgttcgtttgtgccggattggtgggtaggaacgatttctaaccggattgcttctctaatttatataaactttaattagctggaacgattccaggtgcaatccggcgaggcctcagtgagattcaactgctgctgctgcgggcttcaccacctccggagtctcatccttgaccgcagggtcgatgatcttctgcttgccgaacaccgagccgcgcttctggtcgaagtagctcttgaagcagatccagtgcttttgcgcgggtacctccttgaactggttgaagtagtccttggcgatc

SEQ ID NO: 12268 - DNA, 468 bp, Zea mays
  Clone ID: LIB3279-205-Q1-N6-B3
atatgggatccatcgctttgaaaccatcaaatttgatctccttccatatttcaaaaggtgggggtagttcaacactccatttgcaaggtggggggataatttcattaccttcacgagcaagatcgcgcccttcgttacgagcttgtacacaggcttttaaagccacacgattagctgctgcaccaggtgcatttccccaaggatgtcctaaagttcctccaccaaattggaatacggaatcatctccaaagatttcgggcaaagctggcatatgccaaacatgaatacccccaaaagccaccggtataacacctggcatggatacccagtcctgagtgaaaaaaataccgcgagaacgatctttttcaataaaatcatcgcgcaataaatcaacaaaacctaaagttatttcgggttccccttctaacttacctactactggaccggagtggatatgatctccccccg

SEQ ID NO: 12269 - DNA, 462 bp, Zea mays
  unsure (1)..(462): unsure at all n locations; Clone ID: LIB3279-205-Q1-N6-B4
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgncgtagccgccgccaccaccaccgtagccgccgncgncaccaccgtagccgccgccaccgccgtagccgccgccgccatcacggngcccgccaccgncgtagccgccggcttcacggncaccaccgtaccc

SEQ ID NO: 12270 - DNA, 608 bp, Zea mays
  Clone ID: LIB3279-205-Q1-N6-B5
aaaaggaatgtatgtcttctcatccttgcaacatcaaaactcggaagtaatgtccactggaatcaatggctttttttcagctgtgatgacatcagaactgcaagtcgatgtaaaaacaatgtaaatggattttccgatttgtatccaaaatctcgaagttacatggttcactactgaatccaaaaggactcccagcaaaggcaatcagtagctgcggccccaaaacgaccacttctttgctggctttccagatgcaaagcacagggtaccttctggaagttctggctgctcaaatggagtacacaatgttttcgcagctccgagttccccttttgtccgagctttcacatctttctcaacttcctcctcatcgcaccaaggagccaagatcaaccttttgttattcagagcagttgtgaattcatcccaagagttgacgacctgaacacatgcatctctcctttcttgagctgttttgaacagatttttttgaatctcatccaataacactttaacatcttcaaccaaattggtcaccggaatgtcaacctttgcaccgttgtcccggcggacaatgcgtacctaaaaagagatataacttcacactc

SEQ ID NO: 12271 - DNA, 567 bp, Zea mays
  Clone ID: LIB3279-205-Q1-N6-B6
aaaatacgacagtcagcaattcaaacaaaataggatcttaagacaacattgacctacacaaagaaccaaaagcagataacgccatgctgaaccaccaataccgataaaactttcttagatcttctcataatatttgacagacttcaagcagaatgaaacaaggtaggccttcagctctgggagaccatctcgtggggcttgtcacaagagagcacagccaaaacgacttcctccgaactccaaaactcggtttagaagaccatctcgtggggcttgtcaccatccctaagggagaaccgagcgccaagataggccttcagctctgggacagcctcaatagccttgatcagagcagcatccacggccttctggtcatcctttttgaaatcaggcagagacttggacgcctccttctctgtctcaaaaagctcaccctcggtcttcttcaccttctgctttttctccctggcaaagtacttgtcatcaaacttcgctacatcaacaccagagatgtcaaccttggttgatgtagcaatgacataggtctggttgacacgacggatcggt

SEQ ID NO: 12272 - DNA, 620 bp, Zea mays
  Clone ID: LIB3279-205-Q1-N6-B7
aaatgataatatagactgatatcaagccaataccaataacaagatagcacaggcatgctatgctaggtaggaagcaagcactctgacacgccagcaccccacttccagttccacgacaacagttactgtttctcagttcagcaccgattaagacacatcttatgacattgtccttaataggcaatagccatgggcattaggtaccatgattccacgaatttcttttatttcagctgcagacctcaagtctagaaggtggagccgttccaaccgaagtccgagcgcttcgagtcatagaacttgaggtagaagcgcgacttgggaacagacagctttgactccaggatagaagcgatgccagcactaagcttcttgttcacatcagggttcaggcctccgatggaaaccagctcaccgtaagctgctggctcctgggtacctccaaatgccataggcaccgaacccttgagaacaaccatcacgtaggcctcgggcttgccgatgatgttggcgacggacttggaggcttcggcgaggatggcggaggtgtccaccccctccaggttcacgttggtcgacacgttcaggcacggcatcctcgctcgctgccgcttcttctt

SEQ ID NO: 12273 - DNA, 466 bp, Zea mays
  Clone ID: LIB3279-205-Q1-N6-B8
acagaagacgagcacacaatttcatctacagtttcgcagctatcattaaagacaggaccaaccaccaagctacctatccgctgtcatattcacagacgacaaggatcccgacggcgatcatctacctccctacctcgggccggacagttcgacggccctgaggttgtaggtggagtccaccatccagtcgttgtggcgcggggcgagctccgcctcctgccgcatcacctccaccttctgccactgctcccaccgctccgccagcccgtcgccctccagcatccgcgccacctccgacatcttgggccgctccatcggggagccctgcgtgcacagcagcgccacctggatcagcgactccacctcctggtccacgtaccggccctgcaggtccgggtccaccagctgctccagcttcttctccttcagcagcgccttcacctgcaagcacacaacaccccgccac

SEQ ID NO: 12274 - DNA, 619 bp, Zea mays
  Clone ID: LIB3279-205-Q1-N6-C1
ccgcacccatcgaaccgacagttgcaggtcatacccaacacaaactggagcatgacttcgagtaccatgacaatacattactacgcttcagatccaaggctatttacagcgctccgcaaggaaaaggattggccaagcaggcgcaccagcggtttcttgcctgctttctcctgctctgctacaacttacccccaggcgggtcagcacacagagcagggcacacaccccccaaaaaaatccagcttacgacgggaaactagcaccaggagaagcaccatctacaaactgggtaccgcggggcttttacccggaggcatacacacaaaattacctacctactacacaccactgaaacacacccctttctcgttcttccggtcactctgacacgtggccttttgtctgcttcaccactttcaaaagggctcactgactggacaagttagcgcggttctcagaatcgacagccgaagtcgaggggccgctccggggctctttggaagccagccctcttcccagcgagtcagacaggcagtcttcgagcctcgagtttagggcgcctgggttcatcctctccacttcctcccttgtgtagatgaagatcttgtggaccatgtca

SEQ ID NO: 12275 - DNA, 556 bp, Zea mays
  Clone ID: LIB3279-205-Q1-N6-C10
gcgatctagaagtcgatccagtctcagtacaagtcccacgtctacgccaaccctgacaacgtgacgccagatatcatcgagagccgatacgagttaaccaaaagaaaaggcgcacggttcgtccccgcggccttcctgacaggcctccttgatcctgtccaatcgagggaggagtttctgcagttgttcgccaagttagacggagacgtaccagttctggtagtgtcaacggtcaatgctcccaagagatccaaggccgagatggaggctctcaggggatctaaaggggtgacgaagtttgtggaggtcgcaggcgctcttctaccgcaggaagaataccccttggcagtcgcggaggaactctacagcttcctgcaggaatcattcgcagcaagaaggtgaatgtgcgtgcgtgcgtgcgcacaactgtgccagaagacaggttctcaagtcccacacatcgtgagtaaattcgttagcctgctacagtgtactggaggtttttagcaacaataaagcggcatcactcgttcaaaaaaaaaaaaaaagggcggcc

SEQ ID NO: 12276 - DNA, 610 bp, Zea mays
  Clone ID: LIB3279-205-Q1-N6-C11
tttttttttttttttttttttttttttttttttttttttttttttttttttttttttttttttttttttttttttttttttttttttttttttttttttttttttttttttttttttttttttttttttttttttttttttttttttttgggggggaaaaaaaagggggggggggaaatttttttggggggggggggttaaccccccccaaagggccttttttttgtgggggggggccccctttcttttggggggcccttttggggaaaaagggccccaaaaaggttttgtttaaaaagggccccaaaaaaaggggggttccttttttttggggggaaaaaaaaaccctttgggggggggggggccccttttttggggggtttgggggggggccttttttggggagaaaaaaaaaaaaccctccccctttgggcccgggggggggggggggggaaaaaaaaacccggggggggggcccccgggaaaattttttttttgggggggggcccccttttaaagtggaaaggggggggggggtttaattaagccccccccccaaaaaaaagagatacttttttaagagctctcccccccctcaaaattatttttc

SEQ ID NO: 12277 - DNA, 558 bp, Zea mays
  Clone ID: LIB3279-205-Q1-N6-C3
agccaccaaatcaatcactttcctttgccatgccttccttgctcgcgctttcctttgtcatgccttccttgtgcgtgtttttctttgccatgccttccttgcgcgcgctgctgccagcgccccctgcggcctctcgcttttggcgcacataggtgcggccccacatgagtgaccactccctatgatgcccatgacatctccccctcccttgaggaccagctcgtcctcgagctgccatagacttacctgacacgacttaaggttaagccttttacatctcggcttacctttattatttaagacaaaaatacaaaataattgtggaactaaaatataaatttgaactgcagatatgtcctcctgtccttctggatcccaaggaaagagctgaactgcggccttcacgttggatgaaaggtggaggaggaaccagcccgttcttatgttaggtctgtccagcaccaaggcaggtgcccgaatgaaggagacgaccctctttggccgtgcagaggggctgcatacccagatctcgacttctacagggggttcaaaaagtat

SEQ ID NO: 12278 - DNA, 582 bp, Zea mays
  Clone ID: LIB3279-205-Q1-N6-C4
tgctgtcctgtcctcgcggcctggctcttcgcggcgcacgcgcgcaccgcgctgtccgtgcccccggcacccgcgccctcggcggtcgccggggaggaggggctggggcccggcgacgacgggcccatggtgccgtacgacaaccagaggtgcgtggacgcgctgggcgccgctttggagaagcgcggggtggcgctgccccggcccaacgcaacttgcgacactgtgctctgcttctgcggcatccggctccaccagatcggctcgctccgctgccccgccgcgttcgccgtcggtgctggcgctggcgccgcggccaagaacgccacgcccaccgccgccgtgaagggcctggagaagagctgccgcaacgcctcctacgccggctgctctcgatgcgtgcagtccctgcaaaagctgaaggggaacgtgagccgcgaggtctccggtgccggcggcgaccgcgcgcggcggatgctggggcgggactgccagcttatgggcctcacgtggctgctggccaagaacaagacggcgtacatccccaccgtctccgccgtgctgcgcgccatgctctacacc

SEQ ID NO: 12279 - DNA, 501 bp, Zea mays
  Clone ID: LIB3279-205-Q1-N6-C5
aagctgttgcagaacataaacttccaacccaaattttgtacatctgtgagaattacatgatataacactctaaaacacttgctgcctaccaacgatagatgggcatttaccgagggggacataatccctcgtgacataaaaagaaaaagttacactctttgctcccagtaaggaaacatcagtagctccaattacaacatgtttagcaaggtatgttaagctgtgaggtgtggggaggattctaatgtcaattagtgtggaacactataaaccatagaaagaaaccatgaatatcaatgacaccacggaaagaacgttcttgtcccagcttggaatcaaattcttaacatctaatcatttctctggagcaccaacataatctcataaccaacaggttaggaagcacaagagagtcctattttcagttaccaatcatatgatcggagagtatatggttccttttcatgggcataagtgatttaggatgaacagcaccctgac

SEQ ID NO: 12280 - DNA, 390 bp, Zea mays
  Clone ID: LIB3279-205-Q1-N6-C6
ggtccagcgggcaacaaccaaaccataccatcacgggtgcaaacgaaacgagaagctgggtacagagactacttatgatgagggttcaggcacacgattagccctgaaatctaggcgcagcttacgggcccacgcgggacgggaggtttgggtacacatgaaatgacaacggctgttcacgattcagaaaaagcatgcggcgacagtggggggtgatagcttggtgagcggcatcagttgccaccaaacaggtatcccagggaagagccaccgccaggagcagcgtggaccttggtcgaaggacggtccgtaaggaagtttccggtgttctgaccgtcggccctgtggtagttattggtttggctggtaaccccagcagcaatctgactg

SEQ ID NO: 12281 - DNA, 583 bp, Zea mays
  Clone ID: LIB3279-205-Q1-N6-C7
ggccacgaccctagcagcatatacatacatcaacacacatgacatgtagcttcagttcgggtggtgcgtatcagcgtatgtacagacagcgaatggaatcgctcttttttcagaagtcttatgcatatgcacaagctggtaagctagcttgcttgatccgtaaaccatacactacattacagctgcagatggatcgtagatttgggccgctgtggcatgatcatgcccagcccaggatggcacaccttaagctgcgcctgtccagagaaacgtcaggcctggctcactctggtcgcgatggcagaagcatactcggagatcgttggatcaggtgactgcctgaggtggacgatgacggggagcagctccgaagaccgtaggaagttcctgcagatggcgtggtcgcacatcttccgcagggcgaagagcacgattcttagcggagattcggttagagcatctcgtctgctggggctcagggcaacagtagagtaactgcccaccatcttcagcagcgcctgaattgcgccttgggagacaatgtcttcgcaaagcatgtctgagttcctcactagattactga

SEQ ID NO: 12282 - DNA, 380 bp, Zea mays
  Clone ID: LIB3279-205-Q1-N6-C8
aaacaacaaaaaacgatttattatatagcctgctgccaacgtacagttatgtgtgggtgtaataaattcagcatatacaggaccaaaagaagaagaaacagtaaaccggcccaccaaacaaagatatcatcgtcatcatccacgggaggacgcggaattagcatggcaaaagcatgttaacagcagctgcttgcagcggcatcggcttccggaggcttctgcttgaagatgttcttcttggccccagacgaagcatcagcgaggaggcttggcgtgtctaatatctttagcacaagttcctcaaagcactgttctacatttacttttggtttcgcactgcattctaaaaacaaacaaccgtattccctagcaaattcaat

SEQ ID NO: 12283 - DNA, 270 bp, Zea mays
  Clone ID: LIB3279-205-Q1-N6-D1
gagggcgacgacgacgacaggcgcgagccgacgacattgctgtggtgcgcgggcagcacgagcggctgcttcaggttcaggttcatcatggcgccggcgcgcggctagctagctacctgcccctgctggccccctgcctgtagattagatcggactactggtggctaagcagcggcggcgactagctgtgtgagccgaccgtcctgctgtgactgaagctagctgctagctacaggctatagctagctgttccgctgagcaccggatcca

SEQ ID NO: 12284 - DNA, 454 bp, Zea mays
  Clone ID: LIB3279-205-Q1-N6-D10
tcgcgatctagccggatttcaatgccatgctgcctgtgatagtcgaacatcagcgtctctgctacacgcttaccctcatcataacaactcctaacaccaatcgggttaacattgccccagtaggcctcagtttgaggatgctcaagtggatcaccataaacttcagaggttgatgtcaacaaaatcctagctccaactctctttgcaagtccaagcatgttcagggtaccaataacatttgtcttgatggtcttaacagggttgtgcttgtagaagattggtgaagcagggcaagcaaggtgatagatttggtcaacttccacaagaagcggctcggtgacatcatgacggatgagctcaaatcttgggtggccaatccacttcttcaggttgtcttttgaaccagtgaaaaagttatcaacaacaatgacctgaacgtaaaagaacaaagtca

SEQ ID NO: 12285 - DNA, 621 bp, Zea mays
  Clone ID: LIB3279-205-Q1-N6-D11
cagccaacggcacacttcggattattagctcccttcttccattcctttacaaataactcaacgatgctctatgtggcaaacaaagggattaaggttctacaaggtctgtatcctctggatctgcgactcagcttgcgcgtcgctagctgaactatcagcagtgtgctcgatgacgaagctctcgatcttatgaagtgactcaattgcaatatcagtaggtgtcagcttagagacatcatcatgaccttgtttacatgcaatctcttccagagaaacccttacatctgcatttgcataagcatcacccctttgctgtgcaagcatgctgagcttagaaaaggccattgcgtacggatcaccagatggttggtccagaagaggacgagaggcagttcccactttagcaatacgcctagcaagagcatccaagggcacatctaaccaaacagataggcccctcttcatatatctccagttaattggtcggataacagcaccacctccggtggcaacaactaatcgtcgcatggaggacaaatctctcaagacactactctcattatcccgaaagaaggcttcactatggaccttgaatatttgggcaactgatggcattccaac

SEQ ID NO: 12286 - DNA, 73 bp, Zea mays
  Clone ID: LIB3279-205-Q1-N6-D2
ggatgggaaacattttgcacatgtagattataccataagaacgtatagttctccagctgcaagccaatcttgc

SEQ ID NO: 12287 - DNA, 582 bp, Zea mays
  Clone ID: LIB3279-205-Q1-N6-D3
aagcacaaaaagatatcttggcaactgataaaatgtttgtcaaactctattaatgctacctaactttgtgaacgaaggattgacaaatatggccttgacaaaacagcagcttaactaacaacatattcgctattgttatcttacagtaagcaccagagcaaacacactgtgcataattgactgaagaaaccaatcacctgtaatggacagggtattatacttttaatcccaaacttcgaaaacctaactaacaatttcacctcaatgcaaccggaacaaattctcaatggaagggccaatggacataacttcatacacccttaggttcacgtggggcctggaaagggtaaacaaggccaggccattgttggtgaccttggcacagccattgatatgcacagcttcaaggcgcggacagccattgccgagggccagcaagctctggtcgcagatgtgccggcagcggttcacatgcagcactcttagcttactgcagtacagcccgatcgcagaccagccaggtagatggaccccatggcaaacagcaaggttccactcctcgagcaacgggcacccactggc

SEQ ID NO: 12288 - DNA, 450 bp, Zea mays
  Clone ID: LIB3279-205-Q1-N6-D4
aattaaaaaaaaaaaaaaaagaagaaaaaaaaaaaaacataaagttaaaaacttaataaacaagggggggggaaaaaaaaaagaaaaaaaaacagagaaaacaaaccgaaaaaggggaaaaaaaaaccaaaaattcgcaaataaaaactgaaaaaatggaaaaagaaaaaaaaaaaaaaaaaaagtgataaaggaaagggaggacagaaaacggttgtggaccaagggaaccaaacacccagccaaaaaaatgaatagattgccccaaaacaaggaaaaaaaggaaaaaaaagggaaaaaaaaaagaaaaaacagaaaagggattcaaaagaaattttgttaagaagccaaaaagaactggaggggaagacttccaaccttgaaaacctaccggggtaaaaaaataggatttttggcgtaaaaggggaaaattaagaaggaaggggggaa

SEQ ID NO: 12289 - DNA, 620 bp, Zea mays
  Clone ID: LIB3279-205-Q1-N6-D5
aagcagtctcctttcaagttggttgacttcataaggcattaaacagttccctacgttgagttccagctaagtcaaacaacaacaacaaaaaatctcccaaaagggtcacagttccgcccagccacatcatccacggacaacattctgaaccaagcgcaagggctcagttctccaaatcatcgccttcatcgtcatcatcaccatccaaatcatcatcatcttcatctccttcaaattcatcgtcaacctcattgttgaagtacttcaaaggattaggccacaaatcttccttgatgatctccgccacctcatcttgcacaccatcagcaagactcttgagctctgtatcaccaaaccagctaaaaaaactttcctctactaatggccgcttactccccttcttgttaataccatttccatttgcaggtcccattccttccttccacttaatttcggaagcttttattgtggttgttccatcatcagcaaagatataggtctttgcaagctttgtgtcctcaaagtacgggttctcagagaagttaagatgaatggagtatcctgccttaacatcagaatcatccacatcaatggagtctaagtacttgaatatcttctgg

SEQ ID NO: 12290 - DNA, 498 bp, Zea mays
  Clone ID: LIB3279-205-Q1-N6-D6
ggggggggggggccacatttttgtggggaaaaaaaaaaaaaaaaataaccaggggcccctaagcttgccaaccctaaaaagggttaaaaaaaaaaaaaaggaaacaggaaaaaaaaaaattatgaggaaaaaaaaattagaaaaaaaaaaaatttggggaaggaaaaaaaaaaaaaacacccatggcctttttttttttttaaaaaaaaaaaaaagggaaaaaggggtgaacctttttttttcccttccccagttttcaaaaaaaaaaaaagggggaaaggctttgccattttttttttttggcccccccccgcggggggggcccccgacagaggggaagaggacaatttaagttttggaaagcccgggaaaccgggggccccccgaagggggggggaccttttaccaccgggaaatctccgggggggggggggcccgcacaaaaagggcaccccaaaaaaattgttcccaccgggaaggggggggggggccccaccc

SEQ ID NO: 12291 - DNA, 420 bp, Zea mays
  Clone ID: LIB3279-205-Q1-N6-D7
cgaatacaccaaaatattacttccgtttgaatattagatcgagatctgaagttggattcattcataatatacataaaggtacatgacaacttatacacgtctgaaaattaggaaaacacactcaaaacatttatcctagctacacaggtacgtgaccacatataactgcaacagtccaaatattgctcctgaaaggtaccatccctctcgagcatttcctcatcaagtgatcaagtattgacatggacttccagacgtctactatgaaaattttacatcgaatgaaggaatctcctccctgataagtagagcacagagtccagctgacgactgttgagggctactctaatttgcgacgattacttcgtcgaagttccagtctctaacaaggtccctggacacagcacggctgcgttgaag

SEQ ID NO: 12292 - DNA, 539 bp, Zea mays
  Clone ID: LIB3279-205-Q1-N6-D8
aagttctcaaagcaaatcacctttacatataatagaaccaagaacagaagaacttggcgatgcgttccaattcccagtcaaacatttttttagtcccacaggtgaatgttttctaccactgatgcgatgagaaactgaccacgcaaaacaacaacaaaattaactagaagacagcagagacaatagtagcactagcataccaacaacagattgcataatagcataagtggtaagacccacagaacagacccgatgttctctctctttcctccataagaataaacccagcttagtcgacctcctccatcttgctctcgccagcgtcatcctccagagggggcatgtcggtgtcagcctccggagcctcctcgtcctcgtcgatgctcaggcccagcttgagcatgcggtggatgcggctgccaaaggtgttgggatcgtcgaggctaaagccagaagtgagcagcgccgtctcgaacagcagcatgacaaggtccttaacggacttgtcgttcttgtcagcctcggcacgcttgcggagc

SEQ ID NO: 12293 - DNA, 601 bp, Zea mays
  Clone ID: LIB3279-205-Q1-N6-E1
aaagcattacagctagctgcaaacgctgttcaagaaccaaaagcaacaaaacatgatgataaaacgtcttgggaaggtagctctatatccttgcagataaaaataaaactagacatagcaaaaagctccaagcagcacattcagagaacttatgccttggcagcagcctgggcagcaaagtcgcgcctcctctgctcctcgatgatgctgagcttgatacccttgcccttgggcaggctcacccacggcttgttgcccttgccaatggtgaacacgttgcccatgcgggtggcgaactggtggcccatggagtcctcgacgtggatggtatcgaagccgcccttgtgcttctccctgttcttgatcacacctacacgcccggtgttcctcccgccggtcaccatgaccacgttgccgacgtcaaacttgatgaagtccatgatcttgttggtctccagatcgatcttgatggtgtcgttggccttgatgagcgggtcggggtagcggatggtacggccgtcgtaggtgttcaggtaggggatgcccttctggccaaactgaacggacctcaccttgcagagcttgaacttggcatcctcat

SEQ ID NO: 12294 - DNA, 509 bp, Zea mays
  Clone ID: LIB3279-205-Q1-N6-E10
agaaaacttaaacgcttccattgctggttcatcagaaagcgtcacattcattacaaaattattcaacgcaaaaggaaagttcgtcatgttcttcgcaaggagtcatccaccatacatttgaagccaaaaggaaggggaaaatgcctgtataaactatgccagtgaaaccagcaaaagatttggtttatcgaacaccatcatggccgattgcctctgaaggaggaactagaagcaattgcaggagtttcttccctgtaaggctgggttgcaggatcactgacacttggtaatctttgcacactcccctttccttttcttgcgttggggccaatttcttcaatcatgtacttccatccatcgataggacgcctccgactaaaaatgtgggttttgatgaagctagcaatctgcaatagcattttcacgtcaatttggaaacaatttcaagaagactattgggtgcagccgtgcaggaagtataatttgtggacctgctgtttactaaaagc

SEQ ID NO: 12295 - DNA, 544 bp, Zea mays
  unsure (1)..(544): unsure at all n locations; Clone ID: LIB3279-205-Q1-N6-E11
ggcggtcgatgaggaggctgggaacgcggcgaacgccgtgccatcgcggacgcggtcacggtcgtcctggtggaacagcgcccacagcgtgctgcgcccccgcacgtcacacgaacgccgctgcggctcgtccgccctggtggcagcagcaccagccgccgccgccgctgctgcggcaagagcgtccccgccgtggccacacgagaacgacttgcaccgccggaggtccggcggctcggcgggaccggacgcagacgagctgccggcggcgaacggtctggcgaagagggaccggatggccgatgtggacttgcggcccggcgcggaggccgcggcggcagacgcttcgagaccctggaggcgctcgcgcaggcacgcggcgcagaagccggtgaacgcctcgcccgggtgcaggtcgcagctggtcgacaacgaacgccgcgcaggcggcgccggcgggtccatgtgcagcgtcgtcaatcgccaccccgggcgtnnactccccccgncccccacacccacaccccccgaccccacgcgtccg

SEQ ID NO: 12296 - DNA, 596 bp, Zea mays
  unsure (1)..(596): unsure at all n locations; Clone ID: LIB3279-205-Q1-N6-E2
aaaaaaacctgtgcatttttacattgcgaatgtgtagaaccagcggatttcttcactgagcagggcatacagacattaacgcagtaactgtcaagaaaatagctaaagtctgtagcggaacagttacaagtcgacgccaacaattgtccgacacatgcagtgcattgtacaactggttacagtaacacgcagattctccgactaggaagacatcatatgttagtcgtagccagcgtctcttcatccacgtcaaaagctttccttgcttgcttgagctcttcattcatggacagtagttcagtagcacggtgcagtttccgtaaatccttgcgtataagataaagaaaatcctctgtcaggagcttccccctctttgaggcaacgttctgcgccttgtgcaccaggtcagtgacatattccacaacaatgtcttccacaagtgcaacggtttctggaagtggatttggatcatccccaaagccatacatcatgtgttgcaggtctttctggaagacgccgcgcttgcgcttgaggggtggtggcggacgcgtnagcgccaccaccgncaccgncggcagagtggtggtgggaggagg

SEQ ID NO: 12297 - DNA, 613 bp, Zea mays
  Clone ID: LIB3279-205-Q1-N6-E3
aggccatgaaggtattaatagtcattcttttttacaattaattcacaaccacaacaaacgatctgacatctgttcctatctagttttacaattcattcacaatcacaacactgtagtgggtctgggttgatctctaatgttttgttttttcaatcttttcatctagacgtctactgaaatagtgttcaacgattgaagccatgtcttctacagatcgttctagaaaatttgaatcaggttggcaaaagcgtaagaaaaaacaaagaatagagaaattgatccaatattagcaaggagatatggatatgtttgttacaaaacagtcacaagtgtcatctgataatccgacacctgaccaggggcaagcaactgataataatgttgacattgatcctaatcctatagatcatctagaaataatgttgaagttgaggaagctctccctaacaacataaatactcagataggcaataacagtgaagacttgaatccttcttcggatgctggtgattcttttcagcctgatatatttgatccaagatattgggattcacttaatattaaacaagttgacattttagcacaaaaggacctaaaagagacctatcaattt

SEQ ID NO: 12298 - DNA, 398 bp, Zea mays
  Clone ID: LIB3279-205-Q1-N6-E4
aataaaagggtaaaaaattaaaaatttttgaaaaaatcagcaaaaaaattaaaaaggtcaaatattaaaaaggttgagaaatgttcaaactttaaaaaaaaagtaactttaatatagcaggttaaaaaaagcaaaggggaaaactccgaaaatgaggggggaaaaaaattaaaacgggcgaaaaggtaaagcctatgggcgaaaaaaaaccggtgctggaaaaggagctgtagcaacagcaccaggaacagggggggggccttcttgtcaaaaaaaaaggctattcttcctgggcctgaaacgctccggggggttggggtccctgggcttttaaagggaacggacgcggacaaagtgagcgtggatcgcgcaaaaaacgcaagggggcaacttggggt

SEQ ID NO: 12299 - DNA, 530 bp, Zea mays
  Clone ID: LIB3279-205-Q1-N6-E5
aaaacccaccctgaaatccactcctattaagaactgaattgaactcaaacttaaggagtgttatttagagcacctaaccaacccagctaacaaagaaagttgtgatcatgacaacatcagtgatacagagaaagagaaggcgaaagagaacgcaatgtttgagaaaaatgacttgctaccactaccaggtaccagctaagcagccagtggcagagttctcatggagatcaccatcaaacatctggctacatgtttattcttacaagtcgcggatccattattctttacaaatgatcgcatcaacggttccaatagccgacgaatgggattcctttacggctgccgcctggaacggtttttaatttaacaaattttacttcgtgaaacccttgccttaatgaagctgaaagggggggttaccaaaaaacttttgccttattttttaagaattcttcgggaaccccggcccattgggcctttaaattaactttgggaattttaaaacaagggtcttaagaataaattggttc

SEQ ID NO: 12300 - DNA, 541 bp, Zea mays
  Clone ID: LIB3279-205-Q1-N6-E6
gaagggattctcatgactatagaaataacagtgccacaattacaagaaaaaaattcctggtcaataaaggattcttaaaaaaacagttctcggtacacggagtacaatgtaatttggccaaatataactcgtctgccattattgactacctgttggacaagatgcattctaaactataagatattttaatttagtaaaaacaatgcatctaaaaaaattataatttagaatagagagtaaaatgtatatgccaacagaagatcgctatttgacaatgttccatcctcaccaaacgactgctgcatcgcggacttggttctgccgtttgatatgatgtggagattcgcaggcgaagtatggagtagttcacaagttcttcaaggcaaaacatgtttgccacacttgatcatcagccaccaccaccaatggacatccagaacattcacaagctttctgagttgagtagcagctcatgtattgtgactttgaggattactaccatctttggacaagatgcgcttattagccacatcagatgtca

SEQ ID NO: 12301 - DNA, 542 bp, Zea mays
  Clone ID: LIB3279-205-Q1-N6-E7
caatgaagattcagggtgcaaaacttcatttagccaaaagacaacccacactcagtgcaaatgtcaggcattggaatttgatacacagcatgacctgctttcagaactactagtaacattgaaatttgacgagtttttagaacagtagtagacccacagcttcgatccaacatcgagatgggtgatgagaaacttagaagagagatgttcccttgcccttcttgtctccaccaatctcaaaatgcttgcacctcttaattgcgtgctgtgagtagtgcttgcagctctggcactgcagcttcaacacgattttcttggtggtcttggccttcttgtggaagacaggcttggtctggccaccatatcctgactgcttgcggtcataacggcgctttccctgggcagacaggctatccttacccttcttgtactgagtaaccttgtggagagtgtgcttcttgcactccttgttcttgcaggccgccctttttttttttttttgctgccgaatcaacatgtatacaaggagcaatctcgcaccg

SEQ ID NO: 12302 - DNA, 458 bp, Zea mays
  Clone ID: LIB3279-205-Q1-N6-E8
gccaaggcagcgggaacaggacgggagttctgttcacctatttaaaggcccgggacccaacccggggaaaattacattaatgccctttacacccgaaaaaaaccccatagaaaactggcgagggccaaaaagccttttaatttttaagtcgggttcacctggtggtggcacccccaagctttcctggttacacctttggcgcttaaccaaccctcgaattattctgggctaccgggatgcccgacttgagtcccaaaatacctgttcacacattatactccagaaacactattaaatcctgtttttgaggacctttggatgccgaagggccccaacaccccccattggacacccggatcctttccttacgaccctaaaaggaaggacccggacctttttaaaaaaggttggccccccgggaccgaggacgggacaggccctcttttggggcccctccc

SEQ ID NO: 12303 - DNA, 313 bp, Zea mays
  Clone ID: LIB3279-205-Q1-N6-E9
gcaagaacggggtttttttgttggggggggggggggtaaaacataaactactcaatggcatgaaagaagtacaacgtttgctttgttggccgacttgaagctccactgcagcaaatattattcatgggggatgagtaagagtagcttgtaattttattggctgggtaaaggaaaatcttttgttgccacattttttcaactggaaagcacaacataaagcattctttttttttaacattggtgccaggccacagatatgggtacaactccttttccgccacctatgcctgtggggatccctcctaagtctggg

SEQ ID NO: 12304 - DNA, 622 bp, Zea mays
  unsure (1)..(622): unsure at all n locations; Clone ID: LIB3279-205-Q1-N6-F1
cattggacaaaaatagctgcgaacaaaaaccttgctcattcttctctcgtctcgtttcatagcgggagcaaccaaagggaacaacaggggtaccaacacctaatccaaaggtagaacggacactaacacggtgacagaggcgggcggtaacacgatactatagatagataagataactcggccgaagccaggatgggcccacacatcagtccctccagccgccgccgccgccgccgtagccgccaccaccaccctcgcgccgaccgccgtagccgccaccgcctccgtagccgccgccaccaccctcgcgccgaccgccgtagccgccaccgccgccataaccgccgtcacggcgcccgccaccatagccgccgccgccgcgaccgccgccgtagccaccgncgccaccgccaccgncacgggactgggcctggttaacggtgatgttacggccgtcgagctccttgccgttcatgttctcgatagcgtcgagcatggagttctcggaggagaaggtaacgaagccgaagccgcgagacctccccgtctcccggtcggtgatgaccttggagtcgaggatcttcccgtaggaggcgaaggcattctccagcgactcgttgct

SEQ ID NO: 12305 - DNA, 621 bp, Zea mays
  Clone ID: LIB3279-205-Q1-N6-F10
aataatgacaatgaacacaattattccttgtcgattgaacaatagtttacatcatggtacaaaccgaaaaccagcgtgcgctcacatgcatccggacacctaaaggtcaccggcggcgcctccctcacttgccggggacgaagttggtggcgtaggcccaagcgttgttgttgacggggtcggcaatgtggtcagcgaggttctcgagcgggcccttcccggtgacgatggcctggacgaagaatccgaacatggagaacatggcgaggcggccgttcttgagctccttgaccttgagctcggcgaaggcctcggggtcgtcggcgaggccgagcgggtcgaagctgccgccggggtagagcgggtcgacgacctcgccgagcgggccgccggcgatgcggtagccctcgacggcgcccatgagcacgacctggcaggcccagatggcaaggatgctctgcgcgtggatgaggctcgggttcccgaggtagtccagcccgccctcgctgaagatctgggagccggccttgaaccacacggcctcgccgaacttgacgccgttgcgggcgagaagctccgggaagacgcagccgagcgcgcccagcatggcccagcgggagt

SEQ ID NO: 12306 - DNA, 569 bp, Zea mays
  unsure (1)..(569): unsure at all n locations; Clone ID: LIB3279-205-Q1-N6-F11
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgccgtagccgccgcctccacggccaccaccgtacccggcgncgncgncgncttcacgggcgncgngggactgggcctcgttgacggtgatgttgcggccgtccagctccttgccgttcatgccctcgatggcgttccgcatcg

SEQ ID NO: 12307 - DNA, 517 bp, Zea mays
  Clone ID: LIB3279-205-Q1-N6-F12
acatccagatgattagtatttctccatacaagaaaaaaaatgtttcagcgtgtataccagacagcggctgctggtagtttcttcaattcttctacttaggagttgacatggtacgacacggacagaattattagatggtacatagctcgcagagctaaggcttggtctgcgctgaacttctatccatcgcatggaggcgaacgaagcgcgcaacgaggagctcgtgggtcatcaagtcgcagaccaacccttcagtcccctacctaccctgaggctgaggatgcgtaacctgctgctgctgctgctgcgtgcgcgctatcttgctgctcatcccaactcgaccgaaccgacggacgcgatcccggtgctcaggcttctcgactcctgcctgctgacgtagtcgtcacagctgctaccgagcctccgcgcgggggccgagctcaggagctccaggccctgcttccccatctgctgcacctcctgcggggagaggatctttatgcagcccacgcgtccg

SEQ ID NO: 12308 - DNA, 306 bp, Zea mays
  Clone ID: LIB3279-205-Q1-N6-F3
aacaagaagctgcacacgattgaaatggatcggcgcgggctagcgcagagtagaacaatggctgaatggcatggaagaaagtagacagcaactgtaacattgataccagtgttcagacatgcaagtcaccctactaggagtataatgtcgagacattctattagcaatggcatgaatattacgatcaacaagcaaccaataaacgtcaactgcttttatccgccatccatttccagcttctccaaggctgatctggccctaacccttgaagaataaccagccttcacagtccttcggacgcgtggg

SEQ ID NO: 12309 - DNA, 424 bp, Zea mays
  Clone ID: LIB3279-205-Q1-N6-F4
gggaaaggacccccccccccaaaggggtgtttggcaatgggaagctttttttgaaaaaaaggcgaaagagcattctttttttttttggaagggggaagggaaaaatccaaaaaaacaggggggtaaaaaaaaaggaattttttttacccctcttttaaatcccggataaatggactactggagaaaaaaccccccccccggcccgggggggggggggggattgggagggttttttcccccccaggcaacggggggggcaaaatttaaagggggggcccggggctttggttcctttcgctccaaaaaaaaccccaacgggggaaaacggggggggttggaacctaaaccccgaagccccggggggcccctttcccccggggggaacaaagaacccggggcaagtgaaaaaaaaggggtagggggc

SEQ ID NO: 12310 - DNA, 512 bp, Zea mays
  Clone ID: LIB3279-205-Q1-N6-F5
acacaagggaacacacaaaacgtaacgttacagctgtcgaggacagtactatgtcctgcagtcctctccacagatcaatgtcgaccacgctaataacgagttacacttacactgggtatgcagtggtggccgaggcagcacaggccggcccattacccatgcagcaacaccaccgttataaaaaaacgaaaggataactacgtgctgggcagcctagtgctacacagcgctgtcaggttaaccacgattacaattatcaaagcaaatgcgaggtatcgtcctaaagacataacgcaacagagtcccatctgagatcaagctcccttatgtgcacctcacagcagaggcaccaggttgaatctgcccctcgtcgcagtttgctgccttcggttcttgagggccggtattcggctggcctgaattttcagcccccttttctgcatctgccggaggagcatctgccttcgtctcagctacaggcagggctggttgttcaggggcaccaccattct

SEQ ID NO: 12311 - DNA, 528 bp, Zea mays
  Clone ID: LIB3279-205-Q1-N6-F7
aacaatgtacaggcttaccgcaaataatctgatatgtgccggacacaattcataatcaacaaaattgaagaaatacataaactatgctgtccattctgtaaagaacaccatgttgtaatgttaggcctatctgccacactgcaatcctagatcagttaatgaggatttgctatgttttcttgatgaagtggtgaccaagcatttctgatagtcctgacataggaatgctctcacagccaaagagctcttgaagttttgaatcgcataatattgattcgttgatgacatcctcaagttggtttgcttttatgtaatcccacagatatttcagggcaaaatcgtgaggaaatgttccatctgttccaatgaactttgctagtgcgtcagaaataactatggagggttgatcaatggaacgtccaggttgaggagacatggtgggagccttcattctttttacttcatgaagttgaccttttgggtcaagtgggggtatgtgcttagccaataatttattcattttaaaca

SEQ ID NO: 12312 - DNA, 486 bp, Zea mays
  Clone ID: LIB3279-205-Q1-N6-F9
atcaaatggctgatttatgataggtagggtccatttcggcctcccaatatacatacagagccccagaatatccagtaccatgatgctaacaagctatacatacatatactctattattcatgcaatgatgatgcatagtactacgaaacatccatatccacagttcatctcccccattatcccagagcaatgtcaccatcttccgatggcaaatcagcgaatcgttacaacagctgtgccggcgaaacgtttgctggtagcaaaatatgccttctcccttccccttttgggatgtgctcttcataagatgtcatcaaacatcagggacaagacaagcccctgcacaaattggctcctcctggttttctcctccttcacctcagggagcaaaggctcgtcaaagctctccgctgctctctgctctaagttatcacttcccacttctgtctcaaccaaggactcttttttagcatcctttggcaaatc

SEQ ID NO: 12313 - DNA, 543 bp, Zea mays
  Clone ID: LIB3279-205-Q1-N6-G1
ggccgcgtatcagagctcattatgtatgtaggtcaaaagggcaccagattgtcaagctaacaacttaaggaagaaaatcacagacagagcctcagataggaaactcgaaatgacaggacagcgtttactgattaaaacacaaatattctgcacttaaaacacagatgttcttagggcttgttccccaatccccactcaaggagagatgtcttgtggaagacgtagggtgggaaacatttgcaggcgccgattgcaggaatagctccaacacaaacagtccttacaggtcaatgacccgtgaaagcttctggatgcggttcagcaagaagtccccttgcttgatggtcgcctggtagaaagcattcctctcatcaggtcggttagtctccagaacaccagcaaccttatcaatcttgcagtgcagcttcccagctgcaatgaaccgtgacagttcctggtcaatgaaatcaacagttacaccgaacgcagtggccattgcttccattgtcacactcttgtatgactctaagaactgtgagtata

SEQ ID NO: 12314 - DNA, 563 bp, Zea mays
  unsure (1)..(563): unsure at all n locations; Clone ID: LIB3279-205-Q1-N6-G10
gtcttaaaaatantttatttgggaacagcagagtacgtagcgtagatagtacattagtacatcaagacacctactagtagctatttaaacgatggccattatcataattcccatgccaaagccgattattttttaacccaaacaaacttactggcttgacttagctgataacaaatcagcaatgcaagccgcacggacgaccagatagttgagcgtgagcatgcatgactttattcggagctgttcaccacccggcagttccggcggacctcgccgctggtgccgacgcccggtgcaagcctccccatccgcagcatggactccgcgaagtcctggaagaatacggaggcgtcgaaggcgtangtggcgacgaggctggcgacgtccgcctctaccccaggcacggcagccgacgacgccagtgcctggtctgacggcagcagaccgtcgccagagagcaggttgatgtagtactggttgtcgaaggtcgccggggtggcgaggtccaagtgtgccagcgcggacccagccgaccccgtgcacagctgctgcagcgactgcaa

SEQ ID NO: 12315 - DNA, 493 bp, Zea mays
  Clone ID: LIB3279-205-Q1-N6-G11
agaaaggaaacagttcgggatgcccactaacgaaattgtaccgaaatatggcacatatcaggtgaacaatgaccaaaactacaatagcatagttgctatcgtcatatagtattgtgtcatcgacaacatggtaaaacataacataaggccaatatgttcggtaaacaaacacggttcaacaaccaaacaaaaatacagttcgtaaacaaacacggttcaacaaccaaacaacattgtccatgaaactgactagcagcaacacctcagttcttgatcttcttcttggccctcagctggttgctgtgaccacacttcttcttgcggcagttgacagccctagggtgcagccgtgcatagcatttgcggcagatcatcttgtcctggttgtacttgcgagcgagcgcctgcagcgagggctcaatgatgccaccgcggagcctgagcacgaggtggagcgtagactccttttggatgttatagtccgcaagggtgc

SEQ ID NO: 12316 - DNA, 521 bp, Zea mays
  Clone ID: LIB3279-205-Q1-N6-G12
acgaaaccgaaccagaataccgtattacttaaaacgcgtgccacgataatattggtcaccaacaaaaggttctaacgcggatacaccgcgacgacgacgataaatcgagcagcgactgggccagccagccactgcagcagacacacgagactgacacaatccgcttagtccacctcctcgatcttggggccagggccaccgcttccagccggagcgtcctcgtccatgccgccggcgccacccatgtcggcacccgcgccctggtacatcttggcgatgatggggttgcaaaggctctccagctccttcatcttgtcatcgaactcgtccgcctcggcgagctggttggcgtccaaccagctgatggccgcgtcgatggcgtcctcgatcttcttcttgtcgtcggcagccagcttggacgcgatcttctcgtccttgatcgtgttgcgcatgttgtaggcgtagttctccagcgagttcttggactccaccttcttcttgtgctcctcgtcctccgactt

SEQ ID NO: 12317 - DNA, 629 bp, Zea mays
  Clone ID: LIB3279-205-Q1-N6-G2
catgataaacatatgaatattaataggatttatattacattgatatcttcgacttgtttgaaggtgctgatgcgagagtgattacaatccaacgtaaacggtacgtggtactattcaccaatttataggcacgggacgcagcccggataacaatacatttatgaccttaatatatacacataattgtaacataaatcaccagggatcaactagtcttttcttcttcggctcggcattatgcttgaccttcgttgctatcctaagttgaagctgttatccttcagttgtagcttcagcattcgttgttatcgttttcaaacaatgtcttcgtatcgaggacctttgaggaccttcgtaagaggaaggcccccaacagccatgaacttgtcggtcccggtctctcgatgattgcaaagggagtggatcaccaccgccattgccgcaccttaagaacatccttgccaagataaatgagatcctccatccctaaactcaaaggccacataaactccccatttccgcccaaatcaccagtcagatgcccctcaatgttgctctccaaaccatttacaacctggtgaacaagcttgtcgggtaacctccttgttttctggaaatgccgcatatgc

SEQ ID NO: 12318 - DNA, 617 bp, Zea mays
  Clone ID: LIB3279-205-Q1-N6-G3
agaatggaaggagtgctttatagcaacagcaaactttgacgatctacaatccaaccatgattttttactagatacaaccaaaccatgctgataaagaacttgcgacatacaatatagtcttcagtttcaggactcagaattatgaccagcaggcaaaagtccaatgaaaacctgttaaccttttggcacgctaccagtagtacaggagcacgagcactaaacgaggaaatgtgctaacaaagttgaagatacgaatgttgtgagttctcgttccagaggaacttccggacaagcatgaggccagacgaaagacgacgagcaaaatggctctgcatcatgtgacaaaacgtagcggttgctgcttacgtaccaaggcctggtgcttctgccccgcaatatggaactcgtacactttttggctgttcactacaacattgcacacttggcagatttttacttcgccctgcgctgctccagcctcaaggactcgcctcttcttcacctccagatcttcccgggttgctgctgagctgctcttcttcttcggctgtacagagggcaccacacagttggatacagcaacaggtggcatacttggaccgatgacattgcttggg

SEQ ID NO: 12319 - DNA, 317 bp, Zea mays
  Clone ID: LIB3279-205-Q1-N6-G4
aagaaaagcaagcgtcttttccccagtctcggcgattcaccgtgctcgtctcctcacagacgagaagagtcaaccatacagcgcagagcagtgtgaagtcggattaaaaacaaaagaaaacagaagaacaagagaaaggacaacacaccacaccacaccacagacggacagcgtccaaggttggtttggtcggttgttcgctcatcagattacagatccctcgtctctcagcctccctttccacgcaacaaaaaaaaccctaatccacacccacgtgtccgcccacgcgtccgcccacgcgtccgcccacgcgtccg

SEQ ID NO: 12320 - DNA, 276 bp, Zea mays
  Clone ID: LIB3279-205-Q1-N6-G5
gatagtcatgaattatattcgaaatttaatctggaaaatgtctaataattcaacactaaatagtaggcatcactctcattaactcttgggttttgcttagatcaagtttagcttgctacttgcttgtaagcacacgtgctagaccagctcacattttttgtgttcggaatcccatcttattggagattcagtttgaaaccttaattcagtacttgtcttacttgttattggtagttcttcaattacttgcaggacaagtgccataatggctaggta

SEQ ID NO: 12321 - DNA, 502 bp, Zea mays
  Clone ID: LIB3279-205-Q1-N6-G6
gagaagatatatttagtcgcagaacactttaatttttagcagaacaaaagataagtacttccatgcataacgatgttcagcacgagataagcaggttcacacaagggactgtaataccccatacacttaaaattcatgttgcacaaagcaaaataagataggctaaaccaaaacgtctggattcgcattccaactgtagattggacttaagcaacggcctcgaggaaagccttcccaggagcacgcttctcaagtcttccatggttaccgagcagctttgcgttgacaccatcaggaacaattctaccctcactcttgtacttcaggtagtcggcacggctgaacttggtgaagccccactttctgctctcaataatcttttggcggccagggaacttgaacttggcgcgacgcagagcttcactggcatgtgcagcattgttgtccttgcatcgaacagaaaggaggacctgaccaatgtccaccctagcacaggtgccct

SEQ ID NO: 12322 - DNA, 325 bp, Zea mays
  unsure (1)..(325): unsure at all n locations; Clone ID: LIB3279-205-Q1-N6-G7
gtcttaaaaatatttantttgggaacagcagagtacgtagcgtagatagtacattagtacatcaagacacctactagtagctatttaaacgatggccattatcataattcccatgccaaagccgattattttttaacccaaacaaacttactggcttgacttagctgataacaaatcagcaatgcaagccgcacggacgaccagatagttgagcgtgagcatgcatgactttattcggagctgttcaccacccggcagttccggcggacctcgccgctggtgccgacgcccggtgcaagcctccccatccgcacccacgcgtccg

SEQ ID NO: 12323 - DNA, 508 bp, Zea mays
  Clone ID: LIB3279-205-Q1-N6-G8
ccaggtaggaaatacaaagaaaataaaataaacataggcgactccaccggccttgacacgaaaactgaagcgacgttgcttatttcatactgatagaagatagacgagaaaaatgaaagaagagaaatctgattccagaatccagatcagattgagagagaggaatcctagtttggcagtgcccctccaatcctccatcccgtaccggcacttgcttctatttggaaacatctactcgacgttgacttggaacacgtccttgcgctgctgctccttcaccttcggcacgaccaccttgagcacgccgttcttcatctccgccttgatcttgtccatcctgtaaacctctggcgcgagctcgatgcgaccgctgtatctcggaggcggggcggcctcgtcctcgctatcctccttctcgccctcgcccttgatcaccaggctgttctgctccgcccacaccttgacgtgctccttccccaggcctggcatgtccaccctcaggtgcagc

SEQ ID NO: 12324 - DNA, 640 bp, Zea mays
  unsure (1)..(640): unsure at all n locations; Clone ID: LIB3279-205-Q1-N6-G9
tagcattcgctatatttacataaccgttgtcgaccgaacggaagcgagaagtgtatgttccgcaagaacagaagaattagaccaggcatggcattttttagaatgccaaggattatattacaatgaagtagtagtggtactgtggtagtagaggcgaaaccgtgtctgactggacacctcactccaccagccacaaggccgcccaggaggatcctagaagacgcttcctatcaccaacgcgtgtttccgagtccgaggcaccaccaagccctcacggagtggctacgttttccttggcaagtggggcgatctcctctgcgtcgtcgataccagctcgactcccctcgactccaaggcccagaagcacctcctcccacttcttcgcaggccccttccaggacaggtcttgcgccatgcagttctgaaccatctcatggaatgccggggtgtcgtactgcttcagggctcgcgtgacggctgacgctactgctgtcacgtcggctgggtctacagtttcacactcgacattgaaagaacccatgtggaatccggtgacacccttctcaaccgtgtcgacaagtccttcagtggatgaacagatgggaatcactccatatctcatnccttgcagctgaatgag

SEQ ID NO: 12325 - DNA, 633 bp, Zea mays
  Clone ID: LIB3279-205-Q1-N6-H1
aacgcaaaaacgaacaagccttaactgttaaaaatagttacatttccagacagcaaatctgttcagttttcacgtacagcagtgtagtagtattatttttatttagatcatcagtgattgccacaaaattgagaaaaactggccgaaacattacccaaaaaaggcagatagctctacttgttagcagtcacttgttgtcaacttgacttctcaatggcgcttccaggaagcatcactccacaagctccagtttccaagactaacaaagggcaagagaattctcttctgctacttggttgcatccttagcagtaagatttcagtgacatgaattggtcctctgaaaatgatgcccgacaattcaaggtcacgtgtttttcttcagctatgataaacttgcatctctgccatttgtcgatgatgcttcacccttcttgacgccaaaagcaatgtagttcacactgatatcatctgacagggaccattctccactcaacggattgtaaacgaaccctgccatctcttcgacggagactgaagccttttgcagcattaggacaagctcctccggggtaaccagtttggaccactcatgtgtgcctctaggaagccatctgaggatatactcagcagc

SEQ ID NO: 12326 - DNA, 600 bp, Zea mays
  Clone ID: LIB3279-205-Q1-N6-H10
gagcaaatgtccatgataccatatcgtaactttcaattggtacacaattctagaggagatttggatcctcacgactcacaggtcccaatagagttccataaccaacccgactgagccatagcaaagcatggactcgctctcttacaggaactcatgtatcgatgttcctagaatttctacagctgagacacgaacagtgtagttcagtttcctgtgttagaattgttcatcagttgagctcgtctccttagtagctttgtcgacgatgccatcaccagcagtgtcggtgttttccaccttgtcctcctttgactctctgctttcatcatagttttcagaagaaccatccagtttcaagttccccaagttagctgacaagacctcatttgtgccgtctccatttcctttgttcccatcattttcggtagcatcttgaagccccaaattcttcaagctaagtgacacatcttcctgctgcttcttaagggtggtcctcagctcttggaaatctgagcgaagctgctctatttcattattgagtgcactcttgatgtcagagagttccactttgtatttcgtcacttgggagtctaaattact

SEQ ID NO: 12327 - DNA, 553 bp, Zea mays
  Clone ID: LIB3279-205-Q1-N6-H11
aagggaagacctcacacatttagcattcccaagacataatatctgcttgatgcaaacagcaagccactgcttggtagtttacaaccaagctatctattattagtgcaaaggttgaggccaaccaacaagcatacaggtaaagcttattattggtcatacaaatatcacatgtaaatgtctaaatagttggttattagtataatgcttatctaaagagcacgctagcgccaccgcaacgcatcaagggcctctttgtggacacgggcatccccagctgctaccacgttaaaacttgtgggccgtgattctgcagtaacaggccaatggagcttgtcccctctccaatcagttattgaccctccagctccttcaatgacaggtaccagcgagaggaaatcatatggcttcaaaccagattcaacaacaatatccacaaaaccagaagccagaagagcataagcataacaatcacagccataaagtgggactttcaccttattccttacacgaataaatgcatcttcagcatctgcttcaaagagatgtgggcttg

SEQ ID NO: 12328 - DNA, 500 bp, Zea mays
  Clone ID: LIB3279-205-Q1-N6-H12
aaaaatcaaaaatctggggggggcctaaaacgaccccaacgggcaagggggcatacgggggggctgaaacagggttaaaactgggctgggtccaagccccaaaacggggttaataatgatcggggggggggccggaaaaaataaacaaggggggccccaaaacagcctaaaaaattttggtgaactggccgctcagggggtccttggggggggggtaaagcccctaaagggggtactgccttaggggggacaccttgtaccacgagttcaaaaccgacttgggcttgtccgggccaaaaaaagccagctggatgcccaccctgaaatcaacgggcccttgggttttggagctttgggtcctgagggggcatgtttgtttgccgagggaaacaaattttaacttggcggagaaagggccacaaccggccttttttcaaggaaagttttggaggctgcctttgttgaactcaagacccagggggaagctggacactgggact

SEQ ID NO: 12329 - DNA, 481 bp, Zea mays
  Clone ID: LIB3279-205-Q1-N6-H2
atccaaagtaaacattctttaggcataatgctataatcctgacagcgaccacaaaaactgcgacagtgtttcaccatagtccgaggcctcaacacatccggtctgaaacacatgtgctttaacaatctaaagcgcagggggcagcataaacaacgacaataactgtaggtggccttgtcagccttggaggctgaggcaccagcttgacccctgagccttccactcctgctagcggcaatgagaccaaccttctggccagggggagcgtatcagctgacagtacaggctttacctatgtgtgggtggctacctcctccgtggggatgctccacagggttcatggtcacaccacgcaccttgggccagctgtttctcttcacacggtacttgtggtactcgttaccagccttgagcatcggctaatcagtcctgcctgcaccaggaacctgcccaatcatagcacagcagctgctggggacaa

SEQ ID NO: 12330 - DNA, 182 bp, Zea mays
  Clone ID: LIB3279-205-Q1-N6-H3
gcgaaaggaaaagcttataacttttatcatttaagctgactgcacgccatctcgacattttccattataagaagaaaaaaaaaacattcattctcccaaacaacggactacagcagcaaagtgaaccaccatgatgccaaaagaagccatggcacgggatttacagaaatgatgcactactg

SEQ ID NO: 12331 - DNA, 504 bp, Zea mays
  Clone ID: LIB3279-205-Q1-N6-H4
gaggaaaatctgtcggccaccatcaccatttacagattagattagcaccaaaatttcgtttccctaattacaaaaccagccactaaaccaggacgacgggcccggccggcaacgccgccggcgggcgccggctacctgaaaaactacccctaccggagggatcgagagcgctacgacccgacccttgctccctagccggagcaggcgacggcgctgcaggcggtccggcggcggcggcggcggccaaggcggccgaggaacggcagcgcgcgggtgctcctgccgggcccagcgttgggcggcccgggatcggcggcggcggcgggcccccccagctcctgaatggtttccagtttgggcgcccagcggcggaacttgccgtacccaaccagttcctggtagtccttggcaaggcgttcgtccccgcggagcacaacggggggttgttgttgttgcggcggcgcggcaaccttggcggcgtccggcaggaggaagtcttcggaa

SEQ ID NO: 12332 - DNA, 577 bp, Zea mays
  Clone ID: LIB3279-205-Q1-N6-H5
gaatgtaatgacaggagctctgcctttccattaagaagaagattagaattgacctagttttaagaaaaaccgggccaaaaacttacacagagtgcccaaacaacataagcagcggcaaccccacacacaaagcccatacagagtcaccgttgccgagctcaacacaaggtacgggcagctccaacttcaccagacgggccgcacacggtcaaaagaaacacgaaggcacctacacctaaaacctggcacagaaggaggaagaccgtgacacgccatcgttgctaagcctcaacacacccacactcgaggcagctccgattcttcaccaactatcttgatccaacacccacctccagttttttgctcgacctccaaaacaatccaaaccacgaagaaggaggttcgcctcatgtcatcgttaccgagccacatctcctaatgtggcagcttcgacttcatgtttcaaaaaatcccacctccacccgcaatccagacgtcgagaagcgaaagcatcaaccgaaggcaacgtcgaggccaagacggactcaaacgtgacgcctttaggaagggagtgaca

SEQ ID NO: 12333 - DNA, 441 bp, Zea mays
  Clone ID: LIB3279-205-Q1-N6-H6
ggcccaaatggctaacatatggcatatatagcattcttgtgttggaataggggaaataacaagatggtgggtaaacagataaacgggcccccaatagtagagctcaacagttcacaagggaacagcaagtcagcaaccacagcatacaaaacttatgccaaaatggaacatttcagctacgtattggaaaagcagacgctgcattaacgacaggggcgataatttttttttggcagcagccttgggcacctttggaccggtgggggccttttttttcacacttttgatgactccaacaaaacccgtttgtttattgtaagggaaggaaaacttccccagggggggttcctggaaaattgtttcaccaccctggggttgggggggaataattttaacattaccagattaaccgtttttaaaaaattggggttttttttaaag

SEQ ID NO: 12334 - DNA, 573 bp, Zea mays
  Clone ID: LIB3279-205-Q1-N6-H7
catctaaaacagaggattcatctcaaacagagaacagtacaacgagcaagtcaacatcaattaaatcttaagcagagagctaatcatcttttgaagtaaaaacagcagagagctgtttatcacatcatgcaaacctgttgattgcctagacacatgatgcttcactaagcagcaaacaaagtggcaatagcaattatctaataatctaaaaggcagttcagatgccagcttgcgccaatcttaagattcaggagttttcacattcctcagcctgctggagcgccggactggggtcatcgcttcgtcctccttgtttcctttcttggcagggatcttctggtatgtggtgaaactaccataagatgatgtggattgagctgtcgagtctctcctcgacactactggctcaaggccttcacccttggtattcctcctcctgccaagcccagatgacaagctgctgctatactgtgaggggccagaggcttctacgccaggactgtgaaacagtgaacccttggcaacaacatgcccctggctacttcctgagtcagaaagagtttcaacctgatc

SEQ ID NO: 12335 - DNA, 585 bp, Zea mays
  unsure (1)..(585): unsure at all n locations; Clone ID: LIB3279-205-Q1-N6-H8
gataaaataaaacccacttcgatgaaaaaggaaggatccgagtacagtacagagttcctacactccgggtatgaaaactctcctcatgacaagtacagtgttcaccgaagagcgaagtacccctctcactcaaacataactgacttcctcacagacgactggaactaaacacaaacacacagatagggacactcatcaccacagatcgatcgatcgccaccaactttattctaacaacacggcagcagctgctgaccacaggtggctatgccttcaaagctccagatcatggtgatgaccagtgcagccacagaacagcacatttaccaggggacgatcttccagcgctggttgtcgccctcgcaccacttccagagcacgatgttggtgccgtcgcgcacgccgccgtggtccttgtcgccgtggaaggcgtcgaagttgaggtagatgttgttgaccatgcggacgcagcggaagccgtggccgacgtcncggctctccgtccacagcaccgactcgtcctggtagccggggttgtagggcaccagcttgaccgggtggccctcgccctgggagtgcttgatg

SEQ ID NO: 12336 - DNA, 487 bp, Zea mays
  Clone ID: LIB3279-205-Q1-N6-H9
ataggcaaacagagtgtgcttttattaagttggcaataacccatacaagccatacacgtacgatggccgtgcataataataatgatacgaaaacacaacttgcatcaagcaaggcacacttgacaatagcaaatactacttatgttcttatataagtaagcaatgactagtaacttgtcgatgcttcaagctccccaatatgtggaggcacacaatatagggcacaagcatttacaggtcccttagaacccgtgaatcttgatgttctctttcttcgcaatcccagcctgaactaggaaagtagcaacattcttgcgctgatcaccttggagctgaatgacctggcctagctctgggtcctgaactacagtaccattgcagcagaattccttcttcagatccttgaggatcttgttatagctgaactctttcttcagaccctggactgtagtcagactctttctgccgttgcgctgctggatgcgca

SEQ ID NO: 12337 - DNA, 294 bp, Zea mays
  unsure (1)..(294): unsure at all n locations; Clone ID: LIB3279-206-Q1-K6-A1
ctttaaggagtttgacaacgacaatatgggtggggctgtctacgttgtcatgtagatgttcgtcgtgctcaccttcggcatccaaatgcccatggatcgtggtcaagttaccccatctacaccataatcagagacaacatgcaaaacaagattgttttacctttcaattagacattacgggggaggacattcagcnngcgtaactgcccaattggaaccttgatgtcaacgagcatagtgagtagggtgacatgtgaaataaaatcttccatgcacttagttgatttattttaa

SEQ ID NO: 12338 - DNA, 188 bp, Zea mays
  Clone ID: LIB3279-206-Q1-K6-A10
aagatctagagttcagtttctgagatggggcaacggcagcggctcagctcgtcaagtttgtgctgggatgccagtttatcccttctagtctattacagaaatgttgttcggagctgagtctattataaacatcttggtctgagtttattgttgagtggtgccagtttttttcaatatacatttatctt

SEQ ID NO: 12339 - DNA, 667 bp, Zea mays
  Clone ID: LIB3279-206-Q1-K6-A11
ctctcctccggctagggtgttcacgcctgccgcggcgaagcttctgccctccccggcgtcgggctctggtcgtcgtcggccgggaagatggctggcggcttcagggtacttcatctggtcaggccctttctggctttcttgccagaggtgcagagcgcggataggaagataccattcagagaaaaagttatctacactgttatttctctcttcatttttctggtgtgcagccagctcccactctatggcattcattcgacgactggagctgatcctttctactggatgcgtgttatcctcgcatcaaaccgtggcactgtgatggagttgggtattactccaattgtgacctctggtatggtaatgcaacttcttgtcggatcgaagatcattgaagttgacaacagtgtgagagaggatcgtgctctgctgaatggtgcacaaaagttgcttggtatcttgatcgctattggggaagctgtggcatatgtcctgtctggaatgtatggcagtgtaagccaacttggaacagggaatgctattctcattatacttcagcttttctttgctggcatcattgtcatctgtttggatgaacttctccagaaaggttatggtttgggatctggtatttctctgttcattgctaccaatatctgtgagaata

SEQ ID NO: 12340 - DNA, 471 bp, Zea mays
  Clone ID: LIB3279-206-Q1-K6-A2
ctccccactgcctcgtgtggccgtcgtgtcccgtgcggaacgccaagccccccctccggcgaaatggcccccaagcgaggtggcagggcgccggtgccggccaagaagaagacggataaagtgacgaaccctctattcgagaagaggccgaagcagttcggcatcggcggcgcgttgccggccaagaaggacctgcaccggttcgtcaagtggcccaaggtcgtgcgtatccagcggcagcgccgcatcctcaagcagcgcctcaaggtaccaccggcgctcaaccagttcacccgcaccctcgacaagaacctcgctacgaacctttttaagatgcttctcaagtaccggcctgaagacaaggctgccaagaaggagaggcttctgaagagggcccaagctgagaatgaaggaaaaactgttgagtcgaagaaaccaattgttgtgaagtatggccttaaccatgtgact

SEQ ID NO: 12341 - DNA, 614 bp, Zea mays
  Clone ID: LIB3279-206-Q1-K6-A3
atttattatattattatgttttctctagaaaatgtgtggttttgacgaagacgcgaagtcttgtaaggattctagtgcaatagaattggcagaaacattaaataattggcctcaaatgaattattacatcacactttgcaaatttgttcttatgccattgaaatactctacaggctatgtgcttttcgttattaatcatgcaaacaaatctatgtctgtgtttaatttcacaccaactccagaatggtgcaaagatatactactaaaaagattttgggaagctattcttcttatttcgaagaaatataaggcagcatacggtgtcaaacgtattagatggtcacatgacatttatatgtggcgacattcaattcgacccgatgctccaatcgacataaaaggtcttaatactggtcattttgctctgcacattatgtagtggtgggatagtggtataaaagcacaacttagtatggatggtgcgactctgcgtaggaatttatttattaatctgttgacatacgaggggaacacatatcgatttaacattcctggacatatacaagagtaccttgaccgcattatggaaaaaattagatgaaatagatagttat

SEQ ID NO: 12342 - DNA, 618 bp, Zea mays
  Clone ID: LIB3279-206-Q1-K6-A4
gtgaaaaatgcggaaatacttctaaaggatagtgtggttgcatgtatatcagataattgccatatgaacaatgagaaaatgcttctaaagcaaaatgtggatgagcaacagatggagaacgagcagatgcttatagatcaggtcactagtgttcaagttttggatagtcaccatgtgcacgaggaacagttgctggtaggtcatgctgcagatgatcatcaccaaatggaaccaaatcccatggctttttctttgggcgttcatgatctggataactactatttgagtagcaagcaaatacttctgtataatgatgcaggaggtatacaccatttgaaggatgggcaaatttttagatgaggctgcagatggacaagctagagttcacaatatgggccatggacgaacgattcctggaattgatctggaagatgattatgcacaggtgtctgccatcagaaatacaggagaatgtctagaatctgcgtaagtttcttttagattcttttctatggtagtttccagggggagaggaaaatccatgacacctggacatgtttgctgtactgtacagaagtgataccttgcacgaatacatggataatgttctaccagaac

SEQ ID NO: 12343 - DNA, 631 bp, Zea mays
  Clone ID: LIB3279-206-Q1-K6-A6
cggacgcgtgggcggacgcgtggggggtggggcggcgaccactggtcccgcgagcacgcccacctggatgagatagccgagcagctcgagttggtcgccctccttgcctacgatgaggatgaggacctcttctacggcgagcaggcccccgccgccgccgccgcccttaagacagatggggtgctcaaggcgctgaacttgggctccccgaagagcggcgacgccccgcgggggttccgggagaaacccaggcactccgagaagccgaccaagtacgccggcagccccaagagcagcgctcctcgcgtgatccaccagcctcgctaggttcgctggccggcccctgatggggactcggtgactcacatggaaggctgctgcctctctagcagcatctgctactggctgcagctgccgtcggcgtcgtggtctgtctgtcaaagtcgaagtaaaaaaacgtgagtagttgtactactgtagaagtttcttttgtatagcatgcacgtaagaaatgaccaaaaaatataacaagaatgcagctgttagtttactgctgctctcctcgtgtgtctagggtgcacttctgtaagcaaacgtatatgatgtgtaatggcagacagcttaatgttac

SEQ ID NO: 12344 - DNA, 557 bp, Zea mays
  unsure (1)..(557): unsure at all n locations; Clone ID: LIB3279-206-Q1-K6-A7
gtcgtcggggttctggacccagacggggctcccgcacgtgagcccccaggcgcggtcccggcggcggctgttcgccgtggacctcctggggttcggccgcagccccaagccggcggactcgctgtacacgctgcgggagcacgtggagatgatcgagcggtccgtgatcgagcgccacggggtcaagtccttccacatcgtggcgcactcgctgggctccatcctcgcgctcgcgctcgccgtcaggtaccccgccgcggtcaagtccctcacgctcgtcgcgccgccgtacttcccggtgccgcgcggggaggtcggcacgcagtacgtgctgcggactgtggcgccgcggcgggtgtggccggccatcgcgttcggcgcctccgtggcctgctggtacgagcacctcagccgcaccgtcagcatcgtgctctgcaagcaccaccgcctctgggagctcgccttccgcgtcttcaccctctacagggtacggacgtacctgatggacggcttcttctgccacacgcacatcgngtcgtggcacaccctccacaaca

SEQ ID NO: 12345 - DNA, 551 bp, Zea mays
  Clone ID: LIB3279-206-Q1-K6-A8
gaagaatcaaatctgaaaatgtccctgagaataaggatgggtcagacgacgacgacgatgacgacgacgatgaagacaatgacgatgagggtggtgacgacgatgatgatgctgaggaggaattctctggagaagaagatgggggtgatgacgatgatgaagatgatgatcctgaagctagtggtgaaggaggaagtgacaacgacaatgatgacgacgaagatggtgatgatgatggcgatgaggacgacgaaggtgatgaggacgacgaagacgaggacgatgatgaagatgacgaagaccagccaccttccaagaagaagaaatgatttgctcatccatggatttacctcagcttctccatgctgttagttgtgttgtttagatcatggacagctttgggatcaatgtagcttgttgcttgtcatggtatcgtagtgtaggaaaatttgacatctgatgttaaatcactatcctgctttcccctctgtgcatgtagtcttaaatcttgatttttactctattggagctgcgattgtgtcatgccattc

SEQ ID NO: 12346 - DNA, 662 bp, Zea mays
  Clone ID: LIB3279-206-Q1-K6-A9
cccccgcccacttgccccacgcctccgggctgcgacctccatccatccatccatgtataaagccgccaacgcccgcctcctcctcagatccctctcccccaactcagctgcgctagcctccgtcaacccgggccgcgccgcctcctccgcccgcctcgcgctctcgctgccgtgcggcgcgtgggtcggccgaagcgggctcgtccgccgcgccgccgccttctccgggacacggccgcgtttcgcgggcgccagggcgcagatcggggccgccgtgcctgccgtcgagcagttccagcgcaggatggcaacccaagctactgtgcatgccttcaaggatattctgaccagcctccctaagcctggaggtggtgaatatggaaagttctacagccttcctgcactaaatgatccaaggattgataagctgccgtactccatccgtattcttcttgagtcagctatccgtaactgtgataacttccaagttaccaagaatgatgttgagaaaataattgactgggaaaacacatctccaaagctggccgagataccattcaagccagctcgagttcttcttcaggacttcactggagttccagcagttgttgatcttgcagctatgcgtgatgcgatggccaagttgggcagtgatgcgaaca

SEQ ID NO: 12347 - DNA, 585 bp, Zea mays
  Clone ID: LIB3279-206-Q1-K6-B1
gcctacaccaagccggggcgcgggctgatcaaggtgaacggcgtcccgattgagctcatcaggccggagatgctccgcctcaaggccttcgagcccatcctgctggcggggcgctccaggttcaaggacatcgacatgaggatccgcgtccgaggcggcgggaagacgtcgcagatctacgccatccgccaggccgtcgccaaggggctcgtcgcctactaccagaagtacgtcgacgaggccgccaagaaggaggtcaaggacatcttcacccggtacgaccgcacccttctcgtcgccgaccccaggcgctgcgagccgaagaagttcggtggtcgtggcgcccgcgccaggttccagaagtcctaccgttgagcgctcggctgcccgctcttgccggacagttgcctgtgttgtcccaacttgccagatcgatgcctgtacccgtggcttaattttctatcatcggagctacttatgtggttctataactagatgctgttttaccttcaacttgtgcttgtgtaccttcatatttggactttttaagccttgtgtcggacgcctttggcattgaaatatgag

SEQ ID NO: 12348 - DNA, 581 bp, Zea mays
  Clone ID: LIB3279-206-Q1-K6-B10
cccacgcgtccgcttcgtgctcttcggctcctccatcgtgcagtacagcttcagcaacggcggatggggcgccgcgcttgccgacatttacgcccgcaaggctgatgtcctgctaagaggatatattggctggaacacaaggcgggctgttcaagtgatggacaaagtgttccctaaggattcagcagtgcagccgtctctggcaatagtttactttggtggaaacgactcaattgatgctcattgttccggtctcgggcctcatgtgccgctagatgagtacatagggaacatgagaaagattgcagaacacctaaagagcctctccgagaagacacgggtccttttcctgagctgcccacctctgaacgaggagatgcttcgaaactcaaccagtactatactgagtgagatcgtccggaccaacgaaacctgccgtctgtactctgacgcgtgcgtagctctgtgcaaggagatgcacctgaaggtggttgatctctggcatgccatgcagaagagggaggactggaagactgcgtgcttcacggatgggctgcatctgtctgaagaagggagcaaca

SEQ ID NO: 12349 - DNA, 637 bp, Zea mays
  Clone ID: LIB3279-206-Q1-K6-B11
cccacgcgtccggttgcgctcgtgctgcgctgtggttcgtcgtcagcacccccgcgccggcatgggcacggactcctccgccggctcgttccagaagatccagatccagcgcgaggacaccacttttgatgcttatgttgttggcaaagaaaatgctcctggaattgtggttttgcaagagtggtggggagttgactatgagataaagaaccatgcgatccacatttaccaacttggtggaggatacaaagcactcattccagatttataccgtggaaaagttgctctggatgttgctgaggcacaacatctgatggagggtcttgactggcacggtgcagtcaaggatatccaggcttcagctaaatggctgaagtcaaatggatcacccaaggctggtgttactggctattgcatgggaggtgctctatcaattgcaagtggagttttagtcccagaggtcgatgctgttgctgctttctatgggacaccatcttctgagcttgctgatccttctaaggctaaggctcctatacaggctcatttacgggagcatgacagtcttgttggtttttcagatgtcactgcagccaagtccctggaggagaagctcaaatcttgcgggataccatatgaa

SEQ ID NO: 12350 - DNA, 474 bp, Zea mays
  Clone ID: LIB3279-206-Q1-K6-B12
gttcctggtcgaggtcaagtctgggcaggcggacgccagcctaaacccagacatggagctccggaggttgaagcagaacttcgactcgtggaagaaagatttcagtggacggatgagggagacgaaggtgatcctgaacaagctcggcaatggcaacgagtcatcgcccaactctgtgaagcggaagtggtggggcaggctgaacacctccaagttttcgtgagtttattatgtattgattggtaatttgtagatgtaaccggtattttacacgccggtgtggttctagcttcctagagtttctactctacgggtgctgtgaaagtccagtgtgttggactggatttgtattccacggagggcgagttgtatagttctcccacaatggcttccttttgaggggtcaaggaccactgaattgtgatgtaattacttgctgaagtagctgtcgaaggggggagattgtgagtgctt

SEQ ID NO: 12351 - DNA, 547 bp, Zea mays
  Clone ID: LIB3279-206-Q1-K6-B2
acctggaagtcgtacgacctctacattggcgagaatgattcttcaccagcatcagggccgtcccggtcagccttgtcatcgttggtggcatggtagaagttcatatacccaataattctttgatctcgggtgccggtggttcttggccggtaatggaattgccttgcgatgcattcccactggcggctgccgccacagctgctgccgcaagccagctgccgccttccgctgtacaggacagtgaggggaggggcggtatactacagattgcagcaggagcagcagcagcaagggggtgaagacagtgaatagcggggggagcaaattcttgttcgttttgcactatgattcagattgattcattaggctttggttcggaggctgtgactatcatgggatggaaggaattacttgattggtggtgtacaattcttggataggacaaaggtttcggtttttggtgtattagttcagaatggtttcatttacatgtctattcagtacactcgtgtaatacggattaaattgatttgaaacaaattgagtg

SEQ ID NO: 12352 - DNA, 539 bp, Zea mays
  Clone ID: LIB3279-206-Q1-K6-B3
ggattttagcatgtttgctgcctatggtggattgttttctattctttggtataagacatttctctgattcctttgtatcctctttcatttataggtagttttctttgagctttgtatgagcacggttgcgattttgacaccatagaaccttcagtatctacatatttgtaagccccgggcggacttcacgggagcgtcccgtatccggcgttgacacgtgtgatcgcggacccgaaatcggattctaatgcagctgtgagcagcggtggcctgagtccgtgaccgtgtcctctctctcgcgcttcccttcaacgccgcctccctaaagatccaccgcttctctgcgagggagtgcgagagcggcgagaccgtggacgacgaccaccgcgggaggctggcggacgcggcagcgaccagcttggcgggggaaggcggaagcgtgagcaccggcgaggaccctggcgtggcgggcgcgagcgcggacgccacgaagcaccgcagcgcgtcaccgaccacggcgagcgagccgaagtaggcag

SEQ ID NO: 12353 - DNA, 564 bp, Zea mays
  Clone ID: LIB3279-206-Q1-K6-B4
caactacttgcaaatgcaaactggccctatgggatggctggtagatatgggatgcaatcttctggttggccatttggcaacggcaacccaaatcagtttttaggtgttccaaaggattggcgtaatggagattggctctgcagctgtggatttcataactattcatctcgtactcagtgcaaagagtgtggtgcacctgtaccatcgggcattccctccacaacaatgaaagctacatctgatgcctcttccacattaggaactaagcggttggcttcagaggacctggccaatgactgggataataaaaggctaaatccaggaaatgacaattatccactttcaacaggagctgcaaataatttatttttgggtattgagcaaggagctggaagcagcaatggccagtctgcctttcccaagtttgacaacgggagctcaatggcattaccatctgggcagggaatgtctggtcttatgggaaaaggggcaaaatggcgtgacggggactggttgtgcaacaactgcaacaatcacaactatgcatctcgtgcgttttgcaac

SEQ ID NO: 12354 - DNA, 585 bp, Zea mays
  Clone ID: LIB3279-206-Q1-K6-B5
caatccttcaagcgcaagctgcctccgggtggtggtgcggtcgtgagaagggatggcgggccgtggcaaggctatcggcgctggcgccgcgaagaaggcaacgtcgaggagctccaaggccggactccagttccccgtcggcaggattgccaggttcctcaaggcgggcaagtacgcggagcgcgtcggcgccggcgcccccgtgtacctcgccgccgtcctcgagtacctcgcggctgaggttctcgaacttgccgggaacgccgcgagggacaacaagaagacccgcattgtgccgcgccacatccagcttgctgtgcgcaacgacgaggagctgaccaaactggtgggtggtgccaccatcgcgagcggaggtgttatgcctaacatccatcagcatctgctccccaagaaggctgcctcctccaaggccagtgtcgacgacgacgacaactgagactgcttcctgcagaaatgatccgaccaccgccttgttttgtaggaataggatgatgttgtcttccgggaggaggcgggtttgttgggaaggaaaattagattagtatcaggttttttgaatgggat

SEQ ID NO: 12355 - DNA, 628 bp, Zea mays
  Clone ID: LIB3279-206-Q1-K6-B6
cccacgcgtccgcgtctatctctcagagagaatgagtatgagaatcactatatcaaagaaacaaaaggtaaagaaactgctaatgtctataggtcaggaataaaggaaaaaactggtcttggaaaagaagatcctaaagtagcaaagaatattgttgataggagaaggaaagggcttgcgtgactcaaatctgcttggacatctgagatggaagatcctttgtatgatgttgatcttgctctcattctttgtaacactaatgcattcaaagatggtttgctctttctatatgagaaactaaaactttacaaagaggttattagttgttacaagcaagcacatgatcatcaaggtttaattgcatgttgcaagaagttgggggactcatctcaaggaggggatccttctctctggggggatctattgaagtattttggggagcttggggaagattgctctaaagaagttaaagaggtcttgacctacattgagaaagaggatgttgtacctcccatcgtcgtgctacagacactatcaaaaaacccatgcttgacactctcagtcgtcaaagattacattgctcgcaagcttgaacaagaatcaaagctaattgaagatgatagaaaat

SEQ ID NO: 12356 - DNA, 517 bp, Zea mays
  Clone ID: LIB3279-206-Q1-K6-B7
gcaggctctcctgctccccgcgcggggcgcgccgccgacgccggcgatgcttcggcagcgtgcggtttctgcctccgcgtgtgcgtcgcaggtctgccgccccctattcggtgccgccagttgcatctcctgtggggtccacggaagcgttcggcggcacctcacagtggcggtggcggcgggcccgccctcgccttcgtcctcaccttcgtcgggaccgctctacccgacgcctccacccaccgagcaggaggtggagagggtcaagctcgagcaggttatgaggagactagagaaaacagcaaggtatttcaagaatttgggtaccctggggttctggtcccaattggtgtgcacaattatttctgctggaattttggcattctctacagttgtaacggggaaggtgacatcaccctttacattctatgcaactgctgctggtattgctgctgcttttatttcagtcttctggtcatttggttacatccgtctctctgaaaggcttagaaaaaca

SEQ ID NO: 12357 - DNA, 551 bp, Zea mays
  Clone ID: LIB3279-206-Q1-K6-B8
cataaacctaaatcactaagcatgaggtgctaacatgacatttcagagtaggagatgattttatggaatgcctgagagggatttgtatctgccgtaagtattatgcgagattttgttccagccatttacgatacaactgtaatagttcctaaagattcccctcaaccaacaatgctgcggattttgaaagggcaatcatcagtgatacatgtccgcatgaaacgtcatgcaatgagtgagatgccaaaatcagatgatgacgtttcaaaatggtgtaaagacatttttgtggcaaaggatgccttactggacaaacatttggcaacaggcactttcgatgaggagattagacctatcggccgcccagtgaaatcattgctggtgaccctgttttggtcgtgcctgctgttgtttggtgccatcgagttcttcaagtggacgcagctcctatcgacatggagaggagtggcattcactgccgcagggatggcgctcgtgacaggggtcatgcacgtcttcatcatgttctcccaggctgagcggtcgagctc

SEQ ID NO: 12358 - DNA, 607 bp, Zea mays
  Clone ID: LIB3279-206-Q1-K6-B9
cggacgcgtgggcgccctaggtattgatacacgggccagcgaacccccttccccctcacccacctggtaggccgcgccgccgaaatcgactccagggagtttgcaatcggggtagagtgacgtctgggtgtgggagatgggcgccgccgcgatcagatcaatcctatggtggcggtgtggagtcctctgagtcatgcccgtgtgccttgccatgttgtgcgcaacgcatgcgtggctttgcttggggggactcatgcttggtgtatggaggagttgctcactggagcaatggtggcgtcatggatccgctcctcgccgaggccggcatcacccgaacgacaatccatggatatcgtatcaaagattgtgcaggtcccgaaaataactgggaaggctgtctgtgttctctcagtgtttggggccgttcaggattgctatctgctccactctgctgtcatcttaaatcacaagggtcctttagaaatcattcgtgtgtttggatccattttgacatttgatagtcctggatttgggtgcttatctgcgactcttgcttgtggtgattgttctcttgtcagtggcattgcagttggacctctcatagctg

SEQ ID NO: 12359 - DNA, 664 bp, Zea mays
  unsure (1)..(664): unsure at all n locations; Clone ID: LIB3279-206-Q1-K6-C1
ccctcctcatctctgctctgctctggaccgtgaactctccagctccccctcgctccgttcccttccgcccaaatcaccgggaccaccaccgccttcttcaagatcggcgggcgggcaccggccggctatgacatccaccgtcaccacaaccgttgggtgcggggggctccccgtccgcccgtcgtcgacggcgaccagaggacgcccacgcagatgcgccgtccgagcccaggccgcgggagcggatgcctccaatgataagtcagtggaggtcatgcgcaagttctccgagcagtacgcccgccgctccaacactttcttctgcgccgacaagacagtcactgccgtcgtcatcaagggacttgctgatcacagggatactcttggagctcctctatgcccttgcattatgatgacaaagctgcggaggtagcacaaggattttggaattgcccatgtgtccccatgcgtgagaggaaggaatgccactgtatgctttttcttactcccgataatgactntgctgggaaggatcaggttatctccttcgaggagatcaaagaggcgacatcgaagttctagcccttgtatttgtcacggagtgtttacttgacagctaattttttatatgtatatgtacttaagtagcatctataagatatgc

SEQ ID NO: 12360 - DNA, 541 bp, Zea mays
  Clone ID: LIB3279-206-Q1-K6-C10
gcgcccacgcgtgcgcccatgcgttcgtcaaggacactgttgaagagatagctgaacagcaaggaaagagcgaggagaaagaaaatgatgaagtctccactgccgcttctgatttggcacagaagttaacagtggcagagcccagcaaggaggaaaatgcagagaaagaggaggctcctgcatccgatgataagaaggatgataaagagtgaaggttgaaggcaaacaagggtcaaatggatgccattccattcatttcgtttccaaggttcagcttccccgcaaattttcattgtgttttctccgagatgaatgtttgtgttcggtgaaatcagagtcgtcagtcatctacatagcttttcttggttgatagactgttattttaagtcgcatgtttatctgggatggctggggtcagcatgtttgtacaattatttggagttgcttttggaatggacgcggtttgatgagttgcctacagcatgagatgtcttttcgctccacttttctggttcattcgttctcaataatatgggatgct

SEQ ID NO: 12361 - DNA, 486 bp, Zea mays
  Clone ID: LIB3279-206-Q1-K6-C11
atggatggcccctgagcttatacggagtgaaccttttacagagaaatgtgatatattcagccttggtgttatcatgtgggagctgtgcacattgagtcgcccatgggaaggcatctccccagttcaagtggtgtacgcagttgctaatgaaggttcacggcttgagattcctgaaggacctctcggcaggttaattgcagattgctgggcagagcctgagaatcggccgagctgccaggagatcctaacccgtttgctggactgcgaatacactgtcagctgaaatggaagctgctcgctcgtccactcaattcctgcacaggtggaaacatttcttgtataaaacctgtaaaaaaaggctgccgattctgcggacttgaggtcacatatcgaagcgctgtgtttttttttaaacaatggcgaccctttctccaaaaaaaatgtaaaaatgattccctggttatagaagaacatgtctgattcgga

SEQ ID NO: 12362 - DNA, 587 bp, Zea mays
  Clone ID: LIB3279-206-Q1-K6-C2
gttgaccgaagttggaaaatacttctgatacttacagatttcacagaggcagcgattcgcacataatttaattggttcttcattgtgattacaattatgttctgtccactgagtttacgtattgcatttcttgctttaggtcttgtttattttctactattttccttcaagcacgtggaatagtacgtttgacaaacaatttgctgacgaggttttcgaacacggctgaacacgcgcgcaaggcgtgcacagtacacgcgcgcagggggaggaggagaacaagaggatggtgaaggcaaggcccaagccaacgccggtcaaggcggccccagaagtgatcttcgacccaatggcctctggtgcccggaagcccctccgcccaggggcgccgtcagccagcaaagaatggcacagcttcatgggatcgagtctgtcggatatgtatcggaagccagttttggagaaatctgctgacacatctgatgaggagcctgacattgatatcatgaagctgctgaaagatgttgagatcattggtgcccctacatttaaggggcgaaagcaaatcgagaaccgcagagtagttg

SEQ ID NO: 12363 - DNA, 582 bp, Zea mays
  Clone ID: LIB3279-206-Q1-K6-C3
cggacgcgtgggcggacgcgtgggcagtcgctcaaaaccctagagctctcgcctgctcgcctccgccgccggagcgagctccccatcttcatccgtcaaccatggcgacccagatcagcaagaagaagaagttcgtcagcgacggtgttttctacgccgagctcaacgagatgctgacgcgggagctggcggaggacggctactctggcgtggaggtgcgcgtcacgccgatgcgcacggagatcatcatccgcgccacgcgcacgcagaacgtgctcggcgagaagggccgtaggatcagggagctcacctccgtcgtccagaagaggttcaacttccctgagaatggcgtagagctttacgccgagaaggtcgtcaaccgtggcctctgtgccatcgcgcaggccgagtccctccgttacaagctcctcggaggccttgccgtccgcagggcttgctatggtgttcttcgttatgttatggagagtggtgccaagggttgtgaggtgattgtgagtggaaagctcagggcccaaagagccaagtccatgaagttcaaggatggctacatgatctcatctg

SEQ ID NO: 12364 - DNA, 650 bp, Zea mays
  Clone ID: LIB3279-206-Q1-K6-C4
cggacgcgtgggttgaggctgagtttgggcagagctcccacaagggcaaggatggttttgacaaagattctatcagcaagaggcttgaggagatatataaacggcttgagctcattgatgcggatgcagcagaggctcgcgcagcatcaattttggcgggtcttagttttactccagaaatgcaacgcaagcgtacaaaacaattttctggtggatggcgcatgagaatagctctagcccgtgctctgtttattgagcctgatttgctactacttgatgagccgacaaaccatcttgatcttcatgctgtgttatggctagaaacttatctcctgaagtggccaaagacattcattgttgtatcacacgcaagggagtttttgaatacggttgtcaccgatatccttcatctgcatggtagaaaactacatgcttacaaaggtgactatgacacatttgagaggacaagggaagagcaccttaagaatcagcagaaagcctttgaaacaaatgagaaggccagacagcacatgcagacattcattgacaagtttcggtacaatgcaaagagagcatcacttgttcaatcaagaatcaaggcattggagcgaatggaacatgttgatgcagttgtcagcgatccagactat

SEQ ID NO: 12365 - DNA, 589 bp, Zea mays
  Clone ID: LIB3279-206-Q1-K6-C5
gaatgctgtggtcacagtccctgcctacttcaatgactcacagaggcaggccacaaaggatgctggggtgattgctggccttaatgtgctgcgtatcatcaacgagccaacagctgcagctatcgcctatggtcttgacaagaaggctaccagtgtcggtgagaagaatgtcctcatctgtgatcttggaggtggtacctttgatgtctccctcctcaccattgaggaaggaatctttgaggtcaaggccacagctggtgacacccatcttggtggtgaggactttgacaacaggatggtcaaccacttcgtccaggagttcaagaggaagaacaagaaggatatcactggcaaccccagggctctccggaggctgaggaccgcttgtgagagggcgaagaggactctgtcttccactgcccagaccacgattgagattgactcgctgtatgagggcatcgacttctactccaccatcacccgtgccaggtttgaggagctcaacatggacctgttcaggaagtgcatggagcctgttgagaagtgcctgagggatgccaagatggacaagagcaccgtccatgacgtt

SEQ ID NO: 12366 - DNA, 526 bp, Zea mays
  Clone ID: LIB3279-206-Q1-K6-C6
ggaactaatattattgctggagtaagcttgggaatggaatcaacagcactaccagttctagtgataagtgttgccattatatcagcatattggctggggcagacctctggcttggtggacgagtctggcaacccaactggtggtctttttgggacagctgtagcaacaatggggatgcttagcactgcagggtatgttctcaccatggacatgtttggtcctatagctgacaacgctggtggtattgttgagatgagccagcagcctgaaagtgtgagggaaatcacagatgttctagatgctgtgggcaacacaactaaagctactacgaaaggatttgccatagggtcagcagctctggcttccttcctcctgtttagtgcatatatggatgaagtagcttcttttgctcaattgccattcaaggaggttgatatagcagtcccagagatttttgttggtggtttattaggctcgatgcttatattcctgttcagtgcatgggcttgctcagcagttggcaaaa

SEQ ID NO: 12367 - DNA, 588 bp, Zea mays
  Clone ID: LIB3279-206-Q1-K6-C7
cccacgcgtccgcggacacgtggggtcggcctacaaaaacactgtcgagggcataactgggatcatctcgaaaaccatctcaaagaaagggatgcttgaagtgtacaactctttgagcgaggaaggcaaaaaggagttcaacaaggcttatagcgcatcgttttacccatgcatggatatactctacgaatgctatgaagatgtggcctctggaagtgaaatccggagcgtggtgttggctgggcggaggttttatgagaaagagggcctcccagcttttccgatgggcaacatcgaccaaactcgcatgtggaaggttggtgaaaaggtgcgctcaacccgtccggaaggtgatcttggcccgctccatgccttcactgctggagtgtacattgccctgatgatggctcagattgagatcctgaggaagaaggggcactcctactctgagatcatcaacgagagcgtgattgagtcggtggactcgctgaacccgttcatgcacgcccgtggggtcgccttcatggtggacaactgctccacaacggctcgcctgggatccaggaagtgggcgcctcgcttcgacta

SEQ ID NO: 12368 - DNA, 644 bp, Zea mays
  Clone ID: LIB3279-206-Q1-K6-C8
gcctctcattcccaaacacaccatacatgcaacgttcaacccaaaccacaggttttgttcagctagctagtgttctttgacgtttttacatatatgaatcattgctacagtaccttggttggttcatatttgctcatgagcacgatgtatatatatcgctttattgcctttggcacatgaagtttttatcagggccacttgcgatgctgagttattgaagggagatttattttactacctaccaatgatacgagtttgtcattagttgctgatgtcatagccacacacatctgatgggaaagaccgaaagaggatccacatgggcaaacctgttcgtgtggactctggaatatagctggggccgtatgaaccctgtagctgatgggtttagtgttttttccagcaggtcgttatgtgccaaagaggccaaatcaaatttgaataggagggataatcctctccctattcaaatttgaataggcaggggattcctcccacatggattccctccaattccttatccaccaaatcagttgttaggcttgtttgggagcaacaggatttggaagaattgaagggactaaaatcactcactatttaattttgaatagtaagagattttagctcacttaatcccgtccgat

SEQ ID NO: 12369 - DNA, 585 bp, Zea mays
  Clone ID: LIB3279-206-Q1-K6-D1
cccaaccaaagacacgaatcagccatggcgctcgcctccgccacgtcccgccccctcctcggtcgccccgccggcaccgcgcggccccacctcgccgtttcctcatcctcccccgcctcctcgatccgcttcccccgcggcgccgacggcggcgccagcagagcggccgtctctctccgcgcccccacgcctccagtctgtgaccccaaaagccttcttttcatgtttggaatggagctggactacagcgacgccctcattggtggcggcttcttgttccagaatccaaacgcaacaaaaacctgtgggtgcggcaaatctttcgcgactggaaaggagaccgaggccgcggcaaccacttgcaacaactagagtagagaaatattgttagctaaacgtgatgtggcatgttgtatagcttgctcatgttgaagccctgtggctacaccacagatacataaagaggcatagttcaaaggaattacaccattaccaatggcctaattcagattttcttgtttggtgatcattccgaagtccttaaacttgtggtatggtctctcaaaatgcattgtattttcaggt

SEQ ID NO: 12370 - DNA, 623 bp, Zea mays
  unsure (1)..(623): unsure at all n locations; Clone ID: LIB3279-206-Q1-K6-D10
cgcagagataggcgtcttcgtactcgcgtacctgcgcggctcaaacctttcccccttctcccaattcccgccgccgctccatcccgtaacgcgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaggaggatgcagccaacaactttgcccgtggtcactacaccattggcaaggagattgttgacctgtgccttgatcgcatcaggaagcttgccgacaactgcactggtctccagggcttcctcgtcttcaacgctgttggtggaggaacgggctctggccttggttccctcctnctagagcgcctgtctgttgactacggcaagaaatccaagcttgggttcactgtgtacccttccccc

SEQ ID NO: 12371 - DNA, 657 bp, Zea mays
  Clone ID: LIB3279-206-Q1-K6-D11
gcgcacgcctccgccaccctaccaactactggataaggctagctaaaccccacgccgccgcggcgacctcctccgccggcaggatggacagcctcaggggagccaagttgccgggcgtgccgaagggcgggagtgcgctcgtgaaggtggcgctgctcggcggcgcggggctctacgccggcctcaacagcttctacaacgtcgagggcggacaccgcgccatcgtcttcaaccgcctcgaggggatcaaggacaaggtgtaccccgaaggaactcacctgatgatcccgtggatcgaaaggccgatcatctacgacgtccgcgcccgacccaacctcgtcgagagcacctccggaagccgcgacctccagatggtgagaattggtcttcgtgtccttactcgacccatgccagatcagctacctaaaatctacaggaacttgggggagaacttcaatgagagagttctgccttcaatcattcatgaaacactcaaagctgtggttgctcaatacaatgccagccagctgatcacccagagagaggctgtgagcagggagattaggaagattctgactgagagggccaacaacttcaatattgctctggatgatgtgtccatcacaagcctcagctttggaaaagagtttactcatg

SEQ ID NO: 12372 - DNA, 648 bp, Zea mays
  Clone ID: LIB3279-206-Q1-K6-D12
ggagagttgtggcgtttgcgagattcggaaggagaaccacctggtgtgatgggatggtggccttcaagatcagttacatttattgaaaatcatgacactgggtccactcagggtcattggccttttccgtcagatcatattatggagggatatgcttatatactcacccaccctggcatccccacggtgttctatgatcacttctatgaccagggtgtgcctctccatgacgaaattgctaaactgatgcaaatcagaaaatgccaagatatacatagccgttcatcaatcaaaattctggaggttgggtcagatctgtactcagcaatcatcgacgataagttgtgcatgaagatcggggacggctcgtggtgcccaagtgatccagagtggaggctggcagtctctggtgacagatatgctgtgtggcacaagtgaagcatataagtgccctcgatacagtttatttctgctctcaggaacaggagtaattagcatgttagctgaataacagcacggtaaaacatgccaaaaatgaccctcttcgaggttacctgtacaagaggagtgcctaaatgtaatgcttaattagaaatacgtgagatcgggcggctggtccccaggtgagacatacattttgctaatcgc

SEQ ID NO: 12373 - DNA, 504 bp, Zea mays
  Clone ID: LIB3279-206-Q1-K6-D2
gtagaactagcgctgaatccggtgaagcttcaagcgctgactaacaagctcaaggaagttcgtatgacctgcccgttgtttgatacagctcgatgggtgcgcaaccttgaaagggcatactacaagatgtggaacctttactgctccagtcgccacccggagccattcaaggtggtagaggatgacaatgagttcccatttgaccgctaacgagatctcatcagcagcccggctctgtaaataaggcgagagttgtagaatatttagcatcgtgaccgctgttgctccaggtgcttgtttgccgccccctttcctgccgtgcacatcacctctgtggaggctaacttcgtagtatgtatgtactacactgcaaaagaagtcctagggttagcctattgttatcactatttagtttgctatattgtatctcggtcgtggtttctaaaataaactgcaacctttaggagtgttgatgtgaaatctcattcttaatagcttctgtcc

SEQ ID NO: 12374 - DNA, 604 bp, Zea mays
  Clone ID: LIB3279-206-Q1-K6-D4
aacaaaccattgttggacgcgttcccctcctgcacgcaacctcatctcgtcctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttgttttgttttggtggtcgagcatcgcatgttctgcttctggatccagatctggagaaatcgcgaagtcgtcgtcgttcggttcggagcggatctgaggcgacgatagatggaggcggcgggatctctcggtctgcagtcctgctccacctcgatggatgatgtctctgcgctgataattattggatcaatttcgataattattagtagatctatgagatatgccgcctggaagaggcgaggtaagctgcagcatgtaaaaaagagaaaaaagatgtgacatcctagaggaggaggcctttgccatgatgggtgcgctcgcatggcaggccaggcaataataaaaagatgattattgcgtgccgggg

SEQ ID NO: 12375 - DNA, 662 bp, Zea mays
  unsure (1)..(662): unsure at all n locations; Clone ID: LIB3279-206-Q1-K6-D5
caagaaagtttcgtctccttggtatcaaaactatgctactctgtaagtgtgtactagccattttgcgttgcaggtacttgccgaaggtgtttgatcggtttggaggtgcccaaggatttctgttccttcaagatcgtatggtcttcaattactggaacctcttgaatgctgataaggctgagctctggataaccaaccaggtgaaggaatcttggtcggatgtgcctctacatggtaacaacattgagtggtttgtgaaccaaggggatatgattaaaaaggcggtcagcaattttccatctcaatatcaagataattacaggagaagtgtaggtgaaaataatctgattcgttgcagcagtgagatattttacgtacctcaacggtacacccgtgatttctcagatcttgtaaaagttattgggagcttagacattcatcacagttttgcagtccccatgttattccttgcgatcgattcaccgagcaactttgagtccaaagctttgacaaaacttgtctacagggcagatcttccatcagatacaactctttcaacaatttatactactgaagcacatgcagtgtaccctgtgaaggttcagaacgagatggattntgttaaactgataagggctatggctttaggagatccatttctt

SEQ ID NO: 12376 - DNA, 578 bp, Zea mays
  Clone ID: LIB3279-206-Q1-K6-D6
caaaggcaaagggcaaagcagaagtggcgggtggcctcgtcctcctcttctccgtcgcggctcagatctctgcgtgcgtcgatggcgtcgttctcggaggctccccccgggaacccgaaagccggcgagaagatctttaagaccaagtgcgcgcagtgccacacggtcgacaagggcgccggcgcacaagcaaggtccaaacttgaacggtctttttgggagacagtcgggtaccactgcaggctactcctactctgcgggaaacaaaaacaaggctgtagtctgggaagaagacactttgtatgagtacctgcttaaccctaaaaagtacattcctggaaccaagatggtcttccctgggctgaagaagccgcaggagcgtgctgatctcatcgcgtacctgaaggaagcaactgcatagttcattgacatgccttttgccatgaagagaaaaattgttttgcagtttaataaaaaacattttagacaatttgggtcaccctgtttgaacagggtgcaaccacgtctcattattttcgttcttatggtgtcggtatggaatgcctaggtgtttagct

SEQ ID NO: 12377 - DNA, 666 bp, Zea mays
  Clone ID: LIB3279-206-Q1-K6-D7
gacacttccaccctgaaagagaagtcccagcagaaaactcgtagtaatgtggccaacactattaaaggcaatgctttgaaggacaagcccatcctgaaagagaagtccacccaggaacagaggtcaaaagctcttaagaacccaatgaaaattttagttgatgaagagatcaaaatgtgccatgagtgggctaaggatggggtggagggatttcactcaacacaaaataattctcagaagttggataaggatctgctagacaaacgtgtcaagaagaaagtggcggcagtaaactcagccttgtgtggttggccagatacagtatttgattctctaatgtatccatctatggaggttgctgagctttttttatgaacaaaacgtgctggaggtggaacctgagattctcccggacatcagttggcgtctctctagttcagtagatggtaaagcaaagattgctgaaggccgtcttaccgatgatgagcttgaccagtaccattctttggagaacaatccaattatttttgagctgagagacgagccagcgatcccgcagctgggagtgtattgaagaatctgtgccagctggacagaaagctctgtttccttgctgcttgctctggagtctggagttgtctagtctagaatgctagtaggtcttga

SEQ ID NO: 12378 - DNA, 650 bp, Zea mays
  unsure (1)..(650): unsure at all n locations; Clone ID: LIB3279-206-Q1-K6-D8
gtccccgatcatcgcaccacctgtagcccacctcgctctcgagtctcgacccagcgacgagatggccgcggtggatctgaccccaaggacgcccaagaaggcctacggcggcgacggcggcgcctactacgagtggagccccgccgacctgcccatgctctccgtcgcctccatcggcgccgccaagctctcgctcgccgccggcggcctctccctccccagctactccgactccgccaaggtcgcctacgtcctacaaggcgcgggcacctgcggcctcgtcctgcccgaggcgacgaaggagaaggtggtggcggtgaaggagggcgacgcgctggcgctgcccttcggcgcggtgacgtggtggcacaacggccccgccgcgcaggccgacctcacggtgctcttcctcggcgacacctccaagggccacaagcggnggcagttcaccaacttccagctcacggggtccgcgggcatcttcacgggcctgtccaccgagttcgtgtcgcgcgcgtgggatctgccggagcccgacgccgcgaggctggtgtcgagccagccggcctcgggcatcgtcaagctgcccgcctccgctgccgcgctcccggcgccctcgccgcaggaccgcgccggngtggcgctcaact

SEQ ID NO: 12379 - DNA, 623 bp, Zea mays
  Clone ID: LIB3279-206-Q1-K6-D9
tttttaatggttctggaaaacctattgacaatgggcccccgatattacctgaagcctacttggatatctctggaagttctattaatcccagtgagagaacctatccagaggagatgatccaaactgggatatccaccattgatgtgatgaactccattgctcgtgggaaaaaaatccccctattttctgctgctgggctccctcacaatgaaattgctgctcagatctgtcgtcaggctggccttgtgaagacattggagaaaggaaagcatgcagagggtggtgaagatgacaactttgctattgtgtttgctgctatgggagtgaacatggaaacagctcaattcttcaaacgtgattttgaagagaatggttccatggaacgggtcaccctttttctgaatctggctaatgatcccaccattgaacgtattatcacccctcggattgctctaacaacagcagaatatttggcatatgaatgtgggaagcatgtacttgtcatcttgacagatatgagctcttatgcagacgcacttcgtgaggtttctgcagcccgagaagaggtgccaggtaggcgtggttatcctggatatatgtatactgatctggcaacatatatg

SEQ ID NO: 12380 - DNA, 619 bp, Zea mays
  unsure (1)..(619): unsure at all n locations; Clone ID: LIB3279-206-Q1-K6-E1
acaactcacaacccgagccccccaaacccgaagcagcaggagctcccctgaccttgctccgcctccgatcaaggaaaaggaagatgagctactacggccagcagccccccgtcggcgtcccgccgcagcaaggctacccggggaaggacggctacccgccagcggggtacccgccggccggctaccccccgccggcgcagggctacccgccgcagggctacccgcagcagggttacccacagcagggctacccgccgcagtacgcgcagccgcctccacagcagcagcagagcagcgggccttccttcatggaaggatgcttggctgccctctgctgctgctgcctcctggacgcctgcttctgacggaaccatccgtgcctggtccaacacggctgcaagtgaagcaaccagcttacggaagagctggaactgggccgtgctattctagctttgtcctgcgttatcgccctctnttctttttttttctctctctctctctctctgntatgagactactggtactctgtcgatgtcgattggattagactanggctggtgtgtattctgtggatgctccgtgtttctggtgggattcaagttcaccctgggattattgt

SEQ ID NO: 12381 - DNA, 635 bp, Zea mays
  Clone ID: LIB3279-206-Q1-K6-E10
cggacgcgtgggccgccgacaacgctctctaccgtgcgagaccccaagcaccagcgcggcggcgggggcgggggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggcatgaattttaccactgataaactcagatccctagtgaagaagtggcagacattaatcgaagcccatgttgatgtcaagacaaccgacaactacatgttgcgtttgttctgcatcggcttcaccaagaggcgcccaaaccaagtcaagagaacctgctatgctcaggcatcccagatccgtcagatccgccgtaagatggttgagattatgatcaaccaggcttctacatgtgacctgaaagaac

SEQ ID NO: 12382 - DNA, 660 bp, Zea mays
  Clone ID: LIB3279-206-Q1-K6-E11
cagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccgggaacgcggcgaaggacaacaagaagacgcgcatcgtcccgcgacacttgctcctggcgattcgtaacgacgttgagctcggcaagctgctgtctggcgtcaccatcgcgcacggcggtgtcctccccaacatcaacccggttctcctgcccaagaaggtggcggagaaggcgtccagcggcggcagcaaggagagcaagtcccctaagaaggccgccaagtccccaaagaaggcagccaagtccccgaagaaggcttagaaattagtcacttcactagcgctctgctgtagcatgttcgtgtttagatctgtggaacttatgtgttccagcctaatttcctctttgccttgtggctcctgatatgttcactggcat

SEQ ID NO: 12383 - DNA, 611 bp, Zea mays
  Clone ID: LIB3279-206-Q1-K6-E12
cccacgcgtccgatccctcactctcctccgaagccatcgtccccgtcccagcctccccggactccaggggcaaaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggtcgcccgcccgcatggcaactccggcgtcgtccgcgccaagttcaggtccaacctgccgccggaatccatgggccgtaaggtcagggtgttcatgtaccccagcagcatctaaagataatctgaatgtgtggaggacccttttcttctagattttatcttcagctgtccttgtaagggttgtgttcaggttgagagttagcaggttgagctgtctatctgagaaccatttaaagttctctgagttttggtgttatggatcactggaagtattatatgaagtttaagttagaactaa

SEQ ID NO: 12384 - DNA, 578 bp, Zea mays
  Clone ID: LIB3279-206-Q1-K6-E2
ccctattcaccatccaatccaatcggcttcccccaggcacccatggcgacggcggtggaggttcccgtggaggcgccggtgaggacagtgaaggtcaccaatgtctctcttagtgcaactgtgcaagacattaaggagttcttttccttttcaggagatattgatcatgtggagatgcagagtggtgatgagtggtcccaagttgcatatgtcactttcaaagatgcacaaggcgcagaaacagcacttcttctttcgggtgccacaatagttgatctttctgtcatcattgcacctgctccagagtatcagccacctcctactgcctctgctccaccaatgagtggaaccagagttccagttggtggtggagacaacaacgttgttcacaaagcctaggacgttgtgagcactatgcttgccaagggtttcgtgctaggcaaagacgctgttggcaaggccaaagcattcgatgagaagcatggcttcacatccacagccggtgctacagtggcctcaattgacaagaagattgggctgactgataagatcacgacaggcacttccttggttagcgg

SEQ ID NO: 12385 - DNA, 493 bp, Zea mays
  Clone ID: LIB3279-206-Q1-K6-E3
ggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgacgcgttgcagcatccattctaaggctttccaagattgtctcaacaactatggcagcgagatcagcaagtgccagttctacctagacatgctgaacgagtgccgccgtggtggtgtgtctgcctaagctgcttctggggttattcgtggattttctttcggtgatgctatctcattaataagataccgtgaaacttttgtctccacagcttgaagctaaacttcctgggattaatacattttgttatcctatgctgttggagcagacttttgtctcttgatcataaatatttaaacgaacctgttatgttggaat

SEQ ID NO: 12386 - DNA, 685 bp, Zea mays
  Clone ID: LIB3279-206-Q1-K6-E4
cggacgcgtgggttcaagtcagcggttgaggagattgagatctctggattcgatcctgaacaagccatagagtgacaagcacacttagaaccagtgaaggtgagcaatgatataactgaaagcagcacagcgtgagataaaggaatccttttacttttatggtgacattgagcatgtcgaaatgcggaggggcgataaactttatcaagttgcctacattacttagaacgacaacgaaagagctgagacggcgatgcttatcacggcagccacaataggccgatatggatgacatagctacgccagcctatgattatgagctaccagctaatggattagctgctgttgaccctaaagacacaaaaccttctgcccttgaaaatgtcaaggacattgttgggaccatgctgagcagagggattgattgctctgcagagatgcactggacaaagcaaaagctatggacgagaagcaccagctcacgtcaactgccacagctagagtgtgttgcttagacaagagaataggcctaagtgagaagatcagggtaggcacttcagttgtaaatgataaagtgaaggaaatggatcagaaataccaagtctctgagaagacaaagtcagcgctggcagctgctgaacagagtgtctcgaccgctggatctgctatcatgaagaacaggtat

SEQ ID NO: 12387 - DNA, 440 bp, Zea mays
  Clone ID: LIB3279-206-Q1-K6-E5
gttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcgtgctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatactgtggcgggcgccgtgatggaggcggctactgcggtggcggtggaggctaccgcggtggtcgtggaggctaccgcgggggtggggga

SEQ ID NO: 12388 - DNA, 602 bp, Zea mays
  Clone ID: LIB3279-206-Q1-K6-E6
gtcctcgcaccgcacgcaacaagtacgcaggcagcgcagcctcgagccgtcgccatggcgagcaagcacctcgtcctcgccgcatgcctcctcctcctgcccaccgcctcggtcgccaccgacgtcgactactgcagtaagaaggactacccggtgaaggtgagcggggtgcagatcgtgcgcgcgatccggtcgaacccggcaagcccgccactttcaagatctccgcttctactgataaaaccatcgagaaggggaagctggttatcgacgtcaagtatttcttcttctacgtgcactcggagacccgcgacatctgcggagagacttcctgcccagcgaccggcgacttcgtgctgtcccaccagcagacgctgccaggcttcactccgccgggctcctacacgatctacatgaagattgtcggggacgacaacgaggagctgagctgcatctcgttcgggttcagcatcggcttcgtcgcgtccagctgaacgcgtccgagcctgggcacgagaggcagccagcccatggatgtaaattacgtggagcacactctgtatcctatgactttcaagtatctaggtccatgtaagcttttt

SEQ ID NO: 12389 - DNA, 673 bp, Zea mays
  Clone ID: LIB3279-206-Q1-K6-E7
cccacgcgtccgataattgaaagaaacatacggctgaagatccaacaaagtccagactatgctgaacagctagattatgaagctggactggaggacttcaaggaacgtttgattaattatgaaaaggtctacgagccagtaggggaaggttcttacatcaaaatgattgacatggtaaaggggcaagatggtcagttacaggtaaataatatcagcggttatctccctgggaggattgtcttcttcttggtgaactctcatcttacaccacgacctattttgcttaccaggcatggtgagagtttacataatgttagaggaagagtcggtggtgatacagttctaagtgaaactggcgaactttatgcaaagaaactagccaactttatagaaaagcggctcaaatgtgagaaaacagcaactatatggaccagtacccttcagagaacaattttgacagcaagtccaattgttggattccccaaggtatttggttacacgatttaggagtcttcttaaagaactgttgctatgtaagtacagcaagattgctcgacttgtgttatttgtagatacaatggcgtgctcttgatgagatcaattctggagtgtgtgatgggatgacttatgaagagataaagaaaatcatgcccgaggaatttgagtcacgaaa

SEQ ID NO: 12390 - DNA, 335 bp, Zea mays
  Clone ID: LIB3279-206-Q1-K6-E8
aaatttaccatttgtattcgaagttggcaccgaggcctcctttggttcatagaaaaaacagaggaaaaacttagttcatgcttttagttcatagaaatggagtatgtgaatagtgtatgaagttttccagtgtagcactagtgtttgatgggatcctgagagatagggaaggccagagttgacatgaaaatgaagacatccagatagttgacatgaaaatgaagttctccagaggcatcatggatcctggtaagagaagtaggaaaagttgacgttgacatgagaagatgcaatataagcagacttgaaaagatgaaatatacaaaacattcttc

SEQ ID NO: 12391 - DNA, 636 bp, Zea mays
  Clone ID: LIB3279-206-Q1-K6-E9
cccggcgaagccgatggcggtgtacgccaccatctgggacgggtccgcgtgggccacggacgggggcaagtacaaggtcaactacaagcacgcgccgttcgcgtccgacttctccgggctggtcatcgtcggctcccgcgccgacgatccggtgctccgggaccaggaggacctcctcgggctcgtgacggccgactactacgccgccgtcatgacgccgcgggagcgcgcggccatgcgcgccttcagggcgcgccggatgacgtacacggtgtgctacgacgccgtgcggtacgcggacgggccgttccccgagtgcgacaactcggacgaggagagggagtccttctcggcctggggcgagtccaagaccgtcgtcgtgaggccccgcgcccgaggccgccgcccgcgcggacgcaaggtcggcgccggcgcccggcgccacgggacgtgctgacgtgtcaagcagatgagatttcgttgacagaaaaaaaaaaaccaagatctgttgcgaaagctatttggccgacccgcatgcaggttgtaaagctaggtgtagggactagtagggattaatgcgttatgattctttgattccttgggtgacagttataaatttcttattattagtgtgct

SEQ ID NO: 12392 - DNA, 585 bp, Zea mays
  unsure (1)..(585): unsure at all n locations; Clone ID: LIB3279-206-Q1-K6-F1
cccacgcgtccgcccacgcgtccgcgcaggcgtgcgcccacgcgtccgagcaggaccagctagctagctcctcccactgctatcacccgggccccggccagccatctcgctgaaagagaaaagcgcagccatgaagactactagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccncgacatcgactgcgacaagatcgaatgaagggatactgttcccttaccagaatccatacgaccggatggtgatgttcagtgccctgctagcagtaggctgcatctgcactgagtgactagaat

SEQ ID NO: 12393 - DNA, 647 bp, Zea mays
  Clone ID: LIB3279-206-Q1-K6-F10
ctctcccagcctctcttactctccgccgtggccctgctcgcccgaagcagctgccggcaaaatggccccgaagagaggcggtagggcgccggtccccgccaagaagaaggcggtggtgacgaacccgctcttcgagaagaggccgaagcagtttgggatcggcggcgcccttccgcccaagaaggacctccaccgcttcgtcaagtggcccaaggtcgtgcgcatccagcgccagcgccgcatcctcaagcagcgcctcaaggtgcccccggcgctcaaccagttcacacgtaccctcgacaagaaccttgcaacaaacttgttcaagatgcttcttaagtaccgccccgaggacaaagctgccaagaaggagaggctcttgaagagggcccaggctgaaaacgaggggaaaactgttgagtcaaagaaaccaattgttgtgaagtacggccttaaccatgtgacttacctcatcgagcagagcaaggcccagctggttgtcatagctcatgatgttgatccgatcgagctggtcgtgtggctcccggccctttgcaggaaaatggaggttccatactgcattgtcaagggaaaagcacgccttggatcgatcgttcacaagaagactgcatctgttctttgcttga

SEQ ID NO: 12394 - DNA, 645 bp, Zea mays
  Clone ID: LIB3279-206-Q1-K6-F11
cggacgcgtgggcaccgcctccgccggggacagcggcgtagtgtagtgtagttccggagagggttggggagagtagtagtgatccgcaatgtcgacggaggaggctgttgtggctgaggtcccggtgaccgaggtgccagcggaggtcccggcggcccatgtggccgaggcgcccaaggcgaggaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaacccaaggccaaggccaaggccaagcctgtcgctcctgccggcgcgtcgcccaagccccgcgggcgccc

SEQ ID NO: 12395 - DNA, 646 bp, Zea mays
  Clone ID: LIB3279-206-Q1-K6-F12
cggacgcgtgggcccgccgccgccacgggcagcggaccggcaccaccacctcctcgctccacctccgtccgccgtcgccgcgatggaagacgacccgtcgcgccaggtgcgcgtgcgcttcgtcacgaagctgccacctccgctgcggacgccgcccgctgccatcgccgtccccgcggacctcactcgcatgggcctctccgagatcgtcaacagcctcctcgcagccgccgagccggaccaccagtcgcagcccttcgacttcatcgtgcagggcgagctcgtgcggctgccactccaagagtttctcctcgccaagggcatctccgcggagagggtgcttgagctcgagtatgtgagagcagtggcgccaaggaagcaggaggaaccttgcccccatgaagactgggttagtgctgtggatggatcaaacccaggttttatattatctggatgctatgatggtcttgcaagattatggaaagatgcagcagtatgcacacaaattttggagggacacaatgatgcaattacttctaccagattcatcaataagggatctgaaactgagggcagtctgcatgtagtgactggctcaaaggataggtcactgcggctatacaagtgtgatacatcagtcattatg

SEQ ID NO: 12396 - DNA, 562 bp, Zea mays
  Clone ID: LIB3279-206-Q1-K6-F2
gcagagctgaagttgagcgccaaaaccaagaggccattgctaaggcacgagtaagacaggttgatgagaaaggaagagcttatggaacagggaaaaggaaatgcagcattgctcgtgtttggattaagcctggtgatggtaaattcattgtcaatgaaaaggagtttgatgcttacttccgaatcctggaccatagagctgaacttcttcgtccatttaatgtgaccgatactttggggcgtttggatgtgacctgtactgtgaaaggtggtggcgtatcaggacaagttggagctatccgcttagggataagcagggccttggagaattgggaaccaggatggcgtccatatctcaaagcagctggatatttgacgagagattcacgtgtggtcgaaaggaaaaagcctggaaaagcgaaagcaagaaagagcttccagtgggtcaagcggtaacagagctatctgcatggctacgtattttgttgtggcgggtctctgccctttgactttgatgtgggttttctactcaacacagatcacttgatctgctgttatttttt

SEQ ID NO: 12397 - DNA, 473 bp, Zea mays
  unsure (1)..(473): unsure at all n locations; Clone ID: LIB3279-206-Q1-K6-F3
gtctccgccccgactcacccgcagcctgtctctgctcggcggcggccgtctcgactgcgggagaggggagcgccccttcgccgatctgatcgggagctgcaggccaaacggcgaggcgagcccatcaggaaccaccatggcagcggcagccgccgactccgatcccgccgcagctgtgggcgacatgtccacctgcgcccattgtcaacgagagatcccttcttcgaacatcgacttgcattctgtacattgtgcccgtaacctccaaaagtgccagcactgtggagaaatgattcctaggaaacttatggatgaacactatgatgcaaaccatgccccgatcagttgctctctttgcaaagaaacaatagaacgtgtgaggtgggatcttcataaaggcgaaaagtgcccacaaagaatcgtcgcttgtgaatattgcgagtntgaattgcctgcagttgatctccatgagc

SEQ ID NO: 12398 - DNA, 595 bp, Zea mays
  Clone ID: LIB3279-206-Q1-K6-F4
cccagcgtccggaacatattgctagagattgagttactactagtttgaacttgcaaaaggatgaaattgtattgttatttttttattaatgtagagctttagatctcggataccttcatagcatccattagcaaggtattaatcatcaatttggatcactgagacttctggtgttgtgtgggcatctcaaattttatgggtcatgtgtaacctaattgtagttcgcatttggatcttttcggaagctgtgcgccatgttctactgtattttgtttcaagtttctttttttttaacaattgaaattgctatgtttcagtcgctatggatcttgcttgggtcatctggagaagctaaagcctaacctgctcctggatatccatttgcacgaacatgtagagagtctgtatatggatattcgccacaaagcgaattttgatctgtcatgcgattaactgggtttatctttttagcgacacctttgttatcgtggcaaaacacacacacacacacacttgactagacaatttgttttataatgaaaacagaaaggtcatcactatgtatgtatattacatctctgatatagtatttcac

SEQ ID NO: 12399 - DNA, 538 bp, Zea mays
  Clone ID: LIB3279-206-Q1-K6-F5
gaagccgtgtccgcgtgattttctgggtgaattgttcccggcctccgctccggccagatcggctcgggtgaaccccagcccctaccgatccggatccgtccccatcgcctcgtgtgttttccgtcgagtattttagcgtgtgtgtccccccctcttcgcttcggttggtgcgtgcgggtggctcgggtagatctgtggtttggttcgccttgaaggcgcgcggcggcggtgtcgcggcttgtagcttgcgatttcacggtggagcttgtcggctgttggggtcggatttggctgtgacgaattcgctcgatgcttcgggctgatctccgagatggccccgagctgacgtaccgatttcacaacggcaccggttgtgaagcgactcatcatgggcaggcttagcttgttctgttgttagctgttggtgcttaggtcgtgcatatttctgaaacatgatcagttaagagtatttggctatctgcatgggtgttggggcacttcatcatctgtctgcatacggggtggagatttacgtaaa

SEQ ID NO: 12400 - DNA, 618 bp, Zea mays
  Clone ID: LIB3279-206-Q1-K6-F6
cggacgcgtgggctttcattcgccgcggccgcgtgctctctgctgccgtcgccatggggagaaggcctgcgagatgctatcgccagatcaagaacaagccataccccaagtccaggtactgccgtggtgtccctgaccccaagatcaggatctacgatgttggcatgaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcgggtccgggttcaccccttccatgtccttcgtatcaacaagatgctttcgtgtgctggggctgataggctccagactggaatgaggggtgcctttggcaagcctcagggcacctgtgctagggtggacattggtcaggtcctcctttctgttcgatgcaaggacaacaatgctgcacatgccagtgaagctctgcgtcgcgccaagttcaagttccctggccgccaaaagattattgagagcagaaagtggggcttcaccaagttcagccgtgccgactacctgaagtacaagagtgagggta

SEQ ID NO: 12401 - DNA, 643 bp, Zea mays
  Clone ID: LIB3279-206-Q1-K6-F7
cccacgcgtccggttaaaatgctcgagctcaaaaagggtactgctccttgagattccatggataatctggaaatattttggacagcctagtgttgggtaatttgacaccatcatatatcacaatgaagacaataacgctgaagcgttgcaaactgtaggtttgtggtataaccatcattagcaaggtggtgactttggaaattgtttattccagacttaggccttgtttgataatcttgcaaagcgagctatggacctatgtattggaaactgggtacctatgttgtacaaggaaatgtagaggtcaaaactgtttgtgaaaagaataggggcaccatgaaaaccgggtggctttgttttgcattaagagcctgttcggttttcacggattcatggcccggaacgatggctagttcatacttcctagacagattgattatctaatttatataagatttgattagatgtcagaatgattcggagtccattcctgaacaaaggaacaaaatcctgccggggtgaggccaagccactggggtgaagacactatggtgccgtttggtttccaaaatgtaacgtaaatagtaacgataacgggttgtatttgattatcagtggtaatacgtttgaatatgctggtatc

SEQ ID NO: 12402 - DNA, 660 bp, Zea mays
  Clone ID: LIB3279-206-Q1-K6-F8
ttccgcttatgctctggaaacccgtggcgcctgtgtacccgcgccttgtcacgaaggtcccaggtggcttaactccagatgaggccacaaaaatgcgcacgagaggacatcagttaccaccaatttgtaaacttgggaaaaatggtgtttatgccaaccttgtgaagcaagtcagagaaggatttgaagcatgtgatcttgtccgtgttgattgctcaggtcttaacaaaagtgattgcagaaaaattggagctaaactaaaggatctagttccttgtatcttactgtcttttgagtttgagcatatactgatgtggagaggaagtgattggaaatcatctcttcctccattagaaaacagttatgaagtgacaaaggtgcaagaaagttttagtggcaaagaatctaatgaaaaggttacacattcaggaaatgttctgacccagattgagttggtcagtgttgcaacatctcacaagaactggaacttggatgaaggtcaagaaaaatttaaagattccattgacagtgatatggtactgagttctgcaaaggatgttcctgcattgttccattctacaggtatatctagaactgaaccctcagcagacattccattggaatattccccattaaatccagtatgtgatattatggatc

SEQ ID NO: 12403 - DNA, 670 bp, Zea mays
  Clone ID: LIB3279-206-Q1-K6-F9
cggacgcgtggggaatttttgaagaaccttgcgttaatgggtatttcttgcagtcaaaatgggaagctgactgtgacagatgatgatgttatagagaaaagcaatctcagtcgccagtttctcttccgtgactggaacattggacagcccaagtccacagttgctgcaactgccgctatggcgattaatcccgagcttcatgtggaggcccttcagaacagagcaagtcctgagactgaaaatgtgtttaatgatgccttttgggagagcttggatgctgttgttaatgcattggacaatgtcactgcaagaatgtacattgactctagatgtgtatatttccagaagccacttcttgaatcaggtactctgggtgccaagtgcaacacacagatggtcattcctcacctaacagaaaactatggggcatccagagatccaccagaaaagcaggcacctatgtgcactgtacattcatttcctcacaatattgatcactgcctgacttgggccagatctgagttcgagggtctacttgagaagactcccactgaagtaaatgcttttctgtcgaaccctggtggatatgcaaccgcagcaagaactgctggtgatgcacaggctagggaccaacttgagcgagttattgaatgccttgagacagacaagt

SEQ ID NO: 12404 - DNA, 601 bp, Zea mays
  Clone ID: LIB3279-206-Q1-K6-G1
cccaagtcccaacacccgtcggcgtcgagcagcggcggcgatgacgacgagcctgaagaagaaccggaagaagcgcgggcacgtgtcggcggggcacggccgcatcggcaagcaccggaagcacccgggaggccgcggcaacgccggcggcatgcaccaccaccgcatcctcttcgacaaggaccacccgggctacttcggcaaggtgggcatgcgctacttccacaggctccgcaacaagttccactgcccgtcggtcaacgtggagaggctctggtcgatggttcccgccggcaaggccgcggaggcggtcggcgcggaccaggccccgctcgtcgacgtgacgcagttcggctacttcaaggtgctcggcaaggggatgctgccgtccaggcccatcgtcgtcaaggccaagctcatctccaaggtcgccgagaagaagatcaaggctgccggaggcgccgtcctgctgaccgcttaggtccttttgcatcttgtttcaactatctgcgctaagaaatattctatcttttttgggtggatttatgaggccctggttttgagcacttggtaacgaatatgagttcgattatatcgatgc

SEQ ID NO: 12405 - DNA, 568 bp, Zea mays
  Clone ID: LIB3279-206-Q1-K6-G10
gaggggaagcaggagcccgcagggggcggctagcgctgtctcaatccaaggagctgaggacgacctgtccgtccggagctgatcgagaaacggaggggcggttccacagtttcagtccagctagctagctagctagctagaagatcccattcgctgacagatgggttcctacgtcaaaggagatgatgaggtccctgtgtacgagtcgggcgccgaggtgcttgagaaggtgcaagagaaatgggcggcggcggcggcatcgcggcctcctccctacccggccatgtactcgagcgtgttcggcggcatcatcctggacccagccatgatggttctccccatcgacgaccacatggtccaccggggccacggcgtgttcgacacggccatgatcctggacggcgccctgtacgagctggacgcgcacctggaccgcttcctccggtcggccgcggcggcgcgcgtgggcacggccccgttcccgcgcgaggcgctgcggcgcatcctgatccagatgaccgccgcctcgggctgccgcatgggctccatccggtactggctcagctcc

SEQ ID NO: 12406 - DNA, 602 bp, Zea mays
  unsure (1)..(602): unsure at all n locations; Clone ID: LIB3279-206-Q1-K6-G11
gcatctcgcactcatattatctctttattctctccttaccaaggtcagaaccccagaagcagcaaagtcgacaagtcacgcacccagaacatgaaacgaaggcatacaattacaacacataatactagctactgtcttccacaacgcaacaggtaccctcctatagctccccagcatgtaacttgtgccaagagcacccaccagtcctccacaccaagcatcaacaaataaacatgcgtaatctttcgagtcgccgcaactatccctctaccttctctgttcagcttcggctacttagaaagccagtggtggcagaggcaagctgttgttgagccccgaccgcatcctcctcttcctgagcctctctgcaatgatgaaggcgagctccagggactgggaggcgttcagccttgggtcacagtgggtgtggtagcggtcgctcaggtcatcgaaggtcacagtccgtgatccaccaatgcactcggtcacgttctgcccagtcatttcaaggtggatgcctcctgngtgacttccttcttgatcatgcacatcgaagaatgcgcgcacttcagccagaattgagtcaaatggaccagtcttca

SEQ ID NO: 12407 - DNA, 610 bp, Zea mays
  Clone ID: LIB3279-206-Q1-K6-G12
gacgccgccgcccaaagaaagacgtcaactccaggagacaagatagtgagaactgaagagaaggatgggcttcgagaagcagatcctgagatccggcaccggccccaagccgataaagggccagaaggtcaccgttcactgcaccggctacgggaaggatcgtgatctgtccaagaaattttggagcaccaaggaccctgggcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaaccaaactcagtgcttgtgttcgagattgaagtcctcagtgcccagtaattcgcatctgtcagctatggaaacgttggccatgcttctcaagtaatgaaataattccgttgtcacctcatgctacatacagcagattggtgttacgagttaaatcctgtgaaactttagcattctgtaaccgtggatgtcgagtttatggagttccttgtgtggcgcctcaagtcaagttctcgtcaaagattgtaatctgatggc

SEQ ID NO: 12408 - DNA, 422 bp, Zea mays
  unsure (1)..(422): unsure at all n locations; Clone ID: LIB3279-206-Q1-K6-G2
ancagttctggtgttgaccttggggttccttttctttgggaaagaggggctcaacttccatgtcgcccttggcatgcttctggctgtgatcggcatgatctggtacgggaacgcgtcgtcgaaatctggaggcaaagagcggcaggtctaccccacaccgagcgagaagagtcagaagcatggggcgctgtcatcgcagtccgagctcgatcaaaaggtctaaacgagacacacaaaggcatccgatgcttgttgagcaccggtcgacctggctttatttttagtacttatttttgagggatgagatgtttctataggattgtaggtggggccatagcagaaagagggtgcctgggtaaaatgcccatgagtttacttttgcagtgagtatgtcaatctaagctggcagatacttgatttgt

SEQ ID NO: 12409 - DNA, 548 bp, Zea mays
  Clone ID: LIB3279-206-Q1-K6-G3
cccacgcgtccgcaaccaaccaccgctccttcttccttccttccttccccagttcccctcgtctcaccagtcaccaaggttccgagagcagagcgagataaaaaaaaaggtaatccgacggaaacgacaagggcgcggcgagggcggggacagggtcgggaaggccctgggcgcgggggcgccaagcgcatggcatcgtcgagggtgatgccgtcctcctcgccgtcgcacacggcctctgatctcgcgcgcctagcgcaggccgccagcaggcccggcggcgggggcagcgggctgggctccatgaacgtggaggagctcctccgcggcatctacagcgacatgcccaccccggcgccgcccgcgtcggagcccgaacgcccgaggtcgccggccccggcgccggaggtcgccacgcggaggacggcggaggaggtgtggaaggagatcaccggcggaggtggcagtggggaacccgtgccccctgtggcggctcaggctgccgtccccgctggtgggggtggcgcccgccgcccggagatgacgct

SEQ ID NO: 12410 - DNA, 611 bp, Zea mays
  Clone ID: LIB3279-206-Q1-K6-G4
tttagagcagaaaattcaaacacacacaggcatctatgtgagttcgttggtcttgatgctgaaatggagattaaggagcattattttgaggtctgtgacattatagatggcttattcgtatcaatatttaaacacttgtctgaaaactgcaagaaagaactcgaatcaataaacaggcaggatccatttgaacctctgaagtatctagacaaaaccttgaagctcacttatgaagaaggaattcaaatgttgaaggaagccggaacagaaatcgagcctatgggtgacctcaataccgaagctgagaaaaaacttggtcggcttgtcagggaaaagtatgacacagattttttcatcctgtatcggtatcctttggctgtacgtccgttctacaccatgccttgttatgacaacccagcgtacaccaattcttttgatgtcttcattcgaggcgaggagataatatctggagcacaaaggatacacactcctgagctgctggccaagcgcgcgacagagtgtggaatcgacgtgagcactatctcggcctacattgaatccttcagctatggcgtgccgccacacggcggtttcggggtgggtttggagag

SEQ ID NO: 12411 - DNA, 577 bp, Zea mays
  Clone ID: LIB3279-206-Q1-K6-G6
aggacaaggagggcatccctccagaccagcagcgggtcatttttgccggcaagcagctcgaggacgggcgcacgctggccgactacaacattcagaaggagagcaccctccacttggtgctgcgtctcaggggcggcatgcagatcttcgtgaagactctgaccggcaagactatcaccgtggaggtcgagtcttctgataccattgataatgtcaaggccaagatccaggacaaggagggcatccctccggaccagcagcggctcatttttgccggcaagcagctcgaggacgggcgcacgctggccgactacaacattcagaaggagagcaccctccacttggtgctgcgtctcaggggtggcatgcagatcttcgtgaagacacttactggcaagacgatcacccttgaggtggagtcctcagacaccattgacaacgtcaaggccaagatccaggacaaggagggcattccaccggaccagcagcggctgatctttcccggcaagcagctggaggatggtcgcaccttggctgactacaacatccagaaggagagcaccctccacctggtgct

SEQ ID NO: 12412 - DNA, 660 bp, Zea mays
  Clone ID: LIB3279-206-Q1-K6-G7
cgccgtgccgccgcctccgactcctgctccgtgcgagcctaccaccacagggcaagggcttcatccagccgcgtgcgagcctgaccgcccagttagacgatgagccgcagcctcggtatcccggtgaagctgctgcatgaggcggcgggccacgtcgtcacggtcgagctcaagaccggcgaggtctaccgcggctccatggtcgagtgcgaggacaactggaactgccagctcgaaaacatcaccttcacggcaaaggacggcaaggtgtcgcagctggagcacgtcttcatcagggggagcagggtcaggttcatgattatacccgacatgctcaagaacgccccaatgttcaagcgccttgaggccaggattaggggtaaaggctcagctgttggtgtcggccgaggccgcgcggtcgccatgcgggctagggctgctgctggtcgtggcggtggtcctgttggacgaggtggtgcaccccctgtgaggaggtagatctgtcgcgctatgtggcaaatcaagcttttgccctagttgcaaaaactttgcttgagcagcgatgctatatggttgttaagggtagcttatcagcagcagttcatgtttacagcatagatgcaggactttgtgtaactttgcacgagaagactgtggaca

SEQ ID NO: 12413 - DNA, 580 bp, Zea mays
  unsure (1)..(580): unsure at all n locations; Clone ID: LIB3279-206-Q1-K6-G8
tgtcctccacacacacccacacacgcgacactgaggagccctgagccctccgcccttaaaccctagcgagcgagccagcgagaggtctcatccccaccaacaccacccatggagctccgcctctaccacctcgcgctgctgctcggcctcgtcgcctgggcggcggctgctgccacgggagccgaggcgcagccggtgtgcgacccctccatcatcgccacccagatcgcgctcttctgcatgccggacatgcccacggcgccctgctgcgagccgatcatcgcctccgtcgacctcggcggcggcgtcccctgcctctgccgcgtcgccgcccaaccgcagctcgtcctcgcccgcctcaacgccacccacctcctcgcgctctacgcttcctgcggaggacaacacaccgtgggcgctcacctcgctgccgcctgccaaggtccgtcacctcccgccaccgttcctgttatcgncccgncgncgnccgncgngccccgnctcaagcagccaacacgcgaggcccctccccctccgccacaaagcgagaagccgtccccgtcgccccagcagcagcctg

SEQ ID NO: 12414 - DNA, 520 bp, Zea mays
  unsure (1)..(520): unsure at all n locations; Clone ID: LIB3279-206-Q1-K6-G9
ctcaccgcgtccgcctcccctaccatctagggtttctagggttttcgaggaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatactgcggcggcgaccgcggttacggcggcggcggtgaccgcggctacgggggaggaggcgaccgtggctacggcggcggcgaccgtggttacggtggaggtggcgaccgcggctacggcggcgaccgtggctaccggggaggcggcggctatggcggtgggtaccgtggaggcggcngtgga

SEQ ID NO: 12415 - DNA, 395 bp, Zea mays
  Clone ID: LIB3279-206-Q1-K6-H10
cccacgcgtgcgcccacgcgtccgcccacgcgtgcgcccacgcgtccggtcagagtcttagagaacgaacacttcttctccctgtagctagctgctcctacttgtgtccagatcttctgttcgatcgggtttgggactagccagggagtgggcgacgcttcggccttctgcaaggaggcttctcgagatctctggtggtggtccccgcgcggcgcctgaaattccatgctgacatgtgcatgcttcggaccggaggcggagtcacgatctcttcgcattcggaggtgatgggcttataaccgtccttgggccgaaagataaaactccctctatttttttttgtaggcgatgggctgttgttgcaatagttctatgtaggtaagggagagttgtcc

SEQ ID NO: 12416 - DNA, 653 bp, Zea mays
  Clone ID: LIB3279-206-Q1-K6-H11
gacgtctctgaaccgaggctgcgactgcgagggcatctgggcagcgaggcagatcgagccacgcttcttgtcgcgtgaatcccctcgagagccgccggcggagccatggcgcggtccccagccgcctcctcctcctcctacacggacagcacgggatcctcctccgactcaggctccacctcctcgggaatcgaccggcgccgccgccgccaccgccatcggagcagccgccgcaaggagggcacgtcctcgttcgccctgaaggcgcgcaaggaccggaggtcccgccacaagcgccgccgccacgagcgggagcggcggcggtccgcgtcggacgacgacagctacagcagcacaagctcttatgacagtgaccgtgaggtgtctggcagatctcggaaacataagaagagcagcagatcaagaaagtctagggagagggagcggagcaaagatagacatcatagacgagacaagagtaaacacaaagaggtaaatttcctatttattcagaaactactaaacttttatgatggcttaacttaacatgtcagtggtagaagtacattttatcatctatacttccacacaagaggtccttatatttcttttgtgcctgtttctgggttggctctttgacattggagctggga

SEQ ID NO: 12417 - DNA, 647 bp, Zea mays
  unsure (1)..(647): unsure at all n locations; Clone ID: LIB3279-206-Q1-K6-H12
ctctcaactcattggcagcagcaaccgcagccgcgagggccaagcaggggggacaaggaaaagggccgacgaagaggaaaaaggaagaacgcgtcgcggagccatggggcttggccttggcgtgcgggcggcgcccttcacgtacgcggcgcacgcactggccgtcgcggcggcggccatggttctcgtctggtccatccagttccgcggcgggctcgccatcgagtccaccaacaagaacctcatcttcaacgttcaccctgttcttatgcttatcggttatgttattatcggcggtgaagctataatggtgtacagggtacttccaacatcgaatcatgacacaactaagctgatccatctaattctccacgggattgcacttgtccttggtgcggttggaatatactttgctttcaaaaatcacaatgagagtgggattgccaatctttacagcctgcactcttggattgggataggaacaattactttgtatggtattcagtggataattggattcgtcacgttcttcttccctggtgctgcgccaaacgtgaagaagggtgttcttccttggcacgtactctntgggctctttgtctacatcttagcactggctaatgcagaactcggctttcttgagaagc

SEQ ID NO: 12418 - DNA, 602 bp, Zea mays
  unsure (1)..(602): unsure at all n locations; Clone ID: LIB3279-206-Q1-K6-H2
tcccacgcccacgccaccccaccgcacgaagagagcgagcgcacgaacgggggagacatggcccactcgccgtcaggatcgcacgtagcggcgacgtcggtcgggaacgaggccttcaccgacgcggtggctgaggacggcggagactccaagctctccgcgctcctcttcgacgtgtcgcagcaggtgcaggacggtctccagagcatgctcaagacgagcagcgagatcgcgcggtgcgacggcgagatcgacgcggagctggagcgcgcgagggatgccgtggcggagaatgcccgagcgctgcacgacgaacgggagagagtccagaaggccgccctcgccgcgctcgacatcctcagcggcggccgttgcgtcatctgaagggatgcccgccgcatgccggcgccaccgacagtctgcccccgacctcagatcacgctcgattctcgcaagattcctgctccatttgtgaatgtcaccgtcggtgttacccttttgcagtagtagtaatattcgcactgatgctggcattactagtaacttgttgcctgttgaactgcaataatagagtttagaatntgagatgtgcacgatatgat

SEQ ID NO: 12419 - DNA, 497 bp, Zea mays
  unsure (1)..(497): unsure at all n locations; Clone ID: LIB3279-206-Q1-K6-H3
attcattggctcgcgctcggcagtcggcacgacggtacttggacttggctattcccaacgccaccccgcaaccgcaacgtctctctagcgtctagcctctgcctgcgctcccacaccagaacaccacaccgctccgcgtgcgtcgcccgcactcctcgcctctgcccgtctgcctaccgtgccgtgccgtgccgtgctccccacccgatgcagccgccgacgcgggccgtgccgagccacagccggagatgagctccaggaaccgttccgccgccgcctcgtccgctgccccggctctccggacaccgcgccgcctgaagcggcggccagttaaggcgtcggcgccggggccgggcagcgggcggcggagcgggcccgcgacgccgctgctgaaatgggacgtcngtggcggcggcgggcgcggtgaggggaggaaggctggcgcccactaagcgggggacgccgcgcgggcgcgggagaccaaggcgaaggcgacg

SEQ ID NO: 12420 - DNA, 540 bp, Zea mays
  unsure (1)..(540): unsure at all n locations; Clone ID: LIB3279-206-Q1-K6-H4
cggacgcgtgggctacgcacgccggatttttgcgtcgagcacggagatctacaacaaaaacatggagctacgacgcgattcccaaggtacaatcgtaattatgttcaaacaatttttaagtcgtgctgcgctccttctattacgagcaacgttttatattctgtgcttgcataataaatcgaagaaatcctgacaccaatcgaactgaagatcctgaaacgcacgttaataccgttgacgtccgcttcacccagctcgattttcagtcttgtaataataattgagaactccaatgaactgagagttactaatcgctccatgagtctgaagcgtgcaaaaatttaggtcgcagctacacanatttacacgctggtctatattctatattctatattatattaaggtcgcagctacccgtgaatctcctattttgaaaaggtcactgctttttaattccattctatattctatataatattttgggaatattcagtctcgtttaattgctttcagacttaatgttagataattgttaacatt

SEQ ID NO: 12421 - DNA, 629 bp, Zea mays
  unsure (1)..(629): unsure at all n locations; Clone ID: LIB3279-206-Q1-K6-H5
gagaacttgctgaagagaaggaaagaagaagattagaagaggcggaaagggagagggagcgtaaaaaggatagacttgctgttgaaagagcgacaagagaagcacatgagagagcatttgccgaagctcgtgaaaaggcagaaaaaatggctttggaaagaattaatgctgcacggcagcgggcatctgcagaggcccgagagaaagaagatagagcaagtgtcgaaccagctgctgaaagggcttctagagaagctaggataaaagcagaacgtgcggcagtcgagcgagcaactgctgaagctcgggagcgggcaatagaaaaggcaaaggctgagaaggctcttgcagaggcaagagaacggagggaacgatacaaatcctcattcaaggagagttttaagtccaccaatcaggatattcgacaggagtcacagtttcagagggcaacttctagtaatttcatccgaaacccagattccagcaacagagcaatggttgaggttgagtccgctttaagacataaagcaagattagagaggcatcaacgcacaactgagcgtgtgacaaaagctcttgccgagaagaacatgcgggacctgctggctcanagagagcaagcagagaaa

SEQ ID NO: 12422 - DNA, 538 bp, Zea mays
  Clone ID: LIB3279-206-Q1-K6-H6
tgatcttctgcaaatggtgcggtttggtgctgaaatggttttcagttctaaggacagcacaataactgatgaggacattgaccgtattatagctaaaggagaggagacaacagcagaacttgatgcgaaaatgaaaaagttcactgaggatgccatcaaatttaagatggatgataatgctgaattgtatgacttcgatgatgagaaggatgaaaacaaggttgatttcaagaaacttgttagtgataactggattgagccacctagaagagaaaggaagagaaactactctgagtctgactactttaagcaagcacttcgccaaggtgcaccagcaaagcctagggaaccaaggattccaagaatgccgcacttacatgatttccagtttttcaataaccaaaggctaaatgaattatatgaaaaggaagtgcggtaccttatgcaagcgaaccagaagaaagataccattgatggtgaagacgaagatcagttggagcctttgacagcagaggagcaggaagagaaggaacaatta

SEQ ID NO: 12423 - DNA, 664 bp, Zea mays
  unsure (1)..(664): unsure at all n locations; Clone ID: LIB3279-206-Q1-K6-H7
gcaaggccccagcggcggcacggcgcagtggcgcaccctctggagtcaccttcttcctgcccaatacggccagcggcggcaccccgaccaggttgaccccgccccggcaacgaccagcgggtcgtacagcacgccgatccaattcctccgtgaaggtcgataaactgtgagatactgagattgaagctgcacactgttttagtttcttcaaggacaaggaacattaatatcaccaagtactttcgtcaatgaagcttgaagctgatttcgctgatgaagatgtcagttcaaataatggattacaagatctgtggtcacttgacgagatagatccaaagagagcaagattcccgtgctgcattgtttggactcctcttcctgtagtttcatggcttgccccttacataggacatgttggaatctgtcaggaggatggggctatcttggattttgctggttcaaatttggtgagcatggataattttgcttatggttcagttgccagatacctncagcttgacagaaagaagtgctgccttcctgttaatcttgcagcacatgtatgcaagcagtcctacagccattcagaagttggagcagcgatatcatgggatgatgctctgcgatcgggcatgagacgcttncagcacaagtactacaatct

SEQ ID NO: 12424 - DNA, 572 bp, Zea mays
  Clone ID: LIB3279-206-Q1-K6-H8
attataatgccattaggctgccgttggacattcttatattccgacttatcaaagcttatattcgttcctcatctttacggaaagccgctttgaggttttctttattggaaccagacagaaatggatgcatcactcttgacaatatcagaatggccttaacgagagaagctactgatgcaatgaaggaatcccgagttcaagacattcttgtttcgttgagcgcccttcagtacagaagaatggacttccaagagttctgtgcagcagcagttagtgtgcatcagcttgaagcattggatagatgggagcaacatgcgcgatctgcttatgaatattttgagaaggaaggcaaccgagctattgtaatagatgaattagcttctgaattgggcctcagtccttcagtgccactgcatgtcgttctgcaagattggatcaggcatacggatgggaaattaagttttcttggatttgtcaagttgttgcatggcatgtgcagcaggtccctgtcaaagatgagatagctgtcgataatctctaacgacagcgcgtgtttacaccgtcctgttgac

SEQ ID NO: 12425 - DNA, 456 bp, Zea mays
  Clone ID: LIB3279-206-Q1-K6-H9
cccacgcgtccgcggacgcgtgggaatggccatagcgacagttgtgaccgtggcagaaattctgaagaataatggatttgctgttgaaaagaagatcaggacatctactgttgacataaacgacgaatcacgagggcgtccattccaaaaggccaagattgagataatcttgggaaagagtgacagattcgatgagttgatggctgctgctgccgaagagaggggagaagttgaagaaggcgaagagcaggcttgaaagaaaaaaaaaacagtaccgacgacaagcggctgttgttgtggtctgttagttttgcttaatttaatgccatgcgcatgagagctggcatgcgttctcgctcatctacattgccatggcaatgtctgcaaactcatggattgatggatggatgctggtttcttccaattttgacagcttcatttgtttctttggctttt

SEQ ID NO: 12426 - DNA, 622 bp, Zea mays
  unsure (1)..(622): unsure at all n locations; Clone ID: LIB3279-207-Q1-K6-A10
cggnaaatgaacccatcctggccacggngccgatggacatccccgngggggtcacggtcacggtggcggccaagctggtgacggtggaggggccgcgcggtaagctcacccgcaacttcaagcacctcaacctcgacttccagctgcaggacggcggtcgcaagctcaaggtcgacgcatggtttggcacccgccgaaccatggccgccatccgcaccgccatctcccacgtccagaacctcatcgcaggcgtcaccaagggtttccgctataagatgcggttcgtctacgctcactttcccatcaacgcctccatcaccaacgccaactccgccattgagatcagaaacttcctcggggagaagaaggtcaggaaggttgatatgcttgaaggcgtgaccatcttgcgttcagagaaggtcaaggatgagcttgttcttgaaggcaatgatgttgagcttgtctctcgctccgctgctctcataaaccagaaatgccatgtcaagaaaaaggatatccggaagttcttggacggtatctatgtgagtgacaagggccccatctttgatgagcaatgagctgccctttgttcctggctagcaaaagccggttaggctggggc

SEQ ID NO: 12427 - DNA, 532 bp, Zea mays
  Clone ID: LIB3279-207-Q1-K6-A11
cggacgcgtgggccgaaagagagcagagcttggcaatggagctcccgtggggaatgctgctgccgctgctgctggtcctctccgtctcgtcctcgtcatcgtcgtcggctgctgccacgctcgccgtcagcgctccgcccccactgcctgttcctcctcctcgtcatgctcaagacgccgaaggcatgctcatcaacggcaacttcgagacggcgccgcggaagctgaacaagaccctgatcgtggggcgccactcgctgccggggtggacggtgcagggccacgtggagtacgtctcgggcggtccccagcccgggggcatgttcttcgcggtgccgcacggcgtgcacgcgctgcgcctcggcagccgcgcgtcggcgtcgcagaacgtgacggtgcgggcgggggcgctgtacgcgctcacgttcgcggcgacgcggacgtgcgcgcatgacgaggccctgcgcgtgccggtggcgccgtgtttctagggacccgccgacgaggagcgtgcgcacgcatgtacaggggg

SEQ ID NO: 12428 - DNA, 605 bp, Zea mays
  Clone ID: LIB3279-207-Q1-K6-A2
ccccgcgtccggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctactgtggtggtggcggcggctacggcggtggcaaccgtggcggcggctacggcaactccgacgggaactggaggaactgagcggtggggcccgcgcggccaagttatcctgttcg

SEQ ID NO: 12429 - DNA, 621 bp, Zea mays
  unsure (1)..(621): unsure at all n locations; Clone ID: LIB3279-207-Q1-K6-A4
tggcggcggcgcgggcggccaagnagcaggcggnggaggagttgtgccaagccacatgggtatctcgcgtgactcgatgcacaagcgccgagccaccggtggaaagcagaaggcctggaggaagaagcgaaagttgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctgga

SEQ ID NO: 12430 - DNA, 615 bp, Zea mays
  unsure (1)..(615): unsure at all n locations; Clone ID: LIB3279-207-Q1-K6-A5
gctgttcagagtgtctttgagagttggaggacacaaagagagaacgctttagtcacatcatgatcaacatgtcgcgttagtatacttttnatctttgaaagtataatgtgttatctaactacaaggtaattttcgtctctattagcattatgataaaaaactagcagaaaagttgtgagtctaatgttatcattagagtcaaatattatcattaaatatatacagataggactgtacttgtgttggactctaggcttaagctatgtatatatatgctagcattaggacctcatattataataagtattatttcaagacgaccatccgattagtgtggctacgtcgaacgcccgcgccatgattgcaacattctagtggccaatgttgttgacttcaggcaaatcacggtggagatgctctctcgactagagctcgggacgacagggctcaagaccctcacgcgcgaggtgatggacgtgctcatcgacaagcccaagcatgtgacactcggcaggtggaaaagacgttcttttggcccccacaggtctagtacgtcgttgttgatgtctatgagttctacaaggttggttgtctgttgttcatgacagagcgcac

SEQ ID NO: 12431 - DNA, 602 bp, Zea mays
  Clone ID: LIB3279-207-Q1-K6-A6
ggcgcgtgggcactgtctgcctcctgcccccaaaactgtgtggccctcaccaagactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgtagacctcactgtcagaatcgagaagggggcctcctacgaggaaatcaagaaagctattaaggccgcttctgagggcccactcaagggtatcatgggctacgtggaggaggatctggtttccaccgacttcaccggtgacagcaggtcgagcatcttcgacgccaaggccgggattgccctgaacgaccacttcatcaagctcgtctcgtggtacgacaacgagtggggctacagcaaccgcgtagtcgacctgatccgccacatgttcaagacccagtaggctagtagagagatagatttctgcctccctatcgtgggtcgtccccaatggcctttggtcgcagaccatctttgctgcttgtctatgctgagaataaatgtgaacggtgcccctggacgctgg

SEQ ID NO: 12432 - DNA, 616 bp, Zea mays
  unsure (1)..(616): unsure at all n locations; Clone ID: LIB3279-207-Q1-K6-A7
ccccgcgtccgctcgccgctgcntaccgaaacggccagacattccccaaaccctacgctcgctcgctcgccggagccctcgttgaaccgagcaggcgggcgaaggaggctcgacgatgttccgcaaccagtacgacaccgacgtgaccacgtggagcccccaggggcggctcttccaggtggagtacgccatggaggccgtcaagcagggctccgcctgcgtggggctccggtcccgcacccacgccgtcctcgccgccgtcaacaagcccgcctccgagctctcctcctaccagcggaaggtgttccgcgtcgccgaccacgccggggtcgcgctcgccggcctcaccgccgacggccgcgtcctctcgcgcttcctccgcaacgagtgcatcaaccactccttcgtctacgaggcgccgctccccgtctccaggctcgcgctcaggctcgccgacaaggcgcaggtctgcacgcagcggtcatggaagaggccctacggcgtgggcctcctcgttgccggactggacgagtcaggagcccacctgtactacaactgccccacgggaactacttcgagtaccaggcgttcgtcatcggcttccgctcccaaaccg

SEQ ID NO: 12433 - DNA, 610 bp, Zea mays
  unsure (1)..(610): unsure at all n locations; Clone ID: LIB3279-207-Q1-K6-A8
ccccgcgtccgncaaactgcccttgccgccgnccactgcccgaccaggtgtgcagactgctccctcctcctctccgctccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatccgcaagtaccagaagagcacggagctgctcatccgcaagctcccctcccagcgcctcgtccgcgagatcgcgcaggacttcaagacggacctgcggttccagtcctcggccgtggcggcgctgcaggaggccgcggaggcgtacctggtggggctcttcgaggacaccaacctctgcgccatccacgccaagagggtcaccatcatgcccaaggacatccagctcgcccgccgcatcaggggcgagagggcttgagctgtcgcgctgctgctgttcgtcgttgtaatgtctggagtagatggtggtgggtgctttctatgccgtgcctatttggctatttccggacgtgttggttcactgaatgggaaaagg

SEQ ID NO: 12434 - DNA, 493 bp, Zea mays
  Clone ID: LIB3279-207-Q1-K6-A9
gttcacacgcccgcgaccaggcccatgcgatgagtcgacggtggagacggaggtgcgcgcggcgcacaacgtgctggaggcgtgcgcgcagacggacgccatggagcgggtcgtcttcacctcctccgtcaccgccgtcgtctggagcggcgccggcgccggcgtcggcgcccacagggaggaggtcgccgacgagaggagctggagcgacctcgccttctgcaggaagttcaagctgtggcacgccctggccaagacgctgtcggagaagacggcgtgggcgctggccatggacaggggcgtcgacatggtggccatcaacgccggcctgctgctggccgcccccgggctcgggctcaccgccgcgcacccctacctaaagggcgcccccgacatgtacgacggcggcgttctcgctaccgtcgacgtccgcttactggccgacgtgcacgtaatgctactacgagtcccccaccgtctactgtgcgttcct

SEQ ID NO: 12435 - DNA, 526 bp, Zea mays
  unsure (1)..(526): unsure at all n locations; Clone ID: LIB3279-207-Q1-K6-B1
cgctcccgcgcgccgcccggncgacgtcgccgtagntgttgttagtagtagtcctactcctacctccgcagaagccgccggcgaacaagaggccgtgccttctcatgagaccgcgcaccggaacagtagctgccgcagctgtagcatggggggaggaggaggaggaggagacggctgcttcttgcccgtgcgccggtcgctgtccatggactccagcaccgacaaacgcttctacctcgcgctgcagaccattctgcggcagagttccggcggcggcgcctcccaggctgtcaccgcaggaggtgacggcaaagcggagagcagcaatgccgccgccgacattggcccaccatcgtcgaggaggttgcgccggtctttcttctcgttcagccagagcaggggatcccgaaatgccgtcctgccgctctgaattgggcggcattgtccccatgaattcaacttcttcgactcttaaaaaaaaaaaaaagaagagaaggggggggaaaaggataaagaagaaggaggg

SEQ ID NO: 12436 - DNA, 513 bp, Zea mays
  unsure (1)..(513): unsure at all n locations; Clone ID: LIB3279-207-Q1-K6-B10
ngacagagcagggagaccgccagcgccgtccaggcgacggcgacggcatctgggaaggcagctgacgcagccgagaagaccgagcccgtcaaggacgagctgtaaacagccttggcgtggacgctgtgggtatgtaagcatgggacagagtggggagaaaagctggcgccaacgtactcgccaagcctgcggctttagtttttgcgagagggaacagggcaaaggaagagaatgggagggaggggtctgtccgtctgtggcgtgttttgctctggtgcggtggtgcggcatgcctgtgtatcccattgagattctgtacaattgcaaacagagagcggtacctttttagttaattatcagagatgactgtagaaagagactgattgtggtgaggttgagtggacgaataaatggcgagtctgcctcattggatgcatcatgaaacgggcacttttgaggagggatggtaatggggaaatttccgtggagaattaaataaaaaacgcaaatgng

SEQ ID NO: 12437 - DNA, 529 bp, Zea mays
  unsure (1)..(529): unsure at all n locations; Clone ID: LIB3279-207-Q1-K6-B11
ctgctttgttttatttttgtgggggagagaaccccgtgttttgcgtgngagaggcaagccactcgacgctcgtcggatgtttggagcaatgcacaaatcagaatcaccgtcattcttgcaaacaccgtttgggtttgtttatggaccgagagatgatgatcgagccagtgatgtggtgcaaccacaagacgcagttggtggatgacctgaaggatggacttaaccagtggatgctcgccaagcgagtacctccccagcaaacactatctaagtgttaaattaaaggtacctccttgatttggttgatggtgtgacttggccttcatccctgccaccgggatagatggtcgagtgggttactgcttccgcaggagaggaccaggaggagtagtgtggccaggcttcgccatgttacttggttcttctccgttagttatttccgctgcattaaaatttatggttattatttctgaaaactccgataatgtaatcactattgatacttattaaatttgtggtattatgcttt

SEQ ID NO: 12438 - DNA, 630 bp, Zea mays
  Clone ID: LIB3279-207-Q1-K6-B12
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaacttcgacgggaactggaggaactgagcggtggggcccgcgcggccaagttatcctgttcgctaccgggttgtttacccctagccagatgtttatcttcgt

SEQ ID NO: 12439 - DNA, 466 bp, Zea mays
  unsure (1)..(466): unsure at all n locations; Clone ID: LIB3279-207-Q1-K6-B2
gnacattgtacaggattgagttgtatatacgaggtatattaaggtgggcaaattgacaaatgatatcgtcggagaagccagccagctgggttacagggctaggcacacatcattttcttggtcccgaatctgggcttctgctaagatctacagctggtcgcggtatcatcattatgtttatccttgtcaggagttggctatgattcaattgttttcacctgctggtcctgcagtcttgccatgcatgggtatctgtttctggagacaaaaaatcggtggaagtcgatagaacttagagcctggaaacgagtcgtgctgttgttcttggagtctggaattgttgcgtttgtttctagtacaattcatgtgttgtcatcattagaagttaaatcctttgtgctcatcatcatcatacgtatgtggatccaattataaatgcctgataaatggttaagggttcacgatg

SEQ ID NO: 12440 - DNA, 656 bp, Zea mays
  unsure (1)..(656): unsure at all n locations; Clone ID: LIB3279-207-Q1-K6-B3
cggnnacgccgtggggcntttagtttgtnaccaaagnnatcagttatnnggtggnatatagtataagnatgnngtgggactanaagcnntcgacaaaaaaatttaatacattanaaattaattaaggtgatgtttgcgactacttcgatccaccatttttagttctgctccaccaactccaccatggagttgcttcaccatcgaagtttttagagttttcaaactacttagcttatagggggacttggtgggtggagaatgacttattgtaggtcgaccacatgtgcttcttgttcgacgcaggtgacatgaggatgatgctttctgtaggcgacgtcttcgtcgattttgctgtcttctcgggattcgtgacccaacactttttgatccccgggaccacgatcattgcaacttctatggtattgaggcatctcgagcaccgtgctaaactgcagggcgtgcttaatgatcaaagtcaatgtatgctcagtcatgaaagctaagtggcataaaaacaagatggccaggacttcagtataatgttgtgactaaggtcaaggtgactgaggccgtagatgtaccagatgtcgtggaaaggagctcatggtggcacatcatggaagaatgtggcacatggctcagatggtggtagttgt

SEQ ID NO: 12441 - DNA, 590 bp, Zea mays
  Clone ID: LIB3279-207-Q1-K6-B5
cccagcgtacggtcccgcccaccgacgtcgccgcccgaacgcagtaaggaggaaggagcaggaagatgccggtggggcacgggctgcggtcgcggacccgcgacctgttcgcgcggaccttccgcaagaaggggtacatcccactcaccacgtacctgcgcacctacaagatcggcgactacgtcaacgtcaaggttaacggcgccgtgcacaagggcatgccgcacaagttctaccacggccgcaccgggagcgtctggaacgtcaccaagcgcgccatcagcgtccagatcaacaagcaggttaatggccgcatcatcaagaagcggatccatgttcgcgtggagcatgtgcagccctcccgttgcacggaggagttccgcttgaggaaagccaagaatgaccagctcaaggcggatgccaaggcccgcggtgaggtgatcagcaccaagaggcagactgtgggacccaaacctgacttcatggctgagggtgctacacttgagacagtcactcctattccttatgatgtggtcaacgatctcaagggcggatactagagagaatttttgtaccttcagcaggtcaaa

SEQ ID NO: 12442 - DNA, 525 bp, Zea mays
  unsure (1)..(525): unsure at all n locations; Clone ID: LIB3279-207-Q1-K6-B6
ggcgcgtgggcggcgcgtgggtgttgctgagatgggaaggtgaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaactgaggcacgtcatgagagggactgttataggcacacttaattgttaaccagtgcgtggttcggtgtctacacaccctgtattcttccgaggcttctcttctgatccggccaatatttttgccgtgaaatttgtgttctgcaactatggacgtctcctttgttgctgtataaggcatgatttgccatcattctgttgcttcggtgatgcttgcaatgcaatgagaatgtgttggaacgngaaaaaaaaaaaaaaaaaaaaaaaaanaggggcgggc

SEQ ID NO: 12443 - DNA, 619 bp, Zea mays
  unsure (1)..(619): unsure at all n locations; Clone ID: LIB3279-207-Q1-K6-B7
gtcttccaatggcgatgcaaanaaacacttgagnagttctgactaagaggaacatcatgggaatatatgacgtggatacacgtgctataacacgaagattaagagaagacggcagtcttattggtgtcttgagtactgatcagtctcagacagacaatgagttgttggaaatggccaaaaagtggaaaattgttggagttgatttgattagtggtgtcacatgtgatgctccatatgaatggttggacaagactgactcagaatgggagttcaagagggatcagtcaagtgaaacttttcatgtggttgcctatgactttggtatcaagcataatattttgagacgattggcatgatatggatgcaaaataacagttgttccagcaaattggcctgcttcagaggtactcaatttgaagcctaatggtgttctttttagcaatggtcctggagatccagctgcagttccctatgctgtgaagacagtacaagaaataattggaaaggttcctgttttcggcatctgtatgggccaccaattgattgggcaggcgcttggtgggaagactttaaaatgaaatttggtcatcatggggggaatcaccctgtctgggatctc

SEQ ID NO: 12444 - DNA, 615 bp, Zea mays
  Clone ID: LIB3279-207-Q1-K6-B8
ccccgcgtccggcctccctcatctcctccgagcctcgtccccgtcccacctccccggctccagggcaaaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggtcgcccgcccgcatggcaactccggcgtcgtccgcgccaagttcaggtccaacctgccgccggaatccatgggccgtaaggtcagggtgttcatgtaccccagcagcatctaaagataatctgaatgtgtggaggacccttttcttctagattttatcttcagctgtccttgtaagggttgtgttcaggttgagagttagcaggttgagctgtctatctgagaaccatttaaagttctctgagttttggtgttatggatcactggaagtattatatgaagtttaagttagaactaatttgtttgc

SEQ ID NO: 12445 - DNA, 625 bp, Zea mays
  unsure (1)..(625): unsure at all n locations; Clone ID: LIB3279-207-Q1-K6-B9
gccatgccctngacagacaaaccattggtgtggagactcaccggcgtgggtatgcaagcggggaaagggtccgccgcgggtgctcctgcgcggggtagccctgctcgtgtgactgctccctgcacggcggtcacccctgcgtcggacaccgcaccccctgtgctggaactcgacgttcgtgctcctctgcccaaagccggtttctcctcctcctatcccacctctctagagcttcagtgaccgggctgggagagatgcatgcagttaggagctcggcggggaccaccgtcgcgagttcatcggtggcgctctgtggccggcgtgctgtgggtcaataccgcgaatgccccctcaaccgtcccataccagtgttggggcctgggcgtgttggccagggagtttcttgggcgcacctggaactgcaccgtggcgaccgcgggcgtgaaggtgtggacatcgtggaggaatttctcactggtgctgcgggtccgcgcatcggcgcgtgccatcatcaccacgcccggatttttgcgcgaagggacgtgtcatctgaaaagcaagttgatacctggagtctcaagtgcccagtcaagaactggtatcactgggagaggcgcatggggga

SEQ ID NO: 12446 - DNA, 618 bp, Zea mays
  unsure (1)..(618): unsure at all n locations; Clone ID: LIB3279-207-Q1-K6-C10
ccccgcgtccggccttctcgccaagcccgccgncatcaccgaagggttcgcaaagatnnggcggtgccgcttgctgacgcagnaagaatcgtgaagaagagggtcaagcagttcaagaggccccatcttgaccgctacaagtgccttaagccaagctggcgcagcccaaggtatcgactcccgcgtcaggcgtaagttcaagggatgcaccttgatgcccaacattggatatggctccgacaagaagaccaggcactaccttcccaacaagttcaaaaagtttgttgttcacaatgtctccgagctggagctgctgctgatgcacaacaggacttactgcgctgagattgcccacaacgtgtccacccgcaagcgcaaggagattgtcgagcgtgctgcgcaaatggacatcgtggtcaccaacaagcttgccaggctccgcagccaagaggacgagtgaaatgttgggtagttttgattgtgctctgctggtgttgaagatgttactgagattgatgttcttctgtaccatttctatgcttatgatagacttttcatatggacaaaattatgctatgagtgaaaagagtatggggagtgccatctagttntgaccgg

SEQ ID NO: 12447 - DNA, 551 bp, Zea mays
  unsure (1)..(551): unsure at all n locations; Clone ID: LIB3279-207-Q1-K6-C12
ccccgcgtccgccccgcgtccgccccgcgtccgttagctattcagatggccaatggattggtagtccgtggngaaatcaattaagtgctcatggggaaacaagccaactccacctggcaccacctccaagcccctaccccctccagttgcttcataccagcctgctgtagcaatgtcaggtgtcccacaaggtttcacagcagccgaacttcttgcttaccagaggcagcttgccttaagccaggctgcagcagggcagattgctggccagcatggtctcgcgggtcaggtttctgcaggtcttcttgctgctgctggttctcaggccctctacgatggctacccgaaccagtcatcagcccagcagcttatgtactacaactagagttcaagaggacggcgttggccatcgtcgccctgttttttattttgtggttcatgtactatttgtgtgagagttcttgatctcttgtcgccgcggaattgtgttactatcttattactgtaccattgaccatttttcttgtgagattcatttgagtagtcacttt

SEQ ID NO: 12448 - DNA, 614 bp, Zea mays
  unsure (1)..(614): unsure at all n locations; Clone ID: LIB3279-207-Q1-K6-C4
ttctatctcagtttgggggngaaaggcctcgcgggtcgcaaaccgctctctgttgatttgggatttgggaggcgctcgagttttcaggtaaaccatagtttagtgaccaatggctcgtactaagcaaactgctcgcaagtccactggagggaaggctcctaggaagcaacttgccaccaaggctgctcgtaagtctgcacccacaactgggggagtaaagaagcctcatcgttaccgccctggaactgttgctcttcgtgaaatccgcaagtatcagaagagcactgacctgctcataaggaagcttccgttccaaaggcttgtcagggagattgcccaggatttcaagactgatcttcgtttccagagccatgcggtgcttgcgctgcaggaggctgcggaggcgtacctggtgggtctattcgaggacactaatctgtgcgccatccatgccaagcgcgtgaccatcatgcccaaggacattcagctggctaggaggatccgtggtgaaagggcctagattctctgtttacggctactgggagtggctccgtagtatggtttgcatctgttcgatgcttgcttttgtggaagtttacatttgtgggtgttcg

SEQ ID NO: 12449 - DNA, 587 bp, Zea mays
  unsure (1)..(587): unsure at all n locations; Clone ID: LIB3279-207-Q1-K6-C6
cgngnccgtccagcgcgcgggcaggcgcgccgctaactaacccgccaatgccgccgctcctcacctcctcctccgtaccggcgctgccgctggccgcgtggtccaggtaccgcctcagggttgcggcttccaacgccgcctccgccccggacggggccggcgccactgccagatgcaccagcaccggcgggttcccgtccttccttcccggggcggtggagcgcatccgcgacggcgctgccatccgcctggccaagcgaatcgagcgcgtgcccgtccagaccagtttctcgggtagcgcgatatcgagcagctgtgtgaggccgctcaagcagcaacaggacggtgatccggtcgtgctgctgcatggattcgacagttctgttctagaatggagatacacctacccattgctcgaggaggccggattggaggcttgggctgtggacatccttgggtggggcttctctgatttggaaacacggccgccatgtgatgttgcatccaaacgcgagcatttttaccagttctggaaatcatacatcaaaaggcctatggtgttagtcgggcccagccttggtgctgct

SEQ ID NO: 12450 - DNA, 571 bp, Zea mays
  unsure (1)..(571): unsure at all n locations; Clone ID: LIB3279-207-Q1-K6-C7
cggncgcgtgggtttctgggttggctctttgacattggagctgggattggtgaacgggtgacaacatggtggattggcctgctgcttgttctgttggtgggttggttgtgttctattataaatgggggagctttatacagaagaaagagagtgagcatgctgatggccctgtccagctttccaagtttcttggacgggacaaagaaaaggaagaaggtactcaacggagtgcaatctctggtaaaaagataatgatgaagcttgagaagacaaaggaagacaaggcagcagagagcaagcggaacgaactgttgaagtttctgaatgccagttacgattgatgtgttcgaatcgctggcgcggaaagtgcagaatgcccttttttatcgtctttgcactggtgcttttggtgatacttaagttataagcgttttgtttcttgtctataacttggccaccaaagttttgttatgctcaactagcgactgagtgaaggtctacatgcaattgatttgaattctgtgttgccagtcatggatttgcagcttttaaacccatcctttttgtgaaa

SEQ ID NO: 12451 - DNA, 611 bp, Zea mays
  unsure (1)..(611): unsure at all n locations; Clone ID: LIB3279-207-Q1-K6-C8
nagnnatcgatgtgaatccgtggnagggagggcggaggagaaggaagaagagggtcgaggccgaatccgccggtgagaaggggagcgatggcgaggctggcggtggccgcgagggcgttctccgctgcggcctccggcggcggcgtgtccttggtgcagggggcgtcccgggggatcggcctcgagttcgtgcggcagctgctgcgcagaagcgatggaggccgcgtcgtcgctacgtgccgcacgccgggttccgcggccgagctccagaagctcagggaggagcacgcgcccgggcgcctcaccgtgctgccgctcgacgtcaccgacgagagcaccatagaggcagctgcggcctcaatcacggagacccacggttctcttgaccttctgatcaactccgccggcatcctctcgatcccgaacgtgatacagccagagactacgctaagcaaggttcagaagtcgtccctgatgctggcatacgaggtgaacgcagtcggccctatcctagtgatcaagcacatgtggcctctgcttgaagatcggaggccgctccgagactaggagagggttcgcgcttgttgcaaacatgagcgctcgagtcagct

SEQ ID NO: 12452 - DNA, 617 bp, Zea mays
  Clone ID: LIB3279-207-Q1-K6-C9
ccaaccccgtctctccctgcggcgcaggcttcgcttcggctccgctcggctcgagcagaagaaaatgcacgggcagtgcaggccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtgctgatggatcttggctctggtgcaccacagaggatagcgtctatgacgctgtcaaatctatgactcagcacaacgtgggagctttggtggttgtcaaacctggacagaataaatcaatcgctggcattgtcactgagagagattatctccggaaaatcatagtgcagggaagatcttccaagtcaactaaggttggcgacatcatgactgaagagaacaaactgatcacagtgaatcccgacaccaaggtcctgcaggcaatgcagctcatgacagaaaaccgcgtcagacacatcccggtgatcgacggcacggggatgctggggatggtctccatcggcgacgtcgtgcgcgc

SEQ ID NO: 12453 - DNA, 621 bp, Zea mays
  Clone ID: LIB3279-207-Q1-K6-D1
ggcccacaccaaccaactctctctgcctcggtccctccgcccgtacgcgccgagaggagaacgatgcggcggtccctccccctcctcctcgcgcggcaggtggcgcggcagcggcggctgagcaacgtgccggagtccaccgtctacgggggcccacgcccgcaggagtcctcggcggcgcggcgcgtgacggtgaccacactccgtgggaagcaccgccgcggggagcccatcaccgtcgtcaccgcctacgactacccctcggcggtccacgtcgactccgccggcatcgacgtctgcctcgtcggggactccgccgccatggtcgtccacggccacgacaccacgctccccatcacgctcgacatcatgctcgagcactgccgcgccgtggcccggggcgcgccgcgcccgctcctcgtcggggatctcccattcggctgctacgagtcctccgccgcccaggctgttgattcagccgtgagggtcctcaaggaaggtggaatggatgcgatcaagctggaagggggtgccccatcgaggatcactgcagccaaggctattgtggaggctggaatcgctgtcatggggcatgttggcctcacaccgcaagctattagt

SEQ ID NO: 12454 - DNA, 630 bp, Zea mays
  unsure (1)..(630): unsure at all n locations; Clone ID: LIB3279-207-Q1-K6-D10
tctagnacgcgagcggccccctttttttttttttttttttttggtctcagctatccgtagttcgatatgctccgggtatctttttgaagttattagttaagttgaatacattgggccacacatgctacgatagtatgtacacattcactgatcaggggacgtgcaatagaaagaatgcatgtttctggttaacaaagccatccccaaaactaagcagagataacaaacttgccctctgtagtcgtaccattcgctcaatgctcagctttcattttgacatctccattaggcaaagtaccctgggactgagccaaccgctttgcctcagcagcagaagtagcacgtatctccctgtatgcttctacgtcctcagggaaagcttgttcaagctcctcaagaagatgcttccgtaggcccttgaaagcgtcagtcttgcccttggtgatctggtttttggcgatgcagctgttgagcacgtccctagtgaactcgtcggggttcttcccatcgtcgatcaaattgacgacctccataggcacctggatgttgcacccctcggcgagtttctgcatcgtgtcgagctccgccacaagcgcattcaggcgctgngaggagggggagctgggaggc

SEQ ID NO: 12455 - DNA, 633 bp, Zea mays
  Clone ID: LIB3279-207-Q1-K6-D11
tagctcaattgccctcatccagccaggaaagaaagacctttcagcgctagtttggaaactcaaatccccttcggggttgaaggggattggagaggaaattagttcatttccacctcaatcccctctaaccccaaggggatttgaggttcccaaagtagccatcatcgtttgaaattctgcccttttcagtctgatatatatgttgatgaggctctatgccacccatacctggcatcccttcatgagataaacgacgaacccgtctgcccagcgcctttcagcttcgacttcgagcagccatcgctcaccgaagaagatatcaaggagctcatctggagggagtctctcaagttcaaccctgacccagtccgctgaatagttccctgtgtacacacgagtaaactaggatggcatgtctatcagctccatctccatggggacaaaaggcatgaagcaactgcagcaagatgagtgtacaagtgacatcatcatcaccacatctcgtggcttgtcaatagcgacaccgtaacgtcaaaaatattggacatttgtgaaacaagaagcttgatcaataatttctagtggagaaagctggcagcttatctgcatcttgttaggttgtatctacctccc

SEQ ID NO: 12456 - DNA, 544 bp, Zea mays
  unsure (1)..(544): unsure at all n locations; Clone ID: LIB3279-207-Q1-K6-D12
agncctccaggcaggtgatcganagtactactcccgcatgaccctcgacttccacaccaacaagaaggtgctcgaggaggtctcgattctgccctcgaagcgcctccgcaacaaggtggctggcttcagtacccacctgatgcgccgcatccagcgcggcccagtccgcggcatctcgctcaagctgcaggaggaggagcgcgagcgccgcatggacttcgtgccggagaagtccgcgctcgaggtcgaagagatccgcgtcgacaaggagaccatggagatgctcgctgccctcggcatggccgacctgcccggcgttgagcgccaggctgaggtctccaacgcccccgcctacggccgcccgcagtacggtggtccccgccgtgaccgcgtttagacttcgcggtggttgcctcttgatcgcactgctattcgtagttgttgtcctactatgctaaacttcttttagatctttggttgcatctgtggcggttaagttttgaacttgcctgttatggtataaattctgaagtgtttggttcac

SEQ ID NO: 12457 - DNA, 625 bp, Zea mays
  Clone ID: LIB3279-207-Q1-K6-D2
tgctcctgacactttctcctcgtcccagccaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtaggctgcagatgggacgaatgtgcttg

SEQ ID NO: 12458 - DNA, 608 bp, Zea mays
  Clone ID: LIB3279-207-Q1-K6-D3
cggccgcgtgggcagtaaatgcaagtgcaaccaacaccaccacgagaaacggaggagggagcaatggcggagccgagccagcagcagctgctgcggtcgttcgtggaggtgccggcgggctcccacttccccatccagaacctgcccttcggggtcttccgccggcggggggtgcaggcgcaggcgccgcgccccgcggtggccatcggggacttcgcgctcgacctcgccgctgtcgccgacgcggggctcttcgacgggcccgcgctctccggctccccgtgcttccaccaggagacgctcaacatgttcctggggatgggccggccggcgtggagggaggcgcgcgtcacgctacagaaaatcctatcagccgacgagcccgtcttgcgtgacaacgaagcgctgaggaacaagtgtctggtaccaatgagtgatatagagatggttctaccaatcacggttggaggttacacggacttcttttgttctgtgcaccatgcaaggaattgtggattcatcttccgagggccgcagactccagtcaatccaaattggttttatcttccagtaggatacaatgggcgagcatcatctatagttgtgtc

SEQ ID NO: 12459 - DNA, 623 bp, Zea mays
  unsure (1)..(623): unsure at all n locations; Clone ID: LIB3279-207-Q1-K6-D4
catcacaccaccgcgnaaccccagcagccgcatcgatggcgcccaaggcggngnaagaagccggnctgcgaagaagccagcggaggaggagcccgctgccgcgaaggccccggcggggaagaagcccaaggccgagaagcgcctcccggcggccaagtcgtccggcaaagaaggcggcgacaagaagggtaagaagaaggcgaagaagtcggtggagacctacaagatctacatcttcaaggtgctgaagcaggtccaccccgacatcggcatctcttccaaggccatgtccatcatgaactccttcatcaacgacatcttcgagaagctcgccggcgaggctgccaagcttgcgcgctacaacaagaagcccaccatcacctctcgggagattcaaacctctgtccgccttgtccttcccggcgagctcgccaagcacgcggtctccgagggcaccaaggccgtcactaagttcacatcatcttagatttgaggtagtagctattgggtggcgttggtagttgtgtctcaatttgtctgctactaatagtggtagcagtatccatgtgtagttgggttgtggtaagaattgtgttaaactggtaatacgtttgaaattgctt

SEQ ID NO: 12460 - DNA, 601 bp, Zea mays
  unsure (1)..(601): unsure at all n locations; Clone ID: LIB3279-207-Q1-K6-D6
gnaaatgctagtaaatctgaaatcaaagcgccntatcggagcttgctaggagctatcatccagatgtaaacaaagatcctggtgctgaacaaaagttcaaggatatcagtaatgcttatgaggttctgtctgatgatgagaagcgatcgatctatgataaatatggagaagcaggtctgaagggtgctggcatgggcacaggagattactcaaacccgtttgatctctttgagtccctgtttgaagggtttggtggaatgggtggaatggggggtggccgtgctgctcggaacagaccaatgcaaggtgatgatgagagctacaatctggtactcaatttcaaggaagctgtgtttggtgtggagaaggagattgagataaccagattggaaggctgtaacacctgcgacggaagtggtgccaagccaggtacaaaggcaaccacatgtaaaacttgtggaggtcagggccaggtagtctcctccacaagaacaccggttggaatattccagcaagtctccacctgcaatacttgtggtggcaccggggaattctccactccttgcaacacctgtgggggtgatggcccggtgcctaagac

SEQ ID NO: 12461 - DNA, 321 bp, Zea mays
  unsure (1)..(321): unsure at all n locations; Clone ID: LIB3279-207-Q1-K6-D7
naggnaattttacaccatcttccaacaaatcttgttaagaacgatgcaggcttttcatattttctgcaataattttatataaatgttatagctgtatgtattccaagagtcctttcaggaatgctgtacagattctcattttcttttctcgcattacagcaagagaacgtaattatctttttgtggtacgggaaacaaataatcactttgattgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggg

SEQ ID NO: 12462 - DNA, 635 bp, Zea mays
  Clone ID: LIB3279-207-Q1-K6-D8
ggcaagtcagagaagcctgttggaagtcatggcagagttcccttcggcaaagcctccactaggagtcttctttgcagctgttgcccctcgacttcaaccaagatattattctatttcatcttcacctagtatggcaccaaccaggattcatgtcacatgtgcgctcgtgcgccgaaacaacacccgctggaagggtacataagggagtttgctcaacttggattaagaatgctgttccttcggaggagagcaaggaatgcagctgggctccgatatttgtgaggcaatcaaacttcaaactacccgctgatccttcagtaccgattatcatgattggccctgggaccggtcttgcaccctaccgtggcttcttgcaggaaagacttgctcaaaaagaatctggagctgagcttggtcgatctgtgttcttctttggatgcagaaacagcaagatggacttcatctatgagggcgagctgaacaatttccttgagcaaggagcactgtctgagctggttcttgccttctcgcgccagggccttgctaaggaatatgtgcagcacaaaatggcacagaaagcatctgaaatctgggacatgatctcccaaggtgcttacatctatgtctgtggtgac

SEQ ID NO: 12463 - DNA, 305 bp, Zea mays
  unsure (1)..(305): unsure at all n locations; Clone ID: LIB3279-207-Q1-K6-D9
cggncgcgtgggcggacgcgtgggttttctaccatcacactgacacgttcatagctagctagtcttcagctagtaacttacgacgggataatctcgatctgggagcgaggaggaggacgacgacaatgaagatgagctccgtgccagcggcagcggcggtgatggtggtggtggtgctgctgctatctgcagcagcgacgactgtgacggggcaggcgcttgtgccgggcgtgatgatctttggcgactcgttggttgacgccggtaacaacaaccgtttagcgacgctggtgcgcgccgacttt

SEQ ID NO: 12464 - DNA, 563 bp, Zea mays
  Clone ID: LIB3279-207-Q1-K6-E10
gccactgcttggggggccctcggtgaggcggatccccagcaggcggcgccacattagggcttactttagtgatcaccctggccgtgctcttgatcatagtcaaggggccccgcaaccccatcatcaagacatggatgatctccatctgcactctgagcctcgctctgtgtggtgcagtatacaccggcccttacatgaacccagccaatgcatcaggctgggcatatgttaacaaccgtcataatacgtgggagcagatctatgagcactggatatgtccctgcattggtgccattcttgctgcgtggatctttagggctatgttcctaacaccgtcacctaagcccaaggccaagaaagcatgatgaacatcattaggacatggatgctggatttgataagtcaacatgaattgttagaataagaggaacgacaataagttcctggttcccagcatgttgaattaaatggattaatgagatactctatgactacgtccattaatcataccgttctttatgcggatatgaaatatctacctgagtatatacacatgttctttc

SEQ ID NO: 12465 - DNA, 535 bp, Zea mays
  unsure (1)..(535): unsure at all n locations; Clone ID: LIB3279-207-Q1-K6-E11
cgcctgcctgccgcatcactgtcttctcatgtaggtggtggcgccacgtgncgaanaatacaaggacgtggacgtggtgagcaccacctcagagttctcgtcctcgctggagacagcgggtgggcaccggccccgggacgcccaccccgtcgccacgggttctaggaccagggtgccgcccgaggaggactcgtgcgactcggagagcgtggcatccaacttcgagttccacaaggagcggcgggcagcggcggcggcgtcggtcgtccctccattctcaaagcccgccccgtcaaagtgggacgacgcacagaagtggatcgccagcccgacggcgaactgccctggcaggggtggcgcggctcctgcgccgaagaagacagagaaacctggctccggcatcgggaggctgtcgatgccggcgaccaaggttgtggtagaggccatcgtggagatagatacctagaggatggatccgagcatgcataaccttagattgggtggcataaagcgtagaggtgggcgcccgccggcc

SEQ ID NO: 12466 - DNA, 187 bp, Zea mays
  Clone ID: LIB3279-207-Q1-K6-E4
cccagcgtccggtcatatgctgcacatttcagcgctgcatacactgcgccgtgccattgtgcttcggcagtcattaagtttcatagtcatcaaaggaactgagtgtaccatttcacgtctaagaccgaaaacaagccccctctcgatgtactcgtttcatatcgttctgtggttgattgaatttggc

SEQ ID NO: 12467 - DNA, 616 bp, Zea mays
  unsure (1)..(616): unsure at all n locations; Clone ID: LIB3279-207-Q1-K6-E6
gccgnggtagaaggccaganaagaggcgaccaccgagccggcggcggtgaggctggtgggctccttcgccagcccgttcgtccaccgcgccgaggtggccctgcgcctcaaagggtgccctacgagctcatcctggaggacctgggcaacaagagcgagctgctgctggcacacaaccccgtgcacaaactcgtgcccgtgctcctccacggcgacagggccatctccgagtcgctcgtcatcctcgagtacgtcgacgaggccttcgacgggccgcctctcctccccgcggaaccccacgcgagggcggacgcgcggttctgggcccacttcatcgaccaaaagttcgcgcggccgttctggatgtcgttctggacggacgacgaggagcgcagggaggctatggcgaaggaggccaaggagaacctggctctgctcgaggcgcagctcagggggcagaggttcttcggcggcgaggccatcggcttcgtcgacatcgccgcctgtgcgctggcgcactgggtcggggtcatcgaggaggctgccggngtggtcctcgtcggcggcgaggagttcccagcgctccgcgagtgggccgacgcctacgtcaacgacg

SEQ ID NO: 12468 - DNA, 624 bp, Zea mays
  unsure (1)..(624): unsure at all n locations; Clone ID: LIB3279-207-Q1-K6-E7
gttcagnacgcgagcaaacccaagctggnanatactgacattatgcgggaaagtaatagagattttgaggccagacgtgcaacatcttctctcccacctcaagattgaccccacctcttcaatctatgctgcaacgcatccaaagctcgttcaaaacccatcctaataatgttatattttacaagtgtattctaatgatgcaagatgcttcgaaccactgcagaagtctcaacatgtgatgctgttggatgagtagaattgcagtaactgtaacatgtgattcaggggcgtatctgcttagtgattcgccgttgtcagttgtatcctttagttagaatgttgtaaatgctatctgcttagtgcatattaggacataactacatagtgtaagcagtaaccatggaggttatcttgccaggctaagaattttggcttccttgcctgtgagccatgcgacatatgtatcctgtcgcattaggatgagcgacaaccgacacggtcgcatgatgcaagatttgtgccggttggccgattgtcaccgtgcagacctcttcgtaacagtgcttcacgtggaaggtttgaccgagtgacggcatcaccagttaacagtgtaaactgtatcaa

SEQ ID NO: 12469 - DNA, 614 bp, Zea mays
  Clone ID: LIB3279-207-Q1-K6-E8
ccccgcgtccgccccgcgtccggcaggaccagctagctagctcctcccactgctatcacccgggccccggccagccatctcgctgaaagagaaaagcgcagccatgaagactactagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaatccatacgacgggatggtgatgttcagtgccctgctagcagtaggctgcatctgcactgagtgactagaataaaggatttggtgatgtttgtgctgattggtgtgttcgcctgtaatcgtgtgatgc

SEQ ID NO: 12470 - DNA, 308 bp, Zea mays
  unsure (1)..(308): unsure at all n locations; Clone ID: LIB3279-207-Q1-K6-E9
gcccgccgattagcgcgncgggctatttatggggcaacattccgtgatgcagcaagtggtggttgtgttagtgtttaccacgttggccctgatggttggacgaagctttctggggatgatgtcggggagctgcactaccactactacccggttcagaaaactccggttgaacaggagatggccgatgcgcctactgcttctgcttaaacctgttgctgagaaaaccttgagcggagccgcatgtatccatgaaccatgaattgtagaagcgccatgtttatgaacgaacttggacatgtttgtctcac

SEQ ID NO: 12471 - DNA, 620 bp, Zea mays
  Clone ID: LIB3279-207-Q1-K6-F10
cccagcgtccgcggccgcgtggggtggtaggccagctggagggacagaagactctggagattactgcaacccttaccatgctggtttggctttgaatgatgatggtcttcttgggataagacctgtgatgcgtccaagaggtattgatttgaaagatgggccactgtttgctgctctcattgcaaaagttcaaggaaagaacgttggtattcctgtgtgtggaggcgctgctacgtctaaatccccatggaatgcacctgaacttttcgatctttctcttctggagggtgaatctcttagagaatggttgttctttgatactccaagaagagcatttgagagtggcaaccggaagcagaggtcattgccggattacggtggtcgtgggtggcatgaatcaaggaagctggtaatgaaagatttcgcaggtctgaagaggtcctattacatggacccacaaccatcaagcagccatgagtggcatcttttcgagtatgagatcaatgcttctgatgccctcgccttgtaccgtcttgagtacaagtcctctgaccccaaaaagggtgctgctaagtcaaaactggctagtccactgaatgaaaatccgcagcgaatgggca

SEQ ID NO: 12472 - DNA, 624 bp, Zea mays
  unsure (1)..(624): unsure at all n locations; Clone ID: LIB3279-207-Q1-K6-F11
ttgcttcacgcattgactgctactcggnggctagtacctctgtctttgggcaaagttgcgcgagcaagtcgaggagagactggaattctatgacaagggtgttgcgcctcgtaaaaaccttgatgtgatgaaagctgctattgacagtatggtcaatgacaccttaatggatgatgatggtacggcagataatgagaaggcggacacatctgccaagaaaagcaagaaaaagaagacaaaaaccgagactgatggtgatgcaatggatgtggataagccctccaacgtggctgatggagaagctgagcttggaaccaagaagaaaaagaaaaagaagcacaagctagaggaggcacatgaggagaacggtgcagcacatgctaatggcgacgctgaagagacccagactcccaagaagaagaaaaagaagagccgtgaaatttcggaggaagctgaacctaagacagccaccgaggggaagaagaagaaaaagaggcagtcaaggctgatgaatgacaagctatctgttgtatgtcagtacaaatcctagtatttgtagaaaaccgagataaacacctagctttttaattcatgaggtgtacgatgcaatccaattcaactatg

SEQ ID NO: 12473 - DNA, 517 bp, Zea mays
  unsure (1)..(517): unsure at all n locations; Clone ID: LIB3279-207-Q1-K6-F12
gnatttttatattatattttattctagtcagcaaatcctctactctacctcacaatcttcaacattaatatttgttggcggccttcggcttccgaagtcctcaaaaacatgatttaacaatgttttccaagtgaaatgtgtgagcaggtatcttcggaattggattacgagtatataagattaaggccaagacgaagcttgagtgggacggaaggtgattgtgnacgaaggaaaagatcattacgaagctatgcacagaagagcttcgacataacggcggaaagggaaaccgacttaaagatgaaaaaccagattagacctcgaagaattactatagagttatttataaacgtaaagggcattaatgtaatcttgcatgggctgcgacccgcgcctataaatagatgaacagtactcccgtactgttcacgctgactcggcatttgcttttggcgccatacttgtattttcactccttcaagccgaaggtacatttgtaatttaatattgtttgtac

SEQ ID NO: 12474 - DNA, 639 bp, Zea mays
  unsure (1)..(639): unsure at all n locations; Clone ID: LIB3279-207-Q1-K6-F2
cccagcgtccgcggccgcgtgggctgagggccgtcttcctngagccaccaaggttctgaccacctgaggcaagtctttggcaagcagatgggtttgagtgatcaggacattgttgccctctctggtggccacaccttgggaaggtgccacaaagagcggtctggttttgagggggcctggactacgaaccctttggtctttgacaactcttacttcaaggaacttctgagtggcgacaaggagggccttcttcagctcccaagtgacaaagccctgctgagcgaccctgtcttccgccctcttgtggagaaatatgctgcagatgagaaggcattctttgatgactacaaagaggcccacctcaagctctccgaactggggtatgctgatgcttaaatggtccatatcctggagcgggacacaaactgctgcctgtatggactcgtgcgattcagggtgaaccatcagattgtctagtgtcttctttgtaataaatttatctgttcttggtactttgtctatggttgaatcggaacccattttccgtttgcctagattcttaatttctggtgctgtatccagctgaaactagtagatctatgatcttgtggctgcagcatgttcttgtcactttaaaaa

SEQ ID NO: 12475 - DNA, 608 bp, Zea mays
  unsure (1)..(608): unsure at all n locations; Clone ID: LIB3279-207-Q1-K6-F3
ggnaatctgtcacgcagtcaagnatcacgatcgcgagnagctcccatccgaatcccaggatccgaccgtctcacgaatctcgaggcgagctgttcgatcaccactatctgacgtagcttcttcgctcggctcttcttcaccccacccctctcccactcggccactcccccccgcggggacaccgagcgctcgccgccgccttcgagttcggagcggagccacagccacgcatgccaatggccgtctccgctgttaccgcctcccatctcgctctctcttttccagcacgtagtcgccggagacgcgctgcgccccgcgccgcggcaggcggcctaacggctcgcgcacggcggctgcgctgcgagttcgtcgccggtggtgggaacggggcgctctccggagaggacgaccctcgcctcgtcgaccgccaaaaagttcttgatgccgctatgaatgacataaacaactcttttggaaaaggaagtgttacaagattaggcagtgctggtggtgcttttgttgagacattcccaagtggttgtctaacactagattttgctctgggtggcggtcttccaaaagaagagtagtggaggtatatggtccag

SEQ ID NO: 12476 - DNA, 612 bp, Zea mays
  Clone ID: LIB3279-207-Q1-K6-F5
ttgttgtttccgacccaaccccaacacgctccaccggcacctccgctcccacaccacaccgatggcccgcacgaagcagacggcgcgcaagtccaccggaggcaaggcgccgcggaagcagctggcgaccaaggcagcgcgcaagtcggccccggcaaccggcggcgtgaagaagccgcaccgcttccgcccgggcaccgtggcgctccgcgagatccgcaagtaccagaagagcacggagctgctcatccgcaagctccccttccagcgcctggtccgcgagatcgcgcaggacttcaagaccgacctccgcttccagtcctccgccgtcgccgcgctgcaggaggccgcggaggcctacctcgtcggcctcttcgaggacaccaacctctgcgccatccacgccaagcgcgtcaccatcatgcccaaggacattcagctcgcccgccgcatccgcggggagcgcgcttaggcgtttacggttgattgtcactactgtagatgtttaggctatgttctcgccatgtcctaggtctgctttgttcttatttgtttttttggtttcatcctgtgcgttgatggttgtcaatgagctatcggtgcctgtctgag

SEQ ID NO: 12477 - DNA, 609 bp, Zea mays
  Clone ID: LIB3279-207-Q1-K6-F6
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctactgtggtggtggcggcggctacggcggtggcaaccgtggcggcggctacggcaactccgacgggaactggaggaactgagcggtggggcccgcgcggccaagttatcctgttcgctaccgtgttgtttaccct

SEQ ID NO: 12478 - DNA, 445 bp, Zea mays
  unsure (1)..(445): unsure at all n locations; Clone ID: LIB3279-207-Q1-K6-F7
cggccttcaggggctggcctcccgcttcaccgatgccatcttcatcaaggtcgacgtcgacgagctcgcggaggtcgcaaggacatggaaggtagaggcgatgccaacgttcgtgctggtcaaggatgggaaggaggtaggccgtgtgattggggctaagaaggacgagcttgagaggaagatcaggatgttcgtcacgtcatcttcctcgtcctaacttagcagtgcatacactcccaccttctctggtttctcgactccagtggttcgcctgggacggggttgctgaaatggttcccttctctgaatactgaaaaatcaaaaaaagaagtatantgaaaaaatgatggtagacgtgtctgggtcaataagagtttctgaaacttggatttgtatgtgtcagtctctgtgttctgtttccaaggaatggatcatgtgagtttgg

SEQ ID NO: 12479 - DNA, 255 bp, Zea mays
  Clone ID: LIB3279-207-Q1-K6-F8
acgctttctggaggtgagaactgaagagtcgttctccatccccctgtaagagcctgttgccctcactcgtccagttgaatggacgaggaaataaataaaggtgcccaaatactagatgttttgcgttgaaatctaacttgtgctgggttggatctgttacgtcccaattttttttgttcattgttgtgagcatggggacacgtgcaggaatgtcttcgtgtctttttacccaacccaatggacactatgttctgc

SEQ ID NO: 12480 - DNA, 51 bp, Zea mays
  unsure (1)..(51): unsure at all n locations; Clone ID: LIB3279-207-Q1-K6-G1
ggggngggggggggggggggggggggggggggggggacatttttttttcgt

SEQ ID NO: 12481 - DNA, 624 bp, Zea mays
  unsure (1)..(624): unsure at all n locations; Clone ID: LIB3279-207-Q1-K6-G10
ctcgcgtcgncgactgggctaccggcgcctccaccctccgcctggtgtccttcgccgtcgacgagcgcacaccagggtacagtacgtattgctcgtgatttgtgtaactacggagcaagctgcatacagcacaagatagaagatgggtatccttgagaggatcaaggagattgaggccgagatggctcggactcagaaaaataaagcaacagaatatcatcttggacaactgaaggcaaaactagcaaagttgaggacacaactattagagcctccaaagggttccagcggaggtggagatggttttgaagtcacaaagtttgggcatggtcgtgttgcacttattggatttcccagtgttggaaagtcaactcttttaacgatgttgactgggacacattctgaagctgcatcatatgagttcacaacgcttacttgcattcctggaattgttcattacaatgataccaaaatccagcttcttgatcttcctggtatcattgaaggagcttctgaaggcaaggggcgtggtaggcaggttattgctgttgcaaagtcatcagatcttgtgctgatggttctgggtgcctcaaagagtgaaggacatcgtcaaatattaactag

SEQ ID NO: 12482 - DNA, 303 bp, Zea mays
  unsure (1)..(303): unsure at all n locations; Clone ID: LIB3279-207-Q1-K6-G11
agcacattagnagcttagnatcagataagggtctgcggtgatttatcatctcttttgaccattattcgtcggttttggtggatggatgtgattccatgtctaaatacctggacgtgctctagtgttttagtgtggtcagtagcaatgttctaaattatctgagattacgctgaatcatgttctgaagtccacgtttaacgttgctctcccaaaaaaaaaaaaaaaaaaaaaaaaaaaaaaaaaaaaaaaaaaaaaaaaaaaaaaaaaaaaaaaaaaaaaaaaaaaggggcgggccgttttaaa

SEQ ID NO: 12483 - DNA, 383 bp, Zea mays
  Clone ID: LIB3279-207-Q1-K6-G12
cggccgcgtgggccatgagccgctcggggcagcctccggatctcaagaagtcatggacaagaagcttcagattaagctgaatgcaaaccgtgttgttattggcacacttcggggattcgaccagttcatgaatctggtgatcgacaacactgtggaggtcaatggaaatgacaagacagatattggaatggtggttatcaggggaaacagtgttgtcatgatcgaggcactggagccagttgccaagtcgcagtgaatccttatttttcagctgatatagtcgcagcatgaaaactgatgtaaatgctatgagtgaaccctgttgtacttcggactcgtgcttttgcacagcaacataactcggctaccagcacccctgtttc

SEQ ID NO: 12484 - DNA, 363 bp, Zea mays
  Clone ID: LIB3279-207-Q1-K6-G4
tgtgcaacccctcgtgtcggccgtgtaccagcggtcgggcggcgcccctggcggtgacgctgacggcggtgttgacgacgaccacgacgagctgtagatggttgtagatggacgatggtggtggtgacgtggagtgccgggagccgagccaaattttgtaacggtgtttagcggcggacaatacttattactaatcttggtgctgctctgccaatagccgtgctgagcgtagaaactgtttgtttgtaattttttttcttctacttccttggttgttcaggattcggattcgaattttatgtgaaaaaagaagtcgcgcttttaaaatcttgcatttgcccccttgtggtaataatgctaatt

SEQ ID NO: 12485 - DNA, 628 bp, Zea mays
  Clone ID: LIB3279-207-Q1-K6-G6
tgtattcccaaattgccaccctgttctgcgtctcgtcgaacgacgataaccacacgtctcgaaaccctaagctgccccaaattgttatcccaaaccctagacctaaacggctccatgctgtgagaccaccaacagtgtccatggctctggacgccccggtggagcgacgggacgaggtacagatcgcgatggggaacggaaacggcgtggcgccgtctcaaccgtcgcggccagccggtcggccaacggctgctgcggcggcagcgccatacgcggacaggcggctgcggctgaacccaaatgcggatcacaagccggaagactacagcgacgtgcgcggcgagtacgcgccggccgtgtacagcgcactcgagcggcatctcccacccagcctcatcgatgccgaccgcgatgtcaagctacacttcatgcgggacattctcgcgcgctactggccgcagggcgagcgtaacaaggtgcaaaggcacagagaatataggcagaggatactccacctttacaagcctcttcatgaagaattatacaatatgcatccttcagtgttcttcttaccaacattccttgaagcagttaggagccaatacagagaatgctttagaagtattat

SEQ ID NO: 12486 - DNA, 624 bp, Zea mays
  Clone ID: LIB3279-207-Q1-K6-G7
ccccgcgtccgccccgcgtccgccccgcgtccgcccacgcgtccggcgtaccgcgacctcatcgatcaccttcagctttcaatcatggccgacgtcgatgtcgaaccggaggttgccgccggcgctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcgctcatcaagaaactgcgcaaggcgaaaaaggatgctcctgctggtgagaagcccgagccagtcaagacacatctccgtaacatgatcattgtccctgagatgattggaagcattgttggggtctacaacggcaagaccttcaaccaggttgagatcaagcctgagatgatcggccactaccttgctgagttctccatctcctacaagccggtcaagcacggcaggcccggtatcggtgccacccactcctcgcggtttattcctctgaaatgagctgttactcggctctttagtatcccaagagtccgttggcaatgttcattcagatttttctacttctttagtatccca

SEQ ID NO: 12487 - DNA, 613 bp, Zea mays
  unsure (1)..(613): unsure at all n locations; Clone ID: LIB3279-207-Q1-K6-G8
catcccgggacgttgaccgctaagctctgagagcagctaagttgtggcgaagagagaaacttttctaatgaacagaatggngttcctgtaaagagagaaactgttgagataaaaaatcataaaatgtgactaatataagaacaagtgtcaccaaagagaatggaagccataaacgtgaatccaataagccaggaaagcatctcaagaaaaataagaataatgctaccaaagaaattgatggctctgagagcagtgaaacaaatagaggtgggaaagaagagcatcgcgaacaaaccaagaaaatgagtcacaagaggaagtttgcttctgatagatccaaaaaatctggccccgagagcttctcgggtgtcaaagagaagagacaggtcagtgacaagaagcggaaaaagaaatggcaattcaagctgaggcgtgattgggaagctgaaaagaaaggtgacaagaggaggaaggtatgaaggagtattcagatgtccacaggccccaatgaaatttgatgggtgtgtaagggcaaccgagaattttgagcaagcacgagtttggagccaacgaaaatttgatgtatgaaatagcgattgtagtttattatttt

SEQ ID NO: 12488 - DNA, 638 bp, Zea mays
  Clone ID: LIB3279-207-Q1-K6-G9
cttttccccgggcaccaccaccaccccccccagccgcacagctcacttccagccgaaagcacaagcacgccatggcagaggagaagaagaggcacaagcacaagcacaaggagaaggacaagcaggcgggcggcggcacggagcaggcggcgcacttcaagccgtgcggcgacgtgaagggcatccggttcgggggccagttcatcgtgaagtcgttcacggtgcggcgggcgtcgcccctggagctgctgcggctgctgggcatcccgccgtcgtacctgagcgagtgccagagcctgccgttcccgtccaccaccgcctacatgcccacgggcttcaccatcctggcgcaccaggcgtggcacacgctgacgctgggcctgggcaccaacaagtccaaggcggcgctcttcgtgttcgagtccgaggccatgaaggcggccgtggaccgcctgtggcccgccgtcaccccgctcggggacgtcaacaggaggctcatccgcggcctcacgggcagcgagatggcgcgcttcaagttccgcaagggctgcctcaccatctacgtctacgccgtgcgccggctcggcgccgccgggttcatgcgcaccgacgacctcaggcgggtgctgcagtccgtc

SEQ ID NO: 12489 - DNA, 592 bp, Zea mays
  unsure (1)..(592): unsure at all n locations; Clone ID: LIB3279-207-Q1-K6-H1
ggcgactccgacgcacgccgntcgtgcgcctcctccctcaccgcgcgccgccgtcgctcccatcggttcctttcaaccggtggatcaccccgctttccataaccgtttatccttggttgtgctcagcgtctggttccgccactggtcccatggctgccccgcgcgccgcggcggcgtcggcgaagcaggtgacgaggcagaactttgcggaggccgtgctggagctgagggcccacctggaggcatgcgactacgtggccgtggcggcgcagaagaccggtgccccgacgggatggcgccgcgcgttgccggtggacactgcggaaacggcgtatctcaaggccaagctcgccgcagagtcctttcagccactccagatcgccgtctgccccttcagacagcgcaactcttacccgtctaccctcgtcgcctacccgtacaattttcacttatttcctagagatgaactacagctcggaatgccttcatacagtttctcttgtcaaccatgttatttatcaactatagctaatgatggttttgatttcaatatgggcatatatgatgggatttgcttatctatcaagggttc

SEQ ID NO: 12490 - DNA, 541 bp, Zea mays
  Clone ID: LIB3279-207-Q1-K6-H10
ctttactgaggactatgcaaactgcagttggtgtctttggtggtgaaaagttactgatggtgtaaatgcacctccactaatggtcgaaaatgccggacacagtggccgtccggcagtttcaagtttgaactgccccccatttattgcagtcgaaacctgcagagagcacttgggtgtccatccctgtgacaagaggaggagcataaccgaataccggcctctctttcctgcgattgatttttcattgatagagaatgatgaagatgttctttgggaaccagatgtgagagaaccaaatgaggctgtcgcattgaggggtatgaagttcatggactggttgtggacaagagaagagaaagagatagctattgtcagtcacagtggcttcttgtttcacaccttaagcatgtacagcaaggagttgccatccaaccatatgagacgaagttagcaagcactttgcaaactgcgagctacggtcgaatgtgttggctgacagaagcatgctttgggtcatatttctgaagattgaactatgctg

SEQ ID NO: 12491 - DNA, 613 bp, Zea mays
  unsure (1)..(613): unsure at all n locations; Clone ID: LIB3279-207-Q1-K6-H7
gtaaaaggttctactgnagcggcagctgcattttcgactccttcagttataattcgaagtgctgctgactgtgatgctcaagatgatgcaaatggttctaagaagcgggcgaaggttgcaaagtcatctcctagaccaaataaaccagccagcgaatgccatgatgttaggaaagctaccgctaagaaagctacaggtgccactaccaagaaaactaagaaagtaaagattgaggaatctgtgagtaatggactagaaaccagtggttctgatgttccagaacagagtgctgacaacacttctgaccagaatcagagtcccacgaaattccaatctggggcaatgaagttgggtgatgtagttacagcaaaggtctaccagattcgagcctatggactagtacttgagttgagtgatggtgtgcgtggaatgcataaatttgaggcaaatggcctaaaggaatttgaagttggacaggaactagtagtgaaatgttctagtttcaatgcgaaggggattccgttattctcattgctggactagcaatgccaccatttgggaaccggatacaaatgacaccttagcagctaaccaatcaactgggggaacacat

SEQ ID NO: 12492 - DNA, 627 bp, Zea mays
  unsure (1)..(627): unsure at all n locations; Clone ID: LIB3279-207-Q1-K6-H8
ctaacctaccgctacagggcaagaccgtcatgacccagnaagagcgatacgaatccctgcggcactgcaagtgggttgatgaggtcattcctgatgcaccgtgggttctcacacaggagtttattgataagcatcagattgactatgttgctcatgatgcgctgccttatgctgatactagcggaacagcaaatgatgtctatgaatttgttaaaaagattggaaaattcaaggaaacaaaaaggacagacggggtttctacttcagatctcataatgaggatcttgaaggactataaccagtatgtcatgaggaatttagcacggggctactcgaggaaagatcttggtgtgagctatgtcaaggagaaacaattgcaagttaatatgaagatcaataaactgcgggagactgtgaaggcacatcaggaaaagttgcaaacagtggcaaagactgctggtttgaatcatgaagaatggcttgctaatgcggatcgctgggttgctggtttcctagagaagtttgagcaacactgccacaatatggaaactgcgatcaaggatcggatacaggagaggctagggaaacagttgagcaaaggaataatcgctggtcttgtgcaggaac

SEQ ID NO: 12493 - DNA, 155 bp, Zea mays
  Clone ID: LIB3279-207-Q1-K6-H9
gcggtatcttgcaacatttaattgagatttggtgggaaagcaaaaggaaagaaatcctaccactttcaagtctcaatcaacgccaagcagcattagttgccctccctataaatctgatgaaagactgctacttaaggctgtagccttccatacat

SEQ ID NO: 12494 - DNA, 531 bp, Zea mays; identical to SEQ ID NO: 8612
  Clone ID: LIB3279-207-Q1-N6-A1

SEQ ID NO: 12495 - DNA, 553 bp, Zea mays
  unsure (1)..(553): unsure at all n locations; Clone ID: LIB3279-207-Q1-N6-A10
aactgccaaaacattgtttgcattgttgtgctccactccgggccttgtacatcgcaaaagatgatcacttgcaatcaatttcatcatgcagttgaactctttcaactaacgatggaactggaggagtggaggtacttaggggaagaatatgatcacaaacaatgtccaccttgggttacataataacatcctaaaacagttcagaacttcagatccaaccaacttgcaaagatgtagttaactgaactcaaaccaaaaaaaacacaccacacaaaattaagggccctctcataaattcttgctaaagctcttattttcagcaaccttactcattccatcttctattttcaactacattcactccgcaaacagtctactggccacagcctaacacgggttttgctagccaggaacaaagggcagctcattgctcatcaaagatggggcccttgtcactcacatagataccgcccaagaacttccggatatccttcttcttgacatggcatntctggtttatgagagcagcggagcgagagacaagctcacatca

SEQ ID NO: 12496 - DNA, 575 bp, Zea mays
  unsure (1)..(575): unsure at all n locations; Clone ID: LIB3279-207-Q1-N6-A11
gagcaactaaatttcgctacagcacatcgcacagcacagcacaccacgatcacattccgaagggtccagaattcgaccacactttcacaacccaccacaccaaatcacgaggagcacagctacagacgacgagcagagcagaccgtcactcggcgctctcacgatgcatttcactacgccttgacaggcacaaccttgacctggtccagcacggggccgcagagcgagacgccgtcggtgaccttggtgtggtagtaggagctgtaaaaggtgaggcgggtgcggaccccgccggccacgaacctgaacgccgccgtcttgaacccacctttcccggcggaatcgaacggcaccttctgcgtgacgttgcccgcgaacgcctccacaagcatagagccgtggcagccgttccgggcgtcgccgacggcgaacgacaggttgtaggcgcggttgggcacggtgcggatgacctgcgcgatggcgctctcccgcccggccaccagctccaccgngtactgccccgcggggacagagaagtgggccgcgtcgatgaatcgcaccgccttgagcgacta

SEQ ID NO: 12497 - DNA, 571 bp, Zea mays
  Clone ID: LIB3279-207-Q1-N6-A12
acttgcttgctatacaaaaggaacttctacagttgagccacactatccactagctcgaaccaccgttacttcgacttgaaagagcagaccacgagtccacgacagcggcggcagccaggagcaaggctgcaagaggggcagcagccttcctgatgagttcccccagcgaacctagcgaggctggtggatcacgcggggggcgctgctcttggggctgccggcgtacttggtcggcttctcggcgttcctgggtttctcccggaacccccggggggcggttggcggccgccttcggggaggtcatgttcagcgccttgagcaccgaatctgtcttaagggcggcggcgacggggccctgctcgagctggtcgtcgtagaagaggtcctcgtcgtcggggaggaggccggccgcgtcgatctgctcggccatctcgtccaggtgggcgcgctcgcgggaccagtggtcgcggaaccaggcagtggtggtgatgaggtcccaccactgcggcgagaagtcctccacctgtagtagcgccgccgggatgaagagcggcgcgtccgggttcagcga

SEQ ID NO: 12498 - DNA, 527 bp, Zea mays
  unsure (1)..(527): unsure at all n locations; Clone ID: LIB3279-207-Q1-N6-A2
gcagcaccaagaagcaccatgttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccggtcagttcctccagttcccgtcggagttgccgtagccgccgccacggttgccaccgccgtagccgccgccaccaccaccgtagccgtcgccgccaccaccgtagccgccgccaccgccgtagccgccgccgccatcacggcgcccgccaccgccgtagccgccgtcttcacggccaccaccgtacccggcggcgtcgncgtcttcacggtcgccgcgggactgggcctcgttgacggtgatgttgcggccg

SEQ ID NO: 12499 - DNA, 506 bp, Zea mays
  Clone ID: LIB3279-207-Q1-N6-A3
gtcgaccaaaggaagcatcacagaaacaatatcaataatgtgatgagcataacactaggatgcccatgtaaagacagaacgtaaattttagggcaagtcactgggatcggccagtgccacaacgtagaagtttgtccaccgattcagcagaattaacttgacgatacaactagtttagatcatgtcggaagcatcttcagctgctctgagccgactcagtcttggcttccgccgactcagtcttctcggcctcagcagcatgtccggcagcttgaggtttcgacacttcttcttcatcactatcatcctcaaaatcatccattcccataccacccataccgcccattccacccatgccaccaagaccacccaagccagccatatcacccatgccacccataccacccataccgccaaaattcgagaagtccatcccatccaagttgacatcagcaccatcatcatcttcgtcaacccatttgtcccaatcaactttcacaaagtga

SEQ ID NO: 12500 - DNA, 615 bp, Zea mays
  Clone ID: LIB3279-207-Q1-N6-A4
acagcagatattatcaatacattggactagagctcaatcgcttttagaaaagagtgtactaatcaggtctgaaaacatggcataacgctctgaacttgagacgactaaccaaaaaaagtgtactcatcaggacacacatttcggtgcaagacaatccatgagaatgctctaagctacagcgctcttgcccttcttcctctgtagcttcttcatgtagaactcaagctctttaccctcaaggatgtacccatcagctcggccacactgtccagggcgggaagaaatgcatgccagcaaccgtccactgccaaattgctcctcaatgtgtgggtcaagggtacgtccctccttgcgcttctcaagcttcctcgtgacatggttgctctttttcgtttcctcagctgctgcctcaacctcttgtccctcagcattatccttctttgcagcaggggttttcttcttcctaccaatgtcaactccatagtgagtgaggtaccactgcttgaatggggcagcatcaacttgcacaatggcactcttcacaagggtttgtgtcctcacaagctcattgtttgatgcattgtagaccacgtcgaggataccggtcttgcgggt

SEQ ID NO: 12501 - DNA, 441 bp, Zea mays
  Clone ID: LIB3279-207-Q1-N6-A5
aaaaaaaaaaattttggggaaaagggttttttaaaaaaaaaaaactggggaaaaaatttttgggggggaggtttaaaaaaaattttaaaaaaaaaaagggggggggcccttaaaaaaggggggggggccttttgtaaaaaaaaaaaaaaaacaaccttgggaaaaataaaaaaaaaaaaaaacccgttttaaaacgggggggggaaaaaaaaacttttttccccccgggcgggggaaaaaagtgggggtttggaaaaaaaaaccccaaaaccccccggggggggggtttgaacccctttcccccgaagtttttaaaaaaaaaaattccccccgggggtggggggaaaaaaaaaaaatgggccaaaaaaagggtgaaaaaaggggggggggttttaactaaccccaaaaaagggggggggggcgtaaaaaaattttttttaa

SEQ ID NO: 12502 - DNA, 531 bp, Zea mays
  Clone ID: LIB3279-207-Q1-N6-A6
tttttttttttttttttttttttttttttttttttttttttttttttttttttttttttttttttttttttttttttttttttttttttttttttttttttttttttttttttttttttttttttttagaaaaccaattggttgttggtggagaaagaaaaaaaaaaaaaaaaggggggaatttgaaacgggggggggggggaaaattaaaaaaaaaaaagaaagggggtcaaaaaacagagggggtccaggggcggggggcccccaaaaaatttttttttcgaataaaaaaagggaaaaaagggtttgtaaccaaagggccttgggggcaccccaaaatggggggggaaaaatttttttttttaaaagcctaaggggttttaaaaatgggggggaaaagggaaacaacccggttggtgtaaccccaatttttggccccccaaaaaaaaaatttaaaaaagggggcttaaaaggaaatccggggtttggggtaaaaaatcctcaacctgttttaaccgggagaaggggggg

SEQ ID NO: 12503 - DNA, 585 bp, Zea mays
  unsure (1)..(585): unsure at all n locations; Clone ID: LIB3279-207-Q1-N6-A7
gcgtggtggcaagcatgcctccaaaaccaacacgttatgtgttcgcatcacgtgataaattgtcagtccaaaccaaagcaaatataatttactttttttttaaaagaagtggtcatccccctatcccagccctctagatgtccatgggtgcagcagcgtcatccgagcccctctccccctcctcctgcacggaggagctagcagcagcagcctccgcagtcggtgtctcctcggcgacctccatctccatggagtcgataagttcctggacccttgccgcgccgatcacctcgaacggctcgacggtgccgtcgtccttcctgccgacgatggccacggtgcagttggatccggacagcttctcgccctgcagcgtctccttcacggcggagagagcgtccctgacgagctgctccggggtgtagtcgtcgtagccctggaacctgcgctccaggaacgtcttagcggcttgggagcgggagccgatggcgaacgcctggtactcgaagtagttcccgctggggcagttgtagtacaggtgggctcctgactcgtncagtccggcaacgaggaggcccacgccgt

SEQ ID NO: 12504 - DNA, 544 bp, Zea mays
  Clone ID: LIB3279-207-Q1-N6-A8
ctgacgagaaatggcattccattttccattcagtgaaccaacacgtccgaaatagccaaataggcacggcatagaaagcacccaccaccatctacttcagacattacaacgacgaacagcagcagcgcgacagctcaagccctctcgcccctgatgcggcgggcgagctggatgtccttgggcatgatggtgaccctcttggcgtggatggcgcaaaggttggtgtcctcgaagagccccaccaggtacgcctccgcggcctcctgcagcgccgccacggccgaggactggaaccgcaggtccgtcttgaagtcctgcgcgatctcgcggacgaggcgctgggaggggagcttgcggatgagcagctccgtgctcttctggtacttgcggatctcgcggagcgcgacggtgccggggcggaagcggtgcggcttcttcacgccgcccgtggccggggccgacttgcgcgccgccttggtggccagctgcttccgcggcgccttgccgccggtcgacttgcgcgccgtctgcttcgtgcgggcca

SEQ ID NO: 12505 - DNA, 497 bp, Zea mays
  Clone ID: LIB3279-207-Q1-N6-A9
aactcacgaacctagatatgatattgtatttcgttggcaacccgatcactgaaatgctctccccatccccacccacccctgctgctggcaggggctgtatcaacaacacacgtggcgtgtttggccatgtacagcgagcgtatggcacattttggccaaccaaacagatttccctcctttttttttgtgaggggggcgaaaactacaaatagtactacgtacaaaagaatacaacagccctagtcgcatcgcatcatctgtggcctggcacggcagttccttcctagtccagctccccgtataccccgctggcgaactccagcatgagcttgttgagcttcttgccctggatcctctgtggtatcaccttcagttcgtcgcttggcggcggcgagcgtggcgcggccggcgagagcatctgggcgagcttgacggcgtcctcgggacggcagacggcgttgctgaagcagaggtagcggccgtaggcggtgggggac

SEQ ID NO: 12506 - DNA, 442 bp, Zea mays
  Clone ID: LIB3279-207-Q1-N6-B1
aagagtcgaagaagttgaattcatggggacaatgccgcccaattcaaagcggcaggacggcatttcgggatcccctgctctggctgaacgagaagaaagaccggcgcaacctcctcgacgatggggggccaatgtcggggggggcattgctgctctccgctttgccgtcacctcctgcggtgacagcctgggaggcgcccccgccggaactttgccgcaaaatggtctgcaacgcgaggtaaaaacgtttgtcggtgctggagtccatggacagcgaccggcgcacgggcaaaaagcaaccgttttcttcttctccttctccccccatgctacagctgcggcagctactgttccggtgcgcggtcttatgaaaaggcacggccttttgttcgccggcggcttctgcggaggtaggagtaggactactactaacaacatttac

SEQ ID NO: 12507 - DNA, 492 bp, Zea mays
  Clone ID: LIB3279-207-Q1-N6-B10
attctccacaggaaatttccccattaccatccctcctcaaaagtgcccgtttcatgatgcatccaatgaggcagactcgccatttattcgtccactcaacctcaccacaatcagtctctttctacagtcatctctgataattaactaaaaaggtaccgctctctgtttgcaattgtacagaatctcaatgggatacacaggcatgccgcaccaccgcaccagagcaaaacacgccacagacggacagacccctccctcccattctcttcctttgccctgttccctctcgcaaaaactaaagccgcaggcttggcgagtacgttggcgccagcttttctccccactctgtcccatgcttacatacccacagcgtccacgccaaggctgtttacagctcgtccttgacgggctcggtcttctcggctgcgtcagctgccttcccagatgccgtcgccgtcgcctggacggcgctggcggtctccttgctcttgt

SEQ ID NO: 12508 - DNA, 309 bp, Zea mays
  Clone ID: LIB3279-207-Q1-N6-B11
aaagcataataccacaaatttaataagtatcaatagtgattacattatcggagttttcagaaataataaccataaattttaatgcagcggaaataactaacggagaagaaccaagtaacatggcgaagcctggccacactactcctcctggtcctctcctgcggaagcagtaacccactcgaccatctatcccggtggcagggatgaaggccaagtcacaccatcaaccaaatcaaggaggtacctttaatttaacacttagatagtgtttgctggggaggtactcgcttggcgagcatccactggtta

SEQ ID NO: 12509 - DNA, 576 bp, Zea mays
  unsure (1)..(576): unsure at all n locations; Clone ID: LIB3279-207-Q1-N6-B12
gacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgccgtagccgccgcctccacggccaccaccgtacccgccgccgccgccgcctccacggccgccgcgggactgggcctcgttgacggtgatgttgcggccgtccagctccttgccgttcatgccctcgatggcgttccgcatcgcctcctccgtggagaaggtgacgaagccgaagccgcgggacctctgcgtctnccgatcgaggatgatcttggactcgaggacctcgccgtaggtgctgaaggcgttgtggagggagtggtcgtccgtggcccaggcgaggccgccgacgaa

SEQ ID NO: 12510 - DNA, 466 bp, Zea mays
  Clone ID: LIB3279-207-Q1-N6-B2
catcgtgaacccttaaccatttatcaggcatttataattggatccacatacgtatgatgatgatgagcacaaaggatttaacttctaatgatgacaacacatgaattgtactagaaacaaacgcaacaattccagactccaagaacaacagcacgactcgtttccaggctctaagttctatcgacttccaccgattttttgtctccagaaacagatacccatgcatggcaagactgcaggaccagcaggtgaaaacaattgaatcatagccaactcctgacaaggataaacataatgatgataccgcgaccagctgtagatcttagcagaagcccagattcgggaccaagaaaatgatgtgtgcctagccctgtaacccagctggctggcttctccgacgatatcatttgtcaatttgcccaccttaatatacctcgtatatacaactcaatcctgtacaatgttc

SEQ ID NO: 12511 - DNA, 602 bp, Zea mays
  unsure (1)..(602): unsure at all n locations; Clone ID: LIB3279-207-Q1-N6-B3
gagctctctttcctttactatgtccaagatgactagttacaacaactaccaccatctgagccatgtgccacattcttccatgatgtgccaccatgagctcctttccacgacatctggtacatctacggcctcagtcaccttgaccttagtcacaacattatactgaagtcctggccatcttgtttttatgccacttagctttcatgactgagcatacattgactttgatcattaagcacgccctgcagtttagcacggtgctcgagatgcctcaataccatagaagttgcaatgatcgtggtcccggggatcaaaaagtgttgggtcacgaatcccgagaagacagcaaaatcgacgaagacgtcgcctacagaaagcatcatcctcatgtcacctgcgtcgaacaagaagcacatgtggtcgacctacaataagtcattctccacccaccaagtccccctataagctaagtagtttgaaaactctaaaaacttcgatggtgaagcaactccatggntggagttggtggagcagaactaaaatggtggatcgaagtagtcgcaaacatcaccttaataattttaatgattaaatttttttgt

SEQ ID NO: 12512 - DNA, 467 bp, Zea mays
  Clone ID: LIB3279-207-Q1-N6-B4
ggaaaaacattaagggcgggttgcaaaaaccacaccgaaatttggcgcgtgcctacaggtttaaacgggcgaatttgccccaaaacaaagaccggtgatttattaaacaccttacgacttctaccactggtaattttgcacattacatccttaataccggcatgactttgttctcctactttttactggcccccaattcttgtcccacttgcaaaaagggcgcaagagcaacacacaaaaaaaaggcccgggatagggccactccttgtttcctccactcgggactttttacaaacagcttacaaaacaaaacacgttttaaaaaaaaaagttggttggaaaccttttcgggcccccagtttccaaggttaccaacaaggccggcacgttggaacttttgagcacccccaaccttttgggcgggggccacaaacattttccaaggggacgttgccggcaaggaccct

SEQ ID NO: 12513 - DNA, 565 bp, Zea mays
  Clone ID: LIB3279-207-Q1-N6-B5
gcaataaaaaaaatcttttgacgccaacagcaatagccacatgagttcataacaccagaacagaagaactagccaattatcaaaaagattcagataagtttgccagctcgtttgaactgctgaaggtacaaaaattctctctagtaaccgcccttgagatcgttgaccacatcataaggaataggagtgactgtctcgagtgtagcaccctcaaccatgaagccaggtttgggtcccacaggctgcctcttggtgctgatcacctcaccgcgggccttggcatccgccttgagctggtcattcttggctttcctcaagcggaactcctccgtgcaacgggagggctgcacatgctccacgcggacatggatccgcttcctgatgatgcggccattaacctgcttgttgatctcgacgccgatggcgcgcttggtgacgttccaaacgctcccggtgcggccgtggtagaacttgtgcggcatgcccttgtgcacggcgccgttaacctgacgttgacgtagtcgccgatcttgtaggtgcgcaagtacgtggtgagtggggatgt

SEQ ID NO: 12514 - DNA, 494 bp, Zea mays
  unsure (1)..(494): unsure at all n locations; Clone ID: LIB3279-207-Q1-N6-B6
ctcgntccaacacattctcattgcattgcaagcatcaccgaagcaacagaatgatggcaaatcatgccttatacagcaacaaaggagacgtccatagttgcagaacacaaatttcacggcaaaaatattggccggatcaaaagagaagcctcggaagaatacagggtgtgtagacaccgaaccacgcactggttaacaattaagtgtgcctataacagtccctctcatgacgtgcctcagttttgcactagttgaagtcaggcttctccgggtaagtacagcccgggcgctggatgataacgtttgcggcatagcaacctgccctcacgcagtcttcaatgcccttgcctagaaccaactgtgagaggaagcctccaacgaaagcatcacctgcgccgttggtgtcaacaagcttctccttgggcaataggatcacagggaacgttttcaccttcccatcctcagcaacacccacgcgtccgcccacgcgtncg

SEQ ID NO: 12515 - DNA, 468 bp, Zea mays
  Clone ID: LIB3279-207-Q1-N6-B7
aagggggggggggggggggcccccttttttttttggggggggattttttttggggggtttttttttttttttttttttctcccccccttctttttttattctttttttttttttttaaaaaaaaaccccccccctcttttctttttttttttttttttgggggggggggggttttttttttttttttttttttttttccgcccccccccttttttttttttttttttttctccaaaaaaaaaaaaaaaagaagaaatttttttttttttttttttttttttttggggtgggggaaagaattttataaatttttttttttttttctccccccccccccccccccccgtgcttatttttttttttttttttttttttttattccaccccccccccgcggttttttttttttcttccccccccccccccgttatttttttttttttttttaaaaacaaatttttttttttt

SEQ ID NO: 12516 - DNA, 601 bp, Zea mays
  Clone ID: LIB3279-207-Q1-N6-B8
gatcaagatgcaataagagcatattatgcgattaaagagtcatcatacaaaagtatggcaaacaaattagttctaacttaaacttcatataatacttccagtgatccataacaccaaaactcagagaactttaaatggttctcagatagacagctcaacctgctaactctcaacctgaacacaacccttacaaggacagctgaagataaaatctagaagaaaagggtcctccacacattcagattatctttagatgctgctggggtacatgaacaccctgaccttacggcccatggattccggcggcaggttggacctgaacttggcgcggacgacgccggagttgccatgcgggcgggcgaccttgccccagatgcagcggtagtgggtgccgctgctcttggtcttggccttgtagatgtaggccatccgcttcccgcagtaccacgcgacgtcctcctttggtgttcaccccctcgatctgcaccagcgacgtagtctcgtactggttcgacttggaccgcttgtatccaaggacggtgccccggacgtagagcctcacgcgctgccccgtgcgccccttcaccatctcgacgctgca

SEQ ID NO: 12517 - DNA, 265 bp, Zea mays
  Clone ID: LIB3279-207-Q1-N6-B9
ccgccaagaagacaacatatataataacagagtgtttagagataaatgtcaaaaacataatcaggagttttttttcatagcgggagtcctacaaaattaaagacaaattttacagggttttaaattcattcttggggccagaaagttcactgggaaaccattaccttaaccttaaaagaacacaggggaaattcaccattggccttcttcaatgattccaatttttggacttgcacttgggaattcaaggtttaaattggttttt

SEQ ID NO: 12518 - DNA, 449 bp, Zea mays
  Clone ID: LIB3279-207-Q1-N6-C1
catgtgaatgcatatattcattagtggatgatctatttcctgtcaccaaatccgtgccggaaatatgttctgattcacgagacgccagctccgctgtggatgctcaatataccatcataccctcctattccgatgaaggacaaactgaaacaacgcaaactgcggttgctccatagtgaaccttgttttgatcactcattataaaagggcaactcaaacgctgattgacagctcggacccctggctggctgaaaaagctcctccggacacacacaccattgcagtctagaactgttcgatcttgaaactacgtccaatcatatttgtgctccacccgtgactagcttgtccggccccatcaggagatccttgcccacttataagcaggttgttctgatcttgcagaaactatggtcttgggacatctctgtgctaaatgcaactgcctt

SEQ ID NO: 12519 - DNA, 584 bp, Zea mays
  unsure (1)..(584): unsure at all n locations; Clone ID: LIB3279-207-Q1-N6-C10
ccggtcaaaactagatggcactccccataactcttttcactcatagcataattttgtccatatgaaaagtctatcataagcatagaaatggtacagaagaacatcaatctcagtaacatcttcaacaccagcagagcacaatcaaaactacccaacatttcactcgtcctcttggctgcggagcctggcaagcttgttggtgaccacgatgtccatttgcgcagcacgctcgacaatctccttgcgcttgcgggtggacacgttgtgggcaatctcagcgcagtaagtcctgttgtgcatcagcagcagctccagctcggagacattgtgaacaacaaactttttgaacttgttgggaaggtagtgcctggtcttcttgtcggagccatatccaatgttgggcatcaaggtgcatcccttgaacttacgcctgacgcgnggagtcgatacccttgggcctgcgccagcttggcttaaggcacttgtagcggtcaagatggggcctcttgaactgcttgaccctcttcttcacgatctttctgcgtcagcagcggcaccgccatctttgcgacccttcggtgatg

SEQ ID NO: 12520 - DNA, 472 bp, Zea mays
  unsure (1)..(472): unsure at all n locations; Clone ID: LIB3279-207-Q1-N6-C11
ggaaggagaagccttttttccttgcatatttgcccacatttattatggttttacacccaatatagttgcaataccattacatacccgcacaatacacctgctgctgctaaacatataggacgaacacactagtaaattaaacggccgggacggcagaagacaggccgggagcagagagctctgcgttattctctcctcgatcgtctaacggggacggatggcagcacacaaagaggagggtacgtagtagggtagcagtggcctcttatcatcatcattaccatcagcagctcatctttgccggctggctaggacacaacccttccattgatccagaccacctaaatgctccagagactgacagcagtgtggtatggtaggcatcgctttctagtantatggtggcggcgggctggggggtgtgagacaccggcggcgtccgagtgtaggtgggcggcttggtggccggcgc

SEQ ID NO: 12521 - DNA, 531 bp, Zea mays
  Clone ID: LIB3279-207-Q1-N6-C12
aaagggacctctcaaatgaatctcacaagaaaaatggtcaatggtccagtaataagatagtaacacaattccgcggcgacaagagatcaagaactctcacacaaattgtccatgaaccacaaaataaaaaacagggcgacgatggccaacgccgtcctcttgaactctagttgtagtacataagctgctgggctgatgactggttcgggtagccatcgtagagggcctgagaaccagcagcagcaagaagacctgcaaaaacctgacccgcgagaccatgctggccagcaatctgccctgctgcagcctggcttaaggcaagctgcctttggtaagcaaaaagttcggctgctgtgaaaccttgtgggacacctgacattgctacagcaggctggtatgaaacaactggagggggtaggggcttggaggtggtgccaggtggagttggcttgtttccccatgagcacttaattgatttcccacggactaccaatccattggccatctgaatagctaacggacccgtgggcg

SEQ ID NO: 12522 - DNA, 487 bp, Zea mays
  Clone ID: LIB3279-207-Q1-N6-C2
gagtaaacttattttgtatgtattgtaacttagcaacagatatataatttagtacatagtcatatgggcataattaggaacctaccctttgtagcttgagcatttaatacaaatctatcaagtacaggggcagttgcaagttgcaacacaatcagagtagcataagggatttaagctgtaacaagataggtcttgaaacatttcaaagcatcgaacattcttaagcggcggtggcagcggaagccttggaagcggcaaaaagcttggacctccttttggccaaactcccgcggtctctttgttccttcaacctctgagcaagaagcttttggtactcggcagcctcaaacttctttttggcgatcctcttcttcttgccaacgactctagtgcgcttcctctaaagggtcaaggggtcacaagccactggatctcaaggtgcttctaacttcatgtttcattgattcgatgacaccaagactgaact

SEQ ID NO: 12523 - DNA, 571 bp, Zea mays
  Clone ID: LIB3279-207-Q1-N6-C3
agcacgtccgcccccaacaactcaaatcttattcaaatccaggtccccaattatttcccaggcatgtttacagcacttgattgatggcgtacaagctgatacaccgtctgactctatgcagcaatttcctctttttttccccctcccaattcccaaacacaccctctggagcaagatcaacatctatcgccaatgacctctctttttttccctcccgattcgcgaacacaacctgtggagcaagattaacatctatcgccaatgaccacaccaccttattcagcctacatgcagcattccagctttacatccatccttgagatgggaatccagacgctgatcttccaactgctgttcctagttggatgagaaagcgatgacttcaaggagggaagcgacgaagtgcatctggacctcctcgtcgatcgtcaagaagaggggaacatgcacgaacagggatttgatgccgtgttgctccgcgaaccgaagagagtggtagtacacgtagttgcatacaaaccgaccggcgtcgccggagggcaccacgtcgtagcctatctttcggagtgac

SEQ ID NO: 12524 - DNA, 548 bp, Zea mays
  Clone ID: LIB3279-207-Q1-N6-C4
gatccgttgatgggcgaaaccagcaccaacactaattgacatcaattataaattttaaaacatagtcagattggagcacttcctaccacttgtccactacggatgaatattacgaattcgaacacccacaaatgtaaacttccacaaaagcaagcatcgaacagatgcaaaccatactacggagccactcccagtagccgtaaacagagaatctaggccctttcaccacggatcctcctagccagctgaatgtccttgggcatgatggtcacgcgcttggcatggatggcgcacagattagtgtcctcgaatagacccaccaggtacgcctccgcagcctcctgcagcgcaagcaccgcatggctctggaaacgaagatcagtcttgaaatcctgggcaatctccctgacaagcctttggaacggaagcttccttatgagcaggtcagtgctcttctgatacttgcggatttcacgaagagcaacagttccagggcggtaacgatgaggcttctttatcccccagttgtgggtgcagacttacgagca

SEQ ID NO: 12525 - DNA, 592 bp, Zea mays
  Clone ID: LIB3279-207-Q1-N6-C5
gagatctcaggacagacttgtgatatttaataagtatgaaagggcgtgttcggttggctgcaagccgacactgttgcagctgtttggactgctgcagctgcaatccatagagagaaaaatactgtagaagccgcagccgcagccggattgcagccgcagcaagccgcagcgaacaagctgaaagagtgacgcgatgacactttcagtgccagtcaatcttgatttattccagacaagacacaacggccttcaaggtaaatataaaaaaagactcggcaaccatcagggagcagcgaagcgatccacgatccactccaatgtccaaaggcagccagtgatccaatctcactcaggtcctgcaaatctgcagaggagccacagctccggccatctcctcccacgccgcgacctggaccaggtccgggatgcccttcagcgccaggagccgcttcctgcattcctcggcagcggcgatgcccgacgagtaggcgccgtgcacggaccccgagtgctcggcactggccgcctcgcggcgaagtgcaggttctcgacgggggcggcgaacctcgcgcacacgtcggccggcttcgcg

SEQ ID NO: 12526 - DNA, 406 bp, Zea mays
  unsure (1)..(406): unsure at all n locations; Clone ID: LIB3279-207-Q1-N6-C6
attnatcaattnagagactaaaataaaataaaattggggggctaatttacagttctggcaacggccgaaattggcaccctcccatccactacgtcccttgcattacagggcttccggacagtacaatttgtcctaaatgaccaacaaccttttttttaatgtcgctgaaaaaaattgccgagtttaactttaacctttaaaaaaaacaacttgggttaacataacgagttaacgactttccattattcatgggcaaacatttcactttttacaacctaccctttaaagatttttgatcttcttaagggtttaaaaattcttacgggttggaaagaaactggtcttacttttttgacctgtttcttgcgaagaattaaaaacatgttttgcgggctccctcgggttt

SEQ ID NO: 12527 - DNA, 425 bp, Zea mays
  Clone ID: LIB3279-207-Q1-N6-C7
ccacaaaaggggtgggtttaaaagctgcaaatccatgactggcaacacaaaattcaaatcaattgcttgtagaccttcactcagtcgctagttgaccataacaaaactttgggggccaagttttaaacaaaaaacaaaacccttttaacttaagtttcaccaaaagccccagtgcaaagaccataaaaaagggctttttgcactttccgccccagcgattcaaacacataaatcgtaactggcattcaaaaacttcaacagttcgttccgcttgctctttgctgccttggcttcctttggcttctaaagcttaataattatttttttaccaaaaattgcactccgttgagtacctttttccttttttttgtcccgtccaaaaaacttggaaagctggacagggccatcaacatgctcactctttt

SEQ ID NO: 12528 - DNA, 547 bp, Zea mays
  Clone ID: LIB3279-207-Q1-N6-C8
aaaaatgtctaatatttcaacacttagaagaagaaaaaaaacatcttgaactttaggtcggtgataacacaaaaagaggaccctttagctagaaataatgcatctgttcgcttggcttgttgaaaaaaaaacaacgttggattaaaaccaggggcgttgttgactgctgtgtgctgtgctatagactcaagcgagttacgatgaccgttcaccaagggatttcttggccatcccacgcgaagaacttgccgttgtcgcctttcttgacgctgtcgatgacggagagaagcctctgcacagagaactccctcgtgaagagtttaccctcggggacattcctctgaaacggcctcgagaggtcggtgtccacggttccaggatgcagcaggacgcaggcgatgttgtccttcctgccgaactccaccgacactgtcttggtcaactgattcagcgctgttttagaagctctgtacgcatgccagccaccccagagcgtgtctcctatggagctgactcgagcgctcatgtttgcaacaagcgcgaaccc

SEQ ID NO: 12529 - DNA, 564 bp, Zea mays
  unsure (1)..(564): unsure at all n locations; Clone ID: LIB3279-207-Q1-N6-C9
ccttcaaaggaaacacacagcggcacgctcttatttccggtgtttccaccatcagatggtatctgcgccccagcacagcaccgggcgcatggctcacgcatgcctttggcaatatacacatagaccacgcagtagaaaaaaaaaaaagagaaaggcaaaccttgccgaacttaacatcattgtccaagaaaacacggcctatttcgtcatcatcatcgttccgagttattggatttcaaaggcggacttcactgactggcgggatcggaggggtcgtcgtcgctgcacacgccgtcctagtagcctccctggatgtagtcattgagccggttcagctcctccctgtgctcggccaccaccgcgcgcacgacgtcgccgatggagaccatccccagcatccccgtgccgtcgatcaccgggatgtgtctgacgcggttttctgtcatgagctgcattgcctgcaggaccttggtgtcgggattcactgtgatcagnttgttctcttcagtcatgatgtcgccaccttagttgacttgnaagatcttccctgcactatgattttcc

SEQ ID NO: 12530 - DNA, 393 bp, Zea mays
  Clone ID: LIB3279-207-Q1-N6-D1
gggatgacccggaagcgggctttatggggggggaatcggggaaaaattggtttaggggaggaaaccggtttgctagggaaacggccccaaaaatctttactttagggctaggggcctttggggaaaaaaaaagggctttttaaaatagcccccctccattggggtctccacctttttccctgttttaaaaaaaggggggtgggggatttggggggtaaataaaaaccattttttggaggggatccccaaaacccgaaaaaattgggggaggtattttaaacggggggggggttggaccaaggaaaacccgaacccccaccttttggttggaccctaaaaaccccctggtgaaaaaaacccccacgttaccaaaatgtttacaaaaacttgggg

SEQ ID NO: 12531 - DNA, 614 bp, Zea mays
  Clone ID: LIB3279-207-Q1-N6-D10
gccgctgcggcagggaacggcgtccaagcatcgggggctggaggggagcggccggaggacgcgtcgaagcagaacctggcgcaggtgacgagctcgatccagaagacgctgggcctgctccaccagctcaacctcaccgtctcctccttcaactctgcctcccagctccccctcctccagcgcctgaatgcgcttgtggcggagctcgacacgatgcagaaactcgccgaggggtgcaacatccaggtgcctatggaggtcgtcaatttgatcgacgatgggaagaaccccgacgagttcactagggacgtgctcaacagctgcatcgccaaaaaccagatcaccaagggcaagactgacgctttcaagggcctacggaagcatcttcttgaggagcttgaacaagctttccctgaggacgtagaagcatacagggagatacgtgctacttctgctgctgaggcaaagcggttggctcagtcccagggtactttgcctaatggagatgtcaaaatgaaagctgagcattgagcgaatggtacgactacagagggcaagtttgttatctctgcttagttttggggatggctttgttaaccagaaacatgcatatc

SEQ ID NO: 12532 - DNA, 569 bp, Zea mays
  Clone ID: LIB3279-207-Q1-N6-D11
aggcagtgacaaggttctgactacatttgttacgcatacaactgaagggaggtagatacaacctaacaagatgcagataagctgccagctttctccactagaaattattgatcaagcttcttgtttcacaaatgtccaatatttttgacgttacggtgtcgctattgacaagccacgagatgtggtgatgatgatgtcacttgtacactcatcttgctgcagttgcttcatgccttttgtccccatggagatggagctgatagacatgccatcctagtttactcgtgtgtacacagggaactattcaacggactgggtcagggttgaacttgagagactccctccagatgagctccttgatatcttcttcggtgagcgatggctgctccaagtcgaagctgaaaagcgctgggcagacgggttcgtcgtttatctcatgaagggatgccaggtatgggtggcatagagcctcatcaacatatatatcagactgaaaagggcagaatttcaaacgatgatggctactttgggaacctcaaatcccctttggggttagaggggattgaggt

SEQ ID NO: 12533 - DNA, 492 bp, Zea mays
  Clone ID: LIB3279-207-Q1-N6-D12
gggaaccaaacacttaaaaatttaaaccaaaaaagggaagttaaaaaattaaccgccaaagaggcaaccaaagattaaaaaaaagtttagcatagggggaaaacaactacaaataggagggggaaaaaaagggaaccaccgggaagtttaaacgggggcacgggggggaccacccaactgggggcggccgaaggggggggcgttggaaacctaaacctggggctaaaacccgggaaggggggccatgccgagggcaaggagcatttccaggggctccttggggacggggatttttttaacctcgaggggggacttttccggaaaaaaatccaaggggggctcgggctcctccttctgaaatttgagcaaaatacccgggactgggcccccctggatgcggggcataaggggggtactgaaaccaaccaccttgttggggaggggctttgaggggaaaaaaaaaaccccctcgagcacctttttggtgggggg

SEQ ID NO: 12534 - DNA, 540 bp, Zea mays
  Clone ID: LIB3279-207-Q1-N6-D2
gacattgcaacctcagagaaacaaggcatttcttcttccattctaaatagcaaaggacaacttgcagcaggacacatacacatacaagcacattcgtcccatctgcagcctacgcatcaccgcatactggtaacaaggtactgctaaacatcagatcactccggacagtcagtctatgccttcttaggggacttggcggccttcttgggcgactttgcctccttgctcccgccactggacgccttctccgccgtcttcttgggcagcagaacagggttgatattggggagcacaccgccgtgagcgatggtcacgccgcccaacagcttcccaagctcctcgtcgttccggatcgccagaagcacgtggcgcggaataatgcgagtcttcttgttgtccctggcagcattaccggcgagctccagaacctcagcggcgaggtattcgaggacagcggcgaggtaaacgggggcgccggtgccgacacgctgcgcgtagcggcccttcttcaagtagcgcccgatgcggccgacggggaac

SEQ ID NO: 12535 - DNA, 607 bp, Zea mays
  unsure (1)..(607): unsure at all n locations; Clone ID: LIB3279-207-Q1-N6-D3
aaaatggtgaagcgattttattgcacaacagagcatcagtctcctcatcttcaacagcccaggaaaacaacccatattcatatcgttcagttacatagcagccttgctagatagcggcatgaactctttgatagttgagaccgttgagacaactctctgatagctgagatcgttgagactccggagaactgataccaagacgtgttggctcagggaagtgccggcagaaccttcccggtgcaggttccaaaaccaatgttgtagccttcacccttgcaacatcctgtcaagatgacttcatctccatcttctaggaacttgcgggtcaaactccccaccggtatctccttctgcccgttccatgtcagctccagcaggcacccgagggagtccggttcaggtccactcagtgtgccagtcgcaaatatatcccccggcctcatgttgcatccgttgatggtggtggtgtgctagctgctgtgtcagcgtccaatacagatgcttgaaattagtttttgtgacaattgatgcgtcatttttgatctttcggcttaatccagacttcagaggaatgtcatantttatgtgattcttttcggctaagtac

SEQ ID NO: 12536 - DNA, 597 bp, Zea mays
  Clone ID: LIB3279-207-Q1-N6-D4
aaaaagcaatttcaaacgtattaccagtttaacacaattcttaccacaacccaaactacacatggatactgctaccactattagtagcagacaaattgagacacaactaccaacgccacccaatagctactacctcaaatctaagatgatgtgaacttagtgacggccttggtgccctcggagaccgcgtgcttggcgatctcgccgggaaggacaaggcggacagaggtttgaatctcccgagaggtgatggtgggcttcttgttgtagcgcgcaagcttggcagcctcgccggcgagcttctcgaagatgtcgttgatgaaggagttcatgatggacatggccttggaagagatgccgatgtcggggtggacctgcttcagcaccttgaagatgtagatcttgtaggtctccaccgacttcttcgccttcttcttacccttcttgtcgccgccttctttgccggacgacttggccgccgggaggcgcttctcggccttgggcttcttccccgccggggccttcgcggcagcgggctcctcctccgctggcttcttcgcagccggcttcttctccgccttgggcgccatcgatgcg

SEQ ID NO: 12537 - DNA, 371 bp, Zea mays
  Clone ID: LIB3279-207-Q1-N6-D5
ccccgggctccaaaaaaacgttttttttttgggggggcttttttgcttttcccaaacggggttcgtttcccttaaaattttttccaaaaaaaccccgcccccttgtttaaattaaaccttcttcccttttcattagcctttttttccatttggggttttaatacccagggttttttaaaaatttaccccagggggggagctttttttttccttccccaccagggttttttttttttcaattgtcccccccttttttttttttttcttcggggtcctcttttttttgggccgagtttttttctttttttttccacgcgggggttgtttttttttttaattaagggggccttttttgcctttttccatctttt

SEQ ID NO: 12538 - DNA, 602 bp, Zea mays
  Clone ID: LIB3279-207-Q1-N6-D6
cacaaaccataaaactacagttaacatttccatggtacagcttacagcttccatgaatgcatggtgcagcatttgtgcaagaaatgtcaagtctaaacctgattccaccatcagatatcttgcctaaggcttccaagaatacaaaagccgtataacaacaaaaaaaaaggctaataaagtcgcctagtgcatatgctaagctattgcaaaaacgtccagttcactgactcaactttcaatagcttaaaaacgaggttacagatgtgggaacgacatattttttgctcctgtgtaccccttgttgtatgtagttcgtagaagagtttatcactaccaactcttttcatccaatcaccactgcagtttgcatcaaaattgcctatcacacaagcacgctgtcctacgaagccatatgcgataatcatctcctgctattggctgtttgagccttgttcaggtttgcaagctcctcaattagcttcttctcgtcgctgctcagacgcttcggaatctcaacctggacacgcaccagctggtctccacgggcatttgacttcccgagaagcgggacacctttcttggacataccagagttgtgcctg

SEQ ID NO: 12539 - DNA, 342 bp, Zea mays
  unsure (1)..(342): unsure at all n locations; Clone ID: LIB3279-207-Q1-N6-D7
tnttntnntnnnnnnnntnnnnnnnnttnnttttttnnntttttttttgaattaaaggggtttttttttttccggtccccaaaaaggttttttccggtttttttgtttttttgggggaaaggaaatggggtttttttcccgtttttttgggggggtttttggattccttccgggtttaaattttttttaaattttttgggaaaatttttaaaggggggttttttttttaaaaggttttttggggggggggggtaaattttcttgggcgcgggggttgtccccgggttttttgggcggtgccttggggggttcccaatttttcttttttgggggggttttaaa

SEQ ID NO: 12540 - DNA, 568 bp, Zea mays
  Clone ID: LIB3279-207-Q1-N6-D8
ggcaatactaataacatcgtgacaggcttattgccaaaattgtcctcatcttatacatataaagaatttgtaatacataggtacaaagaactcttgggagaaccgcaaagaaagcaaagagctcttgaagagaacgaagcaaaagaaaataaaaataaatatagaagcaataaaaatatcagatctagtccattgtcagtgctcttccggtagtagttgtacacgtgtgtaatacgaacgaatgttcatccaatcgctctttaccacacatccctcagatatctgccctccatttggagattcttcacgaagctctcggccttagaactgtcgagggagccctgctcctgaacaatggtatggagaactctatgtacgtctctggccatgcctttggcgtcaccacagacatagatgtaagcaccttgggagatcatgtcccagatttcagatgctttctgtgccattttgtgctgcacatattccttagcaaggccctggcgcgagaaggcaagaaccagctcagacagtgctccttgctcaaggaaattgttcagctcgccctcat

SEQ ID NO: 12541 - DNA, 531 bp, Zea mays
  Clone ID: LIB3279-207-Q1-N6-D9
cagcgaagaggctgggaagacgctgaatgtaattatacagaccagaaatcttacagcactcccaagtgtttccaagcatcacaaagctacgagagatcatggacagacagacagacagacagacagacagacaagcacacgagacacagtagcaggagggaacgacagaagcagcaaggtacgtataagggcggcgggaggccgttgcgtggctgtggctcacgcgatgagctgtaggccctgcaggaggagcgcgtcggcgagcaccttgttggcggcgtccgtggggtggaagccgtcccagaagacgtagcccgtggcgttggtgcacgtccccggcgccccctggtggcacagcaccgacgtctcgatcgtgcccgtgccgcagcacgcccgccgggactcgaaaacccggcgttggtggggttttggacgaggtcgaggagcggctggtagatgtcgaagacgacgagcttgaggtcggggtgcctgcgcttcacggcgtccgcggccacgccgagcttccggttg

SEQ ID NO: 12542 - DNA, 510 bp, Zea mays
  Clone ID: LIB3279-207-Q1-N6-E1
gcaataagttccctcgttcattcaattgagtaagaaaacttccaacttggggaaaaaagacagtttttaaaacaacgcacccccccaccccaccccccaaaatagtgctcaaacttgcaaataagttctttgccttaacggcaggtcaccgtagggcgcaaataaaacctaacatccagtttggaaacaacattcacaagtccaaccatagtatcgaaggaacaatactgtcatgtgccaaacaacctttggaaacacccgcactgagttggaaactgaaaatagtttgttatggccttcaagttaggacataatgccttcggtcagtgataatgcggcaagctgactggtcgggaggtttgggttttgctggtgggccacattgcggagaacatccatcgcctcagcaaccttggacttgagagcatcaggggactcgagcaggtggaggacctcggtctgatccatctccaaaagcattccagtgacctttgcagcttggtttggttc

SEQ ID NO: 12543 - DNA, 377 bp, Zea mays
  unsure (1)..(377): unsure at all n locations; Clone ID: LIB3279-207-Q1-N6-E10
tnggaaaggacatgtgtttttacacagggggattttttattttcgcataaagaaccttttggtaaatgggccggggtatagagtttcacatttattaatttaattcaacatggtgggaaccaggaactttttggggttcctttttttttaaaaatttatgttggctttttaaatccagcattcatgaacaaaagaggttcattatggttttttgggcttgggcttaggggggggggttaggaaaattacccttaaaatccaccccacaagaatgggccccatgaagggacattttccgtacacattgaactgtttccacgttttatggggggtgttaaaatatgcccaaccaaatgcattggctgggtttatggaaa

SEQ ID NO: 12544 - DNA, 563 bp, Zea mays
  Clone ID: LIB3279-207-Q1-N6-E11
agcataagcatcaagtagagcacaaatcaaatccagtcacaactagcatggtgtgaagtttatcacatatgtggactaggaatccaagctcggccttgaattcggtacatctgtgacacttacacagtaaccaccacagcacaggacgcatggatctcacatcttacatacgtgtgtatatatatatatagttacagcagcttacaagcgactcattctcaacgggcgactcatcttccatgggcacttcatgagcaccagttccagcagccaaacgacggcggcacccggccggtcctcctgatgtgctctgcctgctcagcggtcctcgcggctgcgcggttccgtttcagctccgccgcggcacgcttctcgtctgcgctgtgcctcgccgacgcgagcttggtcatcagcttgtcttgcgcgcgggcacgcatccgctccacctcgaccttgaggaaaggaacgcaaagcacgggccatggttaaaactatcgataccaacaatgcagtatccacaaacacagctccgcgctccaccctttggttttgtatgttcttct

SEQ ID NO: 12545 - DNA, 589 bp, Zea mays
  unsure (1)..(589): unsure at all n locations; Clone ID: LIB3279-207-Q1-N6-E12
aaacaacagtatatatatatatatatatatatatagactagtacaaagaaagtgagaaataaaacgcatgaaaacacagagatcttgttccgcagcagcatcaacacttccatcccagtcacaaagtggcacgacgaaagtagtgcttgtttcatgtgtttctcgagtcgtctctgcgccttacaattggcaagctcgatctcggcacaccacacggttcagagcttaattaattggccttgcctctcttggtgagcgtcaccttgagcccgtgcttcatgtacatggtgagcgccatcttgggcgcgacggggtggccctcgacgacgcggacgcggtagcggcggaggatggaggcggcggtgaacttcatctggtagtaggcgaagtccttgccgaggcacaggcgcgggccgccgttgaaggccgtgaacttgtaggcggactcgcccacgaagcgtccgtcccggagccaccgctccggcttgtactcgcggcagtcgtcgccccagatgctctccatccgccccatggagtacatggcgtagatncaccttggtgcccttcttcagcaccgtcccgtccggga

SEQ ID NO: 12546 - DNA, 476 bp, Zea mays
  Clone ID: LIB3279-207-Q1-N6-E2
aagcctaaaggggaacctataattaaaaaatttttaaggctaaacgggggggggtggttttcttcagcaggggaagagtttctacggggggggttggccgaaacagcgtccgttcggaaccaataaagacggaaaacacgacccaacagcaatccactgccagagcaaaactaaaggaatgacttccatagcagaaacaatacataagttaaaagggacccagggccaactaaaccaaggggactaaatttgaccactaccagccaaaaacatgaaaagggggcaaacaaaagggcaaaaccttgaaatgcatggaacaaaaaaagccttttgtaaaaactgggcgtccaacacaatgggcttgaaaaacacgtcaaaccataaatttaagtttaccaggttactgaccctaaccagaattgcccttagaggattttaagcccttctaaatgccgccctccgtccaaagggtaaag

SEQ ID NO: 12547 - DNA, 149 bp, Zea mays
  unsure (1)..(149): unsure at all n locations; Clone ID: LIB3279-207-Q1-N6-E3
gcaggggtaccagtagcaacttacgggtcacattcagccgaaacgagctggtcttgcaatatacatggttatgcaaggtcccacgcaacaactacgggtggcctggcctatggtatacacgataacattaccactgngagtctcagggt

SEQ ID NO: 12548 - DNA, 492 bp, Zea mays
  Clone ID: LIB3279-207-Q1-N6-E5
ttttttttttttttttttttttttttttttttttttttttttttttttttttttttttttttttttttttttttttttttttttttttttttttttgttttatttttggctctttgtggggccgggggggacagggtcggccccgggggaaagaaaaaaaaagagtcaccggggcgcgaaaaaggggggaaggttagggcggggggggaaacacctattccgggggaaaaaaaaaacacggggccacgcggcccaaaaaaaatggggagggccgggttttttccgaacaaaaaaaaaaggggtacgagggaaaccaaaagcccccccttttggggggggggggggtcccccggaaaaatgggccccgggccaaaggggggtaaccttttatccctaaaaaagatacaaaaaggaggggggaaaaaaaaggccaggggggccccgggggggaaataaattaccctaaaaaattcccaaaaaaatggcggccgg

SEQ ID NO: 12549 - DNA, 459 bp, Zea mays
  Clone ID: LIB3279-207-Q1-N6-E6
aaccaaacagggctttattttggggttattgggaagggggggaaaaaggggggccaaaaaaagtgggggggggggcccttgtttgaaaaaaggaaattttttttcggggggaaaaaaaaatgaagagcttggggggggtcctaaagcactgtttaaagggggggttgttgacgtaggggtgggcccactcgggggggggggggaacccctcgccggcgaagaggaccacccgggggggcttcttgatgaccccgacccagggggccagggcaaagggggggatgtcaaaaaaaccgagggcctccccgccaaaaaacctttgccccctgaggtgggcctaaagaaaagccaggttttccttgggctccttggcaaaaacctccctgggctcctcgggggccggccaaaaaaaaatccaaaaagggcgggcaaacttttggtcgaagaagggggcccaaa

SEQ ID NO: 12550 - DNA, 592 bp, Zea mays
  Clone ID: LIB3279-207-Q1-N6-E7
ttttttttttttttttttttttttttttttttttttttttttttttttttttttttttttttttttttttatttttgatatttttaaaaagaaaaagaaagaaaaaaaagaaaaaggggaaggggggaaaggggggggggaaaaagggggggggggatggaagggggggggggggaaaggggggggccggcaaaaggaaaaaagggaggagggaggaaaggggaaaaaccggccgcggaaagggcgcatgaaaaaaggggcgaggggggaagagggggcaaggggaaaaaaggaggggaaaaagaagggggggggggggggaaaaagaaaagaggaagggaaaaaaaggggggggggaacaaaaggagggaaaaaaaaaaaaagaagggggaaaaaaaaaccaaaggggaacgggcaaaaaaagggaggaaaccgaaaaaaagcccaagaggaaggggataaaaaaactctaaacaaagggaaccaccgggaacgggggaagaaaaaagaagaacgcccccgagaaaaaggtagaaaaagggggaaactttcacaaaaaaaaaagttaaatgggggaacttcgagggggggg

SEQ ID NO: 12551 - DNA, 602 bp, Zea mays
  Clone ID: LIB3279-207-Q1-N6-E8
gacaagcatgataagttgacattataaatggtatagttgcaaacacgagcacttgcgagattagacacggatataagaagccaacgacggcatcacacgattacaggcgaacacaccaatcagcacaaacatcaccaaatcctttattctagtcactcagtgcagatgcagcctactgctagcagggcactgaacatcaccatcccgtcgtatggattctggtaagggaacagtatcccttcattcgatcttgtcgcagtcgatgtcgggggtgatgttgtaggacagcgagaggccgcagtcgccgggcagctcctgcgccgcggagagcacagcgtggacctgaacgtaggccgccttgaggcaccggcacgtggcctgcctgtcgggcctggtgtccgccgccgcgtacagggtcctcacgccgtcgcagcacttggttgttgctctcgctgggtttggctgccttgccctgcaggaagggcaggcacggcgacagggtcgttgagcacgtcggagcacgagatgtcggccaccgcggactggactgccagcatcgccaccaggaggacgactgcaatgcccgagctagtagtcttcat

SEQ ID NO: 12552 - DNA, 308 bp, Zea mays
  Clone ID: LIB3279-207-Q1-N6-E9
gtgagacaaacatgtccaagttcgttcataaacatggcgcttctacaattcatggttcatggatacatgcggctccgctcaaggttttctcagcaacaggtttaagcagaagcagtaggcgcatcggccatctcctgttcaaccggagttttctgaaccgggtagtagtggtagtgcagctccccgacatcatccccagaaagcttcgtccaaccatcagggccaacgtggtaaacactaacacaaccaccacttgctgcatcacggaatgttgccccataaatagcccgtcgcgctaattcggcggc

SEQ ID NO: 12553 - DNA, 587 bp, Zea mays
  Clone ID: LIB3279-207-Q1-N6-F10
aggactcaaatctaacatacccaagcagcaactggttactggtacagcagactaatttacattcagattggcaacttggacaccggctatattatacagagtttatgcaagtatacctctgcatttcaaaattcaaatacaccgacctgccaggcccccgtgcagaaaccaaccatttagaatttagaaatgtgaagggccaagctactcagtcccaacttggtcgatgatgttagaggtttttgcttgataagtgccatgcaatgcatgagcagctacatgatgctgcctgcgtcttcaagtcccgtcacttgggttccaaaagaagctgcttccttcggctgagtatccctgtggaaggtgaggtccatagacgacgttttcagaatgtggaagatgaggtccgtagacaacgttttcagaatgtggaagatgaggtccatagacgacgctttcagaatgtggaaggtgaggtccataaacaacgtttccattcagaaatgccatttggttcacctgctgcgttgtctgataagcatttggagcattaacttgattgggagtgttaacatgtggacgggtatttg

SEQ ID NO: 12554 - DNA, 587 bp, Zea mays
  Clone ID: LIB3279-207-Q1-N6-F11
gagttggattgcagaacttcatagttgaattggattgcatcgtacacctcatgaactagaagctaggtgtttatctcggttttcaacaaatactaggatttgtactgacatacaacaaatagcttgtcattcatcagccttgactgccttctttttcttcttcttcccctcggtggctgtcttaggttcagcttcctccgaaatttcacggctcttctttttcttcttcttgggagtctgggtctcttcagcgtcgccattagcatgtgctgcaccgttctcctcatgtgcctcctctagcttgtgcttctttttctttttcttcttggttccaagctcagcttctccatcagccacgttggagggcttatccacatccattgcatcaccatcagtctcggtttttgtcttctttttcttgcttttcttggcagatgtgtccgccttctcattatctgccgtaccatcatcatccattaaggtgtcattgaccatactgtcaatagcagctttcatcacatcaaggtttttacgaggcgcaacacccttgtcatagaattccagtctctcctcgacttgctcgcgca

SEQ ID NO: 12555 - DNA, 517 bp, Zea mays
  Clone ID: LIB3279-207-Q1-N6-F12
gtacaaacaatattaaattacaaatgtaccttcggcttgaaggagtgaaaatacaagtatggcgccaaaagcaaatgccgagtcagcgtgaacagtacgggagtactgttcatctatttataggcgcgggtcgcagcccatgcaagattacattaatgccctttacgtttataaataactctatagtaattcttcgaggtctaatctggtttttcatctttaagtcggtttccctttccgccgttatgtcgaagctcttctgtgcatagcttcgtaatgatcttttccttcgtcacaatcaccttccgtcccactcaagcttcgtcttggccttaatcttatatactcgtaatccaattccgaagatacctgctcacacatttcacttggaaaacattgttaaatcatgtttttgaggaccttcggaagccgaaggccgccaacaaatattaatgttgaagattgtgaggtagagtagaggatttgctgactagaataaaatataatataaaaattc

SEQ ID NO: 12556 - DNA, 551 bp, Zea mays
  Clone ID: LIB3279-207-Q1-N6-F2
aaagtgacaagaacatgctgcagccacaagatcatagatctactagtttcagctggatacagcaccagaaattaagaatctaggcaaacggaaaatgggttccgattcaaccatagacaaagtaccaagaacagataaatttattacaaagaagacactagacaatctgatggttcaccctgaatcgcacgagtccatacaggcagcagtttgtgtcccgctccaggatatggaccatttaagcatcagcataccccagttcggagagcttgaggtgggcctctttgtagtcatcaaagaatgccttctcatctgcagcatatttctccacaagagggcggaagacagggtcgctcagcagggctttgtcacttgggagctgaagaaggccctccttgtcgccactcagaagttccttgaagtaagagttgtcaaagaccaaagggttcgtagtccaggccccctcaaaaccagaccgctctttgtggcaccttcccaaggtgtggccaccagagagggcaacaatgtcctgatcactcaaacccatctgc

SEQ ID NO: 12557 - DNA, 597 bp, Zea mays
  Clone ID: LIB3279-207-Q1-N6-F4
tcgcgatctagaacggaaaagggaaaagggcaaggcaagagagaggcgtcgtcgtttgatctgctgccggagtgcgaagaggaagaggaagaggagcgccggagttgtaaagatgttcctggtggactggttctatggggtgctggcatcgcttgggctgtggcagaaggaggctaagatcctcttccttggcctcgacaacgccggcaagaccaccctcctccacatgctgaaggacgagcggctcgtacagcaccagccgacgcaataccccacgtcagaagagttgagcatcggcaggatcaagttcaaggcgttcgaccttgggggccaccagatcgcccgccgcgtctggaaggactactacgccaaggttgatgctgttgtgtacttggtggatgctgttgacaaggaacgttttgccgagtcgaagaaggagctcgatgcgcttcttgcagatgactcccttgcaaacgttcctttcctcatactgggcaacaagattgacatcccatacgcggcttcagaggaggagctgaggtactacctcggcctgagcaacttcacaaccgggaaggggcacgtgaacttggccga

SEQ ID NO: 12558 - DNA, 329 bp, Zea mays
  Clone ID: LIB3279-207-Q1-N6-F5
caacaatggcgccaacagatcactccatttctctcagacaggcaccgatagctcattgacaaccatcaacgcccaggatgaaaccaaaaaaacaaattagaacaaagccgaccttgggcatggggagaacatagcccaaacatttacaggtggggcaattaaccggaaacccctaaaccccccccccccggattccgggggccaacttaatgtccttgggccttaaggggacccccctggcctggattgcccaaaagttggtgtccttaaaaaagcccaccaggtaagccttcccggccttcttcaacgcgggaaccggggaagacttg

SEQ ID NO: 12559 - DNA, 359 bp, Zea mays
  Clone ID: LIB3279-207-Q1-N6-F6
aaaaaaaagggaaccctggggtttttttcccccaaaagggggggggttttttttttaaaaaagggccaaacttttttggggcccaaaaaaaacccatttttttcttgggggttaaaaaaaaaaaaaacccgggggggggaaaaaaccccctttttccccaaaacaattgggggtaaaaaaggggtttttggggccccgggttaaaaaaaattttaaaaagggaaaaaaggggccttttaaaaaaaaaaaaaggggggggaaaaaaaacccggggggaaagaaattaaacccttggggggggggaaaaaaacacgggggaaaaaaaaaaaatttggggggggggccccccccgttaaatt

SEQ ID NO: 12560 - DNA, 445 bp, Zea mays
  Clone ID: LIB3279-207-Q1-N6-F7
ccaaactcacatgatccattccttggaaacagaacacagagactgacacatacaaatccaagtttcagaaactcttattgacccagacacgtctaccatcattttttcatatacttctttttttgatttttcagtattcagagaagggaaccatttcagcaaccccgtcccaggcgaaccactggagtcgagaaaccagagaaggtgggagtgtatgcactgctaagttaggacgaggaagatgacgtgacgaacatcctgatcttcctctcaagctcgtccttcttagccccaatcacacggcctacctccttcccatccttgaccagcacgaacgttggcatcgcctctaccttccatgtccttgcgacctccgcgagctcgtcgacgtcgaccttgatgaagatggcatcggtgaagcgggaggccagctccttgaaggccg

SEQ ID NO: 12561 - DNA, 260 bp, Zea mays
  Clone ID: LIB3279-207-Q1-N6-F8
gcagaacatagtgtccattgggttgggtaaaaagacacgaagacattcctgcacgtgtccccatgctcacaacaatgaacaaaaaaaattgggacgtaacagatccaacccagcacaagttagatttcaacgcaaaacatctagtatttgggcacctttatttatttcctcgtccattcaactggacgagtgagggcaacaggctcttacagggggatggagaacgacttcttcagcttctctacctccagataagcgtt

SEQ ID NO: 12562 - DNA, 584 bp, Zea mays
  Clone ID: LIB3279-207-Q1-N6-G1
attgggaactcaagtggctctttcaggacccaaaaatatcagaacagtgttgtggtaatgaggtcgtttgttttcgcgtctgattacggcgtcattcatttattttcgcgggggttactcaagcgaaaaagcggcgtcatctggaaccccaggagattcaaatccagcagctacgcctgcctgcagcaatgagtccgcttggttggcgccatcggcggactccgtaacctggttggtgccgtcgtcgtgctgaacttctgacctcaacacgtcggattcccttggcagcgatttcaaatcacaggccaaactcccttgaccttgcttttcccatggctttggtttcggtgccatacgaggttctgagattggttgatcaggatttggagggtcatcgttaatatcctttatatcgtctgggcgctcacccctttgtatcatttccatgatctccatatatgattttggatgacgaggtaccacaggggccacaggtccagcttcaggttccaccctcttttaaccatccatacactttctatcgacttcaatttcctgctcagtaatcctgcatgaatgatcaa

SEQ ID NO: 12563 - DNA, 479 bp, Zea mays
  unsure (1)..(479): unsure at all n locations; Clone ID: LIB3279-207-Q1-N6-G10
acaaactgccctcgcgttggtccccacaaatgtttcccacaacaaaggctaggctgctgctaataagcagacccaaaatccgtgagttggcaagtttttatcatttcatttttagcaggtaacacacagtgttaagcccacattatacgagcaagacccagcagtgttcatgggggtgccccattggtgtaggttttgtggaaggtggagtactccaaacatgggggtggccccttttgttttggtactacaaaacaagtagcacgccgcggctcagctagttccagattttatgatctcccaccgagcttgtgttgtccatctggtttggagaagctgatcacgacgcgctcagggaacccgttattatgtcttcagtggggctttcttcaccctatcagatatccggtcaggtgcgtttcgtgtgcgacttgaaccggcctngcccaccctnctccttttccttcttctttactatc

SEQ ID NO: 12564 - DNA, 212 bp, Zea mays
  Clone ID: LIB3279-207-Q1-N6-G11
gggggagcaacgttaaacgtgggcttcaaaacatgattcagcgtaatctcagataatttaaaacattgcttctggccacactaaaacacttgagcccgtccaggtttttagacatgggatcacatccatccaccaaaaccgacgaataatgggcaaaagagatgattaatccccgcagacccttatctgattctaagcttctaatggtgctt

SEQ ID NO: 12565 - DNA, 384 bp, Zea mays
  Clone ID: LIB3279-207-Q1-N6-G12
gaaacaggggtgctggtagccgagttatgttgctgtgcaaaagcacgagtccgaagtacaacagggttcactcatagcatttacatcagttttcatgctgcgactatatcagctgaaaaataaggattcactgcgacttggcaactggctccagtgcctcgatcatgacaacactgtttcccctgataaccaccattccaatatctgtcttgtcatttccattgacctccacagtgttgtcgatcaccagattcatgaactggtcgaatccccgaagtgtgccaataacaacacggtttgcattcagcttaatctgaagcttcttgtccatgtacttcttgagatccggaggctgccccgagcggctcatggcccacgcgtccg

SEQ ID NO: 12566 - DNA, 493 bp, Zea mays
  Clone ID: LIB3279-207-Q1-N6-G2
tttttttttttttttttttttttttttttttttttttttttttttttttttttttttttttttttttttttttttttttttttgggatttattatcatttaattaaaagggtttgtttaaaattttttatggggagtttgtttcttttttaggggggggggggaaaaaaaaccaaaaaaaaaaaaggggggcaaaaaaaaaaagagggggggggggaaccccaaaaaaaactttaaaaaaaaaaggaaaaaaaaaaaaaatttaccccccaaagaaaacgggggggcggggaaaaaaaaaccaaaaatttaaaaaagggacccgcccgaaaaaaaaaattaaaaaaagggggccttaaaagaaggcgggggggacaccgggaaaaactgggcccggccccaaaaagggacccccccttcattctaaaggaagtaaaaaaaagggggggaaaaaaaaaaaaaaggggggccccagggaaaaaattattccccct

SEQ ID NO: 12567 - DNA, 513 bp, Zea mays
  Clone ID: LIB3279-207-Q1-N6-G3
aaccacaaccaaatttgagtcattgagacaagcataggataatatcacttgagaaattcacaacgggaaccaactacaaattttagcccccaacttttagccagtctcgggatccaactagaggagctcaacattcccgacaacagcaactaggagaaccctgatgtagcaagctaaatcatgcttcagtctgctctttcaagcgacgaatcgggctcctgacagtgactgcactagcagtgttcatggggtaagcaccgccagccttgaccttcccacagtccttgcatccccaaattccaactggtttccttttcacagaaaacttcccacaaaactcgcaaaagtacttggagtgctgagatacctccatcttcttgatttgcttacgcaagctagcgccatacctggttccatatttgccaacaattccagccttcttggtgcgcttcgtcatttcggcgacgggaaagcaagcgaggtacggggcggtagcaacggcaggtgtggcgg

SEQ ID NO: 12568 - DNA, 364 bp, Zea mays
  Clone ID: LIB3279-207-Q1-N6-G4
aattagcattattaccacaagggggcaaatgcaagattttaaaagcgcgacttcttttttcacataaaattcgaatccgaatcctgaacaaccaaggaagtagaagaaaaaaaattacaaacaaacagtttctacgctcagcacggctattggcagagcagcaccaagattagtaataagtattgtccgccgctaaacaccgttacaaaatttggctcggctcccggcactccacgtcaccaccaccatcgtccatctacaaccatctacagctcgtcgtggtcgtcgtcaacaccgccgtcagcgtcaccgccaggggcgccgcccgaccgctggtacacggccgacacgatggggttgcaca

SEQ ID NO: 12569 - DNA, 158 bp, Zea mays
  Clone ID: LIB3279-207-Q1-N6-G5
gagcaaaatgcaaagaaactttgcatagatgtttgtctttcaattccaaccatcctatgtacaaagttgcaaaaacaaaatttaggatatgtacagttcttctaaggaatagccccatcaccgaaactcttaattcctacttttaattcctacgggcc

SEQ ID NO: 12570 - DNA, 456 bp, Zea mays
  Clone ID: LIB3279-207-Q1-N6-G6
aataatcacgccaagcttttggcgttccaatttatcaattttggcaacaaaagtatccaaatccatagcagtttgtgacccgctattacatttttttcggctgaatttggccaatgtttacatttacatacaaccgggatcgcaccaattaacgcactatcacaaagctggccatcgatacaatgcccctggcaagtcctaaacaatgaagttcagcatgacgcaaaacagtatataacccaaatgacctacctacaaattaaatcgctgcacctccaaaacccctgaaaaaggccattttccttgctttaacacaatgactctgcctttccctacttttggagctggcattcaccacaccagttaagaaaatccttctggcatttcttcatttctctccggcaccacaaaagcagatttattatgagaccagatgaagtagctcgagcaccatgc

SEQ ID NO: 12571 - DNA, 584 bp, Zea mays
  Clone ID: LIB3279-207-Q1-N6-G7
agcaactcagcttagatatgattaactcaaatacttccaacaaaacagcataattgtgcaatgcttagctttgaattcttgagctggaatggaacaacacaaatgtcttgggatactaaagaagtagaaaaatctgaatgaacattgccaacggactcttgggatactaaagagccgagtaacagctcatttcagaggaataaaccgcgaggagtgggtggcaccgataccgggcctgccgtgcttgaccggcttgtaggagatggagaactcagcaaggtagtggccgatcatctcaggcttgatctcaacctggttgaaggtcttgccgttgtagaccccaacaatgcttccaatcatctcagggacaatgatcatgttacggagatgtgtcttgactggctcgggcttctcaccagcaggagcatcctttttcgccttgcgcagtttcttgatgagcgccatgggcttcctcttcagacccctctggaaccttctcctggcgcgcgcggggaagagctggacgagggtcgtccgtggacatgtcgagaagcgcatctaggtcgacgccgcggtagctgtac

SEQ ID NO: 12572 - DNA, 278 bp, Zea mays
  Clone ID: LIB3279-207-Q1-N6-G8
ataacacatacagcaggatttacatagcatttaacaagataattatttgctttaatttccctggccgatttgttacttatttaagattaaacttgggacgttccccggattaaaaattattaacttccattggttttttattccttaaaatttttggtgggttcaaaattgggcttggttaaaaattttgggtggcctttcacacccattaaattttattgggggctggggacatttgaatacttctttatacctttcttctcttgtgaactttcttt

SEQ ID NO: 12573 - DNA, 249 bp, Zea mays
  Clone ID: LIB3279-207-Q1-N6-G9
gcgggaacacttcttcttcttttttttgctcaacagatctatacatctgctctcccagcagaggaggcgaacacttgcaccaccgacactgaacaaacgaattccacccggagagggagaagggggccaaaaaaatgaaattgggccttttaaaaatacaggttccaaccggccaccattcctggttaaggttgtcttggatgcttaacccatccaaggttttggggggttattagaattaaatcaaac

SEQ ID NO: 12574 - DNA, 583 bp, Zea mays
  Clone ID: LIB3279-207-Q1-N6-H1
tcgcgatctagaacctgtatgatatgattggcttctgtgaagatgatagtagatcaataacttctcgaaacccacggaatttaaagttttgttcatcttctaatttctggatatccatcaggagaagattcttatcctctttcgaattagtaaagatcacacgcacagccctaccaactccagctttgtgtggaacgagagatacaaggtcatcagagatatggtttactgcctccaagaccaattgaacttgccgatcactgcagacatcaatactcatactgggcctggaaccatacgtttcagcacccaatattaatctgctaagggaactaaccaaagagccatcatgttttttgcttgggtcagcatatctttttcgccagttcactatcctagactttattctattcatgaaaactgagtcagcaactgatgtgtttggtgatgacaacaattggtgaggacgagtaaagatcttttcccttgctaaggattcttgaacccttgatagataagaaataccatcatatatgcacatattgaaatcaaaaccatcattagctatagttgataaataaca

SEQ ID NO: 12575 - DNA, 543 bp, Zea mays
  Clone ID: LIB3279-207-Q1-N6-H10
gccatgcatcacctggtgaatgtaggtgatccggttattattatcataaatagatgatcctagtccaatgccctgaatctcaatgtaggctgagacaaaagagcagacatgctaatacattgctgcgtagttcaacttgactaacaaaatggtatgcgtaaactctatctgtagatgccctcttagcttgtcctcttcaaagcaaacaagcttcgcaaaggtcagaatggcttgataatccaagtcatatatggtatgctttcgaggttgcctcagttcttctgagcttcgtcaacctgctttttatctgcaatatcactaggcacatctagtccggttggattcttgccagcatagttgaatcttgaggaatatgacccaagcatgcttctgtcaaccaacaccatcgaccgtagctcgcagtttgcaaagtgcttgctaacttcgtctcttatggttggatggcactccttgctgtacatgcttaaggtgtgaaacaagaaaccactgtgactgacaatagctatctctttctcttctctt

SEQ ID NO: 12576 - DNA, 585 bp, Zea mays
  Clone ID: LIB3279-207-Q1-N6-H11
gatcaggaggtagcttttctccctttctttattgaaatataaaataaaatgcttgaatttagcttacaaattattgttggagctgtcataaatatatcgttatctcatgaggctgagcatgaagaaacaaagagacagactgtgcgcaccagataaagacagctctccgaatttcggccgcacaagctcgttctttcagacattattgtacaaaacaaactagtccggagcgacgcttctctgtacttttgtaaccagtagccccagcgctgcatgattgcggggcggtggggccggggcgtctgcgtgcaggtcattgccgctccggcgctccgctgcttaactacagctggcgttcgcactgttgaagctctgcaacgcaggcacctgcgagcaggcctccgtttgcttgtgggcctggacggtccacgtacatgagctggatgaagtcgtcaagcacgaagtccggcatccaaggcggggggcgatgcatggagcgtcttacgaggaagcgcagcccctcggcggtgtccggcagcagcgcatcctcgacggtgcggtcctcgcgcgccgccatggcccgca

SEQ ID NO: 12577 - DNA, 600 bp, Zea mays
  unsure (1)..(600): unsure at all n locations; Clone ID: LIB3279-207-Q1-N6-H12
caagaagagcacaggaatgctcatttccgaacaattcaatgtctcgttacaagcaagcatgctcacacataggcactcaactttcgtcatagaagacacatcactgaacaagcaaacaacccagaacagacttggcttattccattcaccgattgacagggcaaccgtttcaagcagatggcttcatcagggcagcgaccttctggacagacgggctctccatcagaccagaccaccaggccttcacatgcgggtaggcgtcgagcacagatgcgtagggcgtagcgaacaggcagagagtgacagacacatggttcaagtcggcgaggctgaggaagtctccaccaaggtacttgcacttggtcaggcgtgcctcgtacacctctagcaccttcttcagcttctcaaggttctcatccacaactttctggtcggtggttcccccaagcataggactgatgaggacctggaagaggatgggattcantgcagcggtgtactggttagcctccacctcgatccaaacatccaccattgctgcctcctcgaggtttccttccctcaacagctctggcttgtttttgcgagcagcgtacttgc

SEQ ID NO: 12578 - DNA, 594 bp, Zea mays
  unsure (1)..(594): unsure at all n locations; Clone ID: LIB3279-207-Q1-N6-H3
gttaagcatacaaaatgaagctaaacattcagaaaggtataataaaacagctaactgttcccctgctccagtataactgtggcgaagctagagcaaattagtgagtacacttgccttgtggatacatatatggtgaaatttcagtggaaagcactgttttcacattttcagggggtgcaacactccagctactacctagcttcgcccctaagtacaagacagaacaattcggttcgcagtttcagaacaaaccaaaccattttgattcttcctgcttttcctctgatgtttcatagtatgttgagtcctcttggtttgtgtaactttctgcgtattctggaccatcttcagcatatgaagatgattcatactcaggttggatagactggaacataaatttcaggccgcttatgatatcataaatcatcaatccaattcttcctccaccccagcttcctagatggcttcctgcaagatatcccagcttcccaaagcgctcctcaccatggaaaccacccatataagttccaaacaaggtgccagtgccccggagaaaaccttccgtcatgcttncaccaaagtacattgcttcga

SEQ ID NO: 12579 - DNA, 446 bp, Zea mays
  Clone ID: LIB3279-207-Q1-N6-H5
caaaaaggattaaacccatcctgctgcaaaaaagtttggggtccaacacaaaggacccaacggggccattaaaccaacgaagccccaaccccgattcatgacacaaaacccacagttgttttttaaacgacgacaacccaaatccccaggtccagcagcagtttaaaaaaaccatggtttactgaccaccacgggggcggagcaccagggggaaagggccctccttctggatgttgaagcctgctagggggcaaccatcctccaattgtttgccaaaaaaaataaaaccctgttggtttggggggatcccctttttgcccgggatctttgccttcacgttgtcaatggggtcggacctctcaacccccagggttttggtcttcccagcaaaggttttaaaaaaaatctgcataccacctcggaaggggagcaccagggggaggggg

SEQ ID NO: 12580 - DNA, 583 bp, Zea mays
  Clone ID: LIB3279-207-Q1-N6-H6
ggtaccggaatgagccatgattcattccagcttatcaaaatctatataaattagagaagtaatccggctaggaattaatccagggccccaatccggaacaacctaacagagccttcctcacacacctgacatctcaactagatagtatcatgtatcatccgcatagagcccagggagccgtctgcacgcgaaatcaatctcttcctccgtcatttctatcgtggcatcgctatcgtagtggtcatcctctgatttggtattggtcttcctgcggtgctcggtcacatgtgggtcattttgatgcctacccttgttcttgtcgcccatgtccgtgcgagcaaactcggcctggtagatcttcttgcacttgcctgctagttgacgtagctgctctttgggcagagccgcaccttttccgcctccatctagttttaacagctcgttgacaacatgggggacgaagctccactgctctgcaactcccttgatatcattgccttgctcgagggattctatggcatcttgaagacaagtgattaccccttcagaggctatagccttcagttcacttggctctggcttc

SEQ ID NO: 12581 - DNA, 600 bp, Zea mays
  Clone ID: LIB3279-207-Q1-N6-H7
aactacaaactggaactggattcctgtaagtgggacactctgcttcagtacgtcttacaaagaattcatcgtccctattattttaaccaatagatagataagtaacgtaatcctagttatatataatggctacagcaggttccgatggttcgtactcagtccgtacgctctacacttcatgtgattgacctccattctattcatggttgcacgaataaagaacttgaccaacgcttcaacaacagcgaaagaacaaaacttcgctagccatgtgttccacaagttgattggttagctgctaaggtgtcatttgtatccggttcccaaatggtggcattgctagtccagcaatgagaataacggaatccccttcgcattgaaactagaacatttcactactagttcctgtccaacttcaaattcctttaggccatttgcctcaaatttatgcattccacgcacaccatcactcaactcaagtactagtccataggctcgaatctggtagacctttgctgtaactacatcacccaacttcattgccccagattggaatttcgtgggactctgattctggtcagaagtgttgtcagcactctg

SEQ ID NO: 12582 - DNA, 459 bp, Zea mays
  Clone ID: LIB3279-207-Q1-N6-H8
cgatccaaaaaaaaggttaatttaacccgtttgatacaaagaaacacgcccacgacgatgcccaaaacaccaaacgccttttcttttgacatttgttttcgggaagggttcacatgccccacaaaattaaaacgttttagcaaccgggttggacccttacaagccttgcaccaaaaccacattggggggatgatctgaaaagcattagtgcgtttcattgacagcatcacctgttttaggctgtcaccggttcctgcacaaaaccagcgattattcctttgctcaactgtttccctagcctttcctgtatccgatccttgatcgcagtttccatattgtggcagtgttgctcaaactttttttggaaaccagcaacccagcgatccgcattagcaagccattctttatgattaaaaccagcagtctttgccactgtttgcaacttttcctgatgtgcct

SEQ ID NO: 12583 - DNA, 504 bp, Zea mays; identical to SEQ ID NO: 8445
  Clone ID: LIB3279-207-Q1-N6-H9

SEQ ID NO: 12584 - DNA, 642 bp, Zea mays
  unsure (1)..(642): unsure at all n locations; Clone ID: LIB3279-208-Q1-K6-A1
attgcttctcatgggttgtaatttttgtgattttgctcgttatgaagaccgtatcagtgggcaggagaaggttcagtgcagagttccagctagtgttccggttgatcaagggtctgatatttataacatttacagccatcgtggtaatcctaatagcgatccctggcatgacggtgctggacatatttgtttgcatccttgctttcatgcccactggatggggtttgctgctgattgcccaagcgatccggcctgtgatccacaagactgggctctggggctcgatcaaggctcttgcccggggctacgagatcctgatgggacttctcctgttcacgcccatcgccttcctcgcctggttcccgttcgtgtcggaattccagaccaggatgctgttcaaccaggcgttcagcagaggtctgcagatctcccgtatcctgggaggacacaagaaagaccgagggacccggaacaaagaatagggctgggctgctgctgattcaaggtttgtgtgcgccactagtatttatgtgtgaatgggtgggtagcatatggctcgagagtatctcctgaatggagattgattgatcctgaagagtagaagagactcgagtgatgtaagatgctgcangcttgttgctt

SEQ ID NO: 12585 - DNA, 658 bp, Zea mays
  Clone ID: LIB3279-208-Q1-K6-A10
ccggttctggcaagcatgtgccgagggccatcttcgtcgaccttgagcccactgtcattgatgaggttcgcactggctcgtaccgccaactcttccacccagagcagctcatctcgggcaaggaagacgcagctaacaactttgcccgtggccactacactgttgggaaggagattgtcgatctatgcctggaccgtgtgcgcaagcttgcagacaactgcactgggctgcagggattcttggtgttcaatgctgttggtggtgggactggctctggacttgggtcacttttattggagcgcctttcagttgattatggcaagaaatccaagcttggtttcaccatttatccttccccacaggtgtcaacagctgttgtagagccatacaacagtgtcctctccacccactccttgcttgagcacactgatgttgcagtcctcctggacaacgaggctatctatgacatatgcaggaggtcccttgacatcgaaaggccaacctacaccaacttgaacaggctgatctcacagatcatatcatctctaaccacctccctgaggtttgatggtgctatcaatgtggatgtcaccgagttccagaccaaccttgttccatacccacgtatacatttcatgctttcctcatatgcccctgt

SEQ ID NO: 12586 - DNA, 427 bp, Zea mays
  Clone ID: LIB3279-208-Q1-K6-A2
ccccgcgtccgcggacgcgtgggcggacgcgtgggctgcgccgagaagactgggaagaagtcgcgcgtcaagtgcttcatcaagctcgtgaacttcactcacctcatgcccacccgctacaccctcgacgtcgatttcaaggatgtcgccaccggtgggcccgacgcactctctacccacgacaagaaggtcgccgcctgcaagacggccaaagcgcgccttgaggagaggttcaagaccggcaagaacaggtggttctttaccaagctccgcttctagatgctcggcctcccgaatagtcctgctttagctgtcgatttgttgtatcggacacactccatctctgttttcgtattaccatgaatatttcgtgtttagtcctggggctctcagagataaatttgctaagatatgccgttgttgtgtt

SEQ ID NO: 12587 - DNA, 528 bp, Zea mays
  Clone ID: LIB3279-208-Q1-K6-A3
cccagcgtccgcggacctcttcgcgctcgactacacccgcctcgacgtcgccatcggctaccgcggcgcgccgcttggcctggtaacgtccggcggcggacgggtccaggcgcgcgctgtctcgtacgtcgacgccaacctgcagctcgacggcatccgcgtcgtcgaggacgcgatctacctgctcaaggacctcgcgcggggatccgtgccctttgacgccctcgccgaggtcgagggtcaccttcacttcttcttcctcagtatcccggtcaaggggagaatatcttgcgtggtgcatgttaatccacacaaccaaactatagtacatcaggactgctaccccgagtgaaatgcttacggcgtggaaggctgtgtgctatcttgccttgcgaatgggttgtttggttcgtttctaagcttcgcttggagccgttgtaaaagtaagaaacaactaaactctactgggtaatgtgcctattgtaaagccgttaacacgtcatgttaatatcaatcagtttccctact

SEQ ID NO: 12588 - DNA, 544 bp, Zea mays
  unsure (1)..(544): unsure at all n locations; Clone ID: LIB3279-208-Q1-K6-A4
caattcccctcgagcgccgcagcgagcccaanaagccgaccgccgagccccctctccagtccagtccgcggtctcggtttcttgcttgcccggcgcccaatcttcagagagagctccttctcgtcgtctgtctccatggccgcctcgaccaagaccgtcgccgtcctcctcgccgcggtgctcctcgcgctggtcgcgtccgcggcagccagcaggaagctggaggaggacgcacttctgggaagcctggccccagcccccgcgccggccgttggcggtgccgcggggctgcctggcggcaagccgggggcgtgggccgtcgccgctctggtctctctcgtcgccttcctcgtgatctgagggcgtggggatcgtgctgcgcatcgcgggagatggagggacgaatcctgcgatctggatcgcagagagagaggagagggggatattntatggttcgttctggtttgttctaggggtgcctctctttntgcctgtataagagaggatcatgattttttttatataataataccgtttatttgtc

SEQ ID NO: 12589 - DNA, 449 bp, Zea mays
  Clone ID: LIB3279-208-Q1-K6-A6
gtcgacgcccgcatccagcgcctcaagcgtgccatggacctctccatgaagcaccagtacctcccggaggacctccaggcacagcaggttccattcagaggatatttgagtgacatgttggcgttggtgaaaaaggaaagcgccgagcgtcagtcactgggagcccttccactataccagaggacacttccctagggtgttggatagacatggtcgcaagtattctacctctttaccgcaaatcagaacgcatcaaataaaatgcagtggatgaaactgtttttttttgttccaaccaaagtctaattttacttgttcatgccatggtgcattaaccatgggctgtagctgttgttttcagcaaatttgtcttcaaccattattaacctgtgaaatcttcgatcgtgagtgccgttatgacaccgggtgaccggaaatgtcttgactaa

SEQ ID NO: 12590 - DNA, 572 bp, Zea mays
  Clone ID: LIB3279-208-Q1-K6-A7
cggccgcgtgggcggacgcgtgggcggacgcgtgggcggacgcgtgggcgccgcagccgccactaacgcccccgcggcggcgcccgcggcagcgccggcgtcgggcacagaacacgcccactacccgtattacgctggctattcttatccctacggcgcctatcaccaacctgccccgcccacgtactcctccgccgtggccgccgcctcgtcatcctactactaccccgtccctgccgccgcgtcgtccaccgccgcgcagtacgacccctattcgggttaccagcactacagtcacccggagggaggaggctcggcgggggctggcctggtgggctgctacagcaccgtcggcgaggcgttgcagcaggccgcggtagcatcgacgacgcaggctgctctggaggcgaccacaaaggaggcggggaagcaattcggtttcgatccccagagctacgctcaggcagcagttgccagagcctccaatggaattacacaaccagctgcagccccaggcttgcaccatgcccagtggaatgctcattttgggtatcctgtgccgaaatatgtct

SEQ ID NO: 12591 - DNA, 659 bp, Zea mays
  unsure (1)..(659): unsure at all n locations; Clone ID: LIB3279-208-Q1-K6-A8
ctctcctccggctagggtgttcacgcctgccgcggcgaagcttctgccctccccggcgtcgggctctggtcgtcgtcggccgggaagatggctggcggcttcagggtacttcatctggtcaggccctttctggctttcttgccagaggtgcagagcgcggataggaagataccattcagagaaaaagttatctacactgttatttctctcttcatttttctggtgtgcagccagctcccactctatggcattcattcgacgactggagctgatcctttctactggatgcgtgttatcctcgcatcaaaccgtggcactgtgatggagttgggtattactccaattgtgacctctggtatggtaatgcaacttcttgtcggatcgaagatcattgaagttgacaacagtgtgagagaggatcgtgctctgctgaatggtgcacaaaagttgcttggtatcttgatcgctattggggaagctgtggcatatgtcctgtctggaatgtatggcagtgtaagccaacttggaacagggaatgctattctcattatacttcagcttttctttgctggcatcattgtcatctgtttggatgaacttctccagaaaggttatggtntggngatctggtatttctctggtcattgctaccaatatct

SEQ ID NO: 12592 - DNA, 615 bp, Zea mays
  Clone ID: LIB3279-208-Q1-K6-A9
ccccatcaccgatgccaatggattcggataaaccactatccaacttatcttcagttactagtgctgggcaggctggacatcagcaaacatctcttgcacctcaaacacaatctatagccgttaacacaccaggtatatcagcgtcacccttgcttgcagaattcacaagtgctgatggaagtccggccaatgtaccaactcaagttccagccaaatcaagcgcagcagaaaggcctctggaccgtttgcttaaagcattgcgaacaacacagcgtgagtccctaagtgctgcagtcagcgatattggatctgtcgtgagtatgattgacaggattgctggatcagcgcctggtaatggttctagagctgctgtaggagaagatcttgtcgctatgacaaagtgccgcttgcaagccaggaacttcataactcatgacgggagtggtgcatcaaagaaaatgaagcgggacacgagtgctatgcctcttaatgtgtcatcagctggaagcgtgaatgatagcttgaagcaatatatggtgttggtactccagagctacaatcaactgcaacctcacgtgtcaagtggcaaagggctgaggtaaaccatgctctgat

SEQ ID NO: 12593 - DNA, 618 bp, Zea mays
  unsure (1)..(618): unsure at all n locations; Clone ID: LIB3279-208-Q1-K6-B1
ggtgggttggcttctcctccccctccggtntcgggtntcggnngttcgtgaggttctnccgggnngttcggtttcgtgggtngagccggatcgngnatgnngcggcgtcggnattgttgagtacccgctgcttttcgtcggcgggccttcgccttgggccacggnacccgaccactccnnctccacaacgcctnntcagcacctacnnggcgaggtcctttcgagtccaagaatcatttcctcgnnatcgggagaaacgcanaggnntcccgcggcttttcggctttcgtcaccctttctccacggnagnngaggcganntgcggaaccgccanntcgagggcattgaaccggcaaggnagctttggacggccgcaacatttcaccgtcaacgaggcccnnagtcccgcggcggcccgtggaggcggcggcggcggcgggtaccggtggtggcccgtggaggcggcnggctaccggcggtggcgggcgccgtgatggcgnngcggcggctacctggcggtggcggcggctacgngtggtggncggcggcggctacgnngtggtggtnnggcggcggctaccccgcggtggcaaccgtgngcggcggctaccggcaact

SEQ ID NO: 12594 - DNA, 634 bp, Zea mays
  Clone ID: LIB3279-208-Q1-K6-B10
attttattatcttttttttataaacatggcattcctggtatgaatatgcagtcacttcattcgttgttattttggctcagctaaccatcaggaggtctggaggatcacaagtgccttggagaaccacaagtatgaaattgctgactgggaccttggtgccggaatatacgtagacttctacgttttgaagaactcaatgcaagaaagaaatgccatggatgattcgggttcacttgaggagatgagtgaatcatgcagaagtttctttggccgattaaacgagtcgttgttagtctggggaagcaaattacctgttgagtcaagggcatgctactcgaagatggcagaggagctatgtgcgcttctggtggacaccccaagcgagacgctgaacctacccatggggtgtcttctaacgatgctcaacgctccagttccggacgatagcaggtcgtcgtacctgcaggacacactctccgtcttcaccaaaatcctttgcagcgatccgtagcacaagggtccacggtgttgccgtaatctgggtgaagggaagtgaagcctacaggcaacacgccgaagagtttgtacgtctcatgttttggtacttatagaaaaataggaatgtataactatg

SEQ ID NO: 12595 - DNA, 566 bp, Zea mays
  Clone ID: LIB3279-208-Q1-K6-B11
ccccgcgtccgcggacgcgtgggcttttccccactcccgggtctccagcattcctatcctctccccgcccgcccgtgccgccgccgccgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagcgtcaattggtgctaatacatgggtggtcagtggaactccacagacaaagaagctgcaagatctgcttccgtcgattatcaaccagcttggtcctgacaacctggacaatctgcggaggctcgcagagcaattccagaagcaggcctctggtgcttctggtgcagaggctggtgccagcgctggggctgttcacgacgatgatgatgacgttcctgag

SEQ ID NO: 12596 - DNA, 437 bp, Zea mays
  Clone ID: LIB3279-208-Q1-K6-B12
cggccgcgtgggcggccgcgtggggccgcaaagactccaaggcggcctcttggagtctgagctgaagaggaggaggaggaggaggagaacagaatcgcagacggaggaggagagccaagatgcgccgagtgccgctggtgctcgtcgccgccgtgtgcgcactggctgagccggctgccgaggtcgacactgacggtcttctacccgaacggtaactaccaggatggtccgaccaacttggcgctggagaacggcacgggggtgtccggcgcccacgccatcccggggtgggagacgtgcggtttcgtcgagtacatccagtcgtggcacaatcagggggacatgctgctggtggagccgcaaggcgcgcacgcggtgcggctgggcaacgaggcgtatatccggcagatcctgaccttggcgcgcggtgcctacta

SEQ ID NO: 12597 - DNA, 493 bp, Zea mays
  unsure (1)..(493): unsure at all n locations; Clone ID: LIB3279-208-Q1-K6-B2
cgcggcggggctgctcggggtccactacggcttcctgtcgtcgaggtgggacgcggaggagacggggtccgtccttggctgggacctcgccgtgcggcactggaacgtcctttccacggcgaaggaatattcttcttcggtggaggaggaggaggaggaggaggaggaggaggaggaggaggatgaagaggaatactacgaagaagacgacgacgaggattaagtagacagtgattagattattaatctcagggggtaaatgtaataacagaccttggttgatctaagaaaccattcaaactcgggacaaatgacctttgaaatgctcgccgtacggtaaattcctgtggatttcaaggggggaactggcgttgggaaggccgaaggggcactatggctaatcctagtgttccctatgatttagccgtgactgttatctgnnaacattttagagtgtgtttggtagcaaagttttgaatacttacacaaaaat

SEQ ID NO: 12598 - DNA, 440 bp, Zea mays
  Clone ID: LIB3279-208-Q1-K6-B3
cccagcgtccgtgcgaggagacgactatgcatgatgtgaacaacatcgaggaagagatgcgcaggaagcaagctcacgctgcccaggaggcgtacgaggaggacgacgagatgccgggcggagcccagagagtgcagtgcgcgcaacagtaagcagactatcatcaaggcaattgggaggggtggtgcccttaaagcgtgggagtgatctctggttttgctgtcgccgagctgggaaataggaagctgaatcgacctcttaagcggggaatgtatccttttttgctgcaacataaaaaatgctacccaggcatagctgggtaccttttaacttctgtttggggatttgctagagtgatggtttcgatatatagggggacttgaatgtctgtggaatgctacggtataacgcacatttgggtgcaatgtctgttgcattgc

SEQ ID NO: 12599 - DNA, 624 bp, Zea mays
  Clone ID: LIB3279-208-Q1-K6-B4
aaaccacaaccgcgcggttttctccctcccccggctcccgcggcgcaagcgcagcccacccaagcgccatggccgccgccgcccccgacgcagacgcctacgatatcccgtgggtggagaagtaccgccccgcccgcgtcgctgacgtcgtcggaaactccgatgccgtcgcccgcctggaggtcattgcccgcgacggcaacatgcccaacctcatcctctccgggcctccggggactgggaagacgacgagcatcctggcgctggcgcatgagctcctcgggcccagctatcgtgatgccgtgctggagctcaatgcctcagatgacaggggtttggatgttgtgcggaacaagatcaagatgtttgcacagaagaaggtcactctacagcctgggcggcacaaaatcgtgatcttggatgaggctgacagcatgacatcaggagcacagcaagctctgcgaagaacaatggagatctattcaaacaccactagatttgcacttgcatgcaacacatcatcaaagataatcgaacccattcaaagccgatgtgctatcgtcaggttctcaaggctctctgatcaggagatcctcggtcgcctcatgattgttgtggcagctg

SEQ ID NO: 12600 - DNA, 535 bp, Zea mays
  unsure (1)..(535): unsure at all n locations; Clone ID: LIB3279-208-Q1-K6-B6
gttgccgagcctgctgctgttctcgccccagcgcctggaaaccaaaccagatgccaagcctgctgctgttcctgccccagcgcctngaaaacaaaccagatgccgagcctgctgctgctgctgctccagtgcctgacaccaaatcagttgctgagcctgctgctgctccagcgcctgacaccaaatcagttgctgaacctgctgctgctgctccagtgcccgagaccaaactagttgctgaatctgctgctgatgctgttgctgctccggcgcctgaaaccaaatcagatgccgagcctgctgctgctccagtgcccgagaccaaaccagttgctgaatctgctgctgatgctgttgctgctccagcgcctgaaaccaaatcagatgccgagcctgctgctgccgctgatccagcacctgaaatcaaatcagatgctgccgccgctgatccagcacccgggaccaaggcagatgctgccgccactgatgccgcgcctggaaccgagccagacgccgctccactagagaacaccgc

SEQ ID NO: 12601 - DNA, 649 bp, Zea mays
  Clone ID: LIB3279-208-Q1-K6-B7
gccctggggggttcagatcggatcggaagcttccataagtttccatcgggcttcgccgctcgccggtatggcgatccgcaaggggtcttcgtacgccgtcgcggcacttctcgcgctcgcctctgtcgccgccgtcgcaggggaggtcttcttccaggagaagttcgaagatggctgggaaagtcggtgggtcaagtccgagtggaagaaggatgagaacatggctggtgaatggaaccacacttcgggaaaatggaatggagatgccgaggacaaaggtattcaaacctccgaggattacaggttctatgccatttcagccgaataccctgagttcagcaacaaggataagaccctggtgctgcagttctctgtgaagcacgagcagaagcttgactgcggtggtggctacgtcaagttgctgggtggtgatgtagaccagaagaaatttggtggagacacatcttacagcattatgtttggaccagatatctgtgggtacagcaccaagaaggttcacactatcctgaccaaggatggcaagaaccacttgatcaagaaagatgtgccttgtgagactgatcagttgactcatgtttacactttgatcatccgtcctgatgcacatacagcattctcattgataatg

SEQ ID NO: 12602 - DNA, 506 bp, Zea mays
  unsure (1)..(506): unsure at all n locations; Clone ID: LIB3279-208-Q1-K6-B8
gtcgacccagcgtccgggcgggcaagtacgcggngcgcgtcggcgccggcgcccccgtgtacctcgccgccgtcctcgagtacctcgcggctgaggttctcgaacttgccgggaacgccgcgagggacaacaagaagacccgcattgtgccgcgccacatccagcttgctgtgcgcaacgacgaggagctgaccaaactgttgggtggtgccaccatcgcgagcggaggtgttatgcctaacatccatcagcatctgctccccaagaaggctgcctcctccaaggccagtgtcgacgacgacgacaactgagactgcttcctgcagaaatgatccgaccaccgccttgttttgtaggaataggatgatgttgtcttcggggaggagtcgggtttgttgggaaggaaaattagattagtatcagtttttttgaatgggatgggaacgtggctgtgaatctcagggttgtatgctcgttgagaaagaaatggaaggacttcgtgatgc

SEQ ID NO: 12603 - DNA, 634 bp, Zea mays
  Clone ID: LIB3279-208-Q1-K6-B9
caaatcttaagcttcttagcgtctgcgccagagggcggcttaggggcggtcttcctctttccaagagatgcacgtacggattcctcaaccgcgttgacgcagatctcagcatccttgcggtacttctccaggtacttgtccacctcagcagctgagggtccgccgcggcggcccgcctccttggccttcttcttgatgaagttctcggcgagcttttctagatggcggtccccggcctcggccttccattcctcgaggcggcgctcagcgttgacgtggcggaggcggcgaccgttgatgtcgcggcaggcgtcaaagttgctagtctttttctgccccgccttggaggcggcccctctgaggagggagccgaacccgcccttgcctcctcgaaggcggaggagcgcggctatagtgcctgctataggcgactacacagttttagctattttagacaccactactatttgtacacacatttctattagcctattttagcctgctatatccatgtatgggccttatgggaactctgcattactatggatcctcttatcattatgttcgacatagagacaaggtagtatattgagttggaccaataaatcctcatatttatttatgtgaattatgt

SEQ ID NO: 12604 - DNA, 679 bp, Zea mays
  unsure (1)..(679): unsure at all n locations; Clone ID: LIB3279-208-Q1-K6-C1
ccggngtcgacccacgccgtccgttcacgcgtccgcgggacgagggngaagnaggttacaggcacggcgcgtgaagggtcctgtcctgcccagtcccgtctggtccgccgcgatgccgtggcccgagatgtggctgcctcccgcggccggggagggggcggtggcggcggggctgtttctcgacggcgtcgatggggcggcgcacggcgcgctcctcgcggccatgcccgggtgctccctgtcgttcgggcaccagcatcggcgccgacggggggcgccgctggggtttctgtcgctgacaatgtcggtgaaggggggtagggggttcgcgccggccccggttgggttgctccccgacgcggaggagaaggccagggcggaggagtcggacgagctggtcgcagggaagagggctgtggaagtggccgcggaggcggaggcggagggagtgattctgctgcaggagaaggagaagaaggacggtcgtgctggagctggagcgatgaacgtgagcaagcatctctgggctggagcagttgctgccatgatctcgagaacagttgttgctcctcttgagagttaaagttggagtatatagttcgtggtgagcagaggaatctatttgagcttatgcatgctattgcaacaacacaagggttgaaaggcttttggaaaggga

SEQ ID NO: 12605 - DNA, 161 bp, Zea mays
  unsure (1)..(161): unsure at all n locations; Clone ID: LIB3279-208-Q1-K6-C10
cagagnaatgcataacttactgcagatgagaaatgctacgtcaatcggctgaagatgaggccagtgacctcaagaatcaagtatcacactgngaaaaaactggaggctacagctacagctgaggtagtaaaactacggaaaatgctagatactgaagctag

SEQ ID NO: 12606 - DNA, 586 bp, Zea mays
  unsure (1)..(586): unsure at all n locations; Clone ID: LIB3279-208-Q1-K6-C11
cgggaacccaagaacgggcaaacaaagcttgtcgcagggtttcccgtcagcggcttctgcggcgggcgccatgaacagcagcaagcaggcgctgatttacagcttcgtggccaagggctccgtcgtgctggcggaacacacgggcttctccggcaacttcagcaccgttgccgtccagtgcctccagaagcttccccccaacagcaccagatccacctactcctgtgacgggcacaccttcaacttcctcgtcaaccgcggcttcaagttcctagtggtcgccgatgaggcggccgggaggagcgtccccttcgtctttctagagagggttagggaagactttatgcagcggtatgggtccagtatcgatgaggaggggcagcacccgctcgctgatgatgctgatgaggatgactttctgttcgaagaccggttcagcattgcctacaaccttgaccgtgaattcggcccgaggttgaaggaccatatgcagtattgtgttaatcatccagaggaaattaacaagctctgccagtgtgaaagcccacctactcggatgtcaaaggnatcatgatggacaacattg

SEQ ID NO: 12607 - DNA, 483 bp, Zea mays
  Clone ID: LIB3279-208-Q1-K6-C12
cgggcgcgtgggaagcaaagtcctcctgcaaagagaccatggagcggttcttgttccaggtcaaggcgctgctacacagctgctccgccgagaaggaattccagatgggcaatttgaagcacaaggacttgcaaggccatgtggtgagctctcaggcgtatggaaacgtggatgaggaagatgaggagcagacggagatcgactccgaccttccagctgatgagcatgataatggcaatgccatggaggaggatgctgtggaaggtagcaacgagacgccgatggaggaggaagaggaatagtggcataggtaccaatctgtacatctctttctctctaagccggccaaaaatctgtccccaaaattaacagttttgtgtgtgcatttagtgtagaaaaaaagataggatccccatcagaatctaggttgcaacgtcacttgtaaatatggatgtctgaacaagtagtttatatattgctagc

SEQ ID NO: 12608 - DNA, 637 bp, Zea mays
  unsure (1)..(637): unsure at all n locations; Clone ID: LIB3279-208-Q1-K6-C2
cctagccgccactctcttttcttccttcagccagcgcgttttcttccttctcttccccacggcagcacgcagggagcccggctcctctcccatggcgcccgacctccctccctctgctgtccacggcgagctgccagctaggcgtcgagctccaagctccctgggcgcgcacccctccttcccttctctccatccccctcggcgttctgctccctccaggccgctgccccattttatttcctctctctgctctctcggtcgctggccatggccggaccggcccccagctcgagcacgcgtggacgcccctttcccatggccgagctccagctccagctccggccagcggccgtggcgcggcgcccttgcagcggatgcgcaggagctgctccccatggcgcgcctgctcccatggcgctcctccccgcgtgcgctgcgctcagccctgccgagctctcttgccgccgcttttccacagctcggttctgcccagttcggcgcccatctccctgcttcccagccgagcttcccatggcgcccttcctccttctctctgctgcacatggcgccaagcagctaacagccatggcgcctncacctcccagcgccctccctactcccatggcgctcccctgtt

SEQ ID NO: 12609 - DNA, 461 bp, Zea mays
  Clone ID: LIB3279-208-Q1-K6-C3
cggacgcgtgggcggacgcgtgggttcagcgaggacacaagcagaacagtggtggcaggagaaccgggcgagggtataccagcagtacaatgtccgcgtggttgacaaatcaacggccagtgccgacaatgacattgcagctaactgacactagactgacctggagaaacatatctgattacaagtggagctgaggccatgtaccctacctacgtgaaggctctctagtcagtcaagctgggttgctaacgtggctaccattttacctaggtggttttcgctcccaggaaaacaggaggtttttttaatccggttttacataattctttctcttactcccttctcttttctccttgtgtggaaagtagagtgcttgagcagaggtaatgtaaatgcttagtagaagcaggctaatctaccttgtaaatgcataagcaagcatcgattttagaatgtcttgg

SEQ ID NO: 12610 - DNA, 629 bp, Zea mays
  unsure (1)..(629): unsure at all n locations; Clone ID: LIB3279-208-Q1-K6-C4
cggacgcgtgggtacaaaggtcacacacgaggagtgaatgctattagattcacacccgatgggcggtgggttgtgtctggtggcgaagataatatagtaaagctctgggatcttacagctgngaaagttattacatgaattcaagtgtcatgagggtcagatccagtgcatagattttcatccccatgagttcctcctggcaacaggttcagctgataaaactgtcaagttctgggatttggagacatttgagttgattggatctacaggacctgagacgacaggtgttcggtccatgacattcaatcctgacggaagaactctgttatgtgggttgcacgaaagcttaaaggttttctcctgggagccaataagatgccatgatactgtggatgtgggatggtctagacttgctgatttgaatgtccacgagggaaaacttcttggttgttctttcaatcaaagttgtgttggaatatgggtntgttgatctgacgcgtcttgagtcatatgcaacgggtacttcaacaaaattaaatggccattctgaattgaagactgtgtctagtggcactatgcctttacaaaatgatagtggttcaagggctaacatagggcaatcatcagtc

SEQ ID NO: 12611 - DNA, 462 bp, Zea mays
  Clone ID: LIB3279-208-Q1-K6-C5
aaaacattagtgacaatattgtttagataaaagtttgagatgtcagaggaagctgctgaaaaggttaactttatctctggggctaagcttcaattcggcatctgcccattcttcagtcttaatgtcattgccgccgagtacaacagtgactcaccggtgcatgcacaccaaggatgtcatcactaccagcaccatcaacgactacaatagtgaagagttagtcttctactctacacgggagtaccacaccaaccaaaatggctcattgttgccaccaaacagaatgtatagcctattatgtctggcacttagggactcgatagctttaagggcaagttatgcactcaagtgactatcatagggaagggaggccttccaaggaaagaaggtgcttgttgtcggttgtgataacacctttccaacaataatgttcacacgtacattgtttgttcgtcgttgggt

SEQ ID NO: 12612 - DNA, 667 bp, Zea mays
  unsure (1)..(667): unsure at all n locations; Clone ID: LIB3279-208-Q1-K6-C6
ggccagtgcttggaaatgtgagttctgtcattcttcccagttactgagtgtactggccctttgtcacattatttgaatggggagccagtagaagctgatcaagcttggaaatcaagtgttcagcatgtccatgagaaatgcattgaatgggctcctcaagcattctttactggtgacaccgcaaacaacttggggcctgagttggcccgtgcttctaagatcaaatgcagtgtttgtggcttaaaaggtgcagcacttggctgccttgtgaagagctgccgcaaaagttttcatgtcccatgtgcctacaacgtcaaaggctgcaaatgggatcaagagaactttgttatgctgtgtcctacacattcgtcaaaaaagttgccttgtgagagattaaagccaaaaaagaaggccaagctgcagcaaccatcttctgacattgatggtccgaattcaccctctccaactccaatgcaaagggctgaactttggactgcctcaccttttctgactagtgaatgggtngatatgtggatctgcgctcattggccatgagaaggaaatcttggatcagtttgagtgtcacactggcatcacagtaaccaacacctggagtncagatgtgactcatgtgattgctaatacggatgaacgtggggcatgtgca

SEQ ID NO: 12613 - DNA, 619 bp, Zea mays
  Clone ID: LIB3279-208-Q1-K6-C7
catcttttcgcgtttagaactctaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtagggacttcatttgcactgtgtgctgtagcatgctcgtgtctagatctgtggatgggatgtgtcctgctctagtttc

SEQ ID NO: 12614 - DNA, 585 bp, Zea mays
  unsure (1)..(585): unsure at all n locations; Clone ID: LIB3279-208-Q1-K6-C8
ncaacaccatcatgatgatgcagatcaccaagttcacctgcggcggcttcgtgatgggcctgcggttcaaccacgcgtcggcggacggcatgggcgcggcgcagttcatcaacgcggtgggggacatggcgcgggggctggcggagccgagggtgctgcccgtgtggcaccgggagaagttcccggacccgagcatcaagccaggcccgctcccggagctgcccgtgctggcgctggactacgtcgtgctcgacttccccacggcctacatcgacgggctcaagcgggagtacaaggcgcacagcggcaggttctgctccggcttcgacgtgctcacggccaagctctggcagtgccgcacccgggcgctggccctggacccggccgccgaggtcaagctctgcttcttcgccagcgtccgccacctgctcaagctcgaccgggggtactacggcaactccatcttccccgtcaagatgtccgcgccggcagagaaggtgctggcctcctcgctcgtggaggtggtcgacatcatccgggaggccaaggacaggatggccgtcgagttctcccgcttcgctgggg

SEQ ID NO: 12615 - DNA, 525 bp, Zea mays
  unsure (1)..(525): unsure at all n locations; Clone ID: LIB3279-208-Q1-K6-C9
gcaaattccccagcacacttgaataaagaaatgggtctgttccattccatgactgaatattacatgtccatcacacccgatggccatacggtaacaaaagaaagcaatctgatgcagtcatcttttattcgatgatgctcttaaagaaatgcatgggtcaaatctcaataagcttttgtctggacaaaatccctaggtgattaactaccacccgcttgatggccaaatgtctgttcataaacaaggatgccgtgcagtctggttcaagaaaaaagaagtgtgatggactcatctgcctcatcagattcttattttcagaaccacaaggcatccttagtgatgtccatcatcttcatcgtcatggcccatctggatctccaccatcaccaattaccttaagcacaaagtattgcgagcagactggacactcatgcggctcgtcttttttcaaccagaaccataccaacatcatgttcgtnctcaccctcgccgccaggacaaccgactatccgcttgttatagtat

SEQ ID NO: 12616 - DNA, 672 bp, Zea mays
  unsure (1)..(672): unsure at all n locations; Clone ID: LIB3279-208-Q1-K6-D1
ctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgccgccgctgccaaggcctcttctaaaaagaaagaaagtggtaaatcctccgtccttatggatgtcaaaccatgggacgatgagactgatatgaagaagctggaggaggctgtccgcagtgtccagatggagggtctgacttggggagcatcaaagcttgtgcctgttggatacggcatcaagaagatgactatcatgttgacaattgtcgacgatcttgtgtccatcgacactctaattgaggaccaccttacgcaagagcccatcaatgagtacgtccagagttgcgacattgtggctntcaacaagatctagagttcagtttctgagattgggcaacggcagcggctcagctcgtcaagtttgtgctgggatgcca

SEQ ID NO: 12617 - DNA, 610 bp, Zea mays
  Clone ID: LIB3279-208-Q1-K6-D10
cttggttcgttcttgattcttggacgaggtgggatttggagagccaaggcggcgcggcagcggcgggtttctcggtcggactagattgtttccatcgagatggtgccatggtgggcggcggagggcattcgtcgatggaccaccctggcgccaaggacgatggagacggggaagaaagccagtacttctcggacgcggaggaccggtcgtggccgtcgcactcgcgccacgactccaccgcctacgaggactacgtctcgctgtgcgtgtccgcccgcgcgagctccgtcgacgccgacgccgatgccgacggcgaggccgtcagacaacactgcaggaagtcgtcgtgcgtgtcagagggctcgctggacgacgttgacctggaggccggactgagcgagatcatcaaggccagccctgagaaggccgaacagaactgtcgcatttgccaccttggcctggagagcacggcggccgagtccggtgccggcatcacgctcggctgctcctgcaaggggggacttatcctacgcccacaagcagtgcgccgacacctggttcaagatcagaggcaacaaatgccaatcggctggagtagacaccctgtttg

SEQ ID NO: 12618 - DNA, 590 bp, Zea mays
  Clone ID: LIB3279-208-Q1-K6-D11
gagagctcctggaggcaaatcaacagccatggcgaggtaattgatcagcaacttcgtcaataatgggctgcacttgccctctggttagcttctttagtgacaggggcaagccgagataagtgcaagggaaggaagaaacctggcaaggcagctgctgctgcaggacttccatctccccaacgccgcgacggatgggataaacacagcttttctgcacattagtttgcagccccgaagcttccccaaaaagcttcaaaatgttgagaacaacttgaatgttttgatcttttggctgtaaaaacaataccacatcgtccgaagagggatagcctatgttgcagtggcctggttgatagtggctgcagcagccccctttcctctgctttagagactagaaaaccaagtacatccataaccagtataaaaagcattggtgacaacgggtccccttgtttcaatctgagtggaggaggttgccaaaagaccactaaagatgtctctccaaatctgtccaaaacctagtttctgaagaacttctagaaggaaagcccaagaaatagagtcaaaagcctttgtgatgttcgagtttc

SEQ ID NO: 12619 - DNA, 344 bp, Zea mays
  unsure (1)..(344): unsure at all n locations; Clone ID: LIB3279-208-Q1-K6-D12
gtcggcggagccgtcggtgcttgctatggaacttttgaggcgttcagatacaagatccctggattgctaaagatcagatacattgggcaaaccaccgttggcagcgctgcgatttttgggcttttcttgggggctgggagcttgattcactgtgngaaaatcctactagtttgtttccctttttttttctgaagtctgaacacacctttgtcgatgggcttcagtgaaaactattcaatgcctgtttcatgtaacagctaatagctcagggttggaaaagaacaatcaagttatgtcctagttttggtgtggatggaaatagaatcaacgttcatctgcacgag

SEQ ID NO: 12620 - DNA, 626 bp, Zea mays
  Clone ID: LIB3279-208-Q1-K6-D2
cccacgcgtccgcccacgcgtccggtctcttcgggcttggacggaaccagaagacattccgccccaagaagagcgctccatcaggcagcaagggagcacagctccgtaagcacatagatgccactctcggcagtggaaaccttagggaagctgtgaggttgcctcctggagaggatatcaatgaatggcttgctgtcaataccgtggatttctttaaccaagttaatatgctgtatggcacgctcacagaattctgcacacctgagagctgcccgacaatgacagctggcccaaagtatgagtacagatgggctgatggtgtgcagataaagaaacccatagaggtatcagcaccaaaatatatggagtatctgatggattggattgaaggccagcttgacgatgaatccatatttcctcaaaaacttggcacaccattcccaccaaacttcaaggaagtagtgaagacaatattcaagcgcttgtttcgtgtttatgcccacatctaccactctcatttccagaagattgttagccttaaagaggaggcccatctcaatacctgtttcaagcacttcattctgtttaccaaatgagttggcctgattgacaagaaaggagctgct

SEQ ID NO: 12621 - DNA, 599 bp, Zea mays
  Clone ID: LIB3279-208-Q1-K6-D3
cggacgcgtgggttcgtggcaagagggctagtcaggacagaggagagcaagcagaagattggggcagccggtgatgtttacgttgctgacataagagacgcggatcgtctagcacctgctgtacaaggtgtggatgcgctcataatcctcaccagtgctgccccgaaaatgaaaccgggtttcgaccctagcaaaggtggacggcccgagttctactacgaagacggaatgtaccctgaacaggtggattgggttggccaaaagaatcagatcgatgctgctaaagctgctggagtgaagcatattgtgctggtgggatctatgggaggaacaaatcctaaccatccgctgaacagcatgggtaatggcaatatactggtatggaagcgcaaagcagaacagtatttggcagacagtggaatcccttatacaatcataaggccaggaggtctacaagacaaggacggaggagtgagagagctacttgtgggaaaagacgatgaacttctccagactgacacaaagtcgattcctagagccgatgtggctgaggtttgtgtccaggctctgcagtacgaaagggccaagttcaaggcatt

SEQ ID NO: 12622 - DNA, 481 bp, Zea mays
  unsure (1)..(481): unsure at all n locations; Clone ID: LIB3279-208-Q1-K6-D4
ctcgtttggngnggccgacattgacagcnacagtgaaaacagcaaagaagaaagggtccagcaacttgtctactgatctgaacggcaagaccatgcccaagaaggattcagcgtctgcagagaaacagcctccgaaccgtgcgaggccgaaaggaatgagtgggagcagcaattttgcagacgggaaggcctcaacctcaacaaccggagatcatgaaggccgtcgtacccggcagcctcctggcggcgacagcagcattttgctgggctagcgtgcatatgaatcttgctgccctatgccgccgccgcacaggtggttggtccgtcagtgtgtggtcttgttttcgtggtcaggccatgtgtcccatctccggtccttcagatgatctggttcgcatctgtcttgtgtatggttttgatatgtgttggttgtgacatgccccatggaacaaccctatcgctatgctgttttgttgtgtac

SEQ ID NO: 12623 - DNA, 628 bp, Zea mays
  Clone ID: LIB3279-208-Q1-K6-D5
ctcgccaccgccgacggcggcagctgcggcgccggagccgaggaaggagtacccgcccgacctcacgctcccagacctcaagagcgggctcttcagcaccgacgagttccgcatgtacagcttcaaggtgaagccctgctcgcgcgcctactcccacgactggaccgagtgccccttcgtgcaccccggcgagaacgcgcgccgccgcgacccgcgccgcttctcctacagctgcgtcccctgcccggagttccgcaagggcggcgcctgccgcaagggcgacaactgcgagtacgcgcacggcgtcttcgagtgctggctccacccggcgcagtaccggacgcgcctctgcaaggacgaggtcgactgcgcgcgccgcatctgcttcttcgcgcacaagcccgaggagctgcgcgccgtcaacccgtccgcggtctccgtcgggatgcagcccaccgtttcgtcgccgcgctcctcgccgcccaacggcctcgacatgggcgccatgctcaacccggcctggccctcctccccggccagcaggctcaagaccgcgctcgccgccggccgggagctggacttggacctcgagctgctcgcgctcgaccagtaccagcagaagctgttc

SEQ ID NO: 12624 - DNA, 673 bp, Zea mays
  Clone ID: LIB3279-208-Q1-K6-D6
cggacgcgtggggtcgaggccgccgcccagaccgcctccccttccccgcctccggtgcccaaggccaggccaacagttttgaggtggtaatggcggaccaggctaaccaacccactgtccttcataagctaggtggccagttccacctgagctccagcttctctgaaggtgtacgggcccgtaacatctgcctttctttctcatcttatgaaaggagatttgccacgaggaactacatgacccagagcctttggggcccttcaatgtctgttagcggtggcatcaatgttccagtgatgccgactccgctttttgccaatgctccagccgagaaaggtggcaaaaacttcatgattgatttcatgatgggcggtgtttcagctgctgtttcgaagactgcagctgctcccattgaacgagtgaagctgcttattcagaatcaggatgagatgatcaagtctggtaggctatcagagccgtacaagggtattgctgattgcttcaaacgtaccatcaaggatgagggtttctcttccttgtggaggggtaacactgctaatgttattcgttacttccctactcaggctttgaactttgcgtttaaggactacttcaagaggctgttcaacttcaagaagacagggatggttactggaagtggtttgctggcaac

SEQ ID NO: 12625 - DNA, 675 bp, Zea mays
  unsure (1)..(675): unsure at all n locations; Clone ID: LIB3279-208-Q1-K6-D7
cattctttggaccctcttttggaggaggtggnntggaagcagcaggggaagaaggcaaaggaggggagaagatgtagtccactcacttaaagtttctctggaagatctttacaatggaatctcaaagaagctctctctttcgcgcaatgtcatctgctccaagtgcaagggcaagggctcgaagtctggtgcttcaatgaggtgccctgggtgccagggctcaggtatgaaagtcaccattcgtcagctggggccttccatgatacagcagatgcagcagccttgcaacgagtgcaaggggactggggagagcatcaacgagaaggaccgctgcccagggtgtaagggtgagaaggtcgttcaggagaagaaggttcttgaggttcatgttgagaagggaatgcaacacagccagaagatcaccttccctggtgaagctgatgaagcgcctgataccgttactggagacattgtattcgtcctccagcagaaggaccactccaagttcaaaagaaagggtgaagatctcttttatgagcacaccctgtctctgaccgaagctctatgtgggttccaatttgttcttacacatctggacaacagcagcttctgatcaaatcaaacccngncgaagttgttaaacctgaccaattcaaggcaataaacgacgagggg

SEQ ID NO: 12626 - DNA, 535 bp, Zea mays
  unsure (1)..(535): unsure at all n locations; Clone ID: LIB3279-208-Q1-K6-D9
gcttgttgttccacctggntctggcattgtntcaccaggtgaaccttgatatctggcaagggttgtgtttaataatggtgggatcctttaccctgacagcgtcgtaggcactgactcccacacaactatgatagatggtcttggagttgctgggtggggagttggtggtatagaggcggaagctgcaatgcttggccagccaatgagcatggtcttgccaggggttgttggcttcaagttatcaggcaagctgaggaatggagttacagccactgacttggttctaacagtaacccaaatgcttcggaaacatggtgttgtcgggaaatttgttgagttctatgggcaaggcatgagtgaattgtcacttgctgatcgggcgaccatcgcaaatatgtctcccgaatatggcgcaactatgggtttcttcccagttgatggaaagacgctggactatttgaagcttactggccgaagtgatgatacagtggccatggttgagtcctacctgcgtgcgaataagatgttcgttgat

SEQ ID NO: 12627 - DNA, 214 bp, Zea mays
  unsure (1)..(214): unsure at all n locations; Clone ID: LIB3279-208-Q1-K6-E1
gtacaatactgatgaangtttgtgagactaacaatgaaagctttggcagaagaacctatcccactgtcagatgatttgcggcatgaactttcctgggaggcagcaacagnaaagatttattagggttgctgatattgcaccaactgtgncctgtgggacaaccaccaccctcctcacagcatttcatgcgcatctnccccccaaatgaactgca

SEQ ID NO: 12628 - DNA, 567 bp, Zea mays
  unsure (1)..(567): unsure at all n locations; Clone ID: LIB3279-208-Q1-K6-E10
gtgagccatgccgtgaggcgagactttttatctggctttaattttgttacttctcccaccgcagagagaatcaaatctttatctttactaatacagtgagcgaataaattttctctccgacgagnaaataaatattttaaaaataggatgtagggattcaaatgctacccgctagttttaattagtgctcggcttctaccattagaactcatgtctatttatgttatatgaatgtaaaggtaaatactaataattttaaaatacaaaaaaatataaccatattttaataaatatcttatttaaactagatctatctacatgatatgatatataaagaccttagcaatttacaagcaactaactagtgagcccgtaatgcatgagactatgaaggttctttgagatcgctttttggctccatagacttcatgatagagcagcttataaaagctagagtttaaatttacaaagcacccattaaacgctagctctccttgctttatctttttttttactaagcagagttggagcttagtctgaacaacatatcgtaacaaatcagaactc

SEQ ID NO: 12629 - DNA, 603 bp, Zea mays
  unsure (1)..(603): unsure at all n locations; Clone ID: LIB3279-208-Q1-K6-E11
ctcagcatctggagggggccgacttcatcaaggtcagcgacgacgaggtggccttcctcacgcgcggggacgccaacgacgagaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggctctcaagttctccaacgcctgcggcgccatctgcaccaccaagaagggcgccatcccggcgctgcccacggtcgccaccgcccaggacctcatcgccaaggccaactagatgcncggcacgccccgccgttccaccacgtcactgtcccccgccgccccgcccctcgtcgtcgacgtcctcggtttcggttcattaggtagatcgagtcttagcgtccgtctctgcgcctctacgctgagacggtttgtttgggttaattaagttagctttcgtggagatttcgccccggggcatc

SEQ ID NO: 12630 - DNA, 565 bp, Zea mays
  Clone ID: LIB3279-208-Q1-K6-E12
ggcacatgcttggggggccctcgctcaagtggatccccacacaggcggcgccgaattagtgcttacttttgtcatcaccctggccgtgctcttgatcatagtcaaggggccccgcaaccccatcatcaagacatggatgatctccatctgcactctgtgcctcgtcctctctggtgcagcatacaccggcccttccatgaacccagccaatgcatttggctgggcatatgttaacaaccgccataatacgtgggagcagttctatgtgtactggatatgtcccttcattggtgccattcttgctgcgtggatcttcagggctatgttcctaacaccgccacctaagcccaaggccaagaaagcatgatgaacatcatttggtcatggatgctggatttgataagtcaacatgaattgttagaataagaggaacgccaataagttcctggttcccagcatgttgaattaaattgattaatgtgatactctattactcgtaccatttatcataaggttctttatgcgaatatgaaatatctacctgtgtatatacacatgtactttc

SEQ ID NO: 12631 - DNA, 668 bp, Zea mays
  unsure (1)..(668): unsure at all n locations; Clone ID: LIB3279-208-Q1-K6-E2
gcagcccggcngaaaaccctagtaagcaaaccaccggagcagcggcgcttgcgcgggcggagccatggcggacgacgattacaacngaaattgacatggggtatgaggatgagcccccagaaccggagattgaggaaggagctgaagaagagcctgagaacaacgaagatgcccctgatgacgtcataggtggtgagggtgaagataaggaacaggaaaagaccaagcgtgaacgcaaaacaacaaaatacatgacgaagtacgaacgtgcgcgcatcctgggtacacgagccttgcagataagcatgaatgctccagtcatggttgagcttgagggtgaaactgaccctcttgagattgcaatgaaggagctgagagcgcgcaagatacccttcacgatcagacggtacttacctgatggaagctatgaagactggggagtagacgagctcattgtggaggactcctggaaacgccaggttggtggagactgaagacgcggatctacttggcatggaaagggtatgtggtgcagtgggtctttcctgtagttacaagtcttcgttgccactatgagtggatactgtagcgaatgaaccaagacgaaatgatgctatgttaacttaacgtctgtggttgccttgaactctggaaccgtaatgctagca

SEQ ID NO: 12632 - DNA, 592 bp, Zea mays
  Clone ID: LIB3279-208-Q1-K6-E3
cgccagcaccgcctgcggggcatcgtcggggcagggcgacgtgaggcgcgtgcccgaggtggtggagttctaccactcgttaatgcggcgggagtccaagagggacggcagcggcacagcaagtgaggccgcgaacggaggcggcggcggcgcggcggcgacgcgcgacatgatcggagagatcgagaaccggtctgcgcatctcctcgcgatcaagtcggacgtggagaggcagggcgacttcatccggttcctgatcaaggaggtggagggcgcggcgttcgtggacatcgaggacgtcgtgagcttcgtcaagtggctggacgacgagctctcgcgcctggtggacgagcgcgcggtgctgaagcacttcgagtggccggagaacaaggcggacgcgctccgcgaggcggcgttcggctactgcgacctcaagaagctggagcgggaggcggcctccttccgcgacgacgcgcgccagccctgcgccgcggcgctcaagaagatgcaggcgctcttcgagaagctggagcacggcgtgtataacctcgcccgcgtccgggacgccgccaccggccgctacacccggttc

SEQ ID NO: 12633 - DNA, 210 bp, Zea mays
  Clone ID: LIB3279-208-Q1-K6-E4
cagggagtccaaacttattgccaaaaccaattgtttgggaaagtaaatcctgacaaaaggaaggttagccacggagcggccaaaccttcgtcatcaaaggtctcatctaggagttgggcacagttacacacatttattcatacacttttctttaccagctgtactatactattaattttatttatttacatcagtcaatgcaccaaggcc

SEQ ID NO: 12634 - DNA, 663 bp, Zea mays
  unsure (1)..(663): unsure at all n locations; Clone ID: LIB3279-208-Q1-K6-E5
gctgcacacaacttgtgggactccaaactatgttgcaccagaggtcctntgaanatcaaggctacgatggagcaatggctgatctgtggtcatgtggagttatcctgtttgttctgctagcagggtatttgccgtttgaggactctaatctcatgactttgtataagaaaatatcaaatgcagaatttacatttccaccatggacatcttttcctgccaagaggttgttaacaagaatccttgatccaaatccaatgacgagaatatcaatcccagaaatattagaggatgagtggttcaaaaagggctacaagcgcccagaatttgatgaacaatatgacaccacattggatgatgtggatgccgtcttcaatgattcagaagagcaccatgtgacagaaaagaaagaagaagaaccagtagctctgaacgcattcgaactgatttcgatgtcagcgggcctaaaccttggaaacttatttgactcagagcaggagttcaaaagagaaacaggtttacatcaaaatgtccccccaaagaaattgtccgcaagatcgaggaagctgcaaaacctctaggatttgatgttcagaagnaaaaattacagttgaggctcgaaaaggtaaaggcaggggagaaagggaaaacctaacgttgctactg

SEQ ID NO: 12635 - DNA, 591 bp, Zea mays
  unsure (1)..(591): unsure at all n locations; Clone ID: LIB3279-208-Q1-K6-E6
gccggnaccgnaagacttccgccccagnaagagcgctccatcaggcagcaagggagcacagctccgtaagcacatagatgccactctcggcagtggaaaccttagggaagctgtgaggttgcctcctggagaggatatcaatgaatggcttgctgtcaataccgtggatttctttaaccaagttaatatgctgtatggcacgctcacagaattctgcacacctgagagctgcccgacaatgacagctggcccaaagtatgagtacagatgggctgatggtgtgcagataaagaaacccatagaggtatcagcaccaaaatatatggagtatctgatggattggattgaaggccagcttgacgatgaatccatatttcctcaaaaacttggcacaccattcccaccaaacttcaaggaagtagtgaagacaatattcaagcgcttgtttcgtgtttatgcccacatctaccactctcatttccagaagattgttagccttaaagaggaggcccatctcaatacctgtttcaagcacttcattctgtttacaaatgagtttggcctgattgacaagaaggagctggctccact

SEQ ID NO: 12636 - DNA, 521 bp, Zea mays
  Clone ID: LIB3279-208-Q1-K6-E7
ccccgcgtccgctaagctgccctcgctccgacgccgccacctcgtcgtccgaccgcatcgattcgatggcccgcatctccgccgtcgttgccgccgtgatcaccgccgccgttgtcgttgacgcgctgttcacagccgcctccgccaccgaggcgccggcccccgccccgatgtccggcgcgggcgccctctcagcgcagctctccgtcggctgcctcgcggcgctcctcgccgctttcctccgccactgagcggtggggccgccccgtctgcgtgcgcgtcttcagatctagtggtacagtggtagtgagagttgcagtctaatgttagtcgcaggtatcgtagcggtggtgatagtgttatgaagatgaggcatttggttttgttccacgtggtggatggatggataaatctgggcgtttagagagttttttctttttgatgctggatttgatttagtatgattggtgttagtttattactattattatttattatgtgcgtttctgtacctactgctc

SEQ ID NO: 12637 - DNA, 644 bp, Zea mays
  Clone ID: LIB3279-208-Q1-K6-E8
agggcggcggcgcggacggacaaggagcaggcggaagaggagttgtgccaaggcacaatgggtatctcgcgtgactcgatgcacaagcgccgagccaccggtggaaagcagaaggcctggaggaagaacgaaagttgagcttggtcgccagccagccaacaccaagttgtcaagcaataagacagttaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccaacattgaggagcaatttggcagtggacggttgctggcatgcatttcttcccgcctggacaggtggccgtgctgatgggtaca

SEQ ID NO: 12638 - DNA, 664 bp, Zea mays
  unsure (1)..(664): unsure at all n locations; Clone ID: LIB3279-208-Q1-K6-E9
gtcctccaccagnaggtggttanccagacaacccgccgcagcaagggaaactaccagacataccgctcgcagcaagatggaagaggctatgccccacagcagaattatgcacaaggtggtcaggatggtagaggttttggaaggaatgattacacagaccgttcaggctacaatggaccacctgattttcgaagtcaaactcagtaccaagggcatgtaaatccagctgggcaaggtcaaggttacaacaacccccaagagcgtagcaacttctcgcaagggcagggaggaggttttaggcctggtggtccttcagcacctgggtcttatggccaaccatcagcacctggatcttatggtcaacctaatacacttggtaactatgggcaggtacctccatcagtgaatcctggtggtaacagagttcctggtgtgaatcctagttatggtggggatggcagacagggggctggaccagcatatggtggagataactggcaaagaggttctggtcagtatcctagcccaggtgaaggacaaggaaactggcagggaaggcagtaagagctgacgtgttccactgaagacaagatggcacttgagatttagaatcccatctgtaaaataacgactgtgatgcattactctntttttttttcttgca

SEQ ID NO: 12639 - DNA, 571 bp, Zea mays
  Clone ID: LIB3279-208-Q1-K6-F1
tctgaagccaagtcccagaatgattttcttcatgaactgcaaatgaccctcgcaaaagctcaggctggagtgaagaacaacatgcggaggttgaacaagagcatcatccagcagggctcaaaccatgttctccatgttgttctctttgcactgttttgcttcttcattgtctacctcttgtcaaagttctctagaagataattatgtcttcggtgggcaaatctagaataccatgatttgtatgtagtctaaagggaaagcaaaatgctattgtacttttatttggccttgtatcctcggtctatttgtcgaaagttgaaacaaatgagaaaaggggaaattagtacctctaagggctagtttggaaactcaaatccccttcgggattgaaggggattggagaggaaattaatttatttccacctcaatcttctccaatatcgaaggggatatgaggttcccaaagtagccctgagggttgatttggtgacaagtgaattgaaggggatccatgtgaggaaatcacttgctattcaccgttgggtgtttcgttgagtgtatgcaacgagtt

SEQ ID NO: 12640 - DNA, 412 bp, Zea mays
  Clone ID: LIB3279-208-Q1-K6-F10
cggacgcgtgggcgcgaagcacccctatcgtacgttttccgtagctcgacggggacggcgagccgctcctgctgctgccgccgccggaggaggaggaacaggattagcgggaggaggagcagggcaccggtcgcttggggctgtgccacatgccgctctgggggaccgccgcgtccgcgcagccggcagccgagggcgacgccgcccgcgcgccctcagggtccggcggcggcggcgtcaaggtgatccggtcgctgctccccacccggcgccgcctccgcctcgacccgcccgctaagctttattttccatatgaaccccgtaagcaagtccagagcgctgtcaggatcaagaacatcaacaagtctcatgtggctttcaagttccaaacgactgcaccaaagagttgctt

SEQ ID NO: 12641 - DNA, 616 bp, Zea mays
  unsure (1)..(616): unsure at all n locations; Clone ID: LIB3279-208-Q1-K6-F11
tgcgactaaaaaccatctttggggcccttcgccgcgatttgcttcgcttctcggactaggttaagttgccttttcgattctcagaaaaagactggctctgcactcggataattttaaaatggatagtgcacagcagcccactggggaattgaacaattcgttcgatactcttatggtttctggaggtgaccagagtcgacagcctcaggatgctggcaatgaaacgagcttcacgaattggaaagacctccccatggagctgctcctgcgtatcatttcactagttggagatgacaggatagtcattgtggcctccggtgtatgcacaggatggcgtgacaccttggggntggggggttgcaaatctttcactatcatggtgccaggaccgcatgaatgacttggtgatatcactggctcacaagttcacgaagctgcaagttctatctctacgccagatcaggcctcagctagaggacagcggcgtggaaggcccgtggcaaaccactgccacgacctgcgcgagctggatctcagcagaagcttcaggctgagcgaccggtccttgtacgcccctgcgcacgggtgccctcagcttaccaggctcaacatcaag

SEQ ID NO: 12642 - DNA, 313 bp, Zea mays
  Clone ID: LIB3279-208-Q1-K6-F12
gtaacacggtcctcttgaggggccccaagaatgcccgtgaggcagtgaggcactttggcaaggctcctggagtgccgcacagccacaccaagccgtatgtgcgctccaagggaaggaagttcgagaaggctcgtggcaggaggaacagccgtggattcaaggtttaaaacaaattgtggccctccgtgttgccatcagcatagtgcaaccgttgtgtttgatcagtcgacagtaattagtcatcactctgtaccgagattagtagcacaatttgttgtcctggtttgaattttggaagatatttgatgtcgtc

SEQ ID NO: 12643 - DNA, 502 bp, Zea mays
  Clone ID: LIB3279-208-Q1-K6-F2
ctctccctctcctctctcccagcccgcgctggagtgccgctcgccgagccgccggaccgtccgccgtccacgccctcgccgcgcgcgctcgagcccgcccatctcgcctcaccgttcgccgaagccggactgtccgcgccctaccccgtcgagcccctgccggccaagcctcgccagagccgaccgccaccgcccaaaccgccacgccgtgcccttggccaccgccgatcgtcgcaagtagaagctgactgtgtggtagaagaaccaaacacgttcgaagacgacccgcaggacacgttcgagcaagagggtgatgaagaagactttgcagatgatgacgagtactaagtctaacgatgtgtccgtcatcttcctgtggaagagcgtccatgttttatccgctgtacttcgatgatgatactttttaagacatttatgtctagatgatgtaataaatttactccactctctttacgtctttattgtattgtcttttgatatt

SEQ ID NO: 12644 - DNA, 619 bp, Zea mays
  unsure (1)..(619): unsure at all n locations; Clone ID: LIB3279-208-Q1-K6-F3
gtatgctgctaatatgtgngaaanaagcccttaacaaacggcttggaactaagggtcttgacctttctgaaatcatagtggaatcagagaaacgtgggataacatttgacaagttactaactgttcctgagaacgatagctgggtctatgaagatggtcagtcagcatcttgtgtggctttcgtccttatgatgtacaaggaggctggactctttgaccctattaccagctctattgaagttactgaattcacaataaaagatgcttatatcctcaacttttttgaggacaactcgacccgacttccggagtggtgcaacaaggatgacgatgtgaagcttcccttttgccagatcaagggcaagtaccggatggagctgcctggatacaacaccatgaaaccctatgcccacatgaacgagagatgtccatccctgcctccagattacaacaggactaagggctgctagtgctaaccagatatgcgtgtgcattttattcacgctgccttgtagccattgcttcagctgtaaatattatactagtataatagtactgtgggggtatgacgtactgcttgcccttgagacgcgtgtattgattgtaggcaacttatgtg

SEQ ID NO: 12645 - DNA, 501 bp, Zea mays
  Clone ID: LIB3279-208-Q1-K6-F4
ccccgcgtccgaggaacgtgtcagatatgggaatggcctctgttagaagtcctgctcggttcaattcaaccaagtatgagtatgacggtggattctcgggggcttatgacataaatgcggtcaacgggttgagggaacggcagtttgcctcgttggatagctactctaatggcctgtctgacgtgagtgcatcaaagccttggctgaatggctctcccagtccatcggtgatgagccttggggttaacacaaatggataccacccccaggttgcggactaccccagtctgggaaatggtgtgaatggagtctccttgtggcgccgccatgctaacgggcgctggtaatgcgaggtgcctgtatacaatcatacagatggaataatgtttgttgtaacaaatggtttcgggcctgagctgatgtgccatgtaattaaaagttttaagttttaaaagggaaagaaagcgatacatgctgcaaaatctgccccgtgatttggtt

SEQ ID NO: 12646 - DNA, 638 bp, Zea mays
  Clone ID: LIB3279-208-Q1-K6-F6
gtcggcggagaagcgtgcggccgtgtacaggcttaccgaggaggagttccgccttctgctcgggaagatccggtcggtgcacgcggcggtcgcagcgccgatacgggagtccaacctgatcaccgctgcttgcgacaagtggatgagcggccaggttgataggaagatgccgtaccaagagaggcatgtcgcgcagcaggcgtccattgttggaaacatggaggcatttggcttgctgcagaaggctagccatgaggtggttgatggggagaatgcggcggtgagtgctcaggcagttgtggagtttggagctggaagagggtacttgactcaggtgctggtggactgttatgggattagaaatgtcttcttggttgagaggcggtcctacaaacttaaggctgatcgaagcttgcgtcaaaatgaagatgttaccttggagcgtttgagaattgatattgaggatttgaaactgcacggaattgaggcattgagggggctccaatatctagcaattggaaagcatttgtgtggacctgccacagatatgaccatgatgtgctgtcttcctgaacgatatgaccaaaccgaagaaaacggcaaacgtagtcttcaaggccttgctctagctacctgct

SEQ ID NO: 12647 - DNA, 667 bp, Zea mays
  unsure (1)..(667): unsure at all n locations; Clone ID: LIB3279-208-Q1-K6-F7
ccccgcgtccgcttaaccctcgttcctctagccgtctcgcgcagccacagcctccatttctcctccgacggcggtgcggctagctcaaccatggcggactccaaggccacctcggcggtcaccctccgcactcgcaagttcatgaccaaccgcctgctggcccgcaaacaatttgtgcttgaggttatccaccccggccgcgccaacgtctccaaggcggagttgaaggagaggcttgccaagatgtacgaggtgaaggaccccaacaccatcttcgtcttcaagttccgcacccacttcggtggaggcaagtccactggcttcggcctcatctacgataacctcgagtctgccaagaagttcgagcccaaataccgcctcatcaggaatggtcttgctactaaggttgagaagtcccgcaagcaaatgaaagagcggaagaacagggccaagaagatccgtggtgtcaagaagaccaaggctggtgacgccaagaagaagtaaacagtcatttatatttctgtattactgtcctgaactctgggtggtcgtctagttgcaatgtncataattatggtcgtgttaggttnttgttccgcactcagcagtaagtgaaagtttgtaattcctggatgtgaacctacccggattggctgtagcatgttgt

SEQ ID NO: 12648 - DNA, 614 bp, Zea mays
  Clone ID: LIB3279-208-Q1-K6-F9
ccccgcgtccgcgcagtcgcttgcgcgcagcagcacttcgcaccgccgccccatcccatcgccgccagtgtctgctcgatccgatggctcccacgaagaagtcgaagaagagcacagagagcatcaacaacaagctgcagctggtgatgaagagcggcaagtacaccctgggctacaagaccgtcctcaagacgctgcgcaactccaagggaaagctgatcatcatcgcaaacaactgccctccacttaggaagtctgagattgagtactacgccatgctggccaaagttagcgtgcaccatttccacggaaacaatgttgatcttggcactgcctgcggcaagtactacagggtgtgctgcctcagtatcatcgacccaggtgactcggacatcatcagtaccacccctggcacccagtgagccagccccggcacccattgcagctgcttcgcctttctcaaaatgagatgagatgtagcgctccggccctatgtccgtttccttttttatcttttagctatgtaattttgctaccatgtgtccatctaccatactgatagtacctcttattatggctgctatgcaaggcatatccatgggttttgtttgatg

SEQ ID NO: 12649 - DNA, 648 bp, Zea mays
  Clone ID: LIB3279-208-Q1-K6-G1
ccccgcgtccgccccgcgtccggaacgacgcagcccaacccgttcccaccaaaccagcggcaccacccatggcttcggcggcggcgagatccggtctccggtcgctggcggtgcgcgccgccccgttgaggcgccgcatgtcctcctccgtccacgacgacgcctatgagacggccaagtgggagaagatcacctacgccgggatcgtgacctgcaccctcctggcggcgtacaacctgtccaagggccacccccacttcgatgagccgccggcgtacccctatcttcacatccgcaacaaggagttcccatggggccctgatggcttgtttgagacgaaggaccaccactgagccctgattagcacaccttcaggagctggtgcacgcttaaaagagttatatggttgtttcagtgattttccttttcccttgagacctatttgctgcaacaagaaataagaatgaccaaactcttgtattgacagtgaggttttaactgtgttagctgttaccggcttgtctatttttctttgccgtccacgccatatatggtcacctttaagttggtgttgcccggtgtcaggaaacggcatcacaattatcaaaagctgttattgtattctgatggcttaagatgcaccctgtg

SEQ ID NO: 12650 - DNA, 615 bp, Zea mays
  Clone ID: LIB3279-208-Q1-K6-G10
gcgcggacgcccaccagcagctgcccccttgctgtcgccgcctctccgcgcgaccgatctaccgccgccgccaccatgtcgctgatcgccggcgaggacttccaacatattctgcgtctgctgaacaccaacgtggatgggaagcagaagatcatgttcgccatgacctccataaagggtgttgggcgccgcttctccaacatcgtctgcaagaaggccgacatcgacatgaacaagagggccggtgagctgacgcctgaagagctggagcgcctgatgacggtcgtggccaaccctaggcagttcaaggtgccggactggttcctcaacaggaagaaggattacaaggacggaaggttctcacaggtcgtttccaacgccctcgacatgaagctcagggacgacctcgagaggctcaagaagatcaggaaccaccgtggtctgcgtcactactggggcctccgtgtccgtggccagcacaccaagaccactggcaggcgtggaaaaactgttggtgtctccaagaagcgataagctacatatctatcgacaaatctcagatgtactagtgtttgttcttgttcaaactgtcttgatgaaaggttttctgttggg

SEQ ID NO: 12651 - DNA, 595 bp, Zea mays
  Clone ID: LIB3279-208-Q1-K6-G11
cggagaacgtgccttgctgcaggtcgagtagattgatgcggcggcggcttgcaccgcccactcactctcagaaatatctgggttcttcagcttccatagctcagccataggtcctagcagaggagcttcacagctcatgtgtttgaggcctttatcacaattcgattgcatttcttgcacttgcttcaaccggttctccagttgtttcccttcctcctgaagtgctcggtccatctggacaaacagagacctccatcgtgccacatgcgctgctgaaactgctttttcagtacatccagcatcacaagtatttgcaatggatgattcgttctcttggttagatgaaaattctgtcgagattaggtaaggcaattctgtatgaagagcatttctgactctcttcctgctgcgctttaaagcagcgaggcgccccctgatgtcctgatgcagtaattccaaccactgagaagcaacagtggccgcttttactgacagtacagtcatgtaatcatgattagttgctggatcatcagctgatgtactgcaggccctgtctgaagacatagtgactgctgatgagagttgcagtttgagc

SEQ ID NO: 12652 - DNA, 600 bp, Zea mays
  unsure (1)..(600): unsure at all n locations; Clone ID: LIB3279-208-Q1-K6-G12
anagaatatatgttgaggagaaaagaccaaaacacgagttgttgatggtgttatcacccgtggggatgacaatggcaatggcggtggcggtcggttccattctggcagaggtggtggttactatggggacggctacaagcggcagtggggcggtcagaacaacggctactacaacggcggggataacatgaggaacgactactcaggtcgtgtccgtggaccgcaagggaacggccaccctcagaacggccacggctaccatcagaacggccacggctactactctgggaatggctaccaacagcgacgccccaacagcaatgggaacggactgagggtcgagcgcaacaatggcttcaggcagcaaggccctgcatctgcctagaccttgtcattttgcagtccatccttgatacgaaagcagtggggatattttgatgtctataggtagatactttgtcatggctgaattttgttgtcgcggttgataagagcaatcgtgcgtcctttgactggaactgtaatgaggagtggagtcagtcgtgtcgcaaaggggaaaaaaaatctatcgaaatccctgctactcttttgtcgtgctgt

SEQ ID NO: 12653 - DNA, 413 bp, Zea mays
  unsure (1)..(413): unsure at all n locations; Clone ID: LIB3279-208-Q1-K6-G2
gctgatgtcggggagtttaccaggactgtgccgttcttgatttctgatagcttatcttctagtacacctcgtgttgttctcttcgtcacggcgccggtgcgcgtgcgctgaagctgcctgccattgccattgcctttgccgctgtttttaattaagcacacactctagatgttatgcccgcatgctatgtttcgattctcaagttgataaatgatggctggatgctggttttcgtgctccaagcctgctgcttcttccaggngaaaaaaagacctgcccttgttgcagcgttgttgtttagaatgacctatatttgactggtattctgttacggtggctttgcaaagctgtttgtttggtttaatgtctcggaataatatgaattggctgcattggacgtgtgtgtttctttt

SEQ ID NO: 12654 - DNA, 647 bp, Zea mays
  Clone ID: LIB3279-208-Q1-K6-G3
gatccctcatacacacaatttccttttggaggcaagtactagcttcaggaaaggctggaacatctaggcaaccaatagatgaagagagcttccaagaggagactgaagatgtagaagaacaaccgctagttagacgtcgttctcggcgtgccccctctgagaacaccgagctagcacaaatgccgcacccaggagctagccctgttctgaacaatcaccagtctagtggaggtgatttcccatctgagtggggtggcatttcttctgaggaacatgatgaagctgttatgcttgaggctgcaatgttcggcggagtttttggaagaccaatgcatcctttctccatgccttctcacagaagctctacttattatcccccaataactcattctccatcaccagcattagctgaacagcggttattaagagagcagcaggacgatgagtaccttgcgtcactacaagctgatcaagaaaaagagttgaaggccttacaggatgctgagctccgtcgcctagaagaaacaactacaagagaagctgctcttaagaaacagaagcaagagcaggaggaaaaggcgtaaaaagcaacttgaggaagaaggagctagatccagtctcgcttccaagcagcatcattaccatca

SEQ ID NO: 12655 - DNA, 621 bp, Zea mays
  unsure (1)..(621): unsure at all n locations; Clone ID: LIB3279-208-Q1-K6-G4
ccccgcgtccggncggcggtggcggcgccggagccggagccgggngagaagaagagctcgcaggcgcccgcaaagcctggagcgtgcggcgccgcaaagttcctcgcggggttgccgtcgcgcggcaacttctcttccggctccgccccctccaatctgggagggttcagggtttacgtctgcgagcacagcacagatcccccagaaggacaagttataaagacggattcaacgaatattttaatcaggcatctccagttgaacaagcagaagactgagggcaaagatgtggattccagaactgtcggcgaaaacaacagagggaaaagatctgctgccagaagtttggatgtcaacaattcagcaaagaaggctaacttgggtacttcatctggatcatcagcctatgaggaaatttctggcttttcacaacacacactgcagtcatttacagtggagagattgcgtgcacttctacgacaaagtggtcgatcgaccaaaggcaaaaaggatgaactgattgctcgcttacgggagtcgcagggttgacatgaatctggtacttgtttagtcaatcaaaccccctcaggcagggttacacgaccaaatgagtaccatgct

SEQ ID NO: 12656 - DNA, 614 bp, Zea mays
  Clone ID: LIB3279-208-Q1-K6-G5
taatgcccccatctataactttggcttgtgggaaacggcagtccaccaaggtgttacagtatattgcattacagtctaatgttgcatcatatatttaatcaatgaaaaggggctgatggtagaaactagaagcaatgaatagtgttcaaatgggggcagctgccagaatgagacctggcatatctgtgtgctcaacttctaggcctttttttggtacttttcttcttcttttttatttctcactgcatttagttccactgcaaactaccagttcttgctttgataagcattaaatggtctggtaaacacctggctgccgtggcaatttcttatagatggaatatatttatatttaagtggatgtaacatgtccattatggccccgtttgttccagttttttttccatattttggctgccataagctgttgtggattgttaaacactcaacttttcagcccgcttttataagaatccttttggtgaaaagcgccaaaaataaatgtgaacacctaatcgatcgagtcgtcgcgatagcaggagtccgtcactcactttctacatcctaaactttatagactccatctttatccgcatataatcccgacgatactc

SEQ ID NO: 12657 - DNA, 574 bp, Zea mays
  Clone ID: LIB3279-208-Q1-K6-G7
cacaatttctcagtacaccatgctaacggcctcgccgtcgtctcaggtgaagccgcaacaatggggtacatgcggggtcagcgtggcatcgacgccggcgcttcttccgccaccggccgccggacggcttgtcgccgtcgagaccaggaggaggacgaggacggttgcctccgccgcgcttggtcctgtggccaccgagcccgcagaaaggtctcccgtgccacagcctccgccactgtccagcgacgaggagacggtgctccggctcggcaactacgtcccggtcttcgtcatgctcccacttgaagtggtgaccaccgagaacgacctggaggacgcggggaagctgcgggagcagctgcggcggctgcggggggccggcgtcgacggcgtgatggtggacgtgtggtggggcgccgtggagggcgccgggccggcgctgtacgagtggcgcgcgtaccgggacctgttccgggtcgtgcagggcgaggggctcaagctgcaggccatcatgtcgttccacgcgtgcggcggcaacgtcggcgacgacgccgtcagcatcccgctcccgcgt

SEQ ID NO: 12658 - DNA, 585 bp, Zea mays
  unsure (1)..(585): unsure at all n locations; Clone ID: LIB3279-208-Q1-K6-G8
ccgtttttatagtatgtgttgtgaacattttaggcaaagaatgcccttgatgattttacaaaaagaatctgatcgcgaggataacaagcggngaaaagcttttttccactattttgcgaagccaaggaaaggagcattctcttgaaaaccttttgcaactaagggaggatttgagggacccggcggcctgtgaggcactccgccccatttttcgggagttgagtaataaactataaagtcgtacctaatcaaaatggggtggggcaaatatctttcctggtgtaggtttctcataggaaaccgaggcccctactttccttctaagggtaggtagggggaaagaagagtgggttagcgggcttctttcacttgttacttttcctaagagtcacccatactagaacgcacacggaagatatggcttcactatggatttccttttcgtgctatatgtcaagcggaccagcatttgaaagtgctgcgaatcgatgagatgccttgccttctcccaggactagactgtcatcgaattggaaagtgtaggaagcattcttgtgcgggttgttttgagcttccttgctttct

SEQ ID NO: 12659 - DNA, 522 bp, Zea mays
  Clone ID: LIB3279-208-Q1-K6-G9
cggacgcgtgggagccgccgccgcatcggcctcccaggtaagcagtagcgtccaccccagccgccgccatgaagcgcaacccccgcgtcacgagctcccgccggaagtgccgcaaggcgcacttcacggccccgtcctccgtccgccgcgtgctcatgtccgcggcgctatcgacggagctccgccacaagtacaatgtgcgttccatcccgatccgcaaggacgacgaggtgcaggtcgtgcgcggcacctacaagggccgtgagggcaaagtggtgcaggtgtaccgccgtcgctgggtcatccacgttgagcggatcacccgcgagaaggtgaacggctccaccgtgaacgtgggcatccacccttccaaggtcatggttacaaagctgaagcttgacaaggaccgcaaggcgctcctcgaccgcaaggcccggggccgcgccgccgacaggctaaggggcagtttactgccgacgacgtcgccgccgctgctggtggcgccgccgccactggcgcgtc

SEQ ID NO: 12660 - DNA, 641 bp, Zea mays
  Clone ID: LIB3279-208-Q1-K6-H1
aaaaaaaaccgagccttgagatctctgttgacccggtttagaaccttttagggttaggtttttaaaccctaaccctaaaagtcgatctgtttttgctatctcaaatttcatgtgtttggccgagactaagtctctcattggccgaaaaccctagatttagggttatgtaaaccctaactcgagagttctaagattatttgtaatctattctaatctctctgttctcgggtcatgaactatgataaaaaaatgagttcaatcacatttatctgagacctttctgttatctcataaaactgattcggattaggagatgggtctgagaatgcctagaaatagataaaagctccttcgtgtagcaggaaacaacatgagtgctattggttagaagggatgagttgtgtttgctgtatgtgttggtcagagttcgatcactatgtggcgtcttttttggctattttatttattggctggatggctgttggcagaaccaggggaatgggaaaggcaaagggaaagagagggaatgggaatggcagcgggcgcgagagagggacggggaatgggaaaggaaagtaatgagaatgtcagccctcacaagagagggaatgggaaaaggcaccgcgcagacagggaatgag

SEQ ID NO: 12661 - DNA, 475 bp, Zea mays
  unsure (1)..(475): unsure at all n locations; Clone ID: LIB3279-208-Q1-K6-H10
cgagctccggaaggaaagganctaaggtagaaaagataggctggagcagcaagtcaaagctatgaatgtagctcctacaggatatgtaccccatctccctcatccagcttcataccatcctgctgcgttcactccatttgcgccgcctccagccaacaaaagtgctccaatcccagcaccgttccctgggatggcgatgtggcagtggttgccttcgaccatcgtggacacaactcaagatccaaagctctggcccccaaatgcttaggggcagctaccttggaatgttgactcattgtgccttttcatgcatttggtgggcaaatcagtgtcaggtaggtccctggagactggagaggaatcaagttcgcaactcgcgccatgtttatgctgtaacacctggtttccagcactagttatgaacttacttttttctatagaaaggggggggcctgccattaatacatggagcttt

SEQ ID NO: 12662 - DNA, 127 bp, Zea mays
  Clone ID: LIB3279-208-Q1-K6-H2
caattcacaacttgatgacttgttaaatggatcatgcgttatgaaaatataaatacccacgtcatcgcaaaaaccaggtatgtgctgttgaagcagtttggtgtgatgaccaaggtcacaggctcaa

SEQ ID NO: 12663 - DNA, 116 bp, Zea mays
  Clone ID: LIB3279-208-Q1-K6-H3
ctcgtcgcctcgtcggcgtaaccccattccttgttacgtcgctcgtcatcgtcggctcatcgccgtgccgatggcggacgccgccgacaacagcatggcgctggtgcactcaagcc

SEQ ID NO: 12664 - DNA, 587 bp, Zea mays
  Clone ID: LIB3279-208-Q1-K6-H4
gtgaaagctaagcttgatcccatgagtatgaaacaggccataaaaacctagggagagagacccagtcaatgagaatcaaacaggtgacgaaggcttgtgctgaccatttgctccttctcagtccctggggtgttctctaaattcgttttctcaaaactatcaaccagagcagcgattgccttctcaattacaccaagaacctcattgtttccttccagaaaagctgtcatgtatagttgaattaggtcattcatgtgacaaaaatcttccccgttgagtcgttgacaacctgcagcgacgtaatcattctggtgaaacttgatgaaacacatttcgtcaaaatgaaaagcatgacatgaagatccaacagagaacctgggcattttcaaatgtggcgaagcacaccccagaaacaaggtatggctgggggaggaagttggatgctgccacactgagatgctgcatgttggagttggagagggaggagcggagagagttgccacatgagcgctaaggtgcgaccacacctgagagggccacaaccgcaggggcgcacgccatacaggagcaggagattggagaaggcg

SEQ ID NO: 12665 - DNA, 490 bp, Zea mays
  Clone ID: LIB3279-208-Q1-K6-H6
ccggtagcaggagcgcagccagcaagctcagccccccagccctactgccaccgcgccgaacgccatggccgagccggcagagcaccgtccagcggaggaggaggaggccgcggcggccggcgaggatgaggacaccggcgcccaggtcgcgcccatcgtgaagctggaggaggtcgccgttaccaccggagaggaggacgaggacgcgctcctggacatgaaggcgaagctctaccggttcgacaaggaggggaaccagtggaaagagcgcggcacaggcactgtgaagctgctcaagcacaaagacaccgccaaggtccgcctcgtcatgcgtcaggcgaagacgcttaagatctgcgccaaccatctcgtggtggcgacgactaagatgcaggagcacgcggggagcgacaagtcgtgcgtgtggcacgcgctggacttcgccgacggcgagctcaaagaggagatgtttgctatcccgtttggatct

SEQ ID NO: 12666 - DNA, 516 bp, Zea mays
  unsure (1)..(516): unsure at all n locations; Clone ID: LIB3279-208-Q1-K6-H7
ggcggcgcgggcggncaagnagcaggcggaggaggagttgtgccaagccacaatgggtatctcgcgtgactcgatgcacaagcgccgagccaccggtggaaagcagaaggcctggaggaagaagcgaaagttgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacg

SEQ ID NO: 12667 - DNA, 627 bp, Zea mays
  Clone ID: LIB3279-208-Q1-K6-H8
cggacgcgtgggttctgccgtcgttcactggtttgaacaatgttacgaattgcaaccaacattccagctgctcctccaaagatctgataagcttgccttgaatcttgaggagtgcactccttttaccgagcgacctttggaggaaactggaaacatccattacattactggtattgaagacattaatcatctagtaaagttcaggctggaacatcttcgtcaagtgcaatacatgcagtattatgctcctccggcaaatgaactgcctcaagcagcaccagaaaatattgctgatgcaatcccttctgaaaatggcaatgctggaagggctctgaatgatggaaacgaggacatgacccgggaagaaaatggtggtgcaactgacacagtgatcagtaataggatagaggaagacagcgttgaggcaaaggatgacatgacacaggaagggaacaagggtgaagtgagtggcaagggtcacatggctacagaggataggaagggggaagcacaaggtggcgcagatggcaagctggaggaagcaaatgtgatgtcggcggacaagatgatggaggaagcaaatgcgacgtcggcagacaagatggaggaagcaaatgccacgtcggc

SEQ ID NO: 12668 - DNA, 610 bp, Zea mays
  Clone ID: LIB3279-208-Q1-K6-H9
cggtcgcgtgggttgaggctgagtttgggcagagctccgacaagggcaaggatggttttgacaaagattctatcagcaagaggcttgaggagatatataaacggcttgagctcattgatgcggatgcagcagaggctcgcgcagcatcaattttggcgggtcttagttttactccagaaatgcaacgcaagcgtacaaaacaattttctggtggatggcgcatgagaatagctctagcccgtgctctgtttattgagcctgatttgctactacttgatgagccgacaaaccatcttgatcttcatgctgtgttatggctagaaacttatctcctgaagtggccaaagacattcattgttgtatcacacgcaagggagtttttgaatacggttgtcaccgatatccttcatctgcatggtagaaaactacatgcttacaaaggtgactatgacacatttgagaggacaagggaagagcaccttaagaatcagcagaaagcctttgaaacaaatgagaaggccagacagcacatgcagacattcattgacaagtttcgggacaatgcaaagagagcatcacttgttcaatcaagaatcaaggcatttggagc

SEQ ID NO: 12669 - DNA, 611 bp, Zea mays
  unsure (1)..(611): unsure at all n locations; Clone ID: LIB3279-208-Q1-N6-A1
ggaagcactcctctattaggaagtaattcacaaatcagtttccattaggaattaattcactctgaacaggggaagatgtggttaacaggccagagatcctgaaaacatctgttctgcctaacgcctaggtaacaaagcaacaagcctgcagcatcttacatcactcgagtctcttctactcttcaggatcaatcaatctccattcaggagatactctcgagccatatgctacccacccattcacacataaatactagtggcgcacacaaaccttgaatcagcagcagcccagccctattctttgttccgggtccctcggtctttcttgtgtcctcccaggatacgggagatctgcagacctctgctgaacgcctggttgaacagcatcctggtctggaattccgacacgaacgggaaccaggcgaggaaggcgatgggcgtgaacaggagaagtcccatcaggatctcgtagccccgggcaagagccttgatcgagccccagagcccagtcttgtggatcacaggnccgatcgcttgggcaatcagcagcaaaccccatccagtgggcatgaaagcaaggggatgcaacaatatgtccagcaccgtcatgc

SEQ ID NO: 12670 - DNA, 382 bp, Zea mays
  Clone ID: LIB3279-208-Q1-N6-A10
ccgatgaatagcattgcaaatcaaaacaggatgatttgaacaacaatcatggccaatagggggcctcgaacaatttatcacaaaattcaaaatgggaacccacagcagcagcccccaatggggtggacccattcagagttttcttaaaataacttaacccttaagcccccgcgaacttatttttaaccgggttcttaatagtcattgcccttgtcacccttgttatttggaccctttgggccgactttcttatagtccttttcaaaagcagccaaatccttacgggccttggagaactcaccctttttcatacccttaccgacgtaccaatgaacaaacgcccgcttggggtacataaggtcgaacttgtgatcgatgcgcg

SEQ ID NO: 12671 - DNA, 560 bp, Zea mays
  Clone ID: LIB3279-208-Q1-N6-A11
gaaacctcattgtttattctttaacaaagcacaaaagaactaaaacttgcgaattcgttacaggacggcagcagataagttaaacacaaaaagacagcgtgtccaaaaccagcatggatccagcgtccaggggcaccgttcacatttattctcagcatagacaagcagcaaagatggtctgcgaccaaaggccattggggacgacccacgatagggaggcagaaatctatctctctactagcctactgggtcttgaacatgtggcggatcaggtcgacgacccggttgctgtagccccactcgttgtcgtaccacgagacgagcttgatgaagtggtcgttcagggcaatcccggccttggcgtcgaagatgctcgacctgctgtcaccggtgaagtcggtggaaaccagatccttctccacgtagcccatgatacccttgagtgggccctcagaagcggccttaatagctttcttgatttcctcgtaggaggccccctttttgattctgacagtgaggtctacaactgacacatacacggtgggaaccccgaaggacat

SEQ ID NO: 12672 - DNA, 574 bp, Zea mays
  Clone ID: LIB3279-208-Q1-N6-A12
atacaaacaacaggtttaccacacacaaaacatggatacatcacatgcatgtagcattattcatgcctcaagaacatcaccaccgcaccaccgctagctacaaccagtcacaaacggctaaataaattaaacaccaagtctccacaaacagatactgacctaatagtaaagcaaacaccaccaaatgaaacagatccaactctccaatgcaggcaggtaattaaactaaaaagcagtagaacacaagctatatatatagctagctagacgtacggtacgtgcaaggcccaactactgctcgtatggagctaggggaaaccacgaaccacgcatgcatgaagacgacgacgtactacagtaccatcactctactaccacgcacgctggctagcccgacctcgctccagcgacggatcggacggacagacggagttcagggcttgttggcgtgctcggggacggagccggcggtgggggacccgggcatgccgccgaagccgctgaagcccggggagccgccgccgaagaggggcatgctgccgctgccgggcaagctgaacccgggaaggctgct

SEQ ID NO: 12673 - DNA, 439 bp, Zea mays
  unsure (1)..(439): unsure at all n locations; Clone ID: LIB3279-208-Q1-N6-A2
aacacaacaacggcatatcttagcaaatttatctctgagagccccaggactaaacacgaaatattcatggtaatacgaaaacagagatggagtgtgtccgatacaacaaatcgacagctaaagcaggactattcgggaggccgagcatctagaagcggagcttggtaaagaaccacctgttcttgccggtcttgaacctctcctcaaggcgcgctttggccgtcttgcaggcggcgaccttcttgtcgtgggtagagagtgcgtcgggcccaccggtggcgacatccttgaaatcgacgtcgagggtgtagcgggtgggcatgaggtgagtgaagttgacgagcttgatgaagcacttgacgcgcgacttcttcgcagtcttcttggcggacccacggcgtccgnccacgcgtncgnggncgcgtgggcgggcgcgtgg

SEQ ID NO: 12674 - DNA, 472 bp, Zea mays
  Clone ID: LIB3279-208-Q1-N6-A3
agtagggaaactgattgatattaacatgacgtgttaacggctttacaataggcacattacccagtagagtttagttgtttcttacttttacaacggctccaagcgaagcttagaaacgaaccaaacaacccattcgcaaggcaagatagcacacagccttccacgccgtaagcatttcactcggggtagcagtcctgatgtactatagtttggttgtgtggattaacatgcaccacgcaagatattctccccttgaccgggatactgaggaagaagaagtgaaggtgaccctcgacctcggcgagggcgtcaaagggcacggatccccgcgcgaggtccttgagcaggtagatcgcgtcctcgacgacgcggatgccgtcgagctgcaggttggcgtcgacgtacgagacagcgcgcgcctggacccgtccgccgccggacgttaccaggccaagcggcgcgccgcggtagc

SEQ ID NO: 12675 - DNA, 539 bp, Zea mays
  Clone ID: LIB3279-208-Q1-N6-A4
gacaaataaacggtattattatataaaaaaaatcatgatcctctcttatacaggcaaaagagaggcaccctagaacaaacagaacgaacataaatatccccctctcctctctctctgcgatccagatcgcaggattcgtccctccatctcccgcgatgcgcagcacgatccccacgccctcagatcacgaggaaggcgacgagagagaccagagcggcgacggcccacgcccccggcttgccgccaggcagccccgcggcaccgccaacggccggcgcgggggctggggccaggcttcccagaagtgcgtcctcctccagcttcctgctggctgccgcggacgcgaccagcgcgaggagcaccgcggcgaggaggacggcgacggtcttggtcgaggcggccatggagacagacgacgagaaggagctctctctgaagattgggcgccgggcaagcaagaaaccgagaccgcggactggactggagagggggctcggcggtcggcttcttgggctcgctgcggcgctcgaggggaattg

SEQ ID NO: 12676 - DNA, 596 bp, Zea mays
  Clone ID: LIB3279-208-Q1-N6-A5
aaaccaattatttttattcttgcaaatcacaacagtaccacaccgccaagagtttaattttctggtcctcaagcacgagcaatacaagcacaatctaagagttcaaaagcccaggcatattaagttcttacaaactagccattgcagtcacactgcggatccatacaagcttatgaagactgtcgaagctctgggcgcacgaaatctgcatcagcggtcactgagatgtcaacggtgggcctcagctgagcacagacttcgatggcaccgtgcacagggtcagacatgaagttgctgatgaggtcttggttgatcggtgctttcttgtcaacagtcacaaacgcctgttgggtcaagatgtaatcgaagcgtggtgcccatttcctagatcccaaacgagcagttgtggagcagttatcgaccatgaaggccacaccgcgagcatgcatgaacgggttcaacgagtccacggactcgatcaggctctcgttaattatctctgagtaagagtggcccttcttcctaaggacctcaatctgagccatcattaatgcaacatacactccggcagtgaagggatgcagtgggccaagata

SEQ ID NO: 12677 - DNA, 327 bp, Zea mays
  Clone ID: LIB3279-208-Q1-N6-A6
aggcaaaacatttccgggcccccggggttataacgggcctcacgatcgaagatttcacagggtaataatgggggaagacaaatttggtgaaaacaacagcttccgcccctgggtaatgccccctggggtgaacaagtaaaattagactttggggggaacaaaaaaaaaaaggttcatccactggattttatttgaagccttctgatttgggggaaaaagggaaaaaacttgggaccattttttttcaacaccctagggaagggtcctctgggataggggaaggggtcccaaggactgaagcttggggctttcctttttcaccaaccc

SEQ ID NO: 12678 - DNA, 594 bp, Zea mays
  Clone ID: LIB3279-208-Q1-N6-A7
agaatggaaggagtgctttatagcaacagcaaactttgacgatctacaatccaaccatgattttttactagatacaaccaaaccatgctgataaagaacttgcgacatacaatatagtcttcagtttcagcactcagaattatgaccagcaggcaaaagtccaatgaaaacctgttaaccttttggcacgctaccagtagtacaggagcacgagcactaaacgaggaaatgtgctaacaaagttgaagatacgaatgttgtgagttctcgttccagaggaacttccggacaagcatgaggccagacgaaagacgacgagcaaaatggctctgcatcatgtgacaaaacgtagcggttgctgcttacgtaccaaggcctggtgcttctgccccgcaatatggaactcgtacactttttggctgttcactacaacattgcacacttggcagatttttacttcgccctgcgctgctccagcctcaaggactcgcctcttcttcacctccagatcttcccgggttgctgctgagctgctcttcttcttcggctgtacagagggcaccacacagttggatacagcaacaggtggcatac

SEQ ID NO: 12679 - DNA, 491 bp, Zea mays
  Clone ID: LIB3279-208-Q1-N6-A8
gagaacatgttcagttcgaagtaactgaaattgataacaaaatatccggttgccaaattgcagactctttttggacagatgcacatacccccacgctaacctgaaacacacgcacattctgctacatgattgtggccgcaagaaggcaacctaaacagaactctttaagttacaactggctaagcactacagggacttacaagaaaattcagctttagccaagttaaggttccacagcttctaatcaaaaaccaaagaaaccaagctcagtcgccctttccttttcaaaggtttcgaagtattggtatatgattgtcacagcgagcaatataccagttcctgaaccaatcgcacccatgaaatcagccaggacggtcaatgcgccaatgcatacaccaccaaatgcagcggcagtggggatgtatcggttaagttccttctgcaagtttgactcacgatggcctggcatcaccatttgttgttccttgagc

SEQ ID NO: 12680 - DNA, 553 bp, Zea mays
  Clone ID: LIB3279-208-Q1-N6-A9
ctgtaaatagaggcaaagcatacatgatactaaccggactgacgcatacactgtactgtacacgaccatatttatcaagccaacattgacccaatagcaaaaggatggagtatacagcagacacactgtttttttttctattttactcgacacataaatacttataataataataatagatacaatataagcaattaacaagcgcctacgcagctttcccagcaaccatagctcgagctgaaactgcctcctccggtttgctgggcatactctgtgatcactttgcgagcgcaagcatcccatgtccttgcgatttctcgcagtgacatgggctcagctagaccccggagcaatacgctgaactttgtcttggccttggtagacaggtcgtctgagttcctgcattgttcatcaggaaacttgtctagaagcaccggggagcatttcgggtagctagcaggaacaagcaacctcaacggcaaaattggactcatctgcgctgaccaaacacggatttcaagctggggcaaacagcaacagcagtgaatgtgca

SEQ ID NO: 12681 - DNA, 581 bp, Zea mays
  unsure (1)..(581): unsure at all n locations; Clone ID: LIB3279-208-Q1-N6-B1
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgccgtagccgccgcctccacggccaccaccgtacccgncgccgccgccgcctccacggncgccgngggactgggcctcgttgacggtgatgttgcggccgtccagctccttgccgttcatgccctcgatggcgttccgcatcgccttctccgtgg

SEQ ID NO: 12682 - DNA, 591 bp, Zea mays
  Clone ID: LIB3279-208-Q1-N6-B10
gaagcccaggaaatcactccctatctgtacagctcgcaagtcaacgtttcacaagacctggtactcacatacaacgatcacatacaacgaaaatcccgacacatgtcttcagacggagttacaaattcaccggagcaacatcaggtcatagttatacattcctaatttttctataagtaccaaacatgagacgtacaaactcttcggcgtgttgcctgtaggcttcacttcccttcacccagattacggcaacaccgtggacccttgtgctacggatcgctgcaaaggattttggtgaagacggagagtgtgtcctgcaggtacgacgacctgctatcgtccggaactggagcgttgagcatcgttagaagacaccccatgggtaggttcagcgtctcgcttggggtgtccaccagaagcgcacatagctcctctgccatcttcgagtagcatgcccttgactcaacaggtaatttgcttccccagactaacaacgactcgtttaatcggccaaagaaacttctgcatgattcactcatctcctcaagtgaacccgaatcatccatggcatttctttcttgcattgagttc

SEQ ID NO: 12683 - DNA, 297 bp, Zea mays
  Clone ID: LIB3279-208-Q1-N6-B11
ggaaggtgaattgatatgtggtattcatcttcatgcatcacggtaccttgatttggtctaaagtgtggcctttaccattaacaagacttttaccacacaaaagcaagggagatatggatgaaaaaaaaagaggcatacttcatgtaaaatcccaccagcacgccctaccaaattctcgatcatgacataaccagtcccacaggcacaaataaggtaggtcagagttctcaacaggtcccttctaatggcatggtttaacaacagcaggcatgtagcaaaatcatgaggactcctttt

SEQ ID NO: 12684 - DNA, 452 bp, Zea mays
  Clone ID: LIB3279-208-Q1-N6-B12
acaagggttaaaacctgctattttccggtggggcggaccaccccaacccatacacctttttttttcgcaacaacttacaacaagaaaacccccaacgcgacccccctggagccacagacacagggcgcgcgcggcacgtgtttaccatgctctccctccccaaaccaaaaacacataccacccttattacaccattattgcttggcctggccattctgatcgctcacatggtaagacagtttattacaagatctgcatgatgctgatctcggtcttctttttgccctagccctcaaaccaggcctcatggactagcgggccctagagcttgccattgggcttcatgtgttacaaggtgctctagaagacgactcggatgccgttggccatggccaagaaccccaccacggatctcttggatcctccggctccccttgactggtagggcacct

SEQ ID NO: 12685 - DNA, 301 bp, Zea mays
  Clone ID: LIB3279-208-Q1-N6-B2
agtattcaaaactttgctaccaaacacactctaaaatgtttacagattacagtcacggctaaatcatagggaacactaggattagccatagtgccccttcggccttcccaacgccagttccccccttgaaatccacaggaatttaccgtacggcgagcatttcaaaggtcatttgtcccgagtttgaatggtttcttagatcaaccaaggtctgttattacatttaccccctgagattaataatctaatcactgtctacttaatcctcgtcgtcgtcttcttcgtagtattcctcttcatc

SEQ ID NO: 12686 - DNA, 443 bp, Zea mays
  unsure (1)..(443): unsure at all n locations; Clone ID: LIB3279-208-Q1-N6-B3
gcaatgcaacagacattgcacccaaatgtgcgttataccgtagcattccacagacattcaagtccccctatatatcgaaaccatcactctagcaaatccccaaacagaagttaaaaggtacccagctatgcctgggtagcattttttatgttgcagcaaaaaaggatacattccccgcttaagaggtcgattcagcttcctatttcccagctcggcgacagcaaaaccagagatcactcccacgctttaagggcaccacccctcccaattgccttgatgatagtctgcttactgttgcgcgcactgcactctctgggctccgcccggcatctcgtcgtcctcctcgtacgcctcctgggcagcgtgagcttgcttcctgcgcatctcttcctcgatgttgttcacatcatgcantagtcgtctcctcgcacgggacgcgtggg

SEQ ID NO: 12687 - DNA, 618 bp, Zea mays
  unsure (1)..(618): unsure at all n locations; Clone ID: LIB3279-208-Q1-N6-B4
gggtaaacatgatagttgtttcttcagaaagcactatcttacagagatacatcacgtctgtagaaattaagccacgcatgacagcgctattaactgaactaggttaccatgatagcacagcatgacacaagctattatcatctgtaatacaacgagttcatggtgcttttgcagtttccctcacaagcgcaaacttggcaagtagaccagaaagctgaagaaatgatccaacaccatcacagattctcatgtgtgcaaatcctgtttccttcagcatttccagcttcagatattcagccatgtcataattcttgacaacacggaagagagtagtgataatgtcagtaggagagtatcccaaatcataaagttgcttcagtgcagagcaggcctcatcaaactttccatcgagcacgtttttcaccatgttcttgacgtgtagggatgtgggttgatcacacaccttgaacacgttttcttgattaataaagcggaacccactaaatgtagcttgcaggttgttcaaagcttgtctcatgtcaccatcagcagtaaatatgatagcttncagaccctctggcgcataaggcaccttctcagctgccacaacaatcatga

SEQ ID NO: 12688 - DNA, 567 bp, Zea mays
  unsure (1)..(567): unsure at all n locations; Clone ID: LIB3279-208-Q1-N6-B6
ggcctaacattgataataatatgcttacgcagttaggtacaacacaaccaatagtccaaggggatgatgatggtggtggatacaggatacatgtacggcggcgacagcagccatacaaaaaaaaagagctcaaatgcagagcctaattaccaacatgtcacccagcagcgtcagactgactaatcaacatgcttaccgatccatcagattacaatgcgaatgcaaatgtttgttcctacatgagatacacggtgctggaaggggtgttccgttccggcctcagatgcacttcacgttgagtgcccgttgttcacgttgttcacgggctggctgctctcctcgcttccgcctttgtcggcagcggtgttctctagtggagcggcgtctggctcggttccaggcgcggcatcagtggcggcagcatctgccttggtcccnggtgctggatcagcggcggcagcatctgatttgatttcaggtgctggatcagcggcagcagcaggctcggcatctgattttgtttcaggcgctgnagcagcaacagcatcagcagcagattcagcaact

SEQ ID NO: 12689 - DNA, 601 bp, Zea mays
  Clone ID: LIB3279-208-Q1-N6-B7
aacatcagaaagggagataacaatcgtgggcaaaagatccttcctccttgttcagtgttatcgactttaatgggaaaaatgactacaaagcgctacggcgacccaaactgtccatctgcttattagcagtgttctacattcttggtggtcacgggaaaaaaaaaagaacttcatagtggcagagctcgtcgtgctgcttctcatcatcagaatccttgctatcctcggcatcagagtcggccttgtcctcgtctgccttctcatcgtcttcctcatcctctaggtcatcatcctcatcatccccacccttggcggcatcctcttcttccttctttttctcggcctcatcaaaagcagccttttctgcctccttgtgcttgccccaagtctcctctgcaaaagtcttggccaacgcagggtcatcagtgatgatgatgttgtcaaacagagtgcccgatttaacctgccacagctcaatgccaatgtacttcaagctgtcgaaggcgtaaatgtatggatcatccttaaaatctgggttgtcaatcataggtgccttccatttaccctggtagttcgggttcttgattttcttttgtttcca

SEQ ID NO: 12690 - DNA, 490 bp, Zea mays
  Clone ID: LIB3279-208-Q1-N6-B8
gcatcacgaagtccttccatttctttctcaacgagcatacaaccctgagattcacagccacgttcccatcccattcaaaaaaactgatactaatctaattttccttcccaacaaacccgactcctccccgaagacaacatcatcctattcctacaaaacaaggcggtggtcggatcatttctgcaggaagcagtctcagttgtcgtcgtcgtcgacactggccttggaggaggcagccttcttggggagcagatgctgatggatgttaggcataacacctccgctcgcgatggtggcaccacccaacagtttggtcagctcctcgtcgttgcgcacagcaagctggatgtggcgcggcacaatgcgggtcttcttgttgtccctcgcggcgttcccggcaagttcgagaacctcagccgcgaggtactcgaggacggcggcgaggtacacgggggcgccggcgccgacgcgctccgcgtacttgcccgcc

SEQ ID NO: 12691 - DNA, 128 bp, Zea mays
  Clone ID: LIB3279-208-Q1-N6-B9
cgatagggaacattttgctacatctccgatgaccactcaatttcaacaaacccacatgtacttgcatgatggtcacaaacttgaatgctacctatagtacatttcagcaggctaagtaaatcattgcc

SEQ ID NO: 12692 - DNA, 525 bp, Zea mays
  Clone ID: LIB3279-208-Q1-N6-C1
ccctaggacgggagtcgaagagaacaatcttctattaagccactgaatcgggtctcgaataggaccgcgtgtgcaatttggtcaactagtgtgcaaagcatcagatgaacaaccattttaccaacctgaaactaccctcacagcataagttactggggatgcccggcaatttcatcaagatacgtggtcgccatttgaacttgcttgtaggctcaccaatgaatttgtattcactccactttcagaactatcttcattaactcataaacaaaatagctgatcgatgctgatggtagaacctgtaacaagctggggattagaccggcatacagtgctggtaccccaccttggtcgacaatcttaaggcatgttgcaagcgcattcattctggttgcttttacttgcatctgtagctgcctacggaccacttcaaatgggtatgtagcagcttcagcacagcaaccgggcatggccccatagagtaaagtcctcacagtacccagttcaagttgattcaatgcattt

SEQ ID NO: 12693 - DNA, 578 bp, Zea mays
  unsure (1)..(578): unsure at all n locations; Clone ID: LIB3279-208-Q1-N6-C10
aaacaaaaacaaaaaaactttctagtgttcacggaaaacaggtatactgcgaaagtacttttttctgcctttgatatttttacagcaaaaaaattacaaacgctgcattgggtaggtaacaacatctgctatgctaggatcattacaaataaatgaattgctagtgttgtccaggctttcaactgccgccctcagaacaaagaaaaatgaactctcgaggagaaagttgttccactgcctcttgtgattagtcggtgcggtgcccgtgtatgcctgcctgccgaaaccaggtaagtcgattaccagcactcagagcaacgggtacctctataaagtgcacgagaaatggaacttcatagagccagccccagctgcactttgttgttctgtcgtcacagttttattcccagtctcctcatctccgcttgaagagntgggctggatgtcagtgtccggtatgccaactttcttatatcttctcgagaacagtccccttgaatccgaacaagctccatagggctcttcattgataatgtcgntcgaattacttcatgctgtgccaatgacacagtgcgagc

SEQ ID NO: 12694 - DNA, 417 bp, Zea mays
  Clone ID: LIB3279-208-Q1-N6-C11
acaccaaagtgcgtaatgcatttacaatgatcgttggcaccagtacagaaggtaccgaaataataggagcttgcatttttggaatgtacagatatttaagtcgtgatgtcatatctcctccaaacagttctgaccgggtactccagcttcctaccttttaccattatcatatggaagtaatggaacatgggaaagactgcggggattgaagtccactacattgcgataccgtgacactgaaaacacaatttggttgaaagtctgtgcatatcaaacgcctgaaaagaaaaaaaaaggcgagcaacttggtgtgctctaacatttgaatcccctgcagaccatcagccaaatgataaggatcagagccgcaatgccgccacccaccatcagcttaaacctcaggttctgaagccacat

SEQ ID NO: 12695 - DNA, 485 bp, Zea mays
  Clone ID: LIB3279-208-Q1-N6-C12
gctagcaatatataaactacttgttcagacatccatatttacaagtgacgttgcaacctagattctgatggggatcctatctttttttctacactaaatgcacacacaaaactgttaattttggggacagatttttggccggcttagagagaaagagatgtacagattggtacctatgccactattcctcttcctcctccatcggcgtctcgttgctaccttccacagcatcctcctccatggcattgccattatcatgctcatcagctggaaggtcggagtcgatctccgtctgctcctcatcttcctcatccacgtttccatacgcctgagagctcaccacatggccttgcaagtccttgtgcttcaaattgcccatctggaattccttctcggcggagcagctgtgtagcagcgccttgacctggaacaagaaccgctccatggatctctttgcaggaggtactttgcttcccacgcgtccg

SEQ ID NO: 12696 - DNA, 126 bp, Zea mays
  unsure (1)..(126): unsure at all n locations; Clone ID: LIB3279-208-Q1-N6-C2
ttttttttttntttttttttttttttttttttttttttttttttttttnttttttttttttttttttttttggggggttttttttttttttttttntttttttttttttttttttttttttttttt

SEQ ID NO: 12697 - DNA, 461 bp, Zea mays
  Clone ID: LIB3279-208-Q1-N6-C3
ccaagacattctaaaatcgatgcttgcttatgcatttacaaggtagattagcctgcttctactaagcatttacattacctctgctcaagcactctactttccacacaaggagaaaagagaagggagtaagagaaagaattatgtaaaaccggattaaaaaaacctcctgttttcctgggagcgaaaaccacctaggtaaaatggtagccacgttagcaacccagcttgactgactagagagccttcacgtaggtagggtacatggcctcagctccacttgtaatcagatatgtttcttcaggtcagtctagtgtcagttagctgcaatgtcattgtcggcactggccgttgatttgtcaaccacgcggacattgtactgctggtataccctcgcccggttctcctgccaccactgttctgcttgtgtctcgctgaacccacgcgttcgccccacgcgttcg

SEQ ID NO: 12698 - DNA, 464 bp, Zea mays
  Clone ID: LIB3279-208-Q1-N6-C5
acccaacgacgaacaaacaatgtacgtgtgaacattattgttggaaaggtgttatcacaaccgacaacaagcaccttttttccttggaaggcctcccttccctatgatagtcacttgagtgcataacttgcccttaaagctatcgagtccctaagtgccagacataataggctatacattctgtttggtggcaacaatgagccattttggttggtgtggtactcccgtgtagagtagaagactaactcttcactattgtagtcgttgatggtgctggtagtgatgacatccttggtgtgcatgcaccggtgagtcactgttgtactcggcggcaatgacattaagactgaagaatgggcagatgccgaattgaagcttagccccagagataaagttaacctttttcagcagcttcctctgacatctcaaacttttatctaaacaatattgtcactaattgtttt

SEQ ID NO: 12699 - DNA, 499 bp, Zea mays
  Clone ID: LIB3279-208-Q1-N6-C6
gtctcttaatctccttttttcaaaaaaaaaaaacatcagcagatgtcacattcctatgtttgaacctaggcagtagaacacgacacgttcaactcaaccgcgcacgacgcgatacagtccagaagccatgtatgaggaatggctctgcagccagccgtggtcgccagttcctgggcctcggctaatctcttgttgatggtctcgagggcgtctaggttgttgtggggcggcggcgcctccatgctgtagaggatcaaggacgtgctagagagctcggccttctccagaacggacccccctgctgcggcgatcaaatcttcgaggttggccctgtatcccggcatgaaatggccactgaagtagaaggtcaacccagcaaacagacctggtgcctgctgcatcgctcggagccttcctgagcgagggccgtcaacagagccatgaacatcacaccttatctcatagggctcttctgggactggttccctagcctccatac

SEQ ID NO: 12700 - DNA, 368 bp, Zea mays
  Clone ID: LIB3279-208-Q1-N6-C7
agtacacaacgagctctgattgctgaagatcttctcgatgaagacgaacatacaataagacacaaggacgaaactagagcaggacacatcccatccacagatctagacacgagcatgctacagcacacagtgcaaatgaagtccctactttctaagccttcttgggggacttggcgcccttcttgggggacttgggctccttgctgccggcgctggccgccttctccgccgccttcttgggcaggagcacggagtggatgttggggaggacgccgccgtgcgcgatggtgacgcctgccagcagcttcccgagctcctcgtcgttgcggatcgccaggagcacgtggcgcgggatgatgcgcgtcttc

SEQ ID NO: 12701 - DNA, 500 bp, Zea mays
  Clone ID: LIB3279-208-Q1-N6-C8
ggacagtataaccttttttattgtctcggtctcatatcaaatggtgtagtacaaattaagatcgaatttgcttgctgtgatctaatgtggtacgtattgaccaagataaagtgaaccccaaaaaaaaatacaaccaaaagtaacaacagcatcaacgaaacagaagcatgtttacgtcaccattcatcatctccctgcagccagggctcaggatgatcatcagcagtatataataagctaggaagaacaagttcagggcaggtcttccttcatgccacgggcgaactcctcggagtgttccttggtgacgcagctggcgagcatcctggtgccgtcgagcgggagcggcgccttgaggatgacgacggaggcgatgaagtcgttgttgacgagcgggccggcgaagatgggcgggccgaagccgtagtcgacctcggagaagccgagcttgctccagtcggagacgtagatggactcgtagttgaaggtcatctgaacgg

SEQ ID NO: 12702 - DNA, 611 bp, Zea mays
  unsure (1)..(611): unsure at all n locations; Clone ID: LIB3279-208-Q1-N6-C9
ggcttccgccgcactagccctctcctctcagaggacaagccggcgagggtggaggacgtcatgcccatcgccacggggctcgagcgggaggagctagaggccgagctccaggggaagaagcggtttgacatggattccccggtcggccccttcggtaccaaggaggaaccagctgtcattgagtcatactataacaagcggatagtcggttgtcctggcggcgagggtgaggacgaacatgatgttgtatggttctggttgaaaaaagacgagccgcatgagtgtccagtctgctcgcaatactttgtgcttaaggtaattggtgatggtggagatccagatggccatgacgatgaagatgatggacatcactaaggatgccttgtggttctgaaaataagaatctgatgaggcagatgagtccatcacacttcttttttcttgaaccagactgcacggcatccttgtttatgaacagacatttggccatcaagcgggtggtagttaatcaacctaggattttgtncagacanaagcttattgagatttgacccatgcatttctttagagcatcatcgaataaaagatgactgcatcagatttgcttcttt

SEQ ID NO: 12703 - DNA, 485 bp, Zea mays
  Clone ID: LIB3279-208-Q1-N6-D1
agacaaaaaaacatcagtacccggtgtttttaagataaatgtttattgaaaaaaactggcaccactcaacaataaactcagaccaagatgtttataatagactcagctccgaacaacatttctgtaatagactagaagggataaactggcattccagcacaaacttgacgagctgagccgctgccgttgcccaatctcagaaactgaactctagatcttgttgaaagccacaatgtcgcaactctggacgtactcattgatgggctcttgcgtaaggtggtcctcaattagagtgtcgatggacacaagatcgtcgacaattgtcaacatgatagtcatcttcttgatgccgtatccaacaggcacaagctttgatgctccccaagtcagacccttcatctggacactgcggacagcctcctccagctttttcatatcaatctcatcgtcccatggtttgacatccataaggacggaggatttac

SEQ ID NO: 12704 - DNA, 534 bp, Zea mays
  Clone ID: LIB3279-208-Q1-N6-D10
aaaatgcagaattacttacactaattctatttacaagattttggataagagaagtagcaggtttgttaggaggttagagaattagatccatatctacatatagaaagtatttcttgaccctaacacacatttatccgaacaaggtgaccaaacccattgtcatgtacaataccatgcagcaagtgacgtggattatccaactgcctatagtcccaatcttccggatcatcagaggagatcacatatttgcatgtcgagcaccgtgttccaaacgactgggccataagcccacaatggtcacaatgcttgcaggttttgtattcattccgaattatgaaatggtacctccttccacaaacagggtgtctactccagccgattggcatttgttgcctctgatcttgaaccaggtgtcggcgcactgcttgtgggcgtaggataagtcccccttgcaggagcagccgagcgtgatgccggcaccggactcggccgccgtgctctccagccaaggtggcaaatgcgacagttctgttc

SEQ ID NO: 12705 - DNA, 515 bp, Zea mays
  Clone ID: LIB3279-208-Q1-N6-D11
gtgcgactggcatcattttattcaagttttagaatgaatacagtaacaaggtactacggcgcgctgaccaaatctgagaacaatgctatagcttgtgtgctgcagccggctccaccataagctcctacagtcctacacctacaatatatactagcactaaattaacccctccctaatttcatcatgtttttatacaggtcattcagctgacgagctcaggtaacccaacatacagcggagtgcccgactgacaagaccacgacaggaaaaaaaaacgcaacaaagccaaaaccactactcagttcggctgacacatgttctccacattgttctacgacacaaccagaggggaatagcgtttcttcgtcactctgcttatgatgtcgcctaatccaacaacccagcaaggatgtttgcctcacggactctaacaaatgatgtggatgacaagtgtagctaacgtcagcagctgatctccccttcctcggtgttaggatccatcaaaggcgatatgc

SEQ ID NO: 12706 - DNA, 343 bp, Zea mays
  Clone ID: LIB3279-208-Q1-N6-D12
ctcgtgcagatgaacgttgattctatttccatccacaccaaaactaggacataacttgattgttcttttccaaccctgagctattagctgttacatgaaacaggcattgaatagttttcactgaagcccatcgacaaaggtgtgttcagacttcagaaaaaaaaagggaaacaaactagtaggattttccacagtgaatcaagctcccagcccccaagaaaagcccaaaaatcgcagcgctgccaacggtggtttgcccaatgtatctgatctttagcaatccagggatcttgtatctgaacgcctcaaaagttccatagcaagcaccgacggctccgccgac

SEQ ID NO: 12707 - DNA, 547 bp, Zea mays
  Clone ID: LIB3279-208-Q1-N6-D2
ggaaaataaacactgcatacatcaatccaacacattcttgtgctttctctttttgcagtacatgatcatcatcacccttctataactgataacaggcacacttacatggccaatacatgatcatttagaaacacacaggtacatgcacatatagctctatgcagtgaagttctgtcacggatggacacttcacagccatctgcactgagagctctatatccacgtttactacaccgtagtctcagtaaggaacgatgatggattcaatgagctcctggagtggagccagctccttcttgtcaatcaggccaaactcatttgtaaacagaatgaagtgcttgaaacaggtattgagatgggcctcctctttaaggctaacaatcttctggaaatgagagtggtagatgtgggcataaacacgaaacaagcgcttgaatattggcttcactacttctttgaagtttggtggaaatggtggcccaagtttttgaggaaatatgggattcatcgtcaagctggccttcaatccaatccatcagatactcca

SEQ ID NO: 12708 - DNA, 602 bp, Zea mays
  Clone ID: LIB3279-208-Q1-N6-D3
atgcaaacagggttccaaataacttgttttaatggctgtcaacagttcacacaattggcaaccagacgacattcagcagtgtacaagcaaacaatgcaccataaaatggattgatacaagctacctggttgcaattgcaccaaaccgcagctccaacaagctacctggttgtatctccaggacaagcccacgataaaatggattgtgacaccataaaatctagaactcgagtaggcttctcagcagctcgctcaaaaccgagcagtgatctgggagaacagtgccctaaagtcctttgttggcgtgcccacaccttcaggctttgaggccaaatcaaatgccttgaacttggcctcttcgtactgcagagcctggacacaaacctcagccacatcggctctaggaatcgactttgtgtcagtctggagaagttcatcgtcttttcccacaagtagctctctcactcctccgtccttgtcttgtagacctcctggccttatgattgtataagggattccactgtctgccaaatactgttctgctttgcgcttccataccagtatattgccattacccatgctgttcacggatggttaggattt

SEQ ID NO: 12709 - DNA, 480 bp, Zea mays
  Clone ID: LIB3279-208-Q1-N6-D4
gtacacaacaaaacagcatagcgatagggttgttccatggggcatgtcacaaccaacacatatcaaaaccatacacaagacagatgcgaaccagatcatctgaaggaccggagatgggacacatggcctgaccacgaaaacaagaccacacactgacggaccaaccacctgtgcggcggcggcatagggcagcaagattcatatgcacgctagcccagcaaaatgctgctgtcgccgccaggaggctgccgggtacgacggccttcatgatctccggttgttgaggttgaggccttcccgtctgcaaaattgctgctcccactcattcctttcggcctcgcacggttcggaggctgtttctctgcagacgctgaatccttcttgggcatggtcttgccgttcagatcagtagacaagttgctggaccctttcttctttgctgttttcactgtgctgtcaatgtcggcctctccaaacgag

SEQ ID NO: 12710 - DNA, 364 bp, Zea mays
  Clone ID: LIB3279-208-Q1-N6-D5
gcggtcgatgaagctctggctgcgcttggcgaacgccgaggcgcgggagctcatgatggccttggccatggagtggtcgagcccgaacgcggagttcgggccgaccatgggcgacgccggcatgtgcagctgcgtgttccccatggagctgtacccccgcattttgcccgcctgcttgagccacaacgcgtgcaactgggacaacatggcccggtcgaccgagcccagcaagtccccgtagtccggcaccgcccttgtgcttggcgccgcggcgggcaacggtgagcccattccgccttcccagacgggcctcggcgacgacaccttgtcgaacagcttctgctggtactggtcgagcgcgagc

SEQ ID NO: 12711 - DNA, 591 bp, Zea mays
  unsure (1)..(591): unsure at all n locations; Clone ID: LIB3279-208-Q1-N6-D6
agacacaccctatgaccatgttttggggacccatgccaccacctagtaggacagttacgagtgttttgagatcaatgtctccgcccaaaacgaatgttggaaaaattctcctacataaattattaatttcttcgatatgaaaggcaaaaacttgaccagatcctgactgggctggaccgggagcgaactgctcttgttcgtcatcatttttctccatttaagcaccgccggagccgtacttctttccgaagaagaggatctggagctggtcgtagccagaaagcacaccagcgccagcaatggcacgaagaatgttagcaccagcacccttgaacagggacttggggccttccttcttaaggatctgctggaatgcgtccaaggagctcttgtacttgacagcctcaccagaagtcatcatcatccttctgcggacagtatcaatggggtaagatgcaagaccagcaccgtttggtgatcagccaacccagagcaaanactggcaaagaagttgtcctggaggctgccagtgaggacaactggcttgatagaatcgtaaagtccgaaatacaggccacgataaacaataat

SEQ ID NO: 12712 - DNA, 79 bp, Zea mays
  Clone ID: LIB3279-208-Q1-N6-D7
gttcaacagcacaagcacaggcgtcacattaaaataaaatgcaccaatgtgcaacggcaacgtccattgagacatgatg

SEQ ID NO: 12713 - DNA, 398 bp, Zea mays
  Clone ID: LIB3279-208-Q1-N6-D9
attctacatgataccgaatcatggatgggggaggggaacaaccaagaaagccaacgcaacaccagaaccgagccggactgaaaacgggaagagaacaacagcaaagaagagcatgggaaaaggcaagccaaacaaaaggaaaaaacgacaaaaaccaaaaacaaaagaaagagaaacggaaagaaaagaaaaaacaggagactaggaagaaaaaaccgggaacgctaagagggaaaaagaaaccaggataaaaaaacacaaacacagccaaacgaaaaaggatcaactggtgaacaaaaacggatccaaacggaacaacaagcctgacgcggggggcgaccccggaaggcccgaccgaaaccggcaggcgggccaaacctaacaagggaggggaagga

SEQ ID NO: 12714 - DNA, 511 bp, Zea mays
  Clone ID: LIB3279-208-Q1-N6-E1
aggcggtgtagtaaaagtttcagcatggatggctgcgaaaacaaggggcatattattatacaataagattttcaacacacgcgtcaatcctgggaaacaacacgatgaaaaacagtccacatatatgagactgtaatactagtgtgcacttcagactgcttaagattaacaatcagaagatacgatgcatccaggaacttcagaacgcctttgatatatgaagaaaaaatgcagtgccgccacaccagaacaccacatagaatgtatgtttgatcaatctgagaacctctccgagcgacacatctttttgccgttgagttagactggttcattctatggtccatggcaacagcatcgcaagaaaagctaatgctatccctgcaaattccacccaagttccttgcattgctgttcatccggctgcagtgtgtttggtattgcaccgaacacacaacgcacagcttcaaacccagagattgtattatggaaaaatgccgatgcctctttcatg

SEQ ID NO: 12715 - DNA, 211 bp, Zea mays
  unsure (1)..(211): unsure at all n locations; Clone ID: LIB3279-208-Q1-N6-E10
agataccacanctggaaattgatatcagcttactcaaacttattaccgttgtcactcgagtgtgaatcattaccgttgtcatccatgttacaattcgtgaactaaaaaagaccttatagccccaaggcagctaggagtcgttggagctccatttggaaggtcatagttgctttctgtccgtgggcgcaccggacagggaacagtgtcgatt

SEQ ID NO: 12716 - DNA, 552 bp, Zea mays
  Clone ID: LIB3279-208-Q1-N6-E11
cattgaaaactctgcatcgaaggcatcacattagccttcccaatcacacgacactagcaatgttcaaaaccccaactgatccaagctaaaaataaaataaaataaaataaaaaaaaggatagcatcccaccacgcatgccaacattttattgatgccccggggcgaaatctccacgaaagctaacttaattaacccaaacaaaccgtctcagcgtagaggcgcagagacggacgctaagactcgatctacctaatgaaccgaaaccgaggacgtcgacgacgaggggcggggcggcgggggacagtgacgtggtggaacggcggggcgtgcggccatctagttggccttggcgatgaggtcctgggcggtggcgaccgtgggcagcgccgggatggcgcccttcttggtggtgcagatggcgccgcaggcgttggagaacttgagagcctcgcggagcttctcctcgttgtggaagatggagtcgtccttggcgacgttgacgaggagggagccgacgaaggcgtcgccggcgccggtggtgtcgacggtgt

SEQ ID NO: 12717 - DNA, 376 bp, Zea mays
  Clone ID: LIB3279-208-Q1-N6-E12
ggaaaggccatgtgtttttccccaggtggatttttcattttcgcataaagaaccttttgataaatggtgcgagtaatagagtttcacattaatcaatttaattcaacatgctgggaaccaggaacttattggcgttccttttattttaacaattcatgttgacttatcaaatccagcatccatgaccaaatgatgttcatcatgcttttttggccttgggcttaggggggggggttaggaacatagccctgaaaatccacccagcaagaatggccccaatgaagggacatttccagtacacatagaactgctcccacgttttatgggggttgttaacatatgcccagccaaatgcattggctgggttcatggaagg

SEQ ID NO: 12718 - DNA, 614 bp, Zea mays
  unsure (1)..(614): unsure at all n locations; Clone ID: LIB3279-208-Q1-N6-E2
agcgcaaccaacaaccatgctagcattacggttccagagttcaaggcaaccacagacgttaagttaacatagcatcatttcgtcttggttcattcgctacagtatccactcatagtggcaacgaagacttgtaactacaggaaagacccactgcaccacataccctttccatgccaagtagatccgcgtcttcagtctccaccaacctggcgtttccaggagtcctccacaatgagctcgtctactccccagtcttcatagcttccatcaggtaagtaccgtctgatcgtgaagggtatcttgcgcgctctcagctccttcattgcaatctcaagagggtcagtttcaccctcaagctcaaccatgactggagcattcatgcttatctgcaaggctcgtgtacccaggatgcgcgcacgttcgtacttcgtcatgtattttgttgttttgcgttcacgcttggtcttttcctgttccttatcttcaccctcaccacctatgacgtcatcaggggcatctntcgttgttctcaggctcttcttcagctccttcctcaatctccggttctgggggctcatcctcataccccatgtaaatttcgttgtaatcgtcgt

SEQ ID NO: 12719 - DNA, 567 bp, Zea mays
  Clone ID: LIB3279-208-Q1-N6-E3
gagactgaataaacacagatttctctaaaaaaagggtacaaaggctgttctttagttacagtactggagcgtttacagcagaatacacgatcaactatttctcgcaaagaataaaaaaaacaatgaacaaatcatactatggcactgtggcggcgacgacgagatgatggcgtatagataatccgaccatataaataagaaccgcatgctctggtcctcacacactcctctcctcctctcagtctcaggccctggcaacgagcctgtgctggcgcagatgccggtgctccttctgccgctgtacccggcacatggacgccttctccttgagctcctggaaggctcgcatggtgtccacgtcgaacccacctgcaaactgggtgtaccctgaaggcgaaccgtactccttggagcatcagctcctgctcctcctcttcagggcctcccttgatcacctcgagctcggaggaaacccgtttcaggtgcttcattgccagcttcaccgactggagttttgatctggctgacatgcccggtgttctgcttcatccactcccacgggatctg

SEQ ID NO: 12720 - DNA, 210 bp, Zea mays
  Clone ID: LIB3279-208-Q1-N6-E4
ggccttggggcattgactgatgtaaataaataaaattaatagtttagtacagctggtaaagaaaagggtatgaataaatgtgtgtaactgggcccaactcctaaatgaaacctttgatgacaaaggtttggccgctccgtggctaaccttccttttgtcaggatttactttcccaaacaacttggttttggcaataagtttggactcctg

SEQ ID NO: 12721 - DNA, 599 bp, Zea mays
  unsure (1)..(599): unsure at all n locations; Clone ID: LIB3279-208-Q1-N6-E5
actcaaaacctactgaatgaacttcccttcagctacagcaagcaactcaagacgcagcatatacaacgatggtggagcaccagcgcaatttcctgggcacccaccgttacatgcagaatagtttgcttgaaaggatggtgcacaaaatagtttgccattcctcctctctgaggttctgctaagaagcatgttgcgtttgaagatcgtcggatttccagacgacgtccttcaaggtcttggaaaggttcttgtagaacttatgaaattccagagtgtcaccctttgcttttcggacttctaccatgtggagagagggcgcaacttgcagtatctcagtagcaacgttgaggtttcccttcctccctgcctttaccttttcgagcctcaacttgtaatttttcttctgaacatcaaatcctagaggttttgcagcttcctcgatcttgcggacaatttctttggggggacattttgatgtaaaccttgtttctcttttgaactcctgctctgagtcaaataagtttccaaggtttaggcccgctgacatcgaaatcagttcgaatgcgttcagagctactggntcttcttctttcttttct

SEQ ID NO: 12722 - DNA, 586 bp, Zea mays
  unsure (1)..(586): unsure at all n locations; Clone ID: LIB3279-208-Q1-N6-E6
ggccaatacatgatcatttagaaacacacaggtacatgcacatatagctctatgcagtgaagttctgtcacggatggacacttcacagccatctgcactgagagctctatatccacgtttactacaccgtagtctcagtaaggaacgatgatggattcaatgagctcctggagtggagccagctccttcttgtcaatcaggccaaactcatttgtaaacagaatgaagtgcttgaaacaggtattgagatgggcctcctctttaaggctaacaatcttctggaaatgagagtggtagatgtgggcataaacacgaaacaagcgcttgaatattgtcttcactacttccttgaagtttggtgggaatggtgtgccaagtttttgaggaaatatggattcatcgtcaagctggccttcaatccaatccatcagatactccatatanttntggtgctgatacctctatggggtttctttatctgcacaccatcagcccatctgtactcatactttgngccagctgtcattgtcgggcagctctcaagtgtgcagaattctgtgagcgtgccatacagcatattaacttg

SEQ ID NO: 12723 - DNA, 522 bp, Zea mays
  Clone ID: LIB3279-208-Q1-N6-E7
gagcagtaggtacagaaacgcacataataaataataatagtaataaactaacaccaatcatactaaatcaaatccagcatcaaaaagaaaaaactctctaaacgcccagatttatccatccatccaccacgtggaacaaaaccaaatgcctcatcttcataacactatcaccaccgctacgatacctgcgactaacattagactgcaactctcactaccactgtaccactagatctgaagacgcgcacgcagacggggcggccccaccgctcagtggcggaggaaagcggcgaggagcgccgcgaggcagccgacggagagctgcgctgagagggcgcccgcgccggacatcggggcgggggccggcgcctcggtggcggaggcggctgtgaacagcgcgtcaacgacaacggcggcggtgatcacggcggcaacgacggcggagatgcgggccatcgaatcgatgcggtcggacgacgaggtggcggcgtcggagcgagggcagcttagcggacgcgtggg

SEQ ID NO: 12724 - DNA, 563 bp, Zea mays
  Clone ID: LIB3279-208-Q1-N6-E8
ggactagagctcaatcgcttttagaaaagagtgtactaatcaggtctgaaaacatggcataacgctctgaacttgagacgactaaccaaaaaaagtgtactcatcaggacacacatttcggtgcaagacaatccatgagaatgctctaagctacagcgctcttgcccttcttcctctgtagcttcttcatgtagaactcaagctctttaccctcaaggatgtacccatcagcacggccacactgtccagggcgggaagaaatgcatgccagcaaccgtccactgccaaattgctcctcaatgtgtgggtcaagggtacgtccctccttgcgcttctcaagcttcctcgtgacatggttgctctttttcgtttcctcagctgctgcctcaacctcttgtccctcagcattatccttctttgcagcagggggttttcttcttcctaccaatgtcaactccatagtgagtgaggtaccactgcttgaatggggcagcatcaacttgcacaatggcactcttcacaagggttttgtgtcctcacaagctcattgtttgatgcattgt

SEQ ID NO: 12725 - DNA, 594 bp, Zea mays
  Clone ID: LIB3279-208-Q1-N6-E9
aaaaatgccaacatttggcccaaaaaactaaaatgaatttgcatccgtaggtttggtaataacgcatgcccataagtttagagttcaaatgcaagaaaaaaaaaaagagtaatgcatcacagtcgtttattttacagatggagatttctaaatctcaagtgccattcttgtcttcagtggaacacgtcagctcttactgccttccctgccagtttccttgtccttcacctgggctaggatactgaccagaacctctttgccagttatctccaccatatgctggtccagccccctgtctgccatccccaccataactaggattcacaccaggaactctgttaccaccaggattcactgatggaggtacctgcccatagttaccaagtgtattaggttgaccataagatccaggtgctgatggttggccataagacccaggtgctgaaggaccaccaggcctaaaacctcctccctgcccttgcgagaagttgctacgctcttgggggtttgttgtaaccttgaccttttgccagctgatttacatgcccttggtactgagtttgacttcgaaatcaggtggtccattgtagcctg

SEQ ID NO: 12726 - DNA, 569 bp, Zea mays
  Clone ID: LIB3279-208-Q1-N6-F1
gctcaactcgttgcatacactcaacgaaacacccaacggtgaatagcaagtgatttcctcacatggatccccttcaattcacttgtcaccaaatcaaccctcagggctactttgggaacctcatatccccttcgatattggagaagattgaggtggaaataaattaatttcctctccaatccccttcaatcccgaaggggatttgagtttccaaactagcccttagaggtactaatttccccttttctcatttgtttcaactttcgacaaatagaccgaggatacaaggccaaataaaagtacaatagcattttgctttccctttagactacatacaaatcatggtattctagatttgcccaccgaagacataattatcttctagagaactttgacaagaggtagacaatgaagaagcaaaacagtgcaaagagaacaacatggagaacatggtttgagccctgctggatgatgctcttgttcaacctccgcatgttgttcttcactccagcctgagcttttgcgagggtcatttgcagttcatgaagaaaatcattctgggacttggc

SEQ ID NO: 12727 - DNA, 581 bp, Zea mays
  unsure (1)..(581): unsure at all n locations; Clone ID: LIB3279-208-Q1-N6-F10
aggaaagggcgtattattattattattattatcaggcagtggctggatcatctacatccagcgtgaagctcaaatcctaattacacaaggcctcatcgttgcttggctgctccaaatccattttgatcaggaatgcgcgcgcgcccagtgtggtctgcagggcttcctctgtgtctacactgaatcaacgccttcttcctgctggcgagcgaggtatctctctcttcgttccttccattcatcgatcacaaggccttcgccgacaatacgggtgccattgtcctccggaggcttcttgcgtgcctccagcgcggcttctgcttcagcgagctggcgcttgagtttgtccatttgtgggctcgggcgctcagcgtccaagaataccacccgcaaaatttgctcgactgcaacctggtccttctgctcatcaaacaattcagggacatactccaccggccctttgactttcaggctgacaatcttgaacttaaccttgcacttgtccaagggcttctcgttgttctccggatgctcaacaaacttgaaaactgttgctatgatactttcccctgnagcaagta

SEQ ID NO: 12728 - DNA, 313 bp, Zea mays
  Clone ID: LIB3279-208-Q1-N6-F12
gacgacatcaaatatcttccaaaattcaaaccaggacaacaaattgtgctactaatctcggtacagagtgatgactaattactgtcgactgatcaaacacaacggttgcactatgctgatggcaacacggagggccacaatttgttttaaaccttgaatccacgggtgttcctcctgccacgagccttctcgaacttccttcccttggagcgcacatacggcttggtgtggctgtgcggcactccaagagccttgccaaagtgcctcactgcctcacgggcattcttggggcccctcaagaggaccgtgttct

SEQ ID NO: 12729 - DNA, 277 bp, Zea mays
  Clone ID: LIB3279-208-Q1-N6-F2
aatatcaaaagacaatacaataaagacgtaaagagagtggagtaaatttattacatcatctagacataaatgtcttaaaaagtatcatcatcgaagtacagcggataaaacatggacgctcttccacaggaagatgacggacacatcgttagacttagtactcgtcatcatctgcaaagtcttcttcatcaccctcttgctcgaacgtgtcctgcgggtcgtcttcgaacgtgtttggttcttctaccacacagtcagcttctacttgcgacgatcg

SEQ ID NO: 12730 - DNA, 447 bp, Zea mays
  Clone ID: LIB3279-208-Q1-N6-F3
cagtccaaaggcgcgcatacattatacatttttttactattacataatgtaaacacgggataaaaagatcaagcatgggtcactggacatttagggggattcatgttcttccttattcgaggaagtctcacataagttgcctacaataaatacacgcgtttcaagggcaagcagtacgttatacccccacagtactattatactagtataatatttacagctgaagcaatggctacaaggcagcgtgaataaaatgcacacgcatatctggttagcactagcagcccttagtcctgttgtaatctggaggcagggatggacatctctcgttcatgtgggcatagggtttcatggtgttgtatccaggcagctccatccggtacttgcccttgatctggcaaaagggaagcttcacatcgtcatccttgttgcaccactccggaagtc

SEQ ID NO: 12731 - DNA, 503 bp, Zea mays
  unsure (1)..(503): unsure at all n locations; Clone ID: LIB3279-208-Q1-N6-F4
aaccaaatcacggggcagattttgcagcatgtatcgctttctttcccttttaaaacttaaaacttttaattacatggcacatcagctcaggcccgaaaccatttgttacaacaaacattattccatctgtatgattgtatacaggcacctcgcattaccagcgcccgttagcatggcggcgccacaaggagactccattcacaccatttcccagactggggtagtccgcaacctgggggtggtatccatttgtgttaaccccaaggctcatcaccgatggactgggagagccattcagccaaggctttgatgcactcacgtcagacaggccattagagtagctatccaacgaggcaaactgccgttccctcaacccgttgaccgcatttatgtcataagcccccgagaatccaccgncatactcatacttggttgaattgaaccgagcaggacttctaacagaggccattcccatatctgacacgtttcctcggacgcgtggg

SEQ ID NO: 12732 - DNA, 513 bp, Zea mays
  Clone ID: LIB3279-208-Q1-N6-F6
gacactgaaaaactcaagattttattagttgaaagtatcttatacaatccaagctcctgcaaatttgcagggctgaaatgcgtgcacttgcttttcagcctataatcaagatgtacattttgcgataagcagacggttttctggtgaaatgctggatggaacatagcttacaagatcagcaaccagacccttctgcccaagccatagtagcctccccgtatcaatgatatctttacacatggatcccagagtggccctctcccctgctggtatacttcggattactctctcaattccgacggcctcctgatcaagcttctctcgtcctctgacttcagaagggcgtgtcttcaacctccacaggagcatctgggtagctatgatcaccatccacagcccagctgctaaaccatgtcatggcatgaaaatcttcttctgtgatacctagtcccgagagggaagattttattcgtgtaatgctttcactggcaaagatggtggcagcaggtagct

SEQ ID NO: 12733 - DNA, 526 bp, Zea mays
  Clone ID: LIB3279-208-Q1-N6-F7
gacaaaatagccttctcatttcacaacatgctacagccaatccgggtgggttcacatccaggaattacaaaacttcacttactggtgagtgcggaacaaaacctaacacgaccattattttgacattgcaactagaccaccacccagagttcaggacagtaatacagaaatttaaatgactgtttacttttttttggcgtcaccagccttggtctttttgacaccacggatctttttggccctgttcttccgctctttcatttgcttgcgggacttctcaaccttagtagcaagaccattcctgatgaggcggtatttgggctcgaactttttggcagactcgaggttatcgtaaatgaggcccaagccagtggacttgcctccaccgaagtgggtgcggaacttgaaaaccaaaatggtgttggggtccttcacctcgtacatcttggcaagcctttccttcaactccgccttggagaccttggcgcggccggggtggataacctcaacacaaattgtttgcggg

SEQ ID NO: 12734 - DNA, 596 bp, Zea mays
  unsure (1)..(596): unsure at all n locations; Clone ID: LIB3279-208-Q1-N6-G1
gatagaatggtagttgatacggcaaattatcacgagcacagggtgcaatcttaagccatcagaatacaataacagcttttgataattgtgatgccgtttcctgacaccgggcaacaccaacttaaaggtgaccatatatggcgtggacggcaaagaaaaatagacaagccggtaacagctaacacagttaaaacctcactgtcaatacaagagtttggtcattcttatttcttgttgcagcaaataggtctcaagggaaaaggaaaatcactgaaacaaccatataactcttttaagcgtgcaccagctcctgaaggtgtgctaatcagggctcagtggtggtccttcgtctcaaacaagccatcagggccccatgggaactccttgttgcggatgtgaagataggggtacgccggcggctcatcgaagtgggggtggcccttggacaggttgtacgccgccaggagggtgcaggtcacgatcccggcgtaggtgatcttctcccacttggccgtctcataggcgtcgtcgtggacggaggaggacatgcggcgcctcacggggcggcgcgcaccgncagcgaccggagaccggat

SEQ ID NO: 12735 - DNA, 459 bp, Zea mays
  Clone ID: LIB3279-208-Q1-N6-G10
catcaaataaaattactcttataagttgcaaaaaacaaattgcaggatacaatttaacaaggttccataactgcaagattatcctagggcaaaacataatttcaggaaactgtcccaacaaaaacccttcattaaaacagtttgaacaagaacaaacactagtacatctgaaatttgtcgatagatatgtagcttatcgcttcttggaaacaccaacagtttttccacccctgccagtggtcttggtgtgctggccacggacacggaggccccagtagtgacgcaaaccacgggggttcctgatcttcttgagcctctcgaggtcgtccctgagcttcatgtcgagggcgttggaaacaacctgtgagaaccttccgtccttgtaatccttcttcctgttgaggaaccagtccggcaccttgaactgcctagggttggccacaaccgtcatcaggcgct

SEQ ID NO: 12736 - DNA, 592 bp, Zea mays
  Clone ID: LIB3279-208-Q1-N6-G11
tcgcgatctaggctaaaccctggaatcattaaccatgtgagaaatagcaagcaagtttactccataataaaggctatggtacactctgagaggcttgagaatgagaagcagcctgcatttactagtcaaacaggtggaagagggagagaagccagtgagggaattcaggatgagaaatatggtgctggtttcaagaagtgccatatgttgatgaaagacaataatgcggtgtttcaccaagcactgcctaccacatcacagttccttgcacaggacggcgataggctcaaactgcaactctcatcagcagtcactatgtcttcagacagggcctgcagtacatcagctgatgatccagcaactaatcatgattacatgactgtactgtcagtaaaagcggccactgttgcttctcagtggttggaattactgcatcaggacatcagggggcgcctcgctgctttaaagcgcagcaggaagagagtcagaaatgctcttcatacagaattgccttacctaatctcgacagaattttcatctaaccaagagaacgaatcatccattgcaaatacttgtgatgctgggatgtact

SEQ ID NO: 12737 - DNA, 499 bp, Zea mays
  Clone ID: LIB3279-208-Q1-N6-G12
gaagaggacagcacgacaaaagagtagcagggatttcgatagatgtttttttcccctttgcgacacgactgactccactccttattacagttccagtcaaaggacgcacgattgctcttatcaaccgcgacaacaaaattcagccatgacaaagtatctacctatagacatcaaaatatccccactgctttcgtatcaaggatggactgcaaaatgacaaggtctaggcagatgcagggccttgctgcctgaagccattgttgcgctcgaccctcagtccgttcccattgctgttggggcgtcgcttttggtagccattcccagagtagtagccgtggccgttctgatggtagccgtggccgttctgagggtggccgttcccttgcggtccacggacaccacctgagtagtcgttcctcatgttatcccccccgttgtagtaaccgttgttctgaccgccccactgccgcttgtagccctacccatagtaaccaccacc

SEQ ID NO: 12738 - DNA, 430 bp, Zea mays
  Clone ID: LIB3279-208-Q1-N6-G2
aaaagaaacacacaccgtccaattgcagccacattcatatttatttccgagacatttaaaccaaaccaaacagcgtttgcaaagaccacccgtaaccagaataccacgtcaaatatatggtcatttctaaacaacaaccgctgcaacaagggcaggtcttttttttccctggaagaagcagcaggcttggagcacgaaaaccagcatccagccatcatttatcaacttgagaatcgaaacatagcatgcgggcataacatctagagtgtgtgcttaattaaaaacagcggcaaaggcaatggcaatggcaggcagcttcagcgcacgcgcaccggcgccgtgacgaaaagaacaacacgaggtgtactagaagataagctatcagaaatcaagaacggcacagtcctggtaaactccccgacatcagccg

SEQ ID NO: 12739 - DNA, 610 bp, Zea mays
  Clone ID: LIB3279-208-Q1-N6-G3
gagactcgtgggaatgaacggccatgcgtagctgtccacattgtataggtaacgtgacgcctttcttcgaccaacccaaccattttcacagaccgagtttttactagcaaaagctgcaagtataaaatgtaaaaaaaaatctccggctccagcggtggtgtctataaccatgctgcctaaacacttatcctctactctgtgatctgttctagaaatagggcttcctgcttgcttgttaggccaagatcactgaacgatacgtccccctcactgctcgtaaacgtgcgcctcgggtaagtcctcaccaatctgtaggtccctggcttgcaaatcctcccaatgtctaagaaatcaaataggaacttaagtttatcagttttgagaaagcaacgcccctgtcgactgccatcaggcatgcggactacaactgtcacggcaccctctgcgtctggaggcggttctgatggtaatgatgcttgcttggaagcgagactggactctagctcctcttcctcaagttgctttttacgcctttcctcctgctcttgcttctgtttcttaagagcagcttctcttgtagttgtttcttctaggcgacggagctcagcat

SEQ ID NO: 12740 - DNA, 587 bp, Zea mays
  unsure (1)..(587): unsure at all n locations; Clone ID: LIB3279-208-Q1-N6-G4
gaattcacatacctgcattttttaacctaccgggtatgagaaaacagtgaattcatgactactgacaggtaacagctagttaacaaattctgagtataataaggtccggcaaagtctcaacctacatatgccattacattgtattaaatctaggcagagcagccattgacaagtacagcatggtactcatttggtcgtgtaaccctgcctgaaggggtttgattgactaaacaagtaccagattcatgtcaaccctgcgactcccgtaagcgagcaatcagttcatcctttttgcctttggtcgatcgaccactttgtcgtagaagtgcacgcaatctctccactgtaaatgactgcagntgtgtgttgtgaaaagccagaaatttcctcataggctgatgatccagatgaagtacccaagttagccttctttgctgaattgttgacatccaaacttctggcagcagatcttttccctctgttgttttcgccgacagttctggaatccacatctttgccctcagtcttctgcttgttaactggagatgcctgattaaatattcgttgaatccgtctttataacttgt

SEQ ID NO: 12741 - DNA, 495 bp, Zea mays
  Clone ID: LIB3279-208-Q1-N6-G5
gtccgaaatttatatatatcatctcagaagatacatgatattttatgaatctttacaagttcaatgctaaaaacaagaatataaacttgtatagtcgattttataatctatttatttacaatcaaagaaaaaagacccaaagctggtttccgaataaagtatatgttttcatccctaatgccttgtagcttcccaggtccagcagagttagcagaccaacacccccaagggaatctggtaccggttcaatatgataatatttctaaatagtacaacatttattattttaaaaaagtatgatatttgatatctttaaataactcatgataaacgactcgatagtgaaacttaaggcgggggggaagcaaaaggaggagtttagcttagaagatgacttaattagcttgtgctaaatgttatgcttgtatttaaaaacatggatggagaatatatggacatgttagtgagattgggacttgtttgtttcggcttttt

SEQ ID NO: 12742 - DNA, 520 bp, Zea mays
  unsure (1)..(520): unsure at all n locations; Clone ID: LIB3279-208-Q1-N6-G7
gaaaattcaaacaacatctaaaacatcttacccaagatgctgtaaatttcatcagtatatcataaatagccttccgctaaaaggaggacgaagcagaagcgtgtacaggtacaatgtcggtgtcatgacatggtgctgctagcgcaactgcatgtatcactggccatgccattcctgttgcggatcaatggttcgtgtccaacggaaatgctgatcgcctgagtgtgatctgattctgatcctatccaaatagccacgcgatcttgtcgagcacccagtcgacagcctctgcgagcccgccgccgacgctcatgtcggtctccggatcaaacgggaacgccggcgccggcgcggtggcttccagcagccgctccatgggcatctccggcgcggaccgctctaggggcttgaggggccgaccgtaccggtccgcatcagggcagtaatccaggtcggcgtgcattttccggacgaatgntccggaaatccggaaagttgttgctcgccaggagctcgtccg

SEQ ID NO: 12743 - DNA, 599 bp, Zea mays
  Clone ID: LIB3279-208-Q1-N6-G8
aagttgagccagactcaattgcttctgttccttctggggctggcttggcttcttgagtttcctaaaaggccttcctcggatgcgatagagatagatcgcttttctttttaataattctttccccgcaagctcaacagcggaaccggaccctggccttaatggatcccaatctggcctgccccaaagaatggactgtgccaattggtcacttggctgagactaccatatttggaaacctggcctagattagaaggatgccaacaagggatagttccggcactttctctacttcaatacctgcttcttcgcctgtccaaaactaatatctctgttggaaccagtgctgggattcatcttcctcatattcattcatctacctcgcgccggagaccttcacaagctcactagtatagatcagatctatctggccaaaggataaactagtagctatatgaaaacctgcacccgcccctgctctgtaatgtttcccgaggaactgctttcagtatcgatagaagctcgagtgttcacatgcataccactactatccagcatcaactggacctgcacctaagagaaagagagcgcagatcactcac

SEQ ID NO: 12744 - DNA, 121 bp, Zea mays
  unsure (1)..(121): unsure at all n locations; Clone ID: LIB3279-208-Q1-N6-G9
nnntnnnnnnnnnnnnnnnnnnnnnnnnntagccatataatgagttcttcatatctcagatacactccacattaagttcaactcccatcgaagctcaaagcagttttatagtaacataaaa

SEQ ID NO: 12745 - DNA, 448 bp, Zea mays
  Clone ID: LIB3279-208-Q1-N6-H1
aaagaatggagcgtcaataaattcaaaatcacataaaatcggcccactaaattttataagcaaactgcgcaccttacacttctctactacttattaaggcagcaaggggtaggctgccagtacctgttctgccattctgattccctgttctccctttctcattcccctgtcttgcgccggtgcctttcccattccccttttttgtgagggctgacattctcattactttcctttcccattccccgtccccttttttgcgcccgctgccattcccattccctctttttccctttgcctttcccattcccctggttctgccaacagccatccagccaataaataaaatagccaaaaaagacgccacatagtgatcgaactctgaccaacacatacagcaaacacaactcatcccttctaaccaatagcactcatgttgtttcctgctaca

SEQ ID NO: 12746 - DNA, 322 bp, Zea mays
  Clone ID: LIB3279-208-Q1-N6-H10
aagatccatatattaattacaggcaccacccttcaatagaacaaagtaagttcataactagtgctggaaaccagctgttacagcataaacatggcgcgagttgcgaacttgattcctctccagtctccagggacctaactgacactgatttgcccaccaaatgcatgaaaaggcacaatgagtcaacattccaaggtagctgcccctaagcatttgggggccagagctttggatcttgagttgtgtccacgatggtcgaaggcaaccactgccacatcgccattccagggaacggtgctgggattggagcacttttgttggc

SEQ ID NO: 12747 - DNA, 380 bp, Zea mays
  Clone ID: LIB3279-208-Q1-N6-H12
cgataggtcttacaagacaaacaaaatcaccaaggatcattctgttcctgttaaaatatcgaccacggttgtaaagtttttgacatgtattatgtcctgatgccaccttaaatgaaagcatcatgatacagctgccagctaaacaccatcgtaactctcccgtagaatgccataaccagcaggagaaacgaaaaatgacagcttcagccacgctgtttttttgagctaggtaaatcatcgtcgtagtgaccgccatctttcgccccatctttctcgccctttttcctagccaggatcttgttgatcttgtggaggtcattagtgagcttctgatccttgttctgctttctcgtctttctgccgccctgcatctttacccc

SEQ ID NO: 12748 - DNA, 337 bp, Zea mays
  Clone ID: LIB3279-208-Q1-N6-H2
agactggggaacaaaaattttttttaacctttggagcacctcaatgcatgagccatggaaagggggggcgcctgccgcaaaacgaaacgaagcatggtgagggagctgccacacattgaaaagggggtagcgccagcgacctgagcccagtggagatcaaatgcaattaaccgcgggtggagatcgataagggggaaggattattgttggtgccccgcgagggattttttcgaacactttggcagcggggcacccggcctgccccaaattttgttggtcacttttcccgcgatcgactggaaaggggtgctagtacattttgtgggcctatttggtc

SEQ ID NO: 12749 - DNA, 607 bp, Zea mays
  unsure (1)..(607): unsure at all n locations; Clone ID: LIB3279-208-Q1-N6-H3
attattaacactatagcaaaggaatttacccactttccgattttccatccaccgtagctgtaaggaccatacttttccgttacataaaggtgcatgtgcatcaacaagggtacttacagcagcttggatatagttgggagtactctttgaggcagttctttcgatgtgtgatcacctgttgccaagcatttagcaatgaaagaacctgctactgtttaatcatctagataaacatgagcatggttgcaaaatgtctgtattttgaactttgcatgtattgcaaattattggcaaaaagcagtggatagtactgaatttttatctttgcatgtaatctatatagacactatctatctactatgtataaccataagtaactatactgttgcttcacaatctgaacttttgagaaatgtgctgtagggtgccacgaagcacgcctgcattccttcaccgcagaagaggttttgctatctacagcgacatgtcaccaccaagttcatcaatggctntatcaagcttgagcaacatatcattaaaggattcatcagccatatatgtctttatccgtgccattaggtcatatgttaatatactggcatcaact

SEQ ID NO: 12750 - DNA, 526 bp, Zea mays
  Clone ID: LIB3279-208-Q1-N6-H4
gagaaatgtgaagatctctctgtagattctcgtatgtatatgtgctggccatctccagcagagaactgttttgcacagagtagagtttgaaataaacggtgagataggagtacggagtctgctggagatagtcttaggtgcgtcttattcttcaacattttgttccatgactagatgccgttggagtgttacaaagaatgactgatgcagacctgaacttggtgcgttaaggtgccatggctaattttgcgataaatacccatctttagtatgctctgaatgtggcctggactacaagaacatgtagttaatctacactagttggggtttacccagcggtggagtgcctgatatggctcacgccataccttcccttcacccgcacgccgaaccccactcttgtttctccgcagcctgtgctcaccaccattctagctctcctctccagctccatccgcagcctgtgctcgcggctcgccagctctgacactgagctccgccttcttcaatctcctgctcctgtatg

SEQ ID NO: 12751 - DNA, 531 bp, Zea mays
  Clone ID: LIB3279-208-Q1-N6-H5
acatcatacgaacaccacaggaactggaactcatgacatccatacatagattcagagtagacaccaccagtagacccaacatacgcaaagtttgtgaccacattccaccatcctacgacattacgatcatattgacaaacgccataattcttgtaacccaattttatttcacagaacgaccgaggcgaactgccgttcctcaaaccacgcaggtacgacgaccgcagaccgaggtctagccggagatctgaatggacttcacttcaggcttcttggcgtcctccttgggcacagtgactgtaagcacgccgttctccatggcggccctgatctgctccgtcttggcgttctcgggcagtcggaacctgcgcaggaatctcccgctgctccgctccacgcggtgccaggtgtccgtcttctcctcctgctccttgttgcgctcgccgctgatctgaaggacgttgccgtcctcgacctccaccttgacctcctccttcttcagccccggtacgtctgccttgaacacgtgcg

SEQ ID NO: 12752 - DNA, 572 bp, Zea mays
  unsure (1)..(572): unsure at all n locations; Clone ID: LIB3279-208-Q1-N6-H6
gtaggcaactcatcaaaccgcgtccattccaaaagcaactccaaataattgtacaaacatgctgaccccagccatcccagataaacatgcgacttaaaataacagtctatcaaccaagaaaagctatgtagatgactgacgactctgatttcaccgaacacaaacattcatctcggagaaaacacaatgaaaatttgcggggaagctgaaccttggaaacgaaatgaatggaatggcatccatttgacccttgtttgccttcaaccttcactctttatcatccttcttatcatcggatgcaggagcctcctctttctctgcattttcctccttgctgggctctgccactgttaacttctgtgccaaatcagaagcggcagtggagacttcatcattttctttctcctcgctctttccttgctgttcagctatctcttcaacagtgtccttgaacttcttgcaattctcgacagatccaaaacggatagcanacatctcctctntgagctcgccgtcggcgaagtccagcgcgtgccacacgcacgactngtcgctccccgcgtgctcctgca

SEQ ID NO: 12753 - DNA, 602 bp, Zea mays
  Clone ID: LIB3279-208-Q1-N6-H7
aacaaataatcatacccgcttctgtgtttatgctttaaacaaattcatcaacaaataatcataccctgctcagtgctcaaataggaactattgcagctagcgaacagggcaaataaacatcaccgcaataggacaacagcagaaattatcaatacattggactagagctcaatcgcttttagaaaacagtgtactaatcaggactgaaaacatggcataacgctctgaacttgagacgactaaccaaaaaaagtgtactcatcaggacacacatttcggtgcaagacaatccatgagaatgctctaagctacagcgctcttgcccttcttcctctgtagcttcttcatgtagaactcaagctctttaccctcaaggatgtacccatcagctcggccacactgtccagggcgggaagaaatgcatgccagcaaccgtccactgccaaattgctcctcaatgtgtgggtcaagggtacgtccctccttgcgcttctcaagcttcctcgtgacatggttgctctttttcgtttcctcagctgctgcctcaacctcttgtccctcagcattatccttctttgcagcaggggttttcttcttcctac

SEQ ID NO: 12754 - DNA, 535 bp, Zea mays
  Clone ID: LIB3279-208-Q1-N6-H8
ctacaaaaatctaatgcatttgccaaaattatagtagtcagtcaagtttacaaaagcaacgttccagctgtgttatgttacggagacaacgatagatggaacgggtgtttcagaaaaaaactacccaaaaaatcctctacagtttgcacgattaaacacatggggaaacatggatacccttggctggaagagaaggaacattttccagcatagcctggccaagatggtaacgaaaacaaccttcaccaccattaaccgcaggaacatggtcatcatatgtcgatcttgattctgcccacaaggctacacctcttggggagcacgtatcagtctcatctgcggtgacacaggtgaatacatgatgttccaaatcaagatatgcggctgacagaacaagtctaccgctatttcaaaactggttacaccaccacgtcactcctcatacatcttgtgcttttgatcagaattttctcctccatcttgttcggcgacatggcatttgcttcctccatcttgtccggcaacgtgacatttg

SEQ ID NO: 12755 - DNA, 582 bp, Zea mays
  Clone ID: LIB3279-208-Q1-N6-H9
gtgttataataatttcgatgctttactcccaaaatttatacggtaatacaacgtaatagcaagcatatagatatataggctatggtcgataatacatgtttttgttacttgagcatcttcttgtagtccttgaaagtgcccgagaacggggtcaccctgccttccgacaccacccaaagctcgttcacgcttccagtgataagatgctcatcgtgactcaccatcagcacccctccctgaaaaatgagtaaaccctggatgagcgcctcaacagcgtccagatcaagatggttagaaggctcgtcaaggagaatgatgtgcggcttcttgaaggttattttcgcgaatgcaaccctactcttctgaccacctgataaagtgtacatagattggagggcaaggcttcccgaaacaccaaacgaacccagatgtgccctcaacttctgctccggcacacccggatagcacttcatcatgtacaaaaggggattcaccgtcaaatcaaggccatcaacatgatgctgattgaatacagccatgcgaaccttgggagagcgaaatactgttccagaagttggctgc

SEQ ID NO: 12756 - DNA, 637 bp, Zea mays
  Clone ID: LIB3279-209-Q1-K6-A1
gttcgctcacgtcccggcgacccctcgccggtggccacgggccgtgacactccggcatgccgcgcgccccacgccggcagtccgacgaggcgcgccgtggcgcctacaagccgcgcgtcgacttcagccgctcgcgccgccgccgcgaggacggcctcctcgccctccgccgcctcaaccgcgacacgggactcttcaagcgccgccgcgacgagcccgctcccgccgtccctgcctccgatctgactcctacacgcgccgaaacagccccattcgcaggaatcacccgtccggcattcactccctcctcaccgcccgacgtagcggctccccgggatgctgctgagtcagagttagcttgaaggcctgtcagagctggtcgacaaactatgttcagatgacaccaccagtcagctcgaagccacaatccagttcaggaaacttctttcagatgagaagaactcaactgtgataaaaatcatccgagcggatgtcctgcccagatttgccgagtttctttcaagacatgggcttccccagctccaaatggaggcagcctgggttcttaccaacatagctgcatctgattatacactgctggttgcagaatgcggtgctgttccaaggttggtggaac

SEQ ID NO: 12757 - DNA, 651 bp, Zea mays
  unsure (1)..(651): unsure at all n locations; Clone ID: LIB3279-209-Q1-K6-A10
ggnatccagcaatgggacacccagtacctcagctactccgagcaccaaaggggaaaactgccggcaaggttaccaaagaacacctaaaactggccccaaccttaaaaaagaacttgagaagaactccaaggacaaggctaatgtttcaactgggacaaaagatgataagagtgtgagcaaacctaaggaggctattatcaaaggcaaggattcaaaagacgaaggcaagtccactgaaggaaaagctaagcctggtcggaaaccaaaaaatgctggtactcctgcgggtgattctgacaaagagaagcaggaggtagaagtcaaggcagctgaaatagaggaggcatcaggaaatgcttccacagggaagaagcgtaggaggaaggcttgaagttagcgctgatgaacttctcttgtaaatggatgtgctccctcctaggtttgctcctttaggaccttgtattattgagtgttaacttggaatttcgtctgattggtccctagtagttagttaggtgtggaagcaacatttgctatagccgtagtgttaggagtaccatgtgttcgttgtggtcaggtccatggtgcattggtgctgagccttagcggaatgaaccctatgctcgctgtgaggcccatggcatcgtgttg

SEQ ID NO: 12758 - DNA, 640 bp, Zea mays
  unsure (1)..(640): unsure at all n locations; Clone ID: LIB3279-209-Q1-K6-A11
cccggcagccgcctcctgactcagtcggtgggagctggaggtgcgagctgacggtccgggttaccgaccgggcagcacggcggccacagcggaggcaaacggcgggggcggcgaccccggggccgcggcgaggcggcgctgggacctgccggccggaaacattgcaatgggngaaagaagttgttgatatgtctactgatgaagaatcagattgcgtagttatgtgtccacctaacagaaatgctgatcatgaggaagctgtgagtggcagccatgatgaagattcttcaggaaggcaagagaacccttatgctgtgaactcacatatgaaaacccgtggccaggaagatgtgtctgtaaacccagacctgctcaagctgattcatcagcaggagtcttctgtcagcaattcaccatcaaaacctgcaggagctagacagcaagggtctagccatactgtccctgagtcatgcactattgcacctgaaagcaggtcatctggagcaggaacttgtgctccaatttcttatcccaccagcagcggggaaaaaactttcagatataagtagctcctcaccaagaagcatgacaaagagtccatcagtcacatgcaggaagcctctccaatctgacaatactt

SEQ ID NO: 12759 - DNA, 596 bp, Zea mays
  Clone ID: LIB3279-209-Q1-K6-A12
gtggccaacgcctgcggcggcggctgcccgacgccaacgccgccaaccccgacgccgccgtcgccttcaaccggtggcaagtgccccaagcacgcgcttaagttcgctgcgtgcgccaacgtgctgggcctcgtcagcgccgaggtcggccacccgcccgccgagccgtgctgcagcatcctcggcggcctcgccgacttggaggccgccgtctgcctctgcaccgccatcaaggccaacgtgctcggcatcaccgtcgacatccctgtcaagctcagcctcattatcaactactgtggcaagaacctcccaagtggcttcatatgcgcctgatagatactctgatagatagctgcgcgtgtgacgtacttcgcatgcatgcagcccatgcattggctgtctccttctacctttttcttttgtctttgctttgtcatgttagcttggttctgaatgtagaagtactctagacaatgaagctagtgtgagtcaaatcattttcttttttgagtgaagcgtgttgcgttgcgtgcctatattatcttcttcaaggtctagataggctagctaggaactgcatgcagtgctatttgtct

SEQ ID NO: 12760 - DNA, 638 bp, Zea mays
  Clone ID: LIB3279-209-Q1-K6-A2
ggcggcggcgtggccgcgggctacgccgcgctcgagttcgcccgccgcggtgggtactcccgcggagagctctgcatcatctccgaagaggccgttgctccttatgaacgtcctgcactaagcaaaggctatttactcccagaaggtgctgctcgtcttccaggatttcatacttgtgttggtgctaatgatgagttactgacaccgaaatggtacaaagaacaaggcattgaacttgttcttggaacaaaagtgatttctgctgatgtgaggcgcaagacattgcttacaggcactggtgaaactatcagctacaaaactctaattattgcgacaggtgctcgggctttgaagctgcaagaatttggaatacaaggttcagatgcttcaaacatatgttatttgcgcaacatcgacgacgcggataagttggtgagtgtgatgaaatcatgtcctggtggaaatgctgttgtcattggtggtggctacattggaatggagtgtgcagcggcattggttactaacaagattagggtcaccatggtcttccctgagaaacactgcatgggtcgtctatttacaccaaaaattgcagaattttatgaaaactactacacctcgaaaggggtcacctttgt

SEQ ID NO: 12761 - DNA, 425 bp, Zea mays
  unsure (1)..(425): unsure at all n locations; Clone ID: LIB3279-209-Q1-K6-A3
ccccgcgtccggnatttcgttgatgcccatgtgaagctggctangagcaaagcgcacgaanaagactacagggggtgctgccgacggtgctggtggtatggagttggttgccaccgttgctgcgctgcctttcgtctccacctccaccttcctctgatattgaggaagagtttaggtaaagtctgtcttttatagtagcattgccctatgctactgttcctttttttttgttcaatggctatgttaaaacattgtaattccattgtggataatgctatgtttcagatatggacaatcacaagattgttatgctttatcagagatgtttttaatgctttaacttatgaacttaagaatgggttagtctgttccaagtataatctgctggagcataacaatcctttggcacctctagcttgtgcttg

SEQ ID NO: 12762 - DNA, 620 bp, Zea mays
  unsure (1)..(620): unsure at all n locations; Clone ID: LIB3279-209-Q1-K6-A4
gtcacattgcaaactttagaattgaagccagaaaaggacggcatgggtttcattggtatatgngaagatcatattgattaagaatatgccgtataatgacatgcgtagagtggggaaaataccaaaatttttggcacacaggctatttccatcatcgaggttctcaatctggttagacagcaaactgagactacaaactgatcctatccttatcctagagtattttctctggcggcatggttatgaatatgctatttccaatcactatgatcgccattgtgtttgggaggaagtagcacaaaataaaaagctgaacaagttcaaccacacaataattgaccagcaatttgagttttatcaagcggatggactgacaaggttcaacccatcggatcccagcaggcttctaccaagctatgtccctgaaggctcttttatcgcaagagagcacacaccgatgtccaacttattttcctgcctgtggtacaatgaagttgatcgattcacacctcgtgaccagctcagctttgcatatacatacttaaaactgagaaggacaaatcctgacagaccattccgtctcaatatgtttaaggattgtgagagacgatcaatagcga

SEQ ID NO: 12763 - DNA, 508 bp, Zea mays
  unsure (1)..(508): unsure at all n locations; Clone ID: LIB3279-209-Q1-K6-A5
cggccgcgtgggtttctgctgaaaagcggcagatgattttcttaagaaatcggagaagaggctccaagatgtaacacttaaagttgaagaagaaactcaggcagctgctaaggagctgctggagcttcttgattccatggctgaacataaagagttcatgngaaacaacaattgctcagaggaggaaggacctctatgaaactgcagattatatagcatctgtggcatccaagacagtcatcacccaagtacccaaccctcctgaatcctgatacctgaattatgcagtgatcttttcgcatagaaagttgatcatagcaggcctgtggcagccttctctggcatgtaatataagtcaaagttgtcccacttgaagctctggtctttttgtccttggactttggtttgcgttctggtgaggtagtagttggtatgttcgggcttcaatcctagatgtcatgaaactgttgtaatttcattgcttcagtaatgaactttggattggtcc

SEQ ID NO: 12764 - DNA, 436 bp, Zea mays
  unsure (1)..(436): unsure at all n locations; Clone ID: LIB3279-209-Q1-K6-A6
gtcacgtcgtatgcaatatatattggaccctggnggttgcacgtgtacagaagagaggatgcaggagcagatgatcgtcggaggtatttagtcagactgaaatcgaatcgaccgcgaagagtagcacactactataccacgagtatgatctgtagtagtagtaataagaggaatataatatcattagtgtggtagtatttacttattatactactctctcttttcgtttttatttatcgtgttttagtttaaaaatgaactagcgaggttagtcaataggcgtgcatgcatggcccatcatggtcatggatatataggccttgatggttatactagtataagcagtagtgttatgtcacaagggattactgggatctgggatgatgatccacaatcccatctaaaacgaaaagagttaataaagattgttaagttt

SEQ ID NO: 12765 - DNA, 645 bp, Zea mays
  Clone ID: LIB3279-209-Q1-K6-A7
gttggcttctcctccccctccgggtcgggttcgggttcgtgaggttctgcggggttcggttgctgggtgagcggacgggaggcggcgtcggatgttgagtaccgctgcttggccggcggcctcgcctgggccacggacgaccactccctccacaacgccttcagcacctacggcgaggtcctcgagtccaagatcatcctctatcggcagacgcataggtcccgtggctttggttttgtcaccttctacactgatgaggcgatgcggaacgccatcgagggcatgaaccgcaaggagctggacagtcgcaacatcaccgtcaacgaggcccattcccgcggcggacgtggaggcggcggcggcggcgggtacggtggtggccgtggaggcggcggctacagcggtggcgggcgccgtgatggcggctgcggctacggctgtggcggcggctacggtggtggcggcagcagctacagtggtggtggcggcggctacagcggtggcaaccgtggcggcggctgctgctactccgacgggaactggaggaactgagcggtggggcccgcgcggccaagttatcctgttcgctaccgtgttgtttaccctagtccagagtgtttatcttcgttcgtctcgtgtttgttg

SEQ ID NO: 12766 - DNA, 631 bp, Zea mays
  unsure (1)..(631): unsure at all n locations; Clone ID: LIB3279-209-Q1-K6-A8
ggnacgggctctgggcttggttctctcctcctggagcgcctgtctgttgactatggcaagaagtccaagctcggtttcaccgtgtacccatccccccaggtgtccacatccgtggttgagccatacaacagtgtcctgtccacccactctctcctcgagcacactgatgttgctgtcctgctcgacaatgaggccatctatgacatctgccgccgctcccttgacattgagcgcccaacctacaccaacctcaacaggcttgtgtcccaggtcatctcatccctgactgcttccctgaggttcgatggtgctctgaacgttgatgtgaacgagttccagaccaacctggtgccctaccctaggatccacttcatgctttcgtcctacgctccagtcatttctgctgagaaggcctaccacgagcagctgtccgtggccgaaatcaccaacagcgccttcgagccatcctccatgatggccaagtgcgacccccgccatggcaagtacatggcatgctgcctcatgtaccgtggtgatgtggttcccaaggacgtgaacgctgctgtggccacaatcaagaccaagcgcaccatccagttcgtggactggtgcccgactggcttcaagtgcg

SEQ ID NO: 12767 - DNA, 607 bp, Zea mays
  unsure (1)..(607): unsure at all n locations; Clone ID: LIB3279-209-Q1-K6-A9
cttggaaccgtgcctgctctaacgggggcggagacgaccacgacgacggcgaggccaggctctgcgatggagcaggagccgcaccggcccatggagctgcccccgggcttccgcttccacccgaccgacgaggagctcatcacgcactacctggcccgcaaggccgccgacgcccgcttcgccgcgctcgccgtcgccgaggccgacctcaacaagtgcgagccctgggacctgccatcgctggcgaggatgggggagaaggagtggtacttcttctgcctcaaggaccgcaagtacccgacggggctgaggaccaaccgggccacggaggccgggtactggaaggccacgggcaaggacagggacgtcttcaggggcaaggcgctcgtcggctccaagaagacgctcgtcttctacacggggagggcgcccaggggcgagaagtccggctgggtcatgcacgagtaccgcctacacgccaagctccatggccacggcgcggccgtcgtcgtcgtccccaaggccggcgggtccaagaacgagtgggtgctgtgcagggtgttcaagaagagcctggtcgntagtggtgcagctgcagcagcagcac

SEQ ID NO: 12768 - DNA, 620 bp, Zea mays
  Clone ID: LIB3279-209-Q1-K6-B1
cgcagatcgcggcgctcaccaggcagcacgcgtccgaggggtgcagcgccaaccgcacctacgcggtgaccgcgctcaactacccgtccttctccgtggcgttcccggccgccggcggcacggcgaagcacacccgcacggtaaccaacgtcgggcagcccgggacgtacaaggtggccgcgagcgccgccgccggcggcaccccggtgacggtgaccgtggagccgtcgacgctgagcttcagcagggccggcgagaagcagagctacacggtgagcttcacggcgggcgggatgccgtcgggcaccaacgggttcgggcggctcgtctggtccagcgaccaccacgtggtcgccagcccgatcgcggcgacgtggacctaatggctagcggcggccgtaccgtagcaatagcgagataaaatcccgattgggggacggcaatggcgagcgcgcgccattctcgaatgcgagagagatggcggatatcgtcgaggatgtgctgttgtattgtgtgcatgagtccgctccggtgtgtaagctgccggtgtagtgtaatctatctgtagctgacccgattgtagcgatgcagcaattaaatctcaaaaggttgcagacttg

SEQ ID NO: 12769 - DNA, 632 bp, Zea mays
  unsure (1)..(632): unsure at all n locations; Clone ID: LIB3279-209-Q1-K6-B10
ttccttctccattagnatcaggnaatggttctcatggcacttccctgagcttgtcaagattgtgaacgacaattacctatatgccaagcttgctaagtttatcgtgaacaaatctgatttgacggaaaaagatttcctgctttggctgatatagttggcgacgaggacaaggctaaagaaattgttgaagcagcaaaggcttcaatgggccaggatctgtcaccagttgatttgatcaatgtccagcaatttgcccaaagggttatgaatctctctgagtatcgcaaaaacctttatgagtatcttgtgactaagatgaatgatattgcacccaacctgacatcgttgattggtgaagtagttggagctcgcctaatctctcatgctggcagtctttcaaaccttgctaagtgtgcagcctccacccttcaaatacttggtgctgagaaggccctattcagagcactgaaaactcgagggaacacaccaaagtatgggcttatattccactcctcctttattggccgtgcttcaactaagaacaagggcagaatggctcgttacctggcaaacaaatgctcgattgcttcacgcattgactgctactcggaggctagcacctctgtctttgg

SEQ ID NO: 12770 - DNA, 199 bp, Zea mays
  Clone ID: LIB3279-209-Q1-K6-B11
cccacggcgtccaaaaaaaaaaaaaaaaaaaaaaaaaaaaaaaaaaaaaaaaaaaaaaaaaaaaaaaaaaaaaaaaaagaggggaaaaaaaaaaaaaaaaaaaagaggaaggggggaaaaaaaaaaaaaaaaaaaaaaaggaaaaaaaaaaaaaaaaaaaaaaaaaaaaaaagggggggaaagaagagagtgggggggg

SEQ ID NO: 12771 - DNA, 474 bp, Zea mays
  Clone ID: LIB3279-209-Q1-K6-B12
ggcctcgcccacctcgccgcgctccacgccgcgctcgccgagctcctcgtcctccctgagccccgcgccgcgctcgctaccgccggcgccaccgccttctcggaccgcctcctggacggcctcctggcgctggccgacgcgcacggcgcgttccgggagacgctggtcgacctcaggcgccacgccgccgaggcccaggccgcgctgcgccgccgcgacgcggcgcgcctcgcgtcggccgtccgcgcgccgcgccgcgccgagaaggggcctcgcccgcctcgcgtcctccgcgcgcgcagccgccgctgccagctgcaggctgccactgccagcggccaccgccgccgaggtcgaggtgtccgggctgctcgccgaggccctgggcgccgcggcgtccgcgtccgcggccgtgttctccgcccttgaggccgagtcgttcgccggcaccgacgtcgccgtcgcgtctgccgt

SEQ ID NO: 12772 - DNA, 640 bp, Zea mays
  unsure (1)..(640): unsure at all n locations; Clone ID: LIB3279-209-Q1-K6-B2
ccttacgtgtcgcctgnttctatccagctagtcgctgagcatgctgcagcaaataacaaggtgttcctgatgaacctctctgctcccttcatttgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagaggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaactgaggcacgtcatgagagggactgttataggcacacttaattgttaaccagtgcgtggttcggtgtctacacaccctgtattcttccgaggcttctcttctgatccg

SEQ ID NO: 12773 - DNA, 594 bp, Zea mays
  unsure (1)..(594): unsure at all n locations; Clone ID: LIB3279-209-Q1-K6-B3
cttccanagcggtatggctgccgggcgatgatgctgngaaaccgtggcagcggtgcctgggatggtgggcggcatgctgctccacctgcgctcactccgccgcttcgagcagagcggcggctggatccgcgctttgctggaggaggccgagaacgagcgcatgcacctcatgaccttcatggaggtggcgaagccgaggtggtacgagcgcgcgctcgttatcaccgtccagggcgtcttcttcaacgcatacttcctcggctacctcttgtccccgaagttcgcgcaccgcgtcgtcggctacctggaggaggaggccatccactcgtacaccgagtacctcaaggatctggaggccggcaagatcgagaacgtccccgccccggccatcgccatcgactactggcgcctccccgctaacgccacgctcaaggacgtcgtcaccgtcgtgcgcgccgacgaggctcaccaccgcgacgtcaaccactttgcatcggacatacattgccaggggatgcagctgaagcagtctcctgcgccgattgggtaccactgatgcagtgatgctgtttgtgctctgctgagttttgcgtc

SEQ ID NO: 12774 - DNA, 614 bp, Zea mays
  unsure (1)..(614): unsure at all n locations; Clone ID: LIB3279-209-Q1-K6-B4
gcnacgatcacacgctgacgcttccgccccgccgccaccttccccgctctcctccctccgctcgcctccgcttccgttccgcgccctgcccccggaaggcaagcaaagccctcgctacttgcggagcgtcgttggtcaaaccctagcacacgtacgagcaggccagccccgcccgctcccattcccaggccctcatccatggcggcgctctccgtgcccctccacgccgccgccggatcccgcgccgccgcggccgaccccgtcaaggttccgtgcgtgaggagcactggttcagcccattttggccgcgcctccccctccgtcgcggtctcctcttcggctgcgaggcgcatcgagccgatgagagcgatagctacacaggcgccccctgccgtgccacaatatttgagtggcgagaagacaaagatcggcatcaacggctttgggcggattggcaggttggtcctgcgaattgcaactagcagagacgatattgaagttgtggctgtgaatgaccctttcgttgatgctaagtacatggcctatatgttcaagtatgactctactcatggcccgtttaaaggttctatttgtgtcgtggatgattcaaccct

SEQ ID NO: 12775 - DNA, 530 bp, Zea mays
  unsure (1)..(530): unsure at all n locations; Clone ID: LIB3279-209-Q1-K6-B5
cacaagcaccccaaccagccagtcagccagccattactcgcaagcttgctggctgctgaaggcgcagcagagctagcaaaggcttccatccaaagcggggcgggggagcgactctctcaggcaaaaataaaagcttgatgtgaagccgcttgctctgcgattgctggttgcgggctgcagcgttgtctgaggtgcgtggtcaagtcgaggcgaagatgagcaaggaggacgtgctcaaggtgcagacctgcgtgctcaaagtgaatatccactgcgatgggtgcgagaagaaggtcaagaagatcctccacaagatcgatggcgtgtaccagagcagcatagatgcggagcagggcaggtggacggtgnncnnnctnnaggntncggnncccgnnnnnnngnngctnnncnnggcgggcnngccggcgcngctgnggggcgccnngccnggcgtggngggcccgctcccgnngctgcngcttggcggcggcggcggtggcggtggcnnggtcccgccgcccttgggtggc

SEQ ID NO: 12776 - DNA, 390 bp, Zea mays
  unsure (1)..(390): unsure at all n locations; Clone ID: LIB3279-209-Q1-K6-B6
gccagaatctcctgctgctngattcttggctgagnaacagcaaatgattgtggcggcggacgagcgaactaagtgcatgcagacttctggcgtttccttcaatgcatgccttatcaatatatcaggngaaaatacgagcattttatgttggaagcagttcagttacgtgtgaggtctgttgtttttttccctgggcgcgaggtttggttgtgagcataatgcatatgcaagttttatcatgtaagtcatctttcaattttcctgctgcagaggttgttttccactttttcccatgatcgttgatgctgagcatgctgccctatgttcatgcctgcagtattaactgatggcaactcttgccctgagttaaaatgttaattctatttgtgc

SEQ ID NO: 12777 - DNA, 642 bp, Zea mays
  Clone ID: LIB3279-209-Q1-K6-B7
cccacgcgtgcgtacaaacttgggatcccactctggtcaacccctgcacttggtttcatgttacctgcaataatgacaacagtgttatcagagttgatcttggaaatgctgcactatcaggaactttggttccgcaactaggccagctcaaaaacttgcagtacctggagctctacagtaataatatcagtggcactatacctagtgaacttgagaatcttacaaacttggtcagcttggatatgtactttaacaacttcactggtcccataccaaattcattgaggaagctattgaagctgcggatcttgcgtattaacaacaacagactttctggttcaattacaaaattgataactgttatcactgcactccaagtactggatctgtcaaataacaatttgtctggagaagttccatcaactggttccttttcgatattcacccctatcaactctgggaacaaccctaatttatgtggacctggcaccacaaaaccttgtcctggtgctcctcccttttcttcacctcctacatacaaccctacaacccctgtgcaatcaccaggaagtacctcttccattactggagcaattgctgctggagtggctgctcgtgcagccttgctattcgctattcctg

SEQ ID NO: 12778 - DNA, 583 bp, Zea mays
  Clone ID: LIB3279-209-Q1-K6-B8
gcccatcctatagtccatcctacaaactagcgaaagacttgtctgagatattcagtactttgtgtatcacacatagcaaggatcacttgaactgttactagtacatgttcgatgagagcttctctgagtggtgcagtcggtcacgaatccaggaatgactactgcaattaatagtgttgattattttgtcactgatgtccttacatgcacacataactgtacacagaaatgacaccagtaactaatcttttgcctgttcaaaaaactgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccaatttgggggggccccttttatgatcccggttttcccaaacaatagcttttttttaaaggcccctaaaaataaaaacatgggccgaatattaaaaacggctgtaatagaaaaaacccctgggaaaccacattaaaaccccctaaaaaaaatcccctattaaaaaccgggttttaaag

SEQ ID NO: 12779 - DNA, 653 bp, Zea mays
  Clone ID: LIB3279-209-Q1-K6-B9
gtgaccagtgctcgccgtcgtcccctgcctctggccctctgctagccgctaggcgacgggcctttcgccgggcgacgggcacaccgcccctgttaccatggcagcgatgaatactggtatgggaggtttaggtggcaggccgatacatccacaagcaaatccttttggaactgcattgcagggtgctggaccaggattgatccgtactgggctagaaacatatggcggaaggattttagattcaagttctgagtttatgcagagcaatataacacaatatttgtccgaccctcagtactactttcaagtcaacagccagtatgtgaggaacaaactgaaggtcatcttgttccctttcttgcacaggggccactggacaagaataactgaaccagtaggaggaagactatcctacaaacctccagtccaggatatcaatgcaccggacttgtacatccctttgatggcatttggcacctacattgtagctgctgggtatgccttgggtgttcttggaaggtttacccctgaggcactgaccctacagttttctaaagggatacttgggtggtttctgcaagtcgtcctcatcaaaggtctgctgtactccctgggaagcggcgaagctcccttgctggacatcgtggcgtatg

SEQ ID NO: 12780 - DNA, 645 bp, Zea mays
  unsure (1)..(645): unsure at all n locations; Clone ID: LIB3279-209-Q1-K6-C1
ccccgcgtccgctcgcggnaagccaactccaccggcaggggaagcggaagggaagcacctcggccccggcaagatggtgctcgcacagctgggcgggagcatctcccgcgccctggcgcagatgagcaacgccacggtgatcgatgagaaggtgctcaacgagtgcctcaacgagatctcgcgtgcgctcctacaggccgatgtccagttcaagatggtccgcgacatgcaggctaacatcaagcgcatcgtcaacctcgaggcgcttgccgcaggcaccaacaagcgccgcatcatgcagcaggctgtcttcacggaactctgcaccatgttagatcctgggaagccttctttcactcccaaaaagggcaagccaagcgtagtcatgttcgttggtctgcaaggttctggtaaaactactacttgtacaaaatatgcttattatcatcagaagaaaggattcaaaccagcactggtttgtgctgatacatttagggctggtgcttttgatcagttaaagcaaaatgcaacgaaggccaagattcccttttatggaagctacatggaatctgatccagtgaaaattgctgttgagggtgtggagaggttcaagaaagaaaactgtgatctcatcattgtggacac

SEQ ID NO: 12781 - DNA, 539 bp, Zea mays
  Clone ID: LIB3279-209-Q1-K6-C10
cacctttagtatcaaagctgagcagccagtatcccaagataccggtgtacaaagttgacattgaattggaaggactgggaaacaaactccgtgatctaaacatatgttcagtgccgacgttccacttctatcacaaggggcagagaattagtgaaatcgtgggtgctgatgcaaagaaaattgaagctaccatggaaagtctccacaagcagcagtagaagtttcagagcagagcctcaacctcacaccaatggaatggtttaatctacctcgcatgagaagtgttgcgcacttttggattcgtgtttttctttacgtgtcacaccgtgtgaacgccagcgtttcgtcatcagatgcttgtgattcgtgccggcttgtttcatgtgaagacatcagatgcttgtgtttcgtgccggcttgttttgagttttgggtcttgagcttcggcgactctgtccagagctgcggatgtttctcatgcttggaatgagtgagatgggttgaaaatggccacccatatgcagttctggttcgagtcg

SEQ ID NO: 12782 - DNA, 658 bp, Zea mays
  Clone ID: LIB3279-209-Q1-K6-C11
cagaatacgtggagcatgcaaattctattgatgatctttctccatatgcaccactatataaagttatggaagggaatgagccatgcttacttcaagacatactttctcttgggtataacacagaaatctcttggttcatggcaaattccttccagaagaaactctcactgctttttggattgcgttctgagggtgcatctaggagctctggtaatggtggaccaactcaaagggcatctgcattagcagctctatcatctgcattcaatccatcgtctcaacaaaggctctctaatgagaggcttaaaagcacaggcgatggacccactcaacgcgcctcagcactggctgccctatctaatgcattcaatccatccttaaaacccaaaacaccacttccatctcgctcaggtcaaggttcccaaagagcagctgccgtagctgcactatcctctgtgctgactgctgagcaatctggatcttcagaaaatctacgagccaaagctagcagcacaggagataagactgatgtcgataggcctgtcataactccagctggaccatctggtccatcttctcctcagtctgaagctggggagtccaatgtgtttcgccaggaaaaagagctgcagtagatggggcaccatctgacactgat

SEQ ID NO: 12783 - DNA, 344 bp, Zea mays
  Clone ID: LIB3279-209-Q1-K6-C12
ccgcttcttgggacgcggtcgagctcttcgcgccaagccgggatcgctctgaacgaccacttcgtcaagctcgtctcgtggtacgacaacgagtggggctacagcaaccgcgtcgtcgacctgatccgccacatgttcaagacccagtaggggtttttcccccctgcttctcatggatggttgctgcttgtgtatgccgagaataaatgtggatggcgcgtgcctctgggtcgccaggttcatgctgagtctggacatgttttgcacttttgtttcccttcctgctaccatctgtgacagatccgctcgctaatatgggacctgagattagctttttgctgctt

SEQ ID NO: 12784 - DNA, 417 bp, Zea mays
  Clone ID: LIB3279-209-Q1-K6-C2
cggccgcgtgggttcgtcctagccaggcttcccttgccctaggattgcgccgccgccgatccaaccggcttctccccgcccgacggccgcgatgtacaacggcatcgggctgcagaccgcgcgggggtcgggcaccaacggttacgcgcagagcaacacgttcttcgtcaagccccgcccccgctccaccacatccggcgggggtccgggcaggccccacaggccgctgccccccgacgccgccggcgcggatggcggcgggatgcgaaagcccaacaaggagatcctcgagcacgaccgcaagcgccaagtcgagctcaagctgctcgtgctcagggacgcgctcgaggagcacggctacaccgaagacgagatcgaggagcgcgtcgcggaggcgcgcaaggccgcggaggcaga

SEQ ID NO: 12785 - DNA, 620 bp, Zea mays
  Clone ID: LIB3279-209-Q1-K6-C3
cccacccgtccgcacatggatgctgcaaaagaggctgcgaagcaatttgctcgcccgactgctggtactgtacaccgcattgctcaatgccacaactttaaagtacaacatgaagtcaagggctgccataggctatacccttgcagagctcatggctgataacctcccaaaaaaccttgctccaaccattgatctccgtgttgagcaccaacgcatgaacaaactccttgacggactgcagaccattgacccatacctgaacacatacaatgtcaagctaagtatctcccccaggggtacgcccaaggacaatgctgcagactatactgcaacacgatctcgacacccatacccactaccagcgagactccatgccatatactcgtggagagaaacgttcaaatgacgctgataaggtcacagattatactaactcatttgctgtctatcttaagctgctgctcgagcggctgaacaagaaacatcttgataccccccataagacagcaactgaagcaaagaaggaagataagaagtgatacggcccaagatagtaccctgcagtgatctatgcatgcatctacgaatgctactacttaaagggcttgttccatgaatgg

SEQ ID NO: 12786 - DNA, 632 bp, Zea mays
  Clone ID: LIB3279-209-Q1-K6-C4
ccccgcgtccgccccgcgtccggtaaaaggcatcgtcctgcactgcttaaacgactcggccgactacggctttcagttctgtcttcatggttttgttctgcgctctacattcttcgcacaccctcgcatgcttcattcagtctgccgtgtgttaatctgcctgcgtatcttctcgaagatgctgcgcatcgcaaaagcagtaatgaccttccttctcataccatttggtaaggtttgatttgctgacaaatgcagcatctggtaagtttctccccgtaggtttggtctccgtgctgcgtgcgctgctcctggttcaggaactgcagtatgttagatggatgaggatgactgaatgactcacctactcacgttatcatgccttcagaggacccaagttagtgagcgccaggaagtgaattgaccaggccaaatgctacgttgagccgactttggctttgctctgcgatctccacttgccaacatgtgttgccttcgacgaagtcttcttcgccttccgcttccttctctgcagcatcctgattgatattcttcattcttcgagtgacatgcagtcaccctaattgatcgtcatagagcctgcgttgaagtcgaatcccccctaatggacaatg

SEQ ID NO: 12787 - DNA, 410 bp, Zea mays
  Clone ID: LIB3279-209-Q1-K6-C5
ctttatctctggggctaagcttcaattcgacatccgcccattcttcagtcttaatgtcgttgccgccgagtacaatagtgattccccggtgcatccacaccaaggatttcatcaccaccagccccatcaacgactacaatggtgaagagtttgtcttctactctacaaggaagtaccgtgccaaaaactcaataatagagtaccacaccaaccaaagtggctaattgttgccactagagagaatgtatagcctattatgtctggcacttagtgaatcgatagctttaagggcaagttatgcactcgagtgactacaatagggaagggaggccttccaaggcaagaaagtgctcgttgtcggttgtgataacacctttccaaaaataatgttcatgcctacattgtttgtt

SEQ ID NO: 12788 - DNA, 653 bp, Zea mays
  unsure (1)..(653): unsure at all n locations; Clone ID: LIB3279-209-Q1-K6-C6
cggccgcgtgggcggncacgtgggnnattttggagnaaaaacaaatcaatgattgattttattgaatttacttgagataaggggaccatgcaagtatcggtgcaacagttttatttcagttgctagtttgtacaaaaatcagttatggtggatataatttagggtgttgagacttaaagctcgacaaaaaaaattaatacagtaaaattaattaaggagatgtttgcgactactccgatccaccattttaagttctgctccaccaactccaccatgaagttgctccatgatcgaagtttttagagttttcaaactgcttagcttatagggggacttggtgggtggagaatgacttattataggtcgaccacgcgttcttcttgtttgacacaggtgacatgaggacgctgctttctggaggcgacgacgtcgtcgattttgctgtcttctcgggattcgtgacccgacacttcttgatccccgggaccacgatcattgcaacttctatggtattgaggcatctcgagctccgtgctaaaccgcatggcatgcttaatgaccgaagtcaatgtatgctcagtcatggaagttaagcggcataaaaacaagatgaccaagacttcagcataatgttgtgactaaggtcaaagcga

SEQ ID NO: 12789 - DNA, 639 bp, Zea mays
  Clone ID: LIB3279-209-Q1-K6-C7
cctagctcccgcaactgccgccgccactcccacgcccgcagccatgccgcccaagctcgacccgtcgcaggtggtggaggtgttcgtccgtgtgaccggcggcgaggtcggcgcagcgtcttcgctggcccccaagatcggcccgctcggtctttcccccaagaagatcggagaggacatcgccaaggagacggccaaggactggaagggcctccgcgtcaccgtcaagctcaccgtccagaaccggcaggccaaggtctccgtcgtcccctccgccgcggcgctcgtcatcaaggcgctcaaggagccagagagggaccgcaagaaggtcaagaacatcaagcacagcggcaacatcagcctcgacgacgtcatcgagatcgccaggaccatgaggcacaggtccatggccaaggaattggccggcaccgtcaaggagatcctcggtacctgcgtcagcgtcgggtgcaccgtcgacggcaaggaccccaaggacctgcagcaggagattgacgacggcgaggtggagatcccgtccgcttaagaaggattggtgtccaggactgtgttatctttgctgctgaagccattttctctgcctagattttctcatatttatttgaagtgggggtggacgtg

SEQ ID NO: 12790 - DNA, 630 bp, Zea mays; identical to SEQ ID NO: 12034
  Clone ID: LIB3279-209-Q1-K6-C8

SEQ ID NO: 12791 - DNA, 606 bp, Zea mays
  Clone ID: LIB3279-209-Q1-K6-C9
gagcttgatgccgtctgtgctgccgtcgcaaacctcccctttgtgtcagcgtcacctctgtatagtgatcaagctgaagcagagcgtgcatctattcttgagaactttcgtcaagaaacaactcagtggaataaaactgctaaagctaccaatattgccgaaagttctaagcttgaaagtactggctctaaaataagcattatagttgcaacagatgcttgcttgcctcaggcagcgatggcagaggcaccccttatggctcgagtgctgataaactatgagcttcccacaaagaaggaagcttacttaagacgcatgtcaacatgtttggcggcagacggaattgtgattaacatggtcgttggtggtgaggtggttacactcaaggctttagaagagaacagtggtctgcttattgctgagatgccaatacatgtttcagaaatattatgaccgttccagttgtacaacatttcagaagttactgttctgattgcacactaactactcatggtttacttctactttaatttttgaattgcttttcatgtttcagaatgttctcaaattatatctctaaagcattagaataatgctcattgcttc

SEQ ID NO: 12792 - DNA, 643 bp, Zea mays
  Clone ID: LIB3279-209-Q1-K6-D1
agaacctttgcgctcaaattctaaaattcaagcctgatttagttatcacagagaagggctcagtgatctcgctatccattatttgagcaaggctggtgttactgcaatccgtagacttaggaaaactgacaacaacaggattgctaaagcttgtggggcagttatagtgaacaggcctgaggagctccaagaatctgatgtgggaacaggagctggcctgtttgaggtcaagaagataggtgatgaattctttgcctttattgttgactgtaaagatcccaaggcatgtactgttttgttgaggggagcaagcaaagatgtattgaatgaagttgagagaaacctgcaggatgccatgtccgttgcaagaaacattttgaaaaatccgaaactccttcctggaggtggtgctacagagctgactgtatcagcaacactgaagcaaaagagttcttcagttgaaggcgtggaaaagtggccctatgaagctgctgctttagcatttgaggcaattccaaggactttggcccaaaattgcggtttgaatgttattaggataatgacacaacttcagggaaagcatgctaatggtgaaaatgcgtgggttggcattgatggaaggagtggcgatattgttgatatg

SEQ ID NO: 12793 - DNA, 655 bp, Zea mays
  Clone ID: LIB3279-209-Q1-K6-D10
ccccgcgtccgatttgagctccgttctagtgagaactttgagatattcatttgagctcaagtcttggccgtgtgtgtgtgcgtattgctgtggacttgtgtgtgttgttcatcccatccttacttccgtgttcatttgtgatcatcttttgtaagggcgagagactccaagttgtggagattcctcgcaaacgggatatagtgaaaggaaaagaaacactgtggtattcaagtgggtctttggaccacttgaaaggggttgagtgcaaccctcgtccgttgggacgccacaacgtggagtaggcaagtattggacttggccgaatcacgggataaaccactgtgtctctctgtgttgatctttttgtggttgttgtgtttcgcaagaactcctctctagccacttagctttattgctctaacacttaatcaagtttgtggcattaagttttaagtttttacaggatcacctattcaccccccctctaggtgctctcagtttggtcttgctgtaccggacagtcaggttggtggccgccacgcctgtacacctgaccagcagtgacataattcgcacgcaccgagttagcggtgccagcatggccatgcccaagttctagccctcttcgcaatgggcgccggtggcatttcctgcc

SEQ ID NO: 12794 - DNA, 642 bp, Zea mays
  unsure (1)..(642): unsure at all n locations; Clone ID: LIB3279-209-Q1-K6-D11
ngaccaacccagcatctgtaccgcgccgcgcgagcacgtccggcgccggtgcggcaggcgaaatccgagagcactcctcccccgctacgccgcaccgcccatggccgcagctagccgcagatagagagaggcgcaggcgagggcgtgcagatccagatccggtgggcgggaaggacttgatcgcccccaccaccatggccggcgcggtgtcggcgctcttcctgctggacatgaagggccgcgttctcgtctggcgcgactaccgcggcgatgtctccgcgctccaggccgagcgcttcttcaccaagctcctcgacaaggagggcgattcggaagtgcactcgcctgtggtctacgacgacgctggcgtcacttacatgttcatccagcacaacaatgtcttcctcctcaccgccgctcgccagaactgtaacgcggccagcatcctcctcttcctccaccgtgtaatagatgtgtttaagcactacttcgaggagctggaggaggagtcgctcagagataacttcgtcgttgtgtatgagttgctcgatgagatgatggattttgggtacccacaatacacggaggcgaagatattgagtgagttcatcaagacagatgcatacaggatggaggtcacac

SEQ ID NO: 12795 - DNA, 642 bp, Zea mays
  Clone ID: LIB3279-209-Q1-K6-D12
attgagaggtccaccaaccttgactggtacaaaggcccaaccctgcttgaggctcttgaccagatcaccgagcccaagaggccttcagacaagcccctgcgtctgcccctccaggatgtgtacaagattggtggtattggaactgtaccggttggtcgtgtggagactggtgtcatcaagcctggtatggttgtcacctttggtccaactggcctgactaccgaggtgaagtctgttgagatgcaccacgaggcgcttcaggaggctcttccgggtgacaatgttggcttcaacgtgaagaacgttgctgtcaaggatctcaagcgtgggtttgtggcctccaactccaaggatgaccctgccaaggaggctgccagcttcacctcccaggtcatcatcatgaaccaccctgggcagattggcaacggctatgccccagtgctggactgccacacctcccacattgctgtcaagtttgctgagctcattaccaagatcgacaggcggtctggcaaggagcttgagaaggagccaaagttcctgaagaacggtgatgctggtatggtgaagatgataccaaccaagcccatggtgggtggagacattctcagcgtatcctcccctcggtaggtttgctgtccg

SEQ ID NO: 12796 - DNA, 660 bp, Zea mays
  unsure (1)..(660): unsure at all n locations; Clone ID: LIB3279-209-Q1-K6-D2
ggnaaactataactgtgtccataccactgaagnacatactgatgaggttgaagctgttacagtacatgtgactcagaagtattttgtgagtgcttccaaggataactcttggtgcttctatgatatttcaacaggatcttgcctgacacaggttggcgatgcttcaggacaagagggatatacatctgcgtctttccatccagatggtcttatccttggaacaggaactactgatgctgttgttaaaatttgggacgtgaaggctcaggtgtgatttgtcaaatgtcgcaaagtttgagggtcatgtcggaccagtcactgctatgtctttctctgaaaatggttacttcctagcgactgctgctcatgatggtgttaagctttgggatcttcgtaaattaagaaattttaggactttctctccctatgatttggacacgccaaccaatactgtggaatttgatcttagtggaaactatcttgccattggtggttcagatataagggtctaccaagtagctaatgttaaggccgaatggaatcttatcaagacattacccgatttatcaggaacagggaaagtaacttccgtaaaattcggagtagacgcgaaaacatagccataggttctatggaccgcaatctacggatatttggtct

SEQ ID NO: 12797 - DNA, 625 bp, Zea mays
  Clone ID: LIB3279-209-Q1-K6-D3
cccagccacaatccgccgtgcgcacgccgtgcatcccatcaccgccgtgcagatggagtggtcgctctggtcccgagacatcgagcccgagatcgtgccactctgcagagaattggggattggaattgtggcttacagtccaattggccgtggattttttggtggaagaggagtgacacagcaagtttcttctgaatctagtctgcaaaggcatccaagatttacaacagaaagcttggagaagaacaagcagatttacctgaaaatagaagatttggccaagaagtaccagtgcagcccagctcagctagctctagcctgggttctgcatcaaggggatgatgtggttcctataccagggacaacaaaaacgaagaacctagatgccaacgttgactccttgaaggtgaagctcacagctgaggacctgaaggaaattggcagccagatacgtgcagaagatgtggctggtggaagacaatacaattcctatgcacatacctcctggaagtatgcagatacaccaaaaaagtgaagctctggaaaccttgtagcaatcacaggcgtatgcaaatgttgaactatttccctgcatttgagccggaatcgtacgatgatgcatctt

SEQ ID NO: 12798 - DNA, 617 bp, Zea mays
  Clone ID: LIB3279-209-Q1-K6-D4
ccccgcgtccgcaaacattgaatgtagttagtgcatttagagtttttaccttatttttcgagaaaactggaagatcggatacaatatctctactatataaaacactaggttcaactgtcgcccggtgtcatacttcccgtttaattaaaaagttgtaaaattgtacacaaataagagtttggacttttgttattggcttcacatttacatccacctaaccaatagaacaaaccacatatatttatattttattaaaataatgtatactcataaaatatatagaaacgtgacaatgcactggtaactgactagtatacaaatcatagaggacgttctaagaatttaacatcctacactcatgtgatggccatagattatgataccgtggattaagaaatagactcgtgccttgttaggttgtcttcagtggaccgtgtaaaatatagtatttacattgtagatgatactgtttgcatattgaagtttgaaataaggtatgtgataggggatgaaatagggaagctactggtgatagccttagagtatgaagccgtgtattatggatacatatcaacaaggaacgaaacaacgttatcatttaacttctctactactat

SEQ ID NO: 12799 - DNA, 620 bp, Zea mays
  Clone ID: LIB3279-209-Q1-K6-D5
tctctatatttaagttggtttggaacaaagggagacaaacccagggagacaaaaccacccataaataactaaatatcttatacgaatagtatgtccgggattggctgacactgaaaaaacgtaagaatccccagggaattttggtttccaaactagaccttaaattgaagtttctttgtgtgtgtcctctcgagaattccctcgcacactcagtgctagaaaagctagaaaccccatcgttgttctttcccacgtgaaaatccaaaaaaataaatgcagggcctagggttagaaccttaactccctccaacgcttagcgtctaaccactaaaacacatatttattcatgttctagaaataataaattttagaaatattttaaatatagaaaccgtagtaacatacagaaaactgactagtatataaaaaagaaaatgttctaacaactagttagaagaattagttgtctatgcctatgcatgcgcatacaaaatagtcttttttagcaaagaagaactttggggttctttggaaagttggcagttcatttcactatgtattaaaagttccagtataatatatttgatataaatataaatagtattgaatataatttgttt

SEQ ID NO: 12800 - DNA, 650 bp, Zea mays
  unsure (1)..(650): unsure at all n locations; Clone ID: LIB3279-209-Q1-K6-D6
cttctccgttcagatccggctactggcgtccctcctccgccatcttccctacccccgacgtggcgacgagctgtgagccgtgagctgttccaacattcctgtcctagttcaagctgaaaggagaacataaaagaggagaggctagggttttggcgtccgagaccaaaccaagctctctccggcgacggtgagggctcgatatcggagtccagtaggcggctcctgctgcttcggcggtccctaatccctctctcggcagtgtacagatggcgtccggcggtccggcgctcgagccgctcgtcgaccaggtcatctccgtcatcaccaacgatggccgcaacatcgtgggtacgctcaggggattcgatcaggccaccaacattatactcgacgagtcccatgagagggtctattctagaaaggagggagtccaacaacttgttcttggtctgtacattatcaggggtgacaacataagcgttgtgggcgaggttgatgaagagctggattcaagattggatatgtcgaagctaagggcgcacccactgaagcctgttattcactgaggtccgagtatgtctttgggtaatatgtggactggatggatgggtcactgttgaatgcangatgtagcatcatcatggtgaggg

SEQ ID NO: 12801 - DNA, 654 bp, Zea mays
  Clone ID: LIB3279-209-Q1-K6-D7
ccccgcgtccgggcctgttatagaatttatgacatttaatttctcgatgcaggctattgatcatatcatcaattcagctgctaagtcaaactacatgtcagccggtcagatatctgttcctattgtttttagaggaccaaatggagctgctgctggagttggtgctcaacactcacagtgttatgcagcttggtatgcacatgttccaggacttaaggttctcacaccatactcttcagaagatgcccgaggcttgcttaaagctgctattagagatcctgatcctgttattttcttggaaaatgaattgctttatggagaatctttcccagtttctgctgaagtgcttgattctagtttttgcctaccgattggcaaagctaagatagaacgtgggggtaaagatgttaccattactgcattctccaagatggttggctatgctctccaggctgcagagatactgtccaaggaaggaatcagtgctgaggtgatcaaccttcgatcgatcagaccacttgatagagctgctattaatgcatctgtcaggaaaaccaaccgattggtgactgttgaagaagggttccctcaacatgggattggtgccgagatatgcatgtctgttgtagaagaaagcttgagtaccttgatgcc

SEQ ID NO: 12802 - DNA, 643 bp, Zea mays
  unsure (1)..(643): unsure at all n locations; Clone ID: LIB3279-209-Q1-K6-D8
gatttgcgccgtctccacantagctagagttggatctgtcaacttaagcatccagcagatcctcagggcaactcagaacttctcaccttcatttaagttaggtgaaggaggatttgggatggtctacagggctgtattgccagatggcaatgttgttgcggtcaagagagctaaaaaggatcagtttgcaggtcctagggatgagttcagcaatgaagtagacttgcttgctaagatagaccaccgaaatttggtgaggttactgggttttactgataaaggaaatgagcgcattatcatcactgagtatgttccaaatggtactcttagagaacatctagatggtcaacatggaagagtcctagattttaatcagcgtctagaaattgcaattgacgtggctcatgcacttacttatcttcatctgtatgcagagaagactataattcatcgtgatgtgaagtcatcaaacatcctgctgacagatagctatcgggccaaggtgtctgactttgggtttgcaagaagtggccctagtgacacggagaagacacacatatcaacgaaagtgaaaggcacagctgggtacctggaccccgaatacttgaggacataccagctaactccaaagagtgatgtcttc

SEQ ID NO: 12803 - DNA, 653 bp, Zea mays
  Clone ID: LIB3279-209-Q1-K6-D9
ccccgcgtccgacaaaactcccccgacgtcggcttctccagcgccacgctctcctctccagtctccaccaacgtcctccccccaccgcaccgcaccgccctcccctcccctcccctccccgcgcgtgcgccgccgccgcgagatccggggcgcgatgtggcgcagctgcgtctcgcggggcctctccagggccaaggcctccgcctccaggctcctctccacggcatcgtcgtcctacacggtggtggaccacacctacgacgcggtcgtggtgggggccggcggcgcggggctccgggcggccatcggcctctccgagcacggcttcaacaccgcgtgcatcaccaagctcttccccacgcgctcgcacaccgtcgcggcacagggaggcataaatgccgcgcttggaaacatgagtgaagatgattggaggtggcacatgtatgacactgtgaagggaagcgattggctcggtgaccaggattctattcagtatatgtgcagagaagcaccaaaagctgttatagagcttgagaactatggattaccattttcaagaactgaagagggaaagatataccaacgtgcctttggaggacagagcttagattttggcaaaggtggacaagcctaccgttgtgcctgtgctgctg

SEQ ID NO: 12804 - DNA, 615 bp, Zea mays
  unsure (1)..(615): unsure at all n locations; Clone ID: LIB3279-209-Q1-K6-E1
ccagnatcggcccgctcggtctctccccgaanaagatcggcgaggacatcgccaaggagaccgccaaggactggaagggcctccgcgtcaccgtcaagctcaccgtgcagaaccggcaggccaaggtctccgtcgtcccctccgccgcggcgctcgtcatcaaggcgctcaaggaacccgagagggacaggaagaaggtcaagaacatcaagcacagcggcaacatcagcctcgacgacgtcatcgagatcgccaagaccatgcggaacaggtccatggccaaggagttggccgggaccgtcaaggagatcctggggacctgcgtcagcgtcgggtgcaccgtcgatgggaaggaccccaaggacttgcagcaggagatcgatgatggtgaggtcgagatcccatcagcttaaaggctatacaactagaaatcatcggacactatcaaagtggtgttttgttccaaatgcagttcctgcacctcaatcgcctattattgtctgctttagttcccttaagtcttgtgagagacctaatcagtaccttctgcctgataaaattacatcttccgattttctgtcttgtgatttggatggatgcgatcaaaannaaaaa

SEQ ID NO: 12805 - DNA, 482 bp, Zea mays
  Clone ID: LIB3279-209-Q1-K6-E10
ccggctctcccctcctcgagcgctttcggcaccgtagttcggtacgatggcagcggcggccccgacgagggcagaggtgctgtcgcttttccggtccttactccgcacggcgaagcagttctcggactacaacatccgcgagtacacacgccgacgcgccgcggacgccttccgcgaaaacagcgccctctccgacgcgccgtccgccgccgccttgtttgcggtggggaagcagcagctagaggttgcgaagcgacaagcggtgatttactcaatctacgcccccaaggccaagagcgtgatggagttgaaggtgcagtgatggacgaggtgctgcgcccttttcttcctcatcgttttcctttccgaattcgtttcttttctgtgacgatgaaactataaactgttgcattatcacgtttgctggatgattgtcatgatatagcttcttactgtgcaataaattactaaattttattgct

SEQ ID NO: 12806 - DNA, 650 bp, Zea mays
  Clone ID: LIB3279-209-Q1-K6-E11
agcagctggctccaagggcgggcgatcgctggaagcttcgtcagccgcgtcctcgccggcaaggccgcctcgccgaggagggccgtgcacgcctcggcgtacgacaagaacctggaggaacaggtgcgcccggcgttcgtgccggacgatgtgatcggcagcgccgggagccccgacaagtactggagcccccaccccaagaccggcgtgttcggcccggcggcggtggaccccaagctggcagctggtggcgcgccggacgccggcgcggatgctgcaggaggcacggtgctggaccagaaggtgtggttccgcccgctcgaggacgtcgagaagccgccccccgccgcgtgagccgcgcggcgctgctagcccagcccacactgctgctcgctcataaaaagggcggcgggagagcctggcaggcactctgctcgtgctcggctgggctggactccctgcttatatcactacaatattatactactagtagtggtgcttgatagcagtgtgtggctgtgctaataccagtataatactggttctactataatcagtcgtatcaagcatggcgtgcatcaagactggttgtgatagtagcaacgtgatgctcgtgcctgtaataagaacaagcaggcgatgtgtgcctg

SEQ ID NO: 12807 - DNA, 320 bp, Zea mays
  Clone ID: LIB3279-209-Q1-K6-E12
cggacgcgtgggctggagtgagtgagccggtggccatggttttctatactctgctatgctctccctcgccggcgttcttttcgtgtcccaatctggaaggacgacggacggtacggtggctggtttagctatagacaaaaaaaaaaaagtacggccgcgtggtggcggtgctaatatgcttagccacgcgcggttgatctttgagaagttaagcgtgtacgaaatgacagctttgtacgtgtactgtctgctggagtgtgctgtgtatctggtctggatccgatcggcctaatgtatgaaaaaaaggatgtttacgtact

SEQ ID NO: 12808 - DNA, 525 bp, Zea mays
  Clone ID: LIB3279-209-Q1-K6-E2
ccccgcgtccgccccgcgtccgcccacgcgtccgtgtttttcgttacagttatgtggtgttagaggtggtggcgaagcagcctcgcaggcgatgttttggcgacccagaaatgacctcagcttggtgctagccttcgagagcactcgagaacgcaacacggccatcatgctcgctcggcgtttcgctgtagactgcaatatcatccttgctgggccaggcgacaaaactccctggtgatggcacctgtgctgctctgccaatccccaccactcttaacaatccgcgattcgcacagcttgcttgcaccagttcctctgattttccttcctcgtcagtctgggctgtgctgtgctgttctgtgtgaaggcgccgtgcgcaccgttttaaccgcctcggcgccgcctttccatctcgctgtgctgtgtttttttttcagtcgggtgggttgtaatctgttgctaggagatgcgacagtaatgtaagcttggtgcggtacacgtctaattaattgtgtttgacgtgtt

SEQ ID NO: 12809 - DNA, 64 bp, Zea mays
  unsure (1)..(64): unsure at all n locations; Clone ID: LIB3279-209-Q1-K6-E3
gcgagagcccagaggtgagaagatgatgagaggaggngtgatcggtacaggatcaccgctgtgc

SEQ ID NO: 12810 - DNA, 642 bp, Zea mays
  Clone ID: LIB3279-209-Q1-K6-E4
cggacgcgtgggccgctgttaggttctaccaggagaccttcggcgtccctccggccacgcgagctcgccgaatggtcgcccacaggttccatcagtaccaggtggtgggtcgcgcgctgccgaccccaaccgatgagcaccccaagatctaccgcatgaagctctgggccaccaacgaggttcgcgccaagtccaagttctggtacttcctgagaaagctcaagaaggtgaagaagagcaatggccagatgcttgccatcaacgagatctttgagcgcaacccgaccaccatcaagaactatggcatctggctgcgctaccagagcaggactggttaccacaacatgtacaaggagtaccgcgacaccaccctgaacggcgcagtggagcagatgtacaacgagatggcctcccgccaccgcgtgaggtccccctgcatacagatcatcaagacagcgacggtccacttcaagctgtgcaagagggacaacaccaagcagttccacaactccgagatcaagttcccgcttgtgtaccgcaaggtcaggccgcctaccaggaagctccggaccactttcaaggcttccaggcccaaccttttcatgtgagaggtatattgtacccgtgttctgtgtcttgagc

SEQ ID NO: 12811 - DNA, 630 bp, Zea mays
  unsure (1)..(630): unsure at all n locations; Clone ID: LIB3279-209-Q1-K6-E5
gtcgcccggtcggnaagcccaccagctaccaggnatgtctggcgaggaggaggagaacgccgcggagctcaagatcggcgaagagttcctcaaggccaagtgcctgatgaactgcgaggtggcgatcatcctggagcacaagtacgagcagatccagcagcacgcgtcgtcggagtcggacccgtcgtcgcaggtgtcgcaggtgttcgagaagtcgctgcagtacgtgaagcgcttcagccgctacaagaaccccgacgccgtgcgccaggtccgcgagacgctgagccgctacggcctcgccgagttcgagctctgcacgctcggcaacctctgccccgacaccagcggcgaggccaccgcgctcgtcccctccctcaagtccggcggcaggttcgtcggcgaccccggggacgagaagatcgagaagatgctcaacgacctctccctcatcaagaagttcgagtagagcgggagccctctcttctcttatcttcttttctcttggagtagcgagcatccagagaggaggggaattcaacatcaagacgatgtactgataaaattttacttgccttacactactatcgttgaggttaaaaaaaaaaaaaaaaaaaaaaaggcggccgc

SEQ ID NO: 12812 - DNA, 548 bp, Zea mays
  Clone ID: LIB3279-209-Q1-K6-E6
ccccgcgtccgccccgcgtccggcaacgaccaaacccttccccctccctagctccgtgctccagcgggagtccgcggcggcggtgaagatgattatcccagtgcgctgcttcacctgcggcaaggttattgggaacaagtgggatgtctacctcgacctcctccaggccgactactcagaaggggatgctctggatgctttggaattgttccgctactgctgcaggcgaatgctcatgacacatgttgacctcattgagaagttgctcaactacaacaccctagagaagaccgagacaagttaagcgagcacatcatgctccaaaaacactactgtttcgcagtatcatagagcttaggtagtatgttgtctcttctctatcagtagaaatgggttgtgagtgtgaacatgcttttgctcatgagcattcaaggacttttcatgcgacagtgcttgttgccacctatgcaacgatgttggatattttaagtgatataattgctaaaagaaagctaatgtatttgtgtgaattgggtcgataatatttc

SEQ ID NO: 12813 - DNA, 661 bp, Zea mays
  unsure (1)..(661): unsure at all n locations; Clone ID: LIB3279-209-Q1-K6-E7
ggnanaatgatgagctatgtgatgagtgggagccagagctgctatgccctccatcaagagggggccaaaatagatgctccaacattggaaagtgccgttggaccacatacgattgttgattgttgatggtaaagaagttgtgaactttgcatcagcatgaggtctggagtctagacacagtgttgcaaactgaggtttaatcatcttagcaactacggtacgtgaccctgagcgcgtgattgttgcgaaacaacgaccacctcggtctacaccttaaaggtttgcgcgacatggcttttcatagtgctcaattggatctatcccctgagcataggagaaaagtatcaatttgtacagtggatccaagtattctataaagcatgcatcctccaatttcccacaagcgagaatgccatgatatgatggatgaaatggctgttgcggtcaattgtctttcaaggatcaattgtctttcaagaaccacactttgtattggtttgtgtgcagttcaagctctgcaaggtgaggtctgttcagtttggccagaaagtcatcccctacctgaacacctacgacgaccgcaccatccgctaccccgaccctctcatcaaggccaacgacaccatcaagatcgatctggagaccaacaagatcatggact

SEQ ID NO: 12814 - DNA, 648 bp, Zea mays
  Clone ID: LIB3279-209-Q1-K6-E8
tgcctgtgcagtatcctatggtatgcttttcttcctctagcatgcatatggagcgaagcaatgaaggccataatgacacttcaggaactccacctgcataccatttcccattttattatccagggatggtagaacacaacatggcactttcatcagtgcaaaattttcaagcaaacataaacagtgctcaagcacatacaccaccagcgatgcttcatcagtacaatgttttctcccaatgccatagtttacccatgatatcatcatttcagtttaatacttctggcatgagtatgcactcaagtcatttaccgacgcaaaatgtgtggtcatcggcatcgagcacaccaacgcctgacgaaacatgcaatcgctccaagagaagggctgcagcacttgctaaattcaggcagaaaaggaaagagcgctgttttgacaagaaggtgaggtatgtgaacaggaagaaacttgctgagacgaggccaagggtgcgaggtcaatttgttaggcatgcaagcaatatggatatcataagcactggagatgatatatctgaagacgaagatgacgatccaacctccagggaggtagatatgatttcttctccagagtagtggagaggtcctcttgtgtgaaaaatagagtgca

SEQ ID NO: 12815 - DNA, 632 bp, Zea mays
  Clone ID: LIB3279-209-Q1-K6-E9
caggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtggaggaacgggctctgggcttggttctctcctcctggagcgcctgtctgttgactatggcaagaagtccaagctcggtttcaccgtgtacccatcccccc

SEQ ID NO: 12816 - DNA, 467 bp, Zea mays
  Clone ID: LIB3279-209-Q1-K6-F1
gggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctcctggccatccgcaacgacgaggagctcggcaagctgctgtccggcgtcaccatcgcccacggcggcgtcctccccaacatcaacccggtgctcctgcccaagaagaccgctgagaaggcggcggccaaggaggccaagtcgcccaagaaggccgctaagtcccccaagaaggcatagaggggcgcctttaccgctgtgatgttgaatgctcgtgttcagtagatctttacttctgtagtgtcgtcgttgttattggaactggttagtagatctgtgcattgtggttgaaacgtgattccctgatttcagaaatctaatttgc

SEQ ID NO: 12817 - DNA, 598 bp, Zea mays
  Clone ID: LIB3279-209-Q1-K6-F10
ctccaccctccagcgcctccaccctcctcgccgcctcactccctctgaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggccaacatcaagctcgagtcctactggccggcgcttttcgctaagctcctggagaagcgcagcgttgaggatctaatcctctccgttggatctggtggtggcgctgctccagttgctgcttccgccccagctgggggtgctgcagctgctgctgcccctgctgcagaggagaagaaggaagagcccaaggaggagtctgatgacgacatgggcttcagcctgttcgactgagagtctgagaccctcgctacccagccattagcaaattcgcttatgctgtccaagacttatcttacgttatgtctgtaggcttttgttattacaagtactcaagttttgagtttttgagatgtggctatgacaatgtgatgaagaatcctaaaccatcgtattagagtgaaacttgtttct

SEQ ID NO: 12818 - DNA, 640 bp, Zea mays
  Clone ID: LIB3279-209-Q1-K6-F11
ggccgcgtgggcgcgccggctcgcacctcctccacaccctcgtcgccgccggctgctccacccccgccaccgccatgggtaaattccgcaagcttggccgcaattactcccaacgcctctgcatgctcaggacgatggtgtcgcagctggtgaagcacgagcgcatcgagaccaccgttgccaaggcgaaggaggttcggcggaaggcggatcagatggtgcagctagggaaggagggtactcagcatgcagcaagacgtgctgctgcctttgttcgaggtgatgatgtcgttcataagctatttactgagctggccttccgctacagagatcgagctgggggctacacaagaatgttaagaaccaggatacgtgttggtgatgctgctccaatggcatacatcgagttcgtggacagggagaatgagcttcgagaggccaaacctgcaacgccgccgcctcctcaacgagcccctcttgatccatgggccaagtcacgtgctagccaacagtgggcaggacctaaaatcaccaagacctcggaatcagacggcttatgagctagtatacctatgttccatagaaagtttcagttattttgcttaagagatttttttttatctagagataactgccgata

SEQ ID NO: 12819 - DNA, 658 bp, Zea mays
  Clone ID: LIB3279-209-Q1-K6-F12
caagcttggcttcgggtgcatgggcctcactggagtgtacaacgcccctgttcctgatcaagctgggatcgacataatcaagcacgcgtttgaggccggcatcaccttcttcgacaccgctgatgcctatgggccacacaccaacgaggtcctgctcggaaagtctaaacatccaagatattctggggaaaacttggagaagaataaagttctgtatacacgacttgaaatgttgtccaagaagtatgggtgcacacctgctcaactcgctctctcctgggttcttcatcaaggagaagatgtggtccccatccctggaacaacaaaagccaagaaccttgacgaaaatatcggtgctgtaaaggtaaggctgagcaaggaagacctcgaagaaatctcaggcgcattccctgctggtgaggtggctgggtctagactccttggagtcttggagcctttttcctggaggctcgcaaataccccgcctccaaaatagcgagttcagatgcaaattcttggccatcctaccatttaggtcatgttatgttagatcatatctacatgatgcaaatgattgttcctgtgctcgcgcgtgaaaatgctgtacctgaaacaaagagagtaacagttggttctctgtgtggaacgtgctgattgc

SEQ ID NO: 12820 - DNA, 522 bp, Zea mays
  unsure (1)..(522): unsure at all n locations; Clone ID: LIB3279-209-Q1-K6-F2
ggagaagacattgctgtcattgttggcacagtcacagatgacaaaaggatccaggaggttccagcaatgaaggttactgccctgaggttcacggagacagcaagggccaggattgtcaatgctggtggcgagtgcctcacatttgaccagcttgctcttcgtgctccacttggcgagaacacggtcctcttgaggggccccaagaatgcccgtgaggcagtgaggcactttggcaaggctcctggagtgccgcacagccacaccaagccgtatgtgcgctccaagggaaggaagttcgagaaggctcgtggcaggaggaacagccgtggattcaaggtttaaaacaaattgtggccctccgtgttgccatcagcatagtgcaaccgttgtgtttgatcagtcgacagtaattagtcatcactctgtaccgagattagtagcacaatttgttgtcctggtttgaattttggaagatatttgatgtcgtctccttattatctactcgttactggttgngcnnaa

SEQ ID NO: 12821 - DNA, 649 bp, Zea mays
  unsure (1)..(649): unsure at all n locations; Clone ID: LIB3279-209-Q1-K6-F3
ngagnaaggaagnaaaggggcnaggagnaaatcgagcctcactcgatccatcgcctcgccgcagcacacacgaggccggcggcgccatggccatgaagctggacatgtccgcgctcgagaccaacttcgccaacctgaccgcctccgccggcgacgacacgtacttctccgccgaggcccccgacgtgccgtccatggtgctccccatctgcgacgacttcgacggcttccaggcggccaccaaggatatggtgaagaataagaaggggacgaccacgcttgccttcatcttcgacaagggcgtcatcgtcgccgctgattccagggccagcatgggcggttatatatcctcacaaaccgtgaggaaaattattgaaataaatccttacatgctggggacaatggctggaggtgctgctgattgccaattttggcataggaacctaggaaccaagtgtcgtctccatgagctttcaaacaagcgaaggatctctattgctggtgcttccaaactgttggctaacatcctttattcatatcgtgggatgggactgtcgattggtacaatgatcgctggatgggatgagaagggtcctggcttgtactatgttgacagtgagggtgcgcggctcgtggggaacaggttcta

SEQ ID NO: 12822 - DNA, 119 bp, Zea mays
  unsure (1)..(119): unsure at all n locations; Clone ID: LIB3279-209-Q1-K6-F4
tccgcggncgcgtgggcggncgcgtgggcagatgattgattttattgatttacttgnagnataagggaccatgcaagtatcggtgcaacagttttatttcagttgctagtttgtacaaa

SEQ ID NO: 12823 - DNA, 645 bp, Zea mays
  Clone ID: LIB3279-209-Q1-K6-F5
acgggcgaacgaaagccggagggagcagacaaaaccccacttccacttctccgtcagaccatcacatctctgcgagactgcgaccctcccctgcctgcttcttcttcttctccaccgcaagagccgagccgagccgagccgggcctagagggaggacagcgatccatctaacgtctgcttgccggtctgcaatggactgcagctctgacgagtcgtcagagctaagcgagacagatatcgacgactacgccgacaagtcgtactcggacctcaagtccggcaagttcgtggcgaggctgggcagcgacaggttcaggtgcccgttctgtccggggaagaagaagcaggactaccgctacagcgagctgctccagcacgccgtcggggtgggcgcatccaaccgtgccgcgaaggtgaaggcgaaccaccaggccctggcgaaacttctcaaggaggaccacgccgacgcggcggccacactgccagcatggcaggccatcgcgctaagcaacgcgccgaagccggcgcaggaccaggaagcgttcgtttggccctggacgggcgtcctcgcgaacgtcccggccggacaagcccaggagggtggagctacactgatggagcagctagctgagttcaaacccgtgc

SEQ ID NO: 12824 - DNA, 588 bp, Zea mays
  Clone ID: LIB3279-209-Q1-K6-F6
gccgcccgtcggcgattcgcatggccttcgccggcaacgccgacgactcggcggaggactattccgcggaggccaccgtggtgcgcttcgacccgccgctccctctcctccgggcgccagtcccctcgccagcatctagcggcgagggccccgtcctcgccttccgcgacgtcgcgagctggcgagccgcctgggaggccgccgaggccagcctcgtctcccagtgcgagctggccgaggtgcctcgcgatagtcatgcaaggcagtaagtttagcagctgcaaatatcaaggagggcaaaccagctcctggctactggagctcagtggttagggttgacaatgcccccataatcgccggactatgtttgtttcacttatgttttttttactttgtgacgatgtgttctttgtggaaaccggaatggttagggttgacaatgcccccataaccgctggactttcaatgtggcatttatatttgtttcctttttgaaaatgttgtttccagtttcaccccagttgggggcaaagagtacaaactacctcctggcatctgaataccagtggtaagggtggaccgtgctaa

SEQ ID NO: 12825 - DNA, 523 bp, Zea mays
  Clone ID: LIB3279-209-Q1-K6-F7
gttctcctgtcaatctgctcactgctcacggacccaaaccctgatgatcctcttgtccctgagattgctcacatgtacaagaccgacagggccaagtatgagtccaccgcacgctcctggacacagaagtatgccatgggctagaagcaaggctaaaagctggccaaactggtgaatgtgccggaccccaaatcgttatcacctaaataaccagtcaagtcgcaagtatgaatggacttttgaggaccattgtgccctgttgaactcatgtattaccttgtgaagtccgttgtgtctggtttctacctgaccgtttcgttatctgatgctgtttctttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttcttaaaggaccaaagtttacttccccgtgcttgcaaggtaatagtttttttttggg

SEQ ID NO: 12826 - DNA, 647 bp, Zea mays
  unsure (1)..(647): unsure at all n locations; Clone ID: LIB3279-209-Q1-K6-F8
tgacacatgattgagaggtccaccaaccttgactggtacaaaggcccaaccctgcttgaggctcttgatcagatcaccgagcccaagagaccctcagacaagcccctgcgtctccccctccaggatgtgtacaagattggtggtattggaactgtgccagttggtcgtgtggagactggtgtcatcaagcctggtatggttgtcacctttggtccaactggcctgactactgaggtgaagtctgttgagatgcaccatgaggctcttcaggaggcccttcctggtgacaacgttggcttcaacgtgaagaatgtcgcggtgaaggatatcaagcgtggttatgtggcctccaactccaaggatgaccctgccaaggaggctgccagcttcacctcccaggtcatcatcatgaaccaccctggccagatcggtaacggctatgccccagtgctggactgccatacctcccatattgctgtcaagtttgctgagctgattaccaagatcgacaggcgttctggcaaggagcttgagaaagagcccaagttcttgaagaacggtgatgctggtatggtgaagatgattcccaccaagcccatggtggtggagacattctcgcagtatcctnccctnggtaggtttgctga

SEQ ID NO: 12827 - DNA, 526 bp, Zea mays
  unsure (1)..(526): unsure at all n locations; Clone ID: LIB3279-209-Q1-K6-F9
gtngatttgtttgtaggagctagnacttagtgttgttgaatgctgcatggttcctaatccttttcgcagtctaacatctgtggagttagtatgttacatggcaacagctgaacatctgtggactataactatatggcaacagccgaagattgtgtctgtgggataactggttgttttggttgctcttcagtagtttgtttgcttcaggtaaccatgctgcgaactatgatgttttcattctcggtttgcttcagctaaccgagatcgattcagtctgcagtatggactatggagtaaactgcatgctgaaacccgaaccactgctgaaacggcagttgccaggatagcaggagggcctttatgcacagtggaattgagtagagaactgagtaaaccatggttctttctccttttgaactggaacacacacagttggatcttgtttctcttcttatgccattgtcatcgtgtttataaggggtgtaaatggtacaaatattatctgcccgtattcacatttgatcta

SEQ ID NO: 12828 - DNA, 582 bp, Zea mays
  unsure (1)..(582): unsure at all n locations; Clone ID: LIB3279-209-Q1-K6-G1
atctcccctcaccanaaaaatcccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggacgcaccctctacggcttcggaggctaggctaggcgcctcttcatagtcggggactggttaggggacatgtctctgtgtgatgctttctgtggtattattgctgcaatagccgtgtaatccatcgcttctgcaatgaagcgctcggaagcatgctacgtatgttgtgtctgtgggtgattgtatttctggtagtaacagtgattgttcctgaattttggataatacaagctcattcgcagt

SEQ ID NO: 12829 - DNA, 654 bp, Zea mays
  Clone ID: LIB3279-209-Q1-K6-G10
ccccgcgtccgccaatttatagatcgtttgatttttggacaccaagtttgatttactcgtcttattaaaaaatcataattggtatttatttttattgtggtttaattttttcatactttcatagttttttaatcggacaagttagtcaaatttggtgtgaaaaaagtcaaacaacctataaattgagatcgggagagtatttttattggttccagtatttggaaagaaaaactagcgcaactacgtaaaaatttagtagtattttctatgtttctgcctttcctagtttccgtaccatttggggatgacaattttacacacgggtttggatatccgtcggatatctgatccatcgatttttgatttgggtacaatatttgacccgcgggtatcgcccatacccaacccatgattaaatcaggtcgagttcggattttatattttatccatgggtctcagcggatatccaaaaaacacaggcttttatctcatcctaatagccaatagcccatcaacaattccacggcaagctggcccagcccaccatcgctccatgcctccatctcgctaagcctctaaccctaggctccatcgcccaccactggcttatattgagtgatcctatccggtctcctcaagaagtctacagcaata

SEQ ID NO: 12830 - DNA, 440 bp, Zea mays
  Clone ID: LIB3279-209-Q1-K6-G11
gccgccgccaccccggtttccttcgtaagcccgtcgtcctccgtccgcgactctgcgcgagaagcgagagtatggacacccaagtgaagcttgctgttgtggtgaaggtgatgggaaggaccggctccaggggtcaggttacccaggtcagagtgaagttcttggatgaccagaaccgtctcatcatgaggaacgtcaagggaccggttcgcgagggagacatcctcacactgctcgagtctgagagggaggctaggaggctgcgttgaggcgggatactgtcttggtagttttcgtatggagttggatgtcatctaattgtgctatgtttgtcaaactttggtatgacctttaaaacacctgccttgtatgattatttgtgagcctggtggtaagattgcagtttggtttttatgatccggttgagggtatgtttggca

SEQ ID NO: 12831 - DNA, 510 bp, Zea mays
  Clone ID: LIB3279-209-Q1-K6-G12
agcagcgaaaactcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcaagaccgtcacagccatggacgtcgtctacgcactcaagcgccagggccgcaccctctacggcttcggcggctaggctaggccggtcgcgcctcgttgtcgtcgctgcggttctattgtttttgcaattcgcaagttgtggctgggtggcgaaaatgctggttactgtaccactagatcaagcatgttgtgcgtgtctgaagaaatgccaattgtgacttgctgtttgttc

SEQ ID NO: 12832 - DNA, 498 bp, Zea mays
  Clone ID: LIB3279-209-Q1-K6-G2
gctttgatggcgaccgacgtgactgagactcccgcgccgttgggggatgcggccccagaggcgcccgccgacgccccggcggcgcctgctgccgacgcgaagccggccaaggccaagaaggccaccgcgccgaagaagcgcgccagcccgacccacccgccgtacgccgagatggtctcggaggcgatcacgttgctcaaggagaggacggggtccagcagttacgcgattgccaagttcgtggaggacaagcacaaggccaagctgccgcccaacttccgtaagcttctgaacgttcagtttaagaagctcgtccgcggcggtaagctgaccaaggcgaagaactcgtacaagctgttttgcgtcaccaaggcgaatcctaagcccaaggccgctcccaagaagtccaagaccggcgctcagaagttcaaggtcgctgtggagcccaaagctaagaccgtcgccaaggcgaagcccggcacaaaggttaagcccccc

SEQ ID NO: 12833 - DNA, 636 bp, Zea mays
  Clone ID: LIB3279-209-Q1-K6-G3
cttagaaatttgcctatgaccacagagtctgcactgctctatctggatctaccttcaagcatttcaatggctgctgcagttcagccattgacggacaccgccaaggaattccttgccaacaaatacaaggatttgactaagttccaagatgaagcaatgaacattcctcttgctggaattgaagccatcctatggagcaatgaccttcaggtcgcgtcggaggatgctatctacgacttcatgataaagtgggcacgtgctcaatacccaaaattggaggaaagacgtgagatcttgggcacacgcttgctgcccctcgttcggttctgccatatgacctgcaggaagttgcggaaggttattgcctgcagtgatctggatcacgagcaggcgacaaaatgtgtcacagaggcacttctctacaaagctgatgcaccacataggcagcgtgcccttgcagcagacgtgatgacatgtaggaagtatgctgagcgagcttacaaatatcgcccgcttaaggttgtagagtttgataggccgtatcggcagtgcatagcatacttggacctgaagcgagaggagtgcagccgacttttcccatctgggcggatatactcgcaagctttccatctagct

SEQ ID NO: 12834 - DNA, 612 bp, Zea mays
  Clone ID: LIB3279-209-Q1-K6-G4
aaaaaaccggaggcttcggccccccttctcgagcccttcgcccaattcctcaatcggaccaaaccctaggagccacatagatttcgattcgatcggaaatctggcatggcaatgtcagatctcacagccaccgtgatcccgaagccagacggggccgacgacgagtcggtggagatccgggaggtgtgggcggacaacctggaggaggagttcgcgctgatccgcgacatcgtcgacgagtacccgttcgtcgcgatggacacggagttcccgggcatcgtctgccgccccgtaggcgccttccgctcccccgccgactacaactacgccaccctcaaggccaacgtcgacatgctgcacctcatccagctcggcctcaccttctccgggccgcgcggcgagctgcccgcgctcggcgctggccgccgccgctgcgtctggcagttcaacttccgcgagttcgacgacgcgcgcgacatattcgcgtccgactccatcgagctgctccgccgcagcggcatcgacttccgccgcaacgccgagcgcggcgtcgacgcgcggcggttcgccgagctcctcatgtcctctggcgtcgtgctcaacgattccgtg

SEQ ID NO: 12835 - DNA, 628 bp, Zea mays
  unsure (1)..(628): unsure at all n locations; Clone ID: LIB3279-209-Q1-K6-G5
gntcgaaaccccctggcaagcgccgccgttcggctccacctccgcgcttgccctcacccgctccacccgtggcgctctcgccgccgggcttcgtcgccgaccgcgccgaggccgcggcgcgcgtggagcgcctcctgcggtaccagttctgcgaccgcgcccttctagaggaggccctgacccaccaatccttctcggatggcgctctctcttaccagcggctcgagttcgtcggcgacgccgctctcggcctagccttctctaacttcctatacctcaccaaccccaccctcgggcccggcgcgctctccacgctccgcgccgccaacatctctaccgagaagctcgcgcgcgtcgccgtccggcacgacctctacccgctgctccggcgcaagtgcccccgcctcgacctactagtaggccagttcattgagtcagtgaagcaagaactaatgcatgaccttgccactgcaccgtatggtggtagcgtggttaaagctcccaaggtgcttgcagatattgttgaggccatcgctgctgcagtctacgttgattgcaaatttgaccttgagaagctttggaagattagaaaaagaggtggccctgcacatgaaaggaactttgtgtg

SEQ ID NO: 12836 - DNA, 627 bp, Zea mays
  Clone ID: LIB3279-209-Q1-K6-G6
cggccgcgtgggcggccgcgtggggaacacgacctggggggttcagatcggatcggaagcttccataagtttccatcgggcttcgccgctcgccggtatggcgatccgcaggggtcttcgtacgccgtcgcggcacttctcgcgctcgcctctgtcgccgccgtcgcaggggaggtcttcttccaggagaagttcgaagatggctgggaaagtcggtgggtcaagtccgagtggaagaaggatgagaacatggctggtgaatggaaccacacttcgggaaaatggaatggagatgccgaggacaaaggtattcaaacctccgaggattacaggttctatgccatttcagccgaataccctgagttcagcaacaaggataagaccctggtgctgcagttctctgtgaagcacgagcagaagcttgactgcggtggtggctacgtcaagttgctgggtggtgatgtagaccagaagaaatttggtggagacacatcttacagcattatgtttggaccagatatctgtgggtacagcaccaagaaggttcacactatcctgaccaaggatggcaagaaccacttgatcaagaaggatgtgccttgtgagactgatcagttgactcatgtt

SEQ ID NO: 12837 - DNA, 598 bp, Zea mays
  Clone ID: LIB3279-209-Q1-K6-G7
cggacgcgtgggtccggacagagtccagagccgccaggactctcaggtacgccgccaggcgccgggccgctcctccctccctccttgcctctgctaagcacggagtgaaatgcgagcaggctggtggggagtctaccattaccaccactcgctctacgctccggctcgctctaccctacccgacccgcatgctaggcgggggctaacccgttgctccaccatgttcaggacaacatgatgccggtatcagacttagtgtggcatgccaccggatgggttgactgcccttgcccacagccatgagggcttgagtccctctacagctcgttgcaggaaagctgttgaaatcaatagctttgtacctgaaggaacgggcagggctatatttacaaaggaggccagacattatgtctaggtggctcgcgtaagtatgctgaatgatgcccagaatttaactgggattaaaaaaaggatgtgtgtgtatttgtggaaagcaaaggcgagctgcatagctcatacctcttctggactatatgcctgtgtggacagagtggcggactggtggtactgcgtctggagcattctagtgattgcttaa

SEQ ID NO: 12838 - DNA, 637 bp, Zea mays
  Clone ID: LIB3279-209-Q1-K6-G8
gggggattcaaatgaagccaatgatgtaactgaggactctgatgtagatgaccagggagactctgagtatggctttgtgcttcggatcgtgctcttgcttgtactggcatggatgacattactaatattcaatgctggaatgatagtttttcctatctcacttggccgtctggtttttgaggctgttccccgcctgccaatcacacatggcatcaagtgcaatgatctgttctcctttagcattgggtgctatattctctggagtgtggcagctgggaccagatatgcgattgattacatcacatcacgacagctggggtttttggtacaacagatctgcaagtggtgctcaattgttttgaagagctctgttctcttgtcgatatggatctttgttattcctgtgctgattggactcctttttgagctgctggtcatcgtacccatgagggtgcctattgatgagagccctgtcttcctattgtatcaggattgggctctggggttaatattcttgaaaatatggactagactggttatgttggatcagatggcacctttggttgatgaaagctggaggtcaaagtttgagagagttagagacgatggcttctcccgtttaaagggtctgtgggtc

SEQ ID NO: 12839 - DNA, 633 bp, Zea mays
  unsure (1)..(633): unsure at all n locations; Clone ID: LIB3279-209-Q1-K6-G9
cccagcgtccgctcctctcctttcctctcctctaggctctagtcctctcgcatccgcagcttccccagccagctagggtttgcagatgacgaccgcggcgcgccccacctgggcgccggccaagggcggcaacgagcaggggggcacccgcatcttcggcccctcccagaagttctcctcccgcgacctcgccgcgcacacctccctcaagccaagaaaagacggtcaacagacccaagaggagttacagaagaggaatctcagggaggaacttgaggaacgtgagcgcaagcactactcttccaaggataagtcctatgccgaagaaagagaccggcggaaaagctctagccatctactcttagaaggttcaaagagagagacagaggataagatagttccacgagaaatcgatgctgatgactccgatgtggagcctaaaagcgatgacgagagcgatgaagatgatgatgacgacgacactgaagctctaatggcagagcttgagaggattaagaaagaaagagccgaggagaagcttagaaaggagcggcaacaagcagaagaggaggccaagatgaaggaggctgaactgatgcgnggaaacccgttgattaatatcaacaatgctgg

SEQ ID NO: 12840 - DNA, 574 bp, Zea mays
  Clone ID: LIB3279-209-Q1-K6-H1
cccagcgtccgcagtttcacatgaactactcaaacaacatgccgataacacactccacaaaacgctagctaggcaccgttatcgtcttcttcgggcttcacgaagaactctatatgcgcgatccggctcgtctgctcgttccctccaccaatgctacggaagtacggcatgcctggcctggcaagcgacaccaggtgctggaccttcagcatccctcccctcccgatcgagaccttggtcctgcggttctccttcacggcactgctggggatgttcgaggtggtcgctcggaggaacttgtatttgtaccttgaaggggaaaacagcgacgctctgcagattagcacggggagcagcggaggcacagatctgggcacgaggattttttttttacctgtgtgacacttcgtgctcgcattggaacacgattagaaggtcggtgtttgcatagtaggggaattcggtctgccgaatttgtgtgataagtgaaagtgagtcataggcacagctgggagctaaatggacatatataacaggacaacctgtaaaaccgacctgcaagagggcatgacct

SEQ ID NO: 12841 - DNA, 298 bp, Zea mays
  unsure (1)..(298): unsure at all n locations; Clone ID: LIB3279-209-Q1-K6-H10
gcaaagttggggattcaanagtcgttcaaggtgaagcaggccattcttctgtctgcaacagaggctgcggagatgatcctcagggtcgatgagatcataacctgtgccccgcgcagaagagaggataggatgtgatattacacgctgtttctcgatgtagcgggatgctcattaccctagttttgaggggtattatggtttaggggcgctcaagttggtcagatttcgagtgtttttggcccctaagcaactggtacttgttatttggttgaaacaatcagccttaggtttgtgttct

SEQ ID NO: 12842 - DNA, 622 bp, Zea mays
  Clone ID: LIB3279-209-Q1-K6-H11
cccagcgtccgggttcgttcttgattcttggacgaggtgggatttggagagccaaggcggcgcggcagcggcgggtttctcggtcggactagattgtttccatcgagatggtgccatggtgggcggcggagggcattcgtcgatggaccaccctggcgccaaggacgatggagacggggaagaaagccagtacttctcggacgcggaggaccggtcgtggccgtcgcactcgcgccacgactccaccgcctacgaggactacgtctcgctgtgcgtgtccgcccgcgcgagctccgtcgacgccgacgccgatgccgacggcgaggccgtcagacaacactgcaggaagtcgtcgtgcgtgtcagagggctcgctggacgacgttgacctggaggccggactgagcgagatcatcaaggccagccctgagaaggccgaacagaactgtcgcatttgccaccttggcctggagagcacggcggccgagtccggtgccggcatcacgctcggctgctcctgcaagggggacttatcctacgcccacaagcagtgcgccgacacctggttcaagatcagaggcaacaagtgctcgacatgcaaatatgtgatctcctctgatgat

SEQ ID NO: 12843 - DNA, 502 bp, Zea mays
  unsure (1)..(502): unsure at all n locations; Clone ID: LIB3279-209-Q1-K6-H12
ngatcgcgacggccccctttttttttttttttagctatttaaacgatggccattatcataattcccatgccaaagccgattattttttaacccaaacaaacttactggcttgacttagctgataacaaatcagcaatgcaagccgcacggacgaccagatagttgagcgtgagcatgcatgactttattcggagctgttcaccacccggcagttccggcggacctcgccgctggtgccgacgcccggtgcaagcctccccatccgcagcatggactccgcgaagtcctggaagaatacggaggcgtcgaaggcgtatgtggcgacgaggctggcgacgtccgcctctaccccaggcacggcagccgacgacgccagtgcctggtctgacggcagcagaccgtcgccagagagcaggttgatgtagtactggttgtcgaaggtcgccggggtggcgaggtccaggtgtgccagcgcggacccagccgacgttctagatcgcga

SEQ ID NO: 12844 - DNA, 611 bp, Zea mays
  unsure (1)..(611): unsure at all n locations; Clone ID: LIB3279-209-Q1-K6-H2
cggncgcgtgggtttaaaactttaaaaaccgtgaaaaatttaataaataactgaattatagtatatatgatgaatggttggagacatcttgtatatgagaaaaatttttttaggataatatagtaaaatataatagaaagtatagatacgagaagaaattaatataggaggaatggttggatattgccggtgtttggttcctagacattggggatgggggcgttccgagcacggagtattcgtccgtcatctttattcactgttgggggtgttccgagcatggggtattcgtccgtcatccttattcactgttgggggcgttccgagcacagagtgttcgtccattggagatgaaaatactgcagacatacttacaaagtcattatctaataccaagttcaagcattgtcttaacttggtaggtgttcgtggagcttagcaccctagtggtgtttggggaaacagttttatagatttagcgttaagggaagatttgttgaataagtagatacgaccctatctctatctcgtttgccaatataaataggctccctgtaccctgtacaatacaccacataatagatatattttcccgtgattttttctcctcc

SEQ ID NO: 12845 - DNA, 658 bp, Zea mays
  Clone ID: LIB3279-209-Q1-K6-H3
gttaagagtccagtgaacaagtggcgatgtggtgcggctcctatttcgtctatgatgactgtgcagcgatggtcgcgtggcccttcagccacccaaatcggaaagcctgctgttcacatggctagcgttgacttgaaaggaaaagcatacgatgtattgaggcagaattcttccaggtttttgttggaagatgtctacaggaacccaggtccgctccagtttgaaggaccaggtgccgattcaaagcctatctcactgtgcgtcgaggatcaagactacatgggcaggataaagaaattgcaggaatacctggagaaggtgaagagcattgtgaagcctgggtgctcgcaggatgtccttaaggcggcgctgagcgccatgtcttctgtgacggagacactgaacatcatgacctcatcgtccaccggccagactgcactgtgactcgtttggtgccgttttgtggtgcggatcagaatccccactttttccatggtgtcgattgacaaagttaggagcagtaatcctggtgccacacgggtcattcttttgtagcttcttgggagagttctgtcagttttgaattcgatagtttattatggagaggcttgttggtgagtttgagctccaataatttttgaaacaaacggattgcggc

SEQ ID NO: 12846 - DNA, 570 bp, Zea mays
  Clone ID: LIB3279-209-Q1-K6-H4
aaagatatagaagtaggaaaaagaggggaagctttgcatgaaagtgatgggttttgttgctcgtccttctacgaccattgttgagcaaattcgtgatgttattagtattcatatttactttctacttaattttaaattgttggtatgctcgtaggttaactttatctctagggctaagcttcaattcgacatccgcccattcttcagtcttaatgtcgttgccgccgagtacaatagtgattccccggtgcatccacaccaaggatttcatcaccaccagccccattaacgactacaatggtgaagagtttgtcttctactctacaaggaagtactgtgccaaaaaactcaataatagagtaccacaccaaccaaaatggctaattgttgccactagagagaatgtatagcctattatgtctggcacttagtgaatcgatagctttaagggcaagttatgcactcgagtgactacaatagggaagggaggccttccaaggcaagaaagtgctcgttgtcggttgtgataacacctttccaaaaataatgttcatggctacattgtttgtt

SEQ ID NO: 12847 - DNA, 533 bp, Zea mays
  unsure (1)..(533): unsure at all n locations; Clone ID: LIB3279-209-Q1-K6-H6
atcagntcggatttcgtagagatgaagccggcagtagaggcggaggctgacgagcgagcggcggaggagatggcacctaagaaggcagcggctgccaagaaagcggccgaggaagttgaggtggaggaggtggtggacggggacgaggcggtcgatggggagggcgacggtgacgaggacgacgatggggaaggcggtgacgaggaggatgatgatgaggagtggatggggaggagaaggaggcggcaggggttgtggagatctccgacgaagacgacgacgacggtgacggggaggcggacgacgacgacgacgatgacggggatgacgacgacgacgacgacgaggactcagacgacgaggaagaggtcgacggtgaagacgatcaggaggaggagctgggaaccgagtatctggttcagcctcttgggcgggctgaagacgaagagcactcgagcgactttgaaccggaagaaaacggtgagggtgccgacgatgaggagatcgatgaagaagacgatgaccgtgaggac

SEQ ID NO: 12848 - DNA, 569 bp, Zea mays
  Clone ID: LIB3279-209-Q1-K6-H7
aaagatatagaagtagaaaaagaggggaagctttgcatgaaagtgatgggttttgttgctcgtccttctacgaccattgttgagcaaattcgtgatgttattagtattcatatttactttctacttaattttaaattgttggtatgctcgtaggttaactttatctctagggctaagcttcaattcgacatccgcccattcttcagtcttaatgtcgttgccgccgagtacaatagtgattccccggtgcatccacaccaaggatttcatcaccaccagccccattaacgactacaatggtgaagagtttgtcttctactctacaaggaagtactgtgccaaaaaactcaataatagagtaccacaccaaccaaaatggctaattgttgccactagagagaatgtatagcctattatgtctggcacttagtgaatcgatagctttaagggcaagttatgcactcgagtgactacaatagggaagggaggccttccaaggcaagaaagtgctcgttgtcggttgtgataacacctttccaaaaataatgttcatggctacattgtttgtt

SEQ ID NO: 12849 - DNA, 555 bp, Zea mays
  unsure (1)..(555): unsure at all n locations; Clone ID: LIB3279-209-Q1-K6-H8
gcggcggcggagctggagnaccccggtgagtgccagtacgcgggggatccagtgttggtgcgaccgagccagccgacgccgcgccacaccctgcacctctccaacctcgacgaccagcggttcctccgtttctccatcaagtacctgtacgtgttcggcgccgacgccgccgtgcccgccgacgcgctgcgggcggcgctcggcagggtgctcgccgactactacccgctcgccggccggctccggccgagcgccgaggaggatgggaagctcgtcgtggactgcaatgccgagggcgccctcttcgccgagggccgcctcccgggcctcgccgccgccgacttcctcagcggcagcgaccggccgcacaagtcctggaggaagctgcactacagggtggaggcgcagagcttcgtcgccgtgccacctctcgtcgtccaggtcacttggctcgcgtgcggcggcatggtcctctgcaccgccatcaaccactgcctctgcgacggcatcggcaccgcgcagttcctccacgcctgggcgcgcgccgcgcgcggc

SEQ ID NO: 12850 - DNA, 540 bp, Zea mays
  Clone ID: LIB3279-209-Q1-N6-A1
cgcctacagaaacgtgatgcgaaaattctgcacataacagctaccacaccttcacacgttcctctctacatcgacctgatcatagtaagtatcatacaatatgccagtgccactaagaaaaggaaccaggctttcctctcctgaaatacaatctacaatacaacatctaccatcactcggcttcatctgcagtggacggcggcggcggtactggtggtggctgcacagcagcagcagcatcttcggacgttgcttccacagtatctgacgagtcattcgaacctgggatgttcggatcatcactctcgcttacttcctcctcccagtagctctgtagcagcttcatggctagctcgtagatcctgtcgctgtccacgtcctgcagatcctccagtttctccagacctccgcactctagaataaactcggcgtatgggttcgtccctgattcctcgcccttcttccccgcctcacctgcacggagtatgttctcaagaccttcaagacacgtgtatacaaggtcaggatcgttgtgggtga

SEQ ID NO: 12851 - DNA, 447 bp, Zea mays
  unsure (1)..(447): unsure at all n locations; Clone ID: LIB3279-209-Q1-N6-A10
gcttcaatcgcgtataataatataaaatagggcatcaacaagctacaacaccaccccacaacacgatgccctgggccttacagcgagcataggggtcattccggttaagggtcaacacccatgccccctggacctgaccaccaccaacacatgggacttctaacacttccggtatagcaaaaggtggttccacacctaacttacctcttggggcccatcagaccaaattcccaggtaacactcaataatacaagggccttaaggagccaacctatgagggagcacattcctttacaagagaaggtcattaacgcttacattaagccttcctcctacgcttntttcctgtggaagcatttcctgatgcctcctctatttcagatggcttgacttctacctcctgcttctctttgtcagaatcacccgcaggagtaccagcattttttg

SEQ ID NO: 12852 - DNA, 474 bp, Zea mays
  Clone ID: LIB3279-209-Q1-N6-A11
acaacagctcactcaggtcacattacatagtttcagcgaatgctgcccccacccaatgacaatatgcccggccgtttggtttttacacaggaccgactcggtcaccccatacaaaacttgcagcaaatttacagacacggacacagggcacggtctttggcagtggcagccaggtttttacaagggcaacgccaaaaaaaaacaatccagcaccaggcacactgtttgttgccggggcatgaggccatatttccgggtgatgtgagggtttttgaattaaaatgaaaaacggcatggcaatggatgcttcacgggtcaagtttgtacagcgggggggcttggctgctgtcccccttttttttcatggaagccctcgggtcttccctggatttgggggcgccctggacttaacagctggtccagtctttggagagcattgtgccttgccgccgatgtttttggagttccccaccc

SEQ ID NO: 12853 - DNA, 557 bp, Zea mays
  Clone ID: LIB3279-209-Q1-N6-A2
gccacaaaattgcggatctcattaagaaaagagttgcaattttacaacaagagaacccctgaggagttagaggcagccactggtttcttcactagataatacacgaggcatctgtgtttcagtatacgtttgcgacagactatactctcatacaagctatacaactatgattggattaacagccaatagcactcgtcccagatattccaccagcagcagttcggcccggcagaccaaagggaatcaccccaatgcaaatcctcaccacctgcggcgcttcctgccataccaatacccaattgcagcgatcgacacagctgcaatgacaccggctgtggcatgccacgcataagtaggttttccgacaacagcaagcccactgtcaggcacctccttctggctctcctgaatggcgagtgccaggccttgtttctcgagttcacccatgtctgtgaccacagcttcccgccgaacagcgatcgatatggcctcgtactcttcccgacttccgccttcaagaaacgcacccgcgatccgccctttgttgacccaatatg

SEQ ID NO: 12854 - DNA, 280 bp, Zea mays
  Clone ID: LIB3279-209-Q1-N6-A3
tttttttttttgcagatacttaatagatatcaaacgcccattattgcacttacgggaaccagagatgaaatcattcaagattcttaagcccaagcttgaggggccaaaggattggtatgctccagcagattattcttgggacagactaacccattcttaagttcataaggtaaagccttaaaaacatctctggtaaagcataacaatcttgtgattggccatatctgaaacatagccttatccacaatgggattaccatggtttaacatagcccttggac

SEQ ID NO: 12855 - DNA, 575 bp, Zea mays
  Clone ID: LIB3279-209-Q1-N6-A4
gaaagaaggcttgcattatataaagtacaaactcctagacaggggcataaagtttcaatggagagtcttgtggatagctgagctatatcaaagaatacaatccctaacctctctcttctgccctccatcactaggaaggatgtgtcatcttgttaattgtgcactgttgtgtctctcttctgtcctgtgatggaatagcttcgctattgatcgtctctcacaatccttaaacatattgagacggaatggtctgtcaggatttgtccttctcagttttaagtatgtatatgcaaagctgagctggtcacgaggtgtgaatcgatcaacttcattgtaccacaggcaggaaaataagttggacatcggtgtgtgctctcttgcgataaaagagccttcagggacatagcttggtagaagcctgctgggatccgatgggttgaaccttgtcagtccatccgcttgataaaactcaaattgctggtcaattattgtgtggttgaacttgttcagctttttattttgtgctacttcctcccaaacacaatggcgatcatagtgattggaaatagcatatt

SEQ ID NO: 12856 - DNA, 508 bp, Zea mays
  Clone ID: LIB3279-209-Q1-N6-A5
ggaccaatccaaagttcattactgaagcaatgaaattacaacagtttcatgacatctaggattgaagcccgaacataccaactactacctcaccagaacgcaaaccaaagtccaaggacaaaaagaccagagcttcaagtgggacaactttgacttatattacatgccagagaaggctgccacaggcctgctatgatcaactttctatgcgaaaagatcactgcataattcaggtatcaggattcaggagggttgggtacttgggtgatgactgtcttggatgccacagatgctatataatctgcagtttcatagaggtccttcctcctctgagcaattgttgtttccatgaactctttatgttcagccatggaatcaagaagctccagcagctccttagcagctgcctgagtttcttcttcaactttaagtgttacatcttggagcctcttctccgatttcttaagaaaatcatctgcctgcttttcagcagaaacccacgcgtccg

SEQ ID NO: 12857 - DNA, 436 bp, Zea mays
  Clone ID: LIB3279-209-Q1-N6-A6
aaacttaacaatctttattaactcttttcgttttagatgggattgtggatcatcatcccagatcccagtaatcccttgtgacataacactactgcttatactagtataaccatcaaggcctatatatccatgaccatgatgggccatgcatgcacgcctattgactaacctcgctagttcatttttaaactaaaacacgataaataaaaacgaaaagagagagtagtataataagtaaatactaccacactaatgatattatattcctcttattactactactacagatcatactcgtggtatagtagtgtgctactcttcgcggtcgattcgatttcagtctgactaaatacctccgacgatcatctgctcctgcatcctctcttctgtacacgtgcaacctccagggtccaatatatattgcatacgacgtgac

SEQ ID NO: 12858 - DNA, 543 bp, Zea mays
  unsure (1)..(543): unsure at all n locations; Clone ID: LIB3279-209-Q1-N6-A7
ccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgncgtagccgncgnctccacgggcaccaccgtacccgccgncgncgccgnctccacggccgccgcgggactgggcctcgttgacggtgatgttgcggccgtccagctccttgccgttcatgccctcgatggcgttccgcatcg

SEQ ID NO: 12859 - DNA, 542 bp, Zea mays
  Clone ID: LIB3279-209-Q1-N6-A8
aaacaataacgccaaacttaataacccagtagcaaagcgggggaataaagtcttacaacgtaagttgtaaaccacacaacgacagatagataagaaccgacagaaacataacacgataggagccactcagggcagatcacaggatagcagtggcacacaagcccgacgacgccgcgccagtagagcgtctagtactcgtcaccctcgtcgccgtcctcaccctcgtcaaactcagcaccgacctcctcgtagtccttctcgagcgcagccagatcctcacgagcctcggagaactcgccctcctccataccctcaccgacgtaccagtgcacgaaggcgcgcttggcgtacatgaggtcgaacttgtggtcaatgcgggagaagacctccacaacactggtggagttggagatcatgcacacgggacgctgcaccttggccaggtcaccggcggggactacgctgggaggctggtagttgattccgcacttgaagccagtcgggcaccagtccacgaactggatggtgcgccttggtcttga

SEQ ID NO: 12860 - DNA, 598 bp, Zea mays
  Clone ID: LIB3279-209-Q1-N6-B1
caagtctgcaacccttttgagatttaattgctgcatcgctacaatcgggtcagctacagatagattacactacaccggcagcttacacaccggagcggactcatgcacacaatacaacagcacatcctcgacgatatccgccatctctctcgcattcgagaatggcgcgcgctcgccattgccgtcccccaatcgggattttatctcgctattgctacggtacggccgccgctagccattaggtccacgtcgccgcgatcgggctggcgaccacgtggtggtcgctggaccagacgagccgcccgaacccgttggtgcccgacggcatcccgcccgccgtgaagctcaccgtgtagctctgcttctcgccggccctgctgaagctcagcgtcgacggctccacggtcaccgtcaccggggtgccgccggcggcggcgctcgcggccaccttgtacgtcccgggctgcccgacgttggttaccgtgcgggtgtgcttcgccgtgccgccggcggccgggaacgccacggagaaggacgggtagttgagcgcggtcaccgcgtaggtgcggttggcgctgcacccctcggacgcgtgctg

SEQ ID NO: 12861 - DNA, 286 bp, Zea mays
  unsure (1)..(286): unsure at all n locations; Clone ID: LIB3279-209-Q1-N6-B12
cacacatgaacaacgcatgcatttgaacaagagccaaataaacaagagagcctttttttcatccaataatatgtatgtacacttgcattttggtgacattctggagtgtggttttgatgggtgtccaaaggggtcagcatgtctgggtgcggntgttgaggagtgcgaccctagtgtgcaggatgctcctgaacacctngnngntcccggcttccatctcggggatgcacgcgtngagccgntccattttntncagctcggcgagctccctgtcctcttttttggc

SEQ ID NO: 12862 - DNA, 488 bp, Zea mays
  Clone ID: LIB3279-209-Q1-N6-B2
ccaacacattctcattgcattgcaagcatcaccgaagcaacagaatgatggcaaatcatgccttatacagcaacaaaggagacgtccatagttgcagaacacaaatttcacggcaaaaatattggccggatcagaagagaagcctcggaagaatacagggtgtgtagacaccgaaccacgcactggttaacaattaagtgtgcctataacagtccctctcatgacgtgcctcagttttgcactagttgaagtcaggcttctccgggtaagtacagcccgggcgctggatgataacgtttgcggcatagcaacctgccctcacgcagtcttcaatgcccttgcctagaaccaactgtgagaggaagcctccaacgaaagcatcacctgcgccgttggtgtcaacaagcttctccttgggcaataggatcacagggaaacgttttcacctttccatcctcagcaacaaccactggatcagcaccttgagt

SEQ ID NO: 12863 - DNA, 222 bp, Zea mays
  Clone ID: LIB3279-209-Q1-N6-B4
gtgcaaacaaagaaaaatagggtgcaagttgacggattgtcattgccatcctatatttccattaataccgcctcattcaggggctcccacatcaacatatcatcaagtcgacaaaccgtacaacgactcatcaatcaacagttccgcatatagccatgccatggtactacggtgcaaatttgccccttctacaactaaaatacaggccatggatctgagtcc

SEQ ID NO: 12864 - DNA, 613 bp, Zea mays
  unsure (1)..(613): unsure at all n locations; Clone ID: LIB3279-209-Q1-N6-B7
caaaaaaaatttttttttttttttaaaaaaaaaaaaggggggtttttttttttttttgggggggatattgtttaaaaaaaaattttttttttttcccttcaaaaaaaaaaaaatttctccccccaaaaaaaatatttgggggggtgttttttttaaaaaaaaattttttttttataaacgcccccaaaaaaaattttttttttttaaaagtttttttttttttttntttaaagaaaaaaaaaaaaaaaacacccctcttngtggaaaaagaacggagaaaaaatattttttttttnaaaaaaaaaaaataattttttttttttttttcccccccccccctccggaaagggagaagaagtttttttttttttttttttataaaatccccccaccataaaaaaaaaaaaatttttnnttgtttattttttttttttttttttngttgtcgcccccnccctccccaaaaaaaaaaaaaaaaaaaaaaaaaccncaacnggggggggtgggttgttttttttgttaatataanaaaaaaaaaaaattttttttctttttttttttttttttttcgccccccacccaaaaaaaaaggaaaaaaaaaaaaatatttttt

SEQ ID NO: 12865 - DNA, 138 bp, Zea mays
  Clone ID: LIB3279-209-Q1-N6-B9
gacacaaaagggtacacacgaagcagttcatctttatcctatcccaaacgatcgtttttacttttcgcctctatagctaacagaaacataaacagttttataattcgattgcccagatatctatagctaatagtttct

SEQ ID NO: 12866 - DNA, 565 bp, Zea mays
  Clone ID: LIB3279-209-Q1-N6-C10
tttttttttttttttttttttttttttttttttttttttttttttttttttttttttttttttttttttttttttttttttttttttttttgggggttttttttaaacttttttattttttttaagttttttaaattttttttttttttggtttgggggccggagcccaaaacccaaagggggggggatgttcaaaccaaacaaaaaaattcgagggggaaaaaaaaaacaagggggggggaagggcccgcctttgttgaccccaaaataaaaaaaagggggggggaaaaaaaaaagaaaaaaaggggttcaaaaaaaaaaaacccccccaaaaaaaaggaggtgaaaaaaaaaaaacggggggaagacgggggggccccctaaaaaaaaaaaccaaccctagggggggccccccctggcgggggggggggaaaaaaccacccccccgggggggggggggagggtttgcccctaaaaataaaaagggggggggggggagtccccaagggggggaaaaaagtggtgggttccccccccgctcattaaaaaatacctccccccccgg

SEQ ID NO: 12867 - DNA, 375 bp, Zea mays
  Clone ID: LIB3279-209-Q1-N6-C11
caaatcccaaacaaaacaactgccctccataaacaacaaacagtcagcacaagtttttcgcgtgcaatacatctgaatgacaatccaattgacacctaccaggatttgcccattcgtaacaaactgctgaaaaaaaaccatatacccttatggccaggcacaacacaaatctatgatctttttaggacctcagtaagcagcccaacccaggccatgtgcaaataaaaaaatccacctataaaattggttgcaaaaaaacaaccgagcaaagccacccttagccccccctcacaaataaccagcacttttttgagacttactcttatgggaccgtccattcacaaccagagggtgcctttttgtatcatgcgcttg

SEQ ID NO: 12868 - DNA, 352 bp, Zea mays
  Clone ID: LIB3279-209-Q1-N6-C12
agcagcaaaaagctaatctcaggtcccatattagcgagcggatctgtcacagatggtagcaggaagggaaacaaaagtgcaaaacatgtccagactcagcatgaacctggcgacccagaggcacgcgccatccacatttattctcggcatacacaagcagcaaccatccatgagaagcaggggggaaaaacccctactgggtcttgaacatgtggcggatcaggtcgaccacccggttgctgtagccccactcgttgtcgtaccacgagacgagcttgacgaagtggtcgttcagagcgatcccggccttggcgtcgaagatgctcgacctgctgtcaccaaggaagtcggt

SEQ ID NO: 12869 - DNA, 417 bp, Zea mays
  Clone ID: LIB3279-209-Q1-N6-C2
tctgcctccgcggccttgcgcgcctccgcgacgcgctcctcgatctcgtcttcggtgtagccgtgctcctcgagcgcgtccctgagcacgagcagcttgagctcgacttggcgcttgcggtcgtgctcgaggatctccttgttgggctttcgcatcccgccgccatccgcgccggcggcgtcggggggcagcggcctgtggggcctgcccggacccccgccggatgtggtggagcgggggcggggcttgacgaagaacgtgttgctctgcgcgtaaccgttggtgcccgacccccgcgcggtctgcagcccgatgccgttgtacatcgcggccgtcgggcggggagaagccggttggatcggcggcggcgcaatcctagggcaagggaagcctggctaggacgaacccacgcgtccg

SEQ ID NO: 12870 - DNA, 410 bp, Zea mays
  Clone ID: LIB3279-209-Q1-N6-C5
aacaaacaatgtaggcatgaacattatttttggaaaggtgttatcacaaccgacaacgagcactttcttgccttggaaggcctcccttccctattgtagtcactcgagtgcataacttgcccttaaagctatcgattcactaagtgccagacataataggctatacattctctctagtggcaacaattagccactttggttggtgtggtactctattattgagtttttggcacggtacttccttgtagagtaaaaaacaaactcttcaccattgtagtcgttgatggggctggtggtgatgaaatccttggtgtggatgcaccggggaatcactattgtactcggcggcaacgacattaaaactgaaaaatgggcggatgtcgaattgaagcttagccccaaagataaag

SEQ ID NO: 12871 - DNA, 505 bp, Zea mays
  Clone ID: LIB3279-209-Q1-N6-C7
aatcactaaccagacaaataaccaattggccatgcaatatagtcaaattttaaacatcgcatgaaaaattccaacaaaactcaggcactggtaacttcgattgtacctaggaatgttcataaaattgtctcagacttaaagcatgacaaagtttctaagcaaaactccgctgtgataacttccatagttccacgtccacgtccacccccacctcaaataaatatgagaaaatctaggcagagaaaatggcttcagcagcaaagataacacagtcctggacaccaatccttcttaagcggacgggatctccacctcgccgtcgtcaatctcctgctgcaggtccttggggtccttgccgtcgacggtgcacccgacgctgacgcaggtaccgaggatctccttgacggtgccggccaattccttggccatggacctgtgcctcatggtcctggcgatctcgatgacgtcgtcgaggctgatgttgccgctgtgcctgatgttcttg

SEQ ID NO: 12872 - DNA, 554 bp, Zea mays
  Clone ID: LIB3279-209-Q1-N6-C8
aaaaagcgaacatgttatagtaattgaacagtcggtgacgcaacgtcagtttcaggcacaccagcagaaaactcggcccaaatatcgatcaaagaccaacaatacgcatgtttggatacgatctggtttggacttacacgttacactagccaacctgtcaatactcagagcaatgcatgcatttggattacccacacgggacaccaaatcacttgttacctgaagatggtagatatggattcggtacagcaacgtaattgagatgtccaggtcaagagaggatactcccttgtgtgcaagccactggaagaggtaaggagccatgggcacttcgatcatcgcattatgtcgagctccaaaaaaaaaagagatcacttgtcccgggtgctgttcttgatccattccaaatacttggtgttaccaccagttatgggcagagcaataacttcaggaacatcatattcatgattggctttgacatgtgcagtcaaggcatccagaagtgattccctggtcttgatgatgagtaattcttcagcatcagattgtacctt

SEQ ID NO: 12873 - DNA, 473 bp, Zea mays
  Clone ID: LIB3279-209-Q1-N6-C9
gaagcaatgagcattattctaatgctttagagatataatttgagaacattctgaaacatgaaaagcaattcaaaaattaaagtggaagtaaaccatgagttgttagtgtgcaatcagaacagtaacttttgaaatgttgtacaactggaacgggcataatttttttgaaacatgttttggcatttcagcaataagcagaccactgttcttttttaaagccttgagtgtaaccaccttaccaccaacgaccatgttaatcacaattccgtttgccgccaaacatgttgacatgcgttttaagtaagcttccttctttgtgggaagctcatagtttatcagcactcgagccataaggggtgcctttgccatcgctgcctgaggcaagcaagcatttgttgcaactataatgcttattttagagccagtactttcaagcttagaactttcggcaatattggtagctttagcagttt

SEQ ID NO: 12874 - DNA, 543 bp, Zea mays
  Clone ID: LIB3279-209-Q1-N6-D1
gggaaacaacagcattaccgtgtattaggtagatttacggcatacaacaggcaaagttcgtccatcagtccaaagcaaaatgcgcagcaaccacactacaaaaaaccctcggacgagtgtatcaaactatatataaaacctaaggctaaccaccaacactcaaataaaatgaactctattcaaagtgctattccggcactagtaaataataactttgctagtgcaggttggtcacagcctctactcactctgggatcatctgctcattgtcggcatcaccctcagtttcaatttggggttgcttgggagctgaggctccaggagcctgcttcttcttgataccgctgacaatgtcatctattctcaaaagcatgcaagcagcctcaatcgctgtcttgaacgtctgcgctttaacgctgtaggaatcccagatctttcgctctttcatatcaacaatatcgccactccttccatcaatgccaacccacgcattttcaccattagcatgctttccctgaagttgtgtcattatcctaataacat

SEQ ID NO: 12875 - DNA, 597 bp, Zea mays
  unsure (1)..(597): unsure at all n locations; Clone ID: LIB3279-209-Q1-N6-D10
cccaaaatatgttctttctagttgagttttgagttattgattacattgaattctttaattttatttttacgaacttgtaaccagtaacgtagaaaactagttagtccataatacgatgacagtcatcaaacaccaaaactaatatagaaatggcatggtgtccatttctcgtttcacgggtgcatgcaggaaatgccaccggcgcccattgcgaagagggctagaacttgggcatggccatgctggcaccgctaactcggtgcgtgcgaattatgtcactgctggtcaggtgtacaggcgtggcggccaccaacctgactgtccggtacagcaagaccaaactgagagcacctagagggggggtgaataggtgatcctgtaaaaacttaaaacttaatgccacaaacttgattaagtgttagagcaataaagctaagtggctagagaggagttcttgcgaaacacaacaaccacaaaaagatcaacacagagagacacagtggtttatcccgtgattcggccaagtccaatacttgcctantccacgttngtggcgtcccaacggacgagggttgcactcaacccctttcaagtggt

SEQ ID NO: 12876 - DNA, 555 bp, Zea mays
  unsure (1)..(555): unsure at all n locations; Clone ID: LIB3279-209-Q1-N6-D11
acaagtgaactgaaaactgaatatcctttcctccaaaactgtacttgattggtaacttacaataaccagggtaaggtgagcctaacaagatgaacagcaagccccaccacggggaggggtatggtcggcagaagacttccaggccaacatccaaatgaaaactgttcgctgtgtcgatagcaaatatgtatctttagtgtcctgcagcttcaaaagtcgtccggcagccagagaagagagaactcatataagtctcagctcatattcaccagccattgtgatatatttaacccaggggagtgcctgataaccactcttttcaattatcttcagataacggacctgaatacctgatacggtgaaatatggtatctcaaatttcacccgtatcggcgccttcttttctggggccccttcttccgctgttatgctaggaagactaaattctgctctgcacatgtattccttgccaccagggaatgattttattttncaaaccattgcatctctctcaggagcatatgcagcagaccccattgaagttcttatatttgg

SEQ ID NO: 12877 - DNA, 587 bp, Zea mays
  unsure (1)..(587): unsure at all n locations; Clone ID: LIB3279-209-Q1-N6-D12
actccagcattcttgtattgcaaaaggtgaaatagcaagatggtaccaaataaatagataaaagtgcacatgctaacagatctcaacagttcacacgataacagcaacgatcacaaacaaaacttgtgatgatgaaaactaggtattgctaaagcaggcgcaggatcgcatcatttcttcttggcagccgccttggtcaccttggcgccggtcgggtccttcttctccacactcttgataactccaacagcaaccgtctgcctcatgtcacggacagcaaacctaccgaggggaggatacgctgagaatgtctccaccaccatgggcttggttggtatcatcttcaccataccagcatcaccgttcttcaggaactttggctccttctcaagctccttgccagaccgcctgtcgatcttggtaatgagctcagcaaacttgacagcaatgtgggaggtgtggcagtccagcactggggcatagccgttgccaatctgcccagggtggttcatgatgatgacctgngaggtgaagctggcagccttcttggcagggtcatccttggagttggaggccacaaacccaca

SEQ ID NO: 12878 - DNA, 93 bp, Zea mays
  unsure (1)..(93): unsure at all n locations; Clone ID: LIB3279-209-Q1-N6-D5
nnttnttnttttttttttttttttttttaaacaaattatattcaatactatttatatttatatcaaatatattatactggaacttttaataca

SEQ ID NO: 12879 - DNA, 443 bp, Zea mays
  unsure (1)..(443): unsure at all n locations; Clone ID: LIB3279-209-Q1-N6-D7
cccccttttttttttttggggggggcccaaaacccggggggtttttttaacaaaaaggtgtgttttttttttttttttttcccccccccccaaaaatttttttttttttttttttttttttttggggggggggctccaaaaaaattttttttttttggggggcggggggtggttttttttttttttgtgggggggaatttttttttggtttgttttttttttttttaaaaaaaaacaacccctttttttttttttttttttttggtgggggggggggggggaaaccaccccccccnccccnaaaaaaaaaaaaaacattttttttttttttttttttgtgggggggggggggggggggccnccccccccccccctttaanaaaaaataaattatttttttttttttgggttttttcccttttgngggggggggngggggggag

SEQ ID NO: 12880 - DNA, 540 bp, Zea mays
  Clone ID: LIB3279-209-Q1-N6-D8
ccaatacaaacaatttcccttcgtatattatttcagaccgtttgcagtaatgtatgcgggtacatccatcagaataccatatcaacagaatcaagaaatgcgagaactccaaaatatacattctccatagagggagtgcactgcaaactgagacaagaaagcacaaactgatggcggtgttatcgcactgtacatttcttcaggtcacatcttccaagaaacatagatgatcaggtgtttatccaatgggcacaaatacttcgcatgcttagagggtgtttgatttctaggaacttatttttagtctatccattttattccattcaagtctctgaattaccaaatactaaaactaaaataaagttttgatttccgtgtttggtaatttagggacttaaatagaataaaatggaagaactaaaatttaatccctataaaaccaaacacccccttagtccccttggtccagggaaagtcttgagaaacagggaaatgttttccatgatcttcacaccttcctaacactctttccgtactctt

SEQ ID NO: 12881 - DNA, 565 bp, Zea mays
  Clone ID: LIB3279-209-Q1-N6-D9
gttctatcgtacccttttatttctagcaaactaggcagaatacagaaacacagaaaatgagggacactaatccaggtcatgttctcagccaggaacgcacatctgctttattaacaccttacatggaattcccgaggtgttaggcttgaatcgatcaatagacacgtgcttttggcgggaatgactctacttcatcgtccaatgtgttcatgtgcaccggcctgtatgccaatcgaaccttctcgttctcccagtatcccagtgagtgtttcatccacttctcgtcatctctggtcgtgaaatcttcacgagcatgagctcctctgctttccttccgagcctctgccgaatacatagttatgcatgcgtttatcaaaagattttccagctccagggtctctatcaagtcagagttccaaatgagactccggtcgctgagcttcacatcatggaaactttcccatgttttgctaatcagttcacaaccttcttcaagtgtttcttgtgtacggaacacagcagcattattttgcataacacgttgcatgttgagacggatcttgga

SEQ ID NO: 12882 - DNA, 435 bp, Zea mays
  Clone ID: LIB3279-209-Q1-N6-E1
gatcgcatccatccaaatcacaagacagaaaatcggaagatgtaattttatcaggcagaaggtactgattaggtctctcacaagacttaagggaactaaagcagacaataataggcgattgaggtgcaggaactgcatttggaacaaaacaccactttgatagtgtccgatgatttctagttgtatagcctttaagctgatgggatctcgacctcaccatcatcgatctcctgctgcaagtccttggggtccttcccatcgacggtgcacccgacgctgacgcaggtccccaggatctccttgacggtcccggccaactccttggccatggacctgttccgcatggtcttggcgatctcgatgacgtcgtcgaggctgatgttgccgctgtgcttgatgttcttgaccttcttcctgtccctctcgggttccttg

SEQ ID NO: 12883 - DNA, 326 bp, Zea mays
  Clone ID: LIB3279-209-Q1-N6-E10
agcaataaaatttagtaatttattgcacagtaagaagctttttcatgacaatcatccagcaaacgtgataatgcaacagtttatagtttcatcgtcacaaaaaagaaacgaattcggaaaggaaaaccatgagggaaaaaagggggcagcaccttgtccattaatggacctttaaattcattacgcttttgggcttgggggcgtaaattgagtaaaataccggttgggggtttgcaacctttaactggtggtttcccaccgcaaacaaaggggggggggaccggccctccgaaaaggggcttttttcccggaaagggttcccgggg

SEQ ID NO: 12884 - DNA, 585 bp, Zea mays
  Clone ID: LIB3279-209-Q1-N6-E11
gacccaagtacttataacactgaagacaccggtacatcacaggcacacatcgcctgcttgttcttattacaggcacgagcatcacgttgctactatcacaaccagtcctgatgcacgccatgcctgatacgactgattatagtagaaccagtattatactggtattagcacagccacacactgctatcaagcaccactactagtagtataatattgtagtgatataagcagggagtccagcccagccgagcacgagcagagtgcctgccaggctctcccgccgccctttttatgagcgagcagcagtgtgggctgggctagcagcgccgcgcggctcacgcggcggggggcggcttctcgacgtcctcgagcgggcggaaccacaccttctggtccagcaccgtgcctcctgcagcatccgcgccggcgtccggcgcgccaccagctgccagcttggggtccaccgccgccgggccgaacacgccggtcttggggtgggggctccagtacttgtcggggctcccggcgctgccgatcacatcgtccggcacgaacgccgggcgcacctgttcctccaggttcttg

SEQ ID NO: 12885 - DNA, 321 bp, Zea mays
  unsure (1)..(321): unsure at all n locations; Clone ID: LIB3279-209-Q1-N6-E12
agtacgtaaacatcctttttttcatacattaggccgatcggatccagaccagatacacagcacactccagcagacagtacacgtacaaagctgtcatttcgtacacgcttaacttctcaaagatcaaccgcgcgtggctaagcatattagcaccgccaccacgcggccgtaccttttttttttttggctatagctaaaccagccaccgtaccgtccgtcgtccttccagattgggacacgaaaagaacgccggcgagggagagcatagcagagtatagaaaaccatgggcaccgggtcactcactccagcccacgcgtncg

SEQ ID NO: 12886 - DNA, 527 bp, Zea mays
  Clone ID: LIB3279-209-Q1-N6-E2
aacacgtcaaacacaattaattagacgtgtaccgcaccaagcttacattactggcgcatttcctagcaacagattacaacccacccgactgaaaaaaaaacacagcacagcgagatggaaagggggcgcccaggcggttaaaacggtgcgcacggggccttcacacagaacagcacagcacagcccagactgacgaggaaggaaaatcagaggaactggtgcaagcaagctgtgcgaatcgcggattgttaaaagtggtggggattggcagagcaacacaggtgccatcaccagggagttttgtcgcctggcccagcaaggatgatattgcagtctacagcgaaacgccgagcgagcatgatggccgtgttgcgttctcgagtgctctcgaaggctagcaccaagctgaggtcatttctgggtcgccaaaacatcgcctgcgaggctgcttcgccaccacctttaacaccacataactgtaacgaaaaacacggacccgtgggcggacacctgggcggacgcgtggg

SEQ ID NO: 12887 - DNA, 222 bp, Zea mays
  Clone ID: LIB3279-209-Q1-N6-E3
agcaaatcccaaaccttattgggagaagcacaacctttgtagcaacattcagttttataagttcatcaggggggaaacaaaccacccacattttattacaccacagacaagcattactacattctagcacagcacctgggtattccgagccttcagtggagttccttgaggaagtcggtgttgtcaaccaaaaccactttccagccatttggatcaacaaaa

SEQ ID NO: 12888 - DNA, 588 bp, Zea mays
  unsure (1)..(588): unsure at all n locations; Clone ID: LIB3279-209-Q1-N6-E4
ggtaaatagcagtagttgataactaattgcagacaagtcattgttttacacagcatcattcaaatccttaactggaatcaaacaaagtgctcaacgaacagggcaccaaaaacttgcacaggaagaatccttatctctcgggcgctcaagacacagaacacgggtacgatatacctctcacatgaaaaggttgggcctggaagccttgaaagtggtccggagcttcctggtaggcggcctgaccttgcggtacacaagcgggaacttgatctcggagttgtggaactgcttggtgttgtccctcttgcacagcttgaagtggaccgtcgctgtcttgatgatctgtatgcagggggacctcacgcggtggcgggaggccatctcgttgtacatctgctccactgcgccgttcaagggtggtngtcgcggtactccttgtacatgnttgtggtaaccagtcctgctctggtagcgcagccagatgccatagttcttgatggtgggtcgggttgcgctcaaagatctcgttgatggcaagcatctggccattgctcttcttcaccttcttgagctttctcaggaagtacc

SEQ ID NO: 12889 - DNA, 547 bp, Zea mays
  Clone ID: LIB3279-209-Q1-N6-E5
aacctcaacgatagtagtgtaaggcaagtaaaattttatcagtacatcgtcttgatgttgaattcccctcctctctggatgctcgctactccaagagaaaagaagataagagaagagagggctcccgctctactcgaacttcttgatgagggagaggtcgttgagcatcttctcgatcttctcgtccccggggtcgccgacgaacctgccgccggacttgagggaggggacgagcgcggtggcctcgccgctggtgtcggggcagaggttgccgagcgtgcagagctcgaactcggcgaggccgtagcggctcagcgtctcgcggacctggcgcacggcgtcggggttcttgtagcggctgaagcgcttcacgtactgcagcgacttctcgaacacctgcgacacctgcgacgacgggtccgactccgacgacgcgtgctgctggatctgctcgtacttgtgctccaggatgatcgccacctcgcagttcatcaggcacttggccttgaggaactcttcgccgatcttgagctcggcggcgttctcc

SEQ ID NO: 12890 - DNA, 557 bp, Zea mays
  unsure (1)..(557): unsure at all n locations; Clone ID: LIB3279-209-Q1-N6-E6
gaaatattatcgacccaattcacacanaatacattagctttcttttagcaattatatcacttaaaatatccaacatcgttgcataggtggcaacaagcactgtcgcatgaaaagtccttgaatgctcatgagcaaaagcatgttcacactcacaacccatttctactgatagagaagagacaacatactacctaagctctatgatactgcgaaacagtagtgtttttggagcatgatgtgctcgcttaacttgtctcggtcttctctagggtgttgtagttgagcaacttctcaatgaggtcaacatgtgtcatgagcattcgcctgcagcagtagcggaacaattccaaagcatccagagcatccccttctgagtagtcggcctggaggaggtcgaggtagacatcccacttgttcccaataaccttgccgcaggtgaagcagcgcactgggataatcatcttcaccgccgccgcggactcccgctggagcacggagctagggagggggaagggnttttggtcgttgcccggacgcgtgggcgggacgcgtgggcg

SEQ ID NO: 12891 - DNA, 570 bp, Zea mays
  Clone ID: LIB3279-209-Q1-N6-E7
aataacactataattaatataatataaataaataatattcaatatctcataaataagtattgtcaaataactcatacataagtgtactctaaatttaaacttgctcatcaactgtttgtgctaacattgagcctaactaagtatataacttgatgaagtcaacttgatgaagtccatgatcttgttggtctccagatcgatcttgatggtgtcgttggccttgatgagagggtcggggtagcggatggtgcggtcgtcgtaggtgttcaggtaggggatgactttctggccaaactgaacagacctcaccttgcagagcttgaactgcacacaaaccaatacaaagtgtggttcttgaaagacaattgatccttgaaagacaattgaccgcaacagccatttcatccatcatatcatggcattctcgcttgtgggaaattggaggatgcatgctttatagaatacttggatccactgtacaaattgatacttttctcctatgctcaggggatagatccaattgagcactatgaaaagccatgtcgcgcaaacctttaaggtgtagaccga

SEQ ID NO: 12892 - DNA, 603 bp, Zea mays
  Clone ID: LIB3279-209-Q1-N6-E8
gtgagcaaaaagggtgtattgccttgttgccagtagaagaatgtattgtctagtcctactgagttgtaacaaagtgagcagtaaccatctgcactctaatttttcacacaagaggacctctccactactctggagaagaaatcatatctacctccctggaggttggatcgtcatcttcgtcttcagatatatcatctccagtgcttatgatatccatattgcttgcatgcctaacaaattgacctcgcacccttggcctcgtctcagcaagtttcttcctgttcacatacctcaccttcttgtcaaaacagcgctctttccttttctgcctgaatttagcaagtgctgcagcccttctcttggagcgattgcatgtttcgtcaggcgttggtgtgctcgatgccgatgaccacacattttgcgtcggtaaatgacttgagtgcatactcatgccagaagtattaaactgaaatgatgatatcatgggtaaactatggcattgggagaaaacattgtactgatgaagcatcgctggtggtgtatgtgcttgagcactgtttatgtttgcttgaaaattttgcactgatgaaagtgccatgtttg

SEQ ID NO: 12893 - DNA, 591 bp, Zea mays
  Clone ID: LIB3279-209-Q1-N6-E9
gaaagcaaagcatctcagagatcaagaaaacaataacgccaaacttaataacccagtagcaaagcgggggaataaagtcttacaacgtaagttgtaaaccacacaacgacagatagataagaaccggcagaaacataacacgataggagccactcagggcagatcacaggatagcagtggcacacaagcccgacgacgccgcgccagtagagcgtctagtactcgtcaccctcgtcgccgtcctcaccctcgtcaaactcagcaccgacctcctcgtagtccttctcgagcgcagccagatcctcacgagcctcggagaactcgccctcctccataccctcaccgacgtaccagtgcacgaaggcgcgcttggcgtacatgaggtcgaacttgtggtcaatgcgggagaagacctccacaacactggtggagttggagatcatgcacacgggacgctgcaccttggccaggtcaccgccggggacgacgctgggaggctggtagttgattccgcacttgaagccagtcgggcaccagtccacgaactggatggtgcgcttggtcttgattgtggccacagcagcgttcacg

SEQ ID NO: 12894 - DNA, 479 bp, Zea mays
  Clone ID: LIB3279-209-Q1-N6-F1
ttttggttttttgcaaattagatttctgaaatcagggaatcacgtttcaaccacaatgcacagatctactaaccagttccaataacaacgacgacactacagaagtaaagatctactgaacacgagcattcaacatcacagcggtaaaggcgcccctctatgccttcttgggggacttagcggccttcttgggcgacttggcctccttggccgccgccttctcagcggtcttcttgggcaggagcaccgggttgatgttggggaggacgccgccgtgggcgatggtgacgccggacagcagcttgccgagctcctcgtcgttgcggatggccaggagcacgtggcgcgggatgatgcgggtcttcttgttgtccttggcagcgttgccggccagctccagcacctcggcggccaggtactcgaggacggcggccaggtagacgggggcgcccgtgccgacgcgctgcgcgtaccggccc

SEQ ID NO: 12895 - DNA, 489 bp, Zea mays
  Clone ID: LIB3279-209-Q1-N6-F10
acaaacaagttgcaatctaatacgatggtttaggattcttcatcacattgtcatagccacatgtcaaaaactcaaaacttgagtacttggaattacaaaagcctacagacataacgttagataagtcttggacagcataagccaatttgctaatggctgggtagcgagggtcttagactctcagtcgaacaggctgaagcccatgtcggcatcagactcctacttgggctcttccttcttctcctctgcaacaggggcagcagcagctgcagcacccccagctggggcggaagcagcaactggagcaacgccaccaccagatccaacggataggattagatcctcaacgctgcgcttctccaggagcttatcaaaaagcgccggccagtaggactagagcttgatgttggccggcttacgatggtggcgatctttcagcagtgatagcgatgccatcttatctgacgataacggctgcgtatgtgcaag

SEQ ID NO: 12896 - DNA, 599 bp, Zea mays
  Clone ID: LIB3279-209-Q1-N6-F11
gaaactaatctgacataacgatccacggacacagccacacaggactggcagaccgatgcatagacgaatttgatcatgtagttagatctgttacaactccaataagcaaagcagagatacatctctctcgttccaaacttcctcctgtgtggacagccttgcaatcttcacttggtgaattagaagcatacaaaatgacaataaagtttgaattattctatcggcagttatctctagataaaaaaaaatctcttaagcaaaataactgaaactttctatggaacataggtatactagctcataagccgtctgattccgaggtcttggtgattttaggtcctgcccactgttggctagcacgtgacttggcccatggatcaagaggggctcgttgaggaggcggcggcgttgcaggtttggcctctcgaagctcattctccctgtccacgaactcgatgtatgccattggagcagcatcaccaacacgtatcctggttcttaacattcttgtgtagcccccagctcgatctctgtagcggaaggccagctcagtaaatagcttatgaacgacatcatcacctcgaacaaaggcagcagca

SEQ ID NO: 12897 - DNA, 555 bp, Zea mays
  Clone ID: LIB3279-209-Q1-N6-F12
aattccaacgtatttctttgatcaactatagcaatcagcacgttccacacagagaaccaactgttacatctctttgtttcaggtacatgcattttcacgcgcgagcacaggaacaatcatttgcatcatgtagatatgatctaacataacatgacctaaatggtaggatggccaagaatttgcatctgaactcgctattttggaggcggggtatttgcgagcctccaggaaaaagggtccaagactccaaggagtctagacccagccacctcaccagcagggaatgcgcctgagatttcttcgaggtcttccttgctcagccttacctttacagcaccgatattttcgtcaagggtcttggcttttgttgttccagggatggggaccacatcttctccttgatgaagaacccacgagagagcgagttgagcaggtgtgcacccatacttcttggacaacatttcaagtcgtgtatacagaactttattcttctccaagttttccccagaatatcttggatgtttagactttccgagcaggacctcgttggtgtgt

SEQ ID NO: 12898 - DNA, 477 bp, Zea mays
  Clone ID: LIB3279-209-Q1-N6-F2
gctcaaccagtaacgagttgataataaggggacgacatcaaattttttccaaaattcaaaccaggacaacaaattgggcttctaatctcggtacagagtgatgactaattactggcgactgatcaaacacaacggttgcactttgctgatggcaacacggagggccacaatttgttttaaaccttgaatccaagggtgttccttctgccacgagcctttttgaactttctttccttggagcgcacatacggcttggtgtggctgtgcggcactccaagagccttgccaaaatgccttactgccttacgggcatttttggggcccctcaagaagaccctgttcttgccaagtggagcaccaaaagcaagctggtcaaatgtgaggcactcgccaccagcattgacaatcctggcccttgctgtcttcgtgaaccttaaggcagtaaccttcattgctggaacctcctggatccttttg

SEQ ID NO: 12899 - DNA, 602 bp, Zea mays
  unsure (1)..(602): unsure at all n locations; Clone ID: LIB3279-209-Q1-N6-F3
caacagttgcgcaaatttaagatatcaatcaacagaacacaaagagtgatctaacgttgtgagacaaacatgtccaagttcgttcataaacatggcgcttctacaattcatggttcatggatacatgcggctccgctcaaggttttctcagcaacaggtttaagcagaagcagtaggcgcatcggccatctcctgttcaaccggagttttctgaaccgggtagtagtggtagtgcagctccccgacatcatccccagaaagcttcgtccaaccatcagggccaacgtggtaaacactaacacaaccaccacttgctgcatcacggaatgttgccccataaatagcccgtcgcgctaattcggcggcttcctcaactgacatgctgaagcggtaaccatcatccaagataccataagcatacagtgaaccagagccaacagagaacctgttccccacgagccgcgcaccctcactgtcaacatagtacaagccaggacccttctcatcccatccagcgatcattgtaccaatcgacagtcccatcccacgatatgaataaagggatgttagccaacagtttggaagcaccagncatagagatc

SEQ ID NO: 12900 - DNA, 492 bp, Zea mays
  Clone ID: LIB3279-209-Q1-N6-F4
aaaacaaaatgcatgttatcataccctttaaaaagggaaacttgggttcttgtaaagacaaaaaaataatttggttcaactggcgataatcactttgcctagggtttcttgttgggggattcaaaagctcgacctttcgatagtgtgttgaaaatgaatagtttcaacaacttccaccatttgagccatgtgccacattttttcatgatgtgccaccatgagctccttttccacgacgtttggtacatccatgaccatagtcgccttgaccttagtcacaacattatgctgaagtcttggtcattttgtttttatgccgcttaacttccatgactgagcatacattgacttcggtcattaagcatgccatgcggtttagcacggagctcgagatgcctcaataccataaaagttgcaatgatcgtggtcccggggatcaagaagtgtcgggtcacgaatcccgagaagacagcaaaatcgacgacgtcgtcg

SEQ ID NO: 12901 - DNA, 417 bp, Zea mays
  unsure (1)..(417): unsure at all n locations; Clone ID: LIB3279-209-Q1-N6-F5
aaggggggtttttttttttttttttaaaaagggggggaatttttttttcaccccccttttttaaaaattttttttgggggggggcaatttgggttttacagttttttttttntttttttttggggaattttttttttttttaaaaccactttcccccttttggggtttttttttttttttttcccccccccaaaaaaaaaaaagggggttttttttttataaaaaaaaaaacccccccccccccgaaaaaaaaaaaaaaaacccccggggggttttttttttctaggggttttttgtttttttttttttaacacttttttttaagggggccccacatttttttttttttttggggggcgggggctttttttttttaacctttttctcttttttttttttggagcgtttttttttttt

SEQ ID NO: 12902 - DNA, 404 bp, Zea mays
  Clone ID: LIB3279-209-Q1-N6-F6
agcacgggccacccttaccactggttttcaaatgccaggagggagtttgtactttttgcccccaactggggtgaaactggaaacaacattttcaaaaaggaaacaaattttaatgccacattgaaagtccagcggttttgggggcattgtcaaccctaaccattccggtttccacaaaaaacacattgtcacaaagtaaaaaaaacataagtgaaacaaacatagtccggcgattatgggggcattgtcaaccctaaccactgagcttcaatagccaggaactggtttgccctccttgatatttgcaggtggtaaacttactgccttgcatgaatatcgcgaggcacctcggccagctcgcactgggagacaaggctggcctcggggggctcccaagcgggttg

SEQ ID NO: 12903 - DNA, 345 bp, Zea mays
  Clone ID: LIB3279-209-Q1-N6-F7
aaaaaaaacagctttaaataacaaaacgggcggggggaaaccaaacccaacgggcttaaaaggggaatacatgggttcaacagggcccaaggggcccaaaaaggccatttatacttgggacttggcgggttttttaggggaaaacaattggggggccggcccattcaccagtttggccagtttttaaccttgtttttaacccatgggatacttttgggtccaagagcgggggggggactaaaacttggccctgggggttttgtacatgggaacaatttcagggacaaaaggatcattagggtttgggccccggagccgggaccaaattgacaggaaaacccgccc

SEQ ID NO: 12904 - DNA, 569 bp, Zea mays
  Clone ID: LIB3279-209-Q1-N6-F8
aaatctaactagacgacttggtaaaaatccatttaacattgcccaaatgtctaacatatgtcatatatagcattcttgtattgcaataggtgaaataacaagatgctacataaacagataaacgggcacccaatagtagagctcaacagttcacaaggtaacagcaagtcagcaaccacagcatacaaaacttatgccaaaatggaacatctcagctacgtattggaaaagcagacgctgcatcaacgacaggtcgcatcatttcttcttggcagcagccttggtcaccttggcaccggtcgggtccttcttctccacactcttgatgactccaacagcaaccgtctgtctcatgtcacggacagcaaacctacccaggggaggatactgcgagaatgtctccaccaccatgggcttggtgggaatcatcttcaccataccagcatcaccgttcttcaagaacttgggctctttctcaagctccttgccagaacgcctgtcgatcttggtaatcagctcagcaaacttgacagcaatatgggaggtatggcagtccagcactggggcat

SEQ ID NO: 12905 - DNA, 464 bp, Zea mays
  Clone ID: LIB3279-209-Q1-N6-G1
actgcgaatgagcttgtattatccaaaattcaggaacaatcactgttactaccagaaatacaatcacccacagacacaacatacgtagcatgcttccgagcgcttcattgcagaagcgatggattacacggctattgcagcaataataccacagaaagcatcacacagagacatgtcccctaaccagtccccgactatgaagaggcgcctagcctagcctccgaagccgtagagggtgcgtccctggcgcttgagcgcgtagacgacgtccatggcggtcacggtcttgcggcgcgcgtgctcggtgtaggtgacggcgtcgcggatgacgttctcgagaaagatcttgagcacgccgcgggtctcctcgtagatgagccccgagatgcgcttaacgccaccccttctagccaggctccggatcgccggcttggtgatgccctggatgttgtcgcggagcacct

SEQ ID NO: 12906 - DNA, 569 bp, Zea mays
  Clone ID: LIB3279-209-Q1-N6-G10
gtccaagcacctactaagaaatgcatagattaattgaatatgaatcctaatcccaaaccaagagaaatatacatatgtaatggcacaaatcagcagtatacggtacaacagcagccaagttctccacgggaaaacacgccaggaggcaagagtcgttgttacttgcttcgcgaggacgccagtattagcatacgactcccaccttttggaaatgaaccggcgaaggcgaaggccgggatgacaacacactagagatttttccacaacctgtagagcagttttgcacttcagctccttcaatagctccttcaaatagttgtacatgagctcaagattttgagtagcgactcatcaatcataccgcctgccttcccctccgctcctatttggtgcctcctccctattgctgtagaccttcttgaggagaccggataggatcactcaatataagccagtggtgggcgatggagcctacggttagaggcttatcgagatggaggcatggagcgatggtgggctgggccagcttgccgtggaattgttgatgggctattggctattaggatgag

SEQ ID NO: 12907 - DNA, 439 bp, Zea mays
  Clone ID: LIB3279-209-Q1-N6-G11
gccaaacataccctcaaccggatcataaaaaccaaactgcaatcttaccaccaggctcacaaataatcatacaaggcaggtgttttaaaggtcataccaaagtttgacaaacatagcacaattagatgacatccaactccatacgaaaactaccaagacagtatcccgcctcaacgcagcctcctagcctccctctcagactcgagcagtgtgaggatgtctccctcgcgaaccggtcccttgacgttcctcatgatgagacggttctggtcatccaagaacttcactctgacctgggtaacctgacccctggagccggtccttcccatcaccttcaccacaacagcaagcttcacttgggtgtccatactctcgcttctcgcgcagagtcgcggacggaggacgacgggcttacgaaggaaaccggggtggcggcggc

SEQ ID NO: 12908 - DNA, 513 bp, Zea mays
  Clone ID: LIB3279-209-Q1-N6-G12
gaacaaacagcaagtcacaattggcatttcttcagacacgcacaacatgcttgatctagtggtacagtaaccagcattttcgccacccagccacaacttgcgaattgcaaaaacaatagaaccgcagcgacgacaacgaggcgcgaccggcctagcctagccgccgaagccgtagagggtgcggccctggcgcttgagtgcgtagacgacgtccatggctgtgacggtcttgcggcgcgcgtgctcggtgtaggtgacggcgtcgcggatcacgttctccaggaagatcttgaggacgccgcgggtctcctcgtagatgagcccggagatgcgcttcacgccgcccctgcgcgccagccgccggatcgccggcttcgtgatcccctggatgttgtcgcggagcaccttccggtggcgcttcgctccgcccttgcccaggcccttaccgcccttgccgcgccccgacatcttcgccgcggagactagaggggatcgggagattttcgcttgctg

SEQ ID NO: 12909 - DNA, 530 bp, Zea mays
  Clone ID: LIB3279-209-Q1-N6-G2
agactaaaagcttccaacttgatcattcaccagttacagaaacacaaccaccagtttatagtagtaataacacagtcctccatcgccactagcctcagctatcggtctcggatactgaatgaccagtgtacccgagcctctccgatatcaaatttacagcatcgcgccccccttcttggccgctttacttcttggccttacgggacggcgctttccgcaccggggtcgccgccttcttcgagggagcggccttcttggcaggggccttcttccctggcgtgtccttggccgacgtcttcgccgccttggcggggcggccggccttcttagcaagtggcttcggcttagcgccggcggtcttgggcttcgccttggcagctggcttggccttgggcttggcgggtgtcttcggtttcactacggctttcggcttcgcggcgggcttgggctttgtggcgggcttcgccttggcgggggtcttagctttgggcttggcagcggccttgggcttcttagcgccggtcttgggc

SEQ ID NO: 12910 - DNA, 600 bp, Zea mays
  Clone ID: LIB3279-209-Q1-N6-G3
agagagaattgagttgtcgttttcaaaacaaaacagcacacaagatttccatattctacactgcagaacaccattgcatggatttggacacgcgcgcggcacaaacacggcctcatctagggttgttttatggtcagctcagctctgagatgcaataccccgtcgataaagaagagactgtcatcagccatgaataacggccacgggatcgcaaagagattccggtacccaacagccttaccgccagtgaaggtatagtagcccttatatttgctgacaaactcgcctgacggccttgtccttgcagcgaactcataatccacggtaacacttgtcgaccctttctcttgcatccctaggaagagaccaaaacaatagaacgcactttgctggtccacgttacagtgtgctgagaggaagaagccctgtccagctagatggaaagcttgcgagtatatccgcccagatgggaaaagtcggctgcactcctctcgcttcaggtccaagtatgctatgcactgccgatacggcctatcaaactctacaaccttaagcgggcgatatttgtaagctcgctcagcatacttcctacatgtcatc

SEQ ID NO: 12911 - DNA, 477 bp, Zea mays
  unsure (1)..(477): unsure at all n locations; Clone ID: LIB3279-209-Q1-N6-G4
gaaggagaaatagctatttcaatactgagcagccaaagagcactacatcccaaatacacccaagtgagtgagacagacttaacctacatacttgatctttcagtgagccttcttgcgcacttgccaccctttctgtcctaaatcaatcgattcacaaagctaaaattcaaacaggtagcacccctcaatgtgcactaacgccattctctgcattgagcccgtacagcacacctgcatatttctctgttgagcccgcgaagaacgaatccttaagcttccagaacgcacaggacgtgaccaggctatcggacccagcctgatgagactccccaacgcgctccacatcaagtagctcagcgagcttgttgagcccgccgtgcaagctgttgcagaacttcatgaggtgcttgatgtcatacacggtcgggaagtatatcttcatgagtttaaaaaaccngcctgtgtgtctgggaagct

SEQ ID NO: 12912 - DNA, 465 bp, Zea mays
  Clone ID: LIB3279-209-Q1-N6-G5
agagggctaaagatctatccatgtaatgacaaagctaccataataggtatccttgaacaaattgtttctcgaaagaggtataccaaagatctagccatgtacatgaatatatctcacaatttcaacaatagttcgaccattttatgcgcagccgaattctctgcattcttaactcttgacatagattcacctatgggtaccaaagtgccagtttgggtatttacctgaacagaacacacaaaggtcctttcatgtgcagggccaccttctttttctaatcttccaaagcttcttaaggtcaaatttgcaatcaacgtagactgcagcagcgatggcctcaacaatatctgcaagcaccttgggagctttaaacacgctaccaccatacggtgcagtggcaaggtcatgcattagatcttgcttcactgactcaaagaactgggctactagtaggtcgaggcgggg

SEQ ID NO: 12913 - DNA, 599 bp, Zea mays
  Clone ID: LIB3279-209-Q1-N6-G6
ctcggcctcatcaaaagcagccttttctgcctccttgtgcttgccccaagtctcctctgcaaaagtcttggccaacgcagggtcatcagtgatgatgatgttgtcaaacagagtgcccgatttaacctgccacagctcaatgccaatgtacttcaagctgtcgaaggcgtaaatgtatggatcatccttaaaatctgggttgtcaatcataggtgccttccatttaccctggtagttcgggttcttgattttcttttgtttccatggtcccttgtattctgggttgggaatggtaggggcagtccattcaccatcttcctcatcgtcccagtcctcaggcttcttagcatcagggtcaggaatttccttgggaatatcatcatagccctctggcttcttgtcctcagggtcaggaatgtactccttgtcatcccagtcctcaggcttcttagcctctgggtccttgattttcttagggggaagaatatcccagtgctcgtagatgctgccagtttgcttctcttcattatcaatgagaatgctgtatgttgcatcaggacggatgatcaaagtgtaaacatgagtcaactgatcagtct

SEQ ID NO: 12914 - DNA, 582 bp, Zea mays
  Clone ID: LIB3279-209-Q1-N6-G7
attcacaaaagcatcacaattataatatcattcacaatgtctgcaaatttactttttcggggaaaatacaaaacaaaatatctagctgcgtccatccaaaagaactgtagatctttattgtggcagcattcataggcaccaacgcgatctggttgctgttgccttcatggagtaaacaagtgacttactacctctaggacctccctactgacaaaattaaaacccaaatcattagtagactacttataaatccattgcaaaataacacttgctacacgtgcttaggcccggccctgctacccttactagtgcactgctgtaataatgattatatctagtgcgcatttcaaatgcactgacaacaaaaatgtgtatactcttaccaagtcagccttctcatgtactgttttcaggaatcactccctgtttgtcgcacaccaggaggtgttttttctccaccaaatgctccaccaatttcagcaccattagtaggtatgttcacattcactataccacaatcactaccatggggcctgcataataagagaacaaacagcgaggattattggcaatcaaataata

SEQ ID NO: 12915 - DNA, 579 bp, Zea mays
  unsure (1)..(579): unsure at all n locations; Clone ID: LIB3279-209-Q1-N6-G8
aaacgaagagggattttggcggtttttttttaaaaaaaaaaaattttgggggccccccaaaaaaaaagggggggggcggggcggtttttaacccccctgtttttttttttttttttctcccacaaaggggggcccccnataacacctttttttttttaaaggggggggggggtcccccccctttttgggggggggggggggggtttttttttttcaacaaatttttttttttgggggggggccccccccccaggggggggggggggggggggccccttttttttttttttaaaccccatcccccnnntttttttgggtgtgggtgggagattaaaaaagatttaaaatttttttttttttttttaattttaaaaaaaaaatttttttccccccccccccaaaanaaaaaaaaaaaaagaaagcggcgggcggcggcgnnccgnnngggggggtttttttttttttttttttttgctcgnctttttttttttttttttatttaaaaaaaagaggggaaaggtggggggggggtttttttttttttttnataaaaaaaacccccaccctcccccccccccc

SEQ ID NO: 12916 - DNA, 78 bp, Zea mays
  Clone ID: LIB3279-209-Q1-N6-G9
gtcacattcaactaggatatgcattgctcagcataactttgttaagtagtagacatatgtttacactcttgtttcata

SEQ ID NO: 12917 - DNA, 488 bp, Zea mays
  Clone ID: LIB3279-209-Q1-N6-H1
cagatacagtctcctgggattaccattttgagcatgctgggaatagtccagtcagttttaccgtcaaggtagtctatctcgacgcgccctgtatatttgttggcactatgttattttagttcatgatgaataatatgattcgctgcctgaaattccagtccgccgtcctgaaagaaacgatcgacgacctcgaatggccaggttccagcatccagattcgaatgcaaccagatcctccaactgttatactaaaaggcgaaggtcatggcgacttgcaggtccgttttacaggttgtcctgttatatatgtccatttagctcccagctgtgcctatgactcactttcacttattacacaaattcggcagaccgaattcccctactatgcaaacaccgaccttctaatcgtgttccaatgcgagcacgaagtgtcacacaggtaaaaaaaaatcctcgtgcccagatctgtgccttcgctgctccccgtg

SEQ ID NO: 12918 - DNA, 299 bp, Zea mays
  Clone ID: LIB3279-209-Q1-N6-H10
agaacacaaacctaaggctgattgtttcaaccaaataacaagtaccagttgcttaggggccaaaaacactcgaaatctgaccaacttgagcgcccctaaaccataatacccctcaaaactagggtaatgagcatcccgctacatcgagaaacagcgtgtaatatcacatcctatcctctcttctgcgcggggcacaggttatgatctcatcgaccctgaggatcatctccgcagcctctgttgcagacagaagaatggcctgcttcaccttgaacgactcttgaatccccaacttttgc

SEQ ID NO: 12919 - DNA, 570 bp, Zea mays
  unsure (1)..(570): unsure at all n locations; Clone ID: LIB3279-209-Q1-N6-H11
acttacactaattctatttacaagattttggataagagaagtagcaggtttgttaggaggttagagaattagatccatatctacatatagaaagtatttcttgaccctaacacacatttatccgaacaaggtgaccaaacccattgtcatgtacaataccatgcagcaagtgacgtggattatccaactgcctatagtcccaatcttccggatcatcagaggagatcacatatttgcatgtcgagcacttgttgcctctgatcttgaaccaggtgtcggcgcactgcttgtgggcgtaggataagtcccccttgcaggagcagccgagcgtgatgccggcaccggactcggccgccgtgctctccaggccaaggtggcaaatgcgacagttctgttcggccttctcagggctggccttgatgatctcgctcagtccggcctccaggtcaacgtcgtccagcgagccctctgacacgcacgacgacttnctgcagtgttgtctgacggcctccccgtcggcatcggcgtcggcgtcgacggagctcgcgcgggcggacacgcacagcgaga

SEQ ID NO: 12920 - DNA, 472 bp, Zea mays
  unsure (1)..(472): unsure at all n locations; Clone ID: LIB3279-209-Q1-N6-H12
tcgcgatctagaacgtcggctgggtccgcgctggcacacctggacctcgccaccccggcgaccttcgacaaccagtactacatcaacctgctctctggcgacggtctgctgccgtcagaccaggcactggcgtcgtcggctgccgtgcctggggtagaggcggacgtcgccagcctcgtcgccacctacgccttcgacgcctccgtattcttccaggacttcgcggagtccatgctgcggatggggaggcttgcaccgggcgtcggcaccagcggcgaggtccgccggaactgccgggtggtgaacagctccgaataaagtcatgcatgctcacgctcaactatctggtcgtncgtgcggcttgcattgctgatttgttatcagctaagtcaagccagtaagttttgtttgggttaaaaaaaaatcggctttggcttgggaattatgataatgggcctcgncggaatagctg

SEQ ID NO: 12921 - DNA, 361 bp, Zea mays
  Clone ID: LIB3279-209-Q1-N6-H2
ggaggaaaaaaaaataaggaaaaaaatatttattatttggggtattttaaaaggtaaaaggaacctatttatattgggaaaaaaaaaaaaaaaaaggttgtatttaattattaaaaaaaattttccttaaacctaaaattaaaaaaatttttccccaaaaaacaatagggtgctaagcttcaccaaaacctaccaaattaaaaaaaagcttaaaattggtattaaaaaaaaaatttttaaatatttttccagttttttcattttcaaatgaaaaaaaatttttttttggaaagcccccaacagtgaataaggattacggaaaaaaaccccatttttggaacaaccccaacagggaataaaa

SEQ ID NO: 12922 - DNA, 524 bp, Zea mays
  Clone ID: LIB3279-209-Q1-N6-H3
ctcattcagacgactggcagaaatgtgaatgcagtcacaaattttggtttattaagattccgcaatccgtctgtttcaaaaattattcgagctcaaactcaccaacaagcctctccataataaactatcgaattcaaaactgacagaactctcccaagaagctacaaaagaatgacccgtgtggcaccaggattactgctcctaactttgtcaatcgacaccatggaaaaagtggggattctgatccgcaccacaaaacggcaccaaacgagtcacagtgcagtctggccggtggacgatgaggtcatgatgttcagtgtctccgtcacagaagacatggcgctcagcgccgccttaaggacatcctgcgagcacccaggcttcacaatgctcttcaccttctccaggtattcctgcaatttctttatcctgcccatgtagtcttgatcctcgacgcacagtgagataggctttgaatcggcacctggtccttcaaactggagcggacctgggttcctgggaca

SEQ ID NO: 12923 - DNA, 571 bp, Zea mays
  unsure (1)..(571): unsure at all n locations; Clone ID: LIB3279-209-Q1-N6-H4
aacaaacaatgtagccatgaacattatttttggaaaggtgttatcacaaccgacaacgagcactttcttgccttggaaggcctcccttccctattgtagtcactcgagtgcataacttgcccttaaagctatcgattcactaagtgccagacataataggctatacattctctctagtggcaacaattagccattttggttggtgtggtactctattattgagttttttggcacagtacttccttgtagagtagaagacaaactcttcaccattgtagtcgttaatggggctggtggtgatgaaatccttggtgtggatgcaccggggaatcactattgtactcggcggcaacgacattaagactgaagaatgggcggatgtcgaattgaagcttagccctagagataaagttaacctacgagcataccaacaatttaaaattaagtagaaagtaaatatgaatactaattacatcacgaatttgctcaacatggtcgtnngaggacgagccacaaaacccatcactttcattgcaagccttcccatctttttcctacttctttaatcttt

SEQ ID NO: 12924 - DNA, 573 bp, Zea mays
  Clone ID: LIB3279-209-Q1-N6-H6
gaaagaagcagcaacaagtacaagaccttcatcattcatccatcggccaagccaaatcacacacatatcccaggtgatgatgagttcttctaaaccaacatcagcagcactacctacctaccaaacacccaaggacacagctacaaaactagagctaaccatactatcgctttgatggtggcctcccatcgtcatcatcgtcaccatcatcatccccatcgtcgtcgtcttcttcttcttcgtcgcctgacctcttcctcttcgtagaggtctgcgccttcacagagtcctcaccgtcatcgtcctcttcatcgatctcctcatcgtcggcaccctcaccgttttcttccggttcaaagtcgctcgagtgctcttcgtcttcagcccgcccaagaggctgaaccagatactcggttcccagctcctcctcctgatcgtcttcaccgtcgacctcttcctcgtcgtctgagtcctcgtcgtcgtcgtcgtcgtcatccccgtcatcgtcgtcgtcgtcgtccggctccccgtcaccgtcgtcgtcgtcttcgtcggagatcttcacaacccctg

SEQ ID NO: 12925 - DNA, 452 bp, Zea mays
  unsure (1)..(452): unsure at all n locations; Clone ID: LIB3279-209-Q1-N6-H7
aacaaacaatgtagccatgaacattatttttggaaaggtgttatcacaaccgacaacgagcactttcttgccttggaaggcctcccttccctattgtagtcactcgagtgcataacttgcccttaaagctatcgattcactaagtgccagacataataggctatacattctctctagtggcaacaattagccattttggttggtgtggtactctattattgagttttttggcacagtacttccttgtagagtagaagacaaactcttcaccattgtagtcgttaatggggctggtggtgatgaaatccttggtgtggatgcaccggggaatcactattgtactcggcggcaacgacattaagactgaagaatgggcngatgtcgaattgaagcttacccctgagataaagttaacctacgagcataccaacattgtaaatttagttgaaagt

SEQ ID NO: 12926 - DNA, 463 bp, Zea mays
  unsure (1)..(463): unsure at all n locations; Clone ID: LIB3279-209-Q1-N6-H8
gccgcgcgcggcgcgcgcccaggcgtggaggaactgcgcggtgccgatgccgtcgcagaggcagtggttgatggcggtgcagaggaccatgccgccgcacgcgagccaagtgacctggacgacgagaggtggcacggcgaccaagctctgcgcctccaccctgtagtgcagcttcctccaggacttgtgcggccggtcgctgccgctgaggaagtcggcggcggcgaggcccgggaggcggccctcggcgaagagggcgccctcggcattgcagtccacgacgagcttcccattctcctcggcgctcggccggagccggccggcgagcgggtagtagtcggcgagcaccctgccgagcgccgcccgcagcgcgtctgcgggcacggcggcgtctgcgccgaacacgtacaggtacttgatggagaaacggaggaaccgctggtcgtcnaggttggagaggtgc

SEQ ID NO: 12927 - DNA, 521 bp, Zea mays
  Clone ID: LIB3279-210-Q1-N6-A1
gaaaacaataacgccaaacttaataacccagtagcaaagcgggggaataaagtcttacaacgtaagttgtaaaccacacaacgacagatagataagaaccgacagaaacataacacgataggagccactcagggcagatcacaggatagcagtggcacacaagcccgacgacgccgcgccagtagagcgtctagtactcgtcaccctcgtcgccgtcctcaccctcgtcaaactcagcaccgacctcctcgtagtccttctcgagcgcagccagatcctcacgagcctcggagaactcgccctcctccataccctcaccgacgtaccagtgcacgaaggcgcgcttggcgtacatgaggtcgaacttgtggtcaatgcgggagaagacctccacaacactggtggagttggagatcatgcacacggcacgctgcaccttggccaggtcaccgccggggacgacgctgggaggctggtagttgattccgcacttgaagccagtcgggcaccggacgcgtggg

SEQ ID NO: 12928 - DNA, 369 bp, Zea mays
  Clone ID: LIB3279-210-Q1-N6-A10
gcgcatgaacaccagagctttattgactcggaggaccagtgcgcaacgcaacgacccgtcgtcggatgccccaccggcccaggccgcaaacattagcccgagaccaggaccccgacccgggtacgtaacttggttgccagccaattaagggaccaggagggaccaacaccacaccacaccagcgacgtgcactaatagactgtgacccgtccatgaatggactggaactggactggactggaccatcttcaagtggcgctccatctaattcttgaagagggagtcctccagggcctggaacctcttggtggcgggcttcttgatgacatccgggtcaagcacctggtcgttgggcttgtcgaactccat

SEQ ID NO: 12929 - DNA, 597 bp, Zea mays
  unsure (1)..(597): unsure at all n locations; Clone ID: LIB3279-210-Q1-N6-A11
atcaatcatgcgatatatgcgttcattacaacataacactgttcattacaacataacactctgaacatatgcaagccatcagttttcaccgtttcaccatcctaatgtggtcttttattgacccgagtgtactggactaaggtgcatcaacgtgcggcagaaccgcagaactacattcactgcctcaactgaagctagggcagataggtcccttggacaaaccaaggcgaacctccattccgtggtgcatgtcaggttgacggaaaccttcagaatcttgaggcatgttaagataatcttcaaaaccaaaatcatctagggaacctgtcagtgcctcatatccaagcagagatgatggcaaagcaccagggggcctttggaaccttgagaggatttgggcatcgagatccttgcggatgttcaaggcggatccgtagatggcctctgtcccaaacttcttcttgtccgcccagaacttggcctccgattggatgctggactggagcgggtgcggcggcgcgaggtcngccttgacgccggcattgaggccgaagcggagggtgtcgtgggtctcgctgatctccctcttcatgctga

SEQ ID NO: 12930 - DNA, 609 bp, Zea mays
  Clone ID: LIB3279-210-Q1-N6-A12
tgcggctccgcgtttccgcacggaagttggtgaaggtttcttgaggctgagaacatggtgctgaagacggaactttgccgtttcagcggccagaagatttatcctgggaaaggcattagatttatccgtgctgattctcaggtcttcctttttgccaactcgaaatgcaagcgctacttccacaaccgcctgaaacctgcaaagcttacctggacagcaatgtacaggaagcagcacaagaaggatatccatgctgaagcagtaaagaagaggcgccgcgccaccaagaagccatactccaggtcaattgtgggtgcttccttggaagtaatccagaagaagagagctgagaagccagaggtccgcgatgctgctagagaagctgctcttcgtgagatcaaggagcgcatcaagaagaccaaggatgagaagaaagcgaagaaggcggaggtgagcaagtcccagaagacgcagacaaagggtgcggtccagaagggttccaagggccccaagttgggcggcggtggtgggaagcgctgaaagaacttagtgtcgtttctcgacattgcagtcgttccttagccaaagccactttcgtagaacctgtgt

SEQ ID NO: 12931 - DNA, 142 bp, Zea mays
  Clone ID: LIB3279-210-Q1-N6-A2
ggggcccattaactaaaactggatcacgtttgggtacctgtccctaacatgttacatgttggatattattgctaaaatctactcagggcccctccaagagtaaaatctgcagggcgcagtaaacagtttcacaggacttggg

SEQ ID NO: 12932 - DNA, 442 bp, Zea mays
  unsure (1)..(442): unsure at all n locations; Clone ID: LIB3279-210-Q1-N6-A3
gaggcttgaaacgaggacattccattgattacagcagcgagatattacagcacatggactagaaactagaacgatgcagtacaaccaccacagaaaacagcaccgataaagacaacacagactaactagaccaagaacacaacacgaccggcaccggcaccacgtaattcggcaccgggagaggggcgacctaaccgccgaaaccggagagggtgcggccctggcgcttgagagcgtagacaacgtccatggcgggcacagtcttgcggcgggcgtgctcggtgtaggtgacggcgtcncggatgacgttctcgaggaagatcttgagcacgccgcgggtctcctcgtagatgagcccggagatgcgcttgacgccgcccctcctcggcaacctgcggatcgccggcttggtgatgccctggatgttgtcacgcagcacctt

SEQ ID NO: 12933 - DNA, 401 bp, Zea mays
  Clone ID: LIB3279-210-Q1-N6-A4
aaacaaataaggggtataaaaggaaaggggggggaatccttttttttcccgccaaaaaagggggcaggagccctggaaccctttgcctaaaaaaaaaggggggggcataaatgttccccccccccccgaaaaatccaaatcgggggacccccttatttccgggggaaggggaaaaaaaaaaccaaaggggggacggcccccccccccggggggcccttagggagcccccgggttcccccctcggggggggccggcccccgcaaaagggttcccaaaaaaggggccccctcccccaatttcctgggggcccccgggggccccaccagggggaggagcaccccgggaaggaggaaaacaatggttttttttgggggggccctggttcccaaccaacagaaaaa

SEQ ID NO: 12934 - DNA, 462 bp, Zea mays
  unsure (1)..(462): unsure at all n locations; Clone ID: LIB3279-210-Q1-N6-A5
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccggcaccaccgtagccgccgccaccgncgtagccgtcgccgccatcacggggcccggcaccggcgtagccgccgcctccacgggcaccaccgtaccc

SEQ ID NO: 12935 - DNA, 461 bp, Zea mays
  Clone ID: LIB3279-210-Q1-N6-A7
caaacaaagtcctaatgaaacgacccggtttacatggggcccccttcgagcccacaaatgctcgacaagatcattttggggggggcccgacctattttgacgacaaatttcaaaggggttaatgacccattctgcccttccttttccaattatttgagatgtgtcaatggctgaactgttatttccgaaatcagttttaccagccaaagggccttaattttccacaatcatattgggcatgatgatgcaagctgtgattatttttgttaaacgggtgcaatcccacccatatgctggaccacggagcaccgcctaccgggcttgaagaactccgaaagcaccctcaatattttttcggcaactcttttgcatttgggtgaaaaaaactttcttttcctcataggggtgtctgatagctttgacaaaagtaggccagttcgggtaaataccatcagctaagt

SEQ ID NO: 12936 - DNA, 522 bp, Zea mays
  Clone ID: LIB3279-210-Q1-N6-A8
gtccaaagaaaacatgtatttctcgcttacataaagctagtctacttaatacgttacacccgaatctgtacgaggaccgtaaagaaatttccaaagatacaagctttttgaaaagagtacacgaccaaagaagattatgtgggtgcagtgatcaccagcgagcacgggatcctggctgcttcagtgctaccccctacggacatattcggttacaccaatccataaggggattggtgaggtttaaatcctcttctagtcatttttaactagaaaaggatttaatcccctccaatccgcttctgaattgttgtaaccgaacaagccctacaagggttgatcatttaagctaatccttgtttgtcgggtaaggtttggttgcagaattcctcatgttagagcctcatgaaacgtgcttgcttcaagctacagccgtctgcttaccaccaacccagtattgctttacggcatacaagatcttctcgcgcacgagggggccatcctcgtgatcaaccatcttcgtgt

SEQ ID NO: 12937 - DNA, 416 bp, Zea mays
  Clone ID: LIB3279-210-Q1-N6-A9
gaaaccgaaatgagggagatgacttcaaaactcaataaaacgctagagcaaccactgacatgcttctcaaatccagtgaataataccagtccacacggacttaatgccaactagcggcaacacaaagcaatggggaactaattcgaacactaccagcctactaatataaaaaaagaagtgagggaacaggaaatcagctacaataatagcacggcacagcttcagcttcgacagcatagagcatctaaaacaatgggctcgaacaatatgcgctctcccaagattactggccgtcaccagcctcacctttcggggcttctttgccctcatcagcaccatcctccgtgaggtcagaggtccaaagggtcaagttgtccctaaggagctgcatgatcagagtgctatctttgtatgac

SEQ ID NO: 12938 - DNA, 537 bp, Zea mays
  Clone ID: LIB3279-210-Q1-N6-B1
gcgacatcgaaccacttcttttatacaaaagcacgcagcagagagctaaatggaacacagcgtcatcatcatggtccgtaaccatcgtcccatcacgcatctagtacaacgccgctaccataccataccaccatctttaactggcccccggattcacgcttccttattttcagttcagttcggaaggggatccaaatccagagtcaccaccggcaaagacgagctcgcgcgcgcgcgcacacacacacacactactggccctttgccagcggctcggcctctggcgccgacgaaaacaccttggcgatgcgttcggtggggatggcggggaggtacttggcccccgcgtagccgtgctccgcggcggctgcgaccgccctgttgtacttgtcggcccagtgcgcggcggtgggcacgacgatctccgcgacgtgcgggaacaccggcaggccgttcagcgagcgccaggcggagacggccaggtgctccgccgcgggctcgtaccgcacgtagaggtccttggccacgggctccacg

SEQ ID NO: 12939 - DNA, 332 bp, Zea mays
  Clone ID: LIB3279-210-Q1-N6-B10
aagataaagggttcgttacttagcatagcaatgctgcaaggaatcttggggtacaacacagtactgccaattttctcttaacgtcaccactcatcagaatcttaataaaagcatcacagcatcacttgctagcttacagaaacagagacaatgataaaacagaagatagctcttagaccctagccttccgacgcagcagccggccaatcccgacgctcagaagccgagcttggtgcggcgccagtgcctgcgcttggcgttgtacctgatggtattgtcagtgcgcatgcggatccagtaggggatggggcggttctggcgcatcttcttcg

SEQ ID NO: 12940 - DNA, 604 bp, Zea mays
  Clone ID: LIB3279-210-Q1-N6-B12
tcgcctttggcattttacaaaggcttcctgccaaactttgcaagactgggatcttggaatgtgattatgttcttgacattggagcaggttcaaaagctgtttgtgaggaaagcgacaagctgaagatagagtttttgcagtcaggtggcgtacaattgacgcacagggtttttcttctatagacaaaaggggagaaatgacacctcccccctcgagaattggggaacaaggacagatctgacacctcaattgcgagaaataaaaataacagccgacagttgcatgatccctgaacgaataaattcagaactagaaaacagatgtcagtaaacaacatgtggtgaatgttggaacttgaactgctctagttcagtgggcatctgttgttgcatgcttgggatggatttaatgtttcgttttttttcttccttgtactgaagtgctctgatcggtaacgatcactgtgtgtgaagtgcttgattgttatgtggtatcatgagaatgaataaacataataaaaaaaaaaaaaaagggcggccgccctttttttttttttttgataaacaggtcgtccaaaggatgcactctttatagcaacatatac

SEQ ID NO: 12941 - DNA, 552 bp, Zea mays
  Clone ID: LIB3279-210-Q1-N6-B2
aggcaaacagagtgtgcttttattaagttggcaataacccatacaagccatacacgtacgatggccgtgcataataataatgatacgaaaacacaacttgcatcaagcaaggcacacttgacaatagcaaatactacttatgttcttatataagtaagcaatgactagtaacttgtcgatgcttcaagctccccaatatgtggaggcacacaatatagggcacaagcatttacaggtcccttagaacccgtgaatcttgatgttctctttcttcgcaatcccagcctgaactaggaaagtagcaacattcttgcgctgatcaccttggagctgaatgacctggcctagctctgggtcctgaactacagtaccattgcagcagaattccttcttcagatccttgaggatcttgttatagctgaactctttcttcagaccctggactgtagtcagactctttctgccgttgcgctgctggatgcgcacatgcacataatccttcgttccaggaccagcaccagagtcctcagcatttgcctcagcaaacggatc

SEQ ID NO: 12942 - DNA, 235 bp, Zea mays
  Clone ID: LIB3279-210-Q1-N6-B3
gagaagaatgatttatgaaactgacacgtacgccagcattttgtccagcggtatcattcatcgatgagatgacccaatcctaagctcaaatcacagactggtattcggaatcaacctatcactcaaattctagatacaaaagggaccagaaatatagggggtggaaatggcaaaaggaacatgcggcgttgacgccagcccagcatcaaatattaagggcaatgaacttctgtac

SEQ ID NO: 12943 - DNA, 522 bp, Zea mays
  Clone ID: LIB3279-210-Q1-N6-B6
aatgaactccacttcgatcttaagatgtcggttagtggcttgcatgttgcgccataacaaagtgtgctcatacatacacacagcccttctgttcacattctccccaactgtgtcaagagcaggaggactagagcagaagatgagcaccgcagcacatacgactttacagggtagcctaaacatagtatccagtacttgccatcactacataacacatcaaaaccctaactgctgcgtctactacctagtcgattgcgataggagtaattcgcctcttagcaggcttactagatgcgctgttcttcgccgccggtaccgctggtggcggtgtcacttcagctgccacgggtatgggtgcctccttgcctttggtatcatcggcatctacttccatactgtctattgttaccggctccttgttttcacaggttacatttccttcggcaagctctcctgttctcttgatgttctcagttggcagcagtggtgctctaactcctacagcaacaggactggcttcca

SEQ ID NO: 12944 - DNA, 605 bp, Zea mays
  Clone ID: LIB3279-210-Q1-N6-B7
aaataaataaataaatagatagatagattttaatcgattggtattagattgttctcttcccacctttacttacaccatcttccattatgttccacatttccctagcagggcaggagctgctcaagagaaccaggaaataataattacaatcataatgtgagcgtataaatattgacttgtacagggccatgctccatcttcggcagggctgcactacccaaaaaaaaactacatgatccaaccctcctcgtcgccactgctaaaggattccatcatatcactctcatcgccttccccttcgtcatcacccaaaatatccatcaagccccctcccccttcaaaatcaccaccaccatcaatgtactctgggtcatcttcaatgtcatccgaactggggatatcatcgtcaccaccatcttcatcaccatcatcgctgctgctactaatctcttcggaatctgtatccccttccagcaccggcgcaaggagaacatcatcatcagagtcgccatcgtcgtcatcgtcatcgtcggtttcacctgcatcctccgggtctgaatcgtcatcggttattcgcttcctgccaacttcgaacaagcgggcag

SEQ ID NO: 12945 - DNA, 599 bp, Zea mays
  Clone ID: LIB3279-210-Q1-N6-B8
gatagatagatagtatcatacataaagctggtttacaacggaagcatcatttggccaactataacggacaaaacaccataaggacaaagacatccaatccgtgcaaccaaagataaaaacaggagtgacccgattttagtagatctatccagcgtcttcatgcttaggactcaggagatataacacttgctgaacatccaaagagtacccccacatgctaacaacttcagtgcttcataacgatttgaaggagggaacatacggggtaacataaggacagccgtgccctaaggagcacagaacttgcacttgcctgctatccatgtcgtatgatatcagtttctggtataagcgatgaacaaaaaaaatcaaattccgatccgtatgaatgccaacaatagaatagtaagaattgtatttaagttttgtagcttcgaccagctggcaaaggctcaggctatgcttcagaacccactcttctgtatcgtagtcctcaagaacccagatcgacagaccagggtcgctgaaacgattacattcaaccaatcgagtgatacaatgaaggcgtccctgtgattgaccaataaaaccaactgtaa

SEQ ID NO: 12946 - DNA, 214 bp, Zea mays
  Clone ID: LIB3279-210-Q1-N6-B9
acacggtaaaatagcaaaaccagaactgggttccaccgaagcattaagcagattctgtgaaaatttgtttccaaataactttgggacaaacaattttaaattttttttccagttttttgccagtttggttttttaacaccaaaaaatttggggccttccaaatttaggtcttaaaattaaaaaataacctttttaattttttggctttttttgt

SEQ ID NO: 12947 - DNA, 509 bp, Zea mays
  Clone ID: LIB3279-210-Q1-N6-C1
agtaatgataatattttggtttggacaatgtaaacagatggtaaaacagcatggttaactccccaccaaacacccatctgtctgcaatcactgggaaacagatgtttttatttctaaatcaagcaggcaactactcagatacccttctccagcatcgcccggacccgtgtcggtaggccctacagcctaatgaacccctcggcgtcagcttggttgtagatctccccgttctcaaacgaggagatatcttccctgtacaggctgtaggggctcttccgggacccgaccttcacggaacccttgtacagcttcagggtcactgaaccagtggtcgtcgcggtaaccttctccatgaaggcatcaaaggactgccggagcgggtcaaaccagcggccagcataaaccagctcggcgtacttgagggcaatgatgtccttccactgcatggtctccctgtccagggtcagggactccaactcgcgtaccgcggctgccccgacgcgtgggcc

SEQ ID NO: 12948 - DNA, 515 bp, Zea mays
  Clone ID: LIB3279-210-Q1-N6-C10
ggccaaaaagcagattaatacttaatgaaaacaattttgaacattcgacacggtaattgtcacaggtagtctagtttgagtacgattacatgccggacaactgtggtaggagttggttcagataatgtctgaaaactggaacgcagcaaccagcaaagcggaaaccaaatttatcccgagcagagcatatacaccattcacgtacgcaagcaaaggccaaggcatcactcatcgacgacttggatcagcgttggctcatagtgatcgggtgcctcaaacccatgaaggttcatgaccgtcgccgcaacattggcgaggccggcacttgcgaggtctgtacggaacctgacgccaggcgcaagcccggggcctcctagcgcgattggaaccggattcagcgtgtgcgaagtcagggtctgcaccttgccgtccttgtcccggagtggttctccagactcgtctcttttcgccatgtcctcggcgttgccgtggtcggcagtcaccacgaaaacacc

SEQ ID NO: 12949 - DNA, 528 bp, Zea mays
  unsure (1)..(528): unsure at all n locations; Clone ID: LIB3279-210-Q1-N6-C11
gcctgaaatgcagatcaaagatagaattcagtaatcagtcagtactacaggtttccttgtacatgctggagaaaaaacactgacgtgcctaaatagaggagtagaggactaacaatctagtctagcataatcgggtacgaggtggtgctcgtcattgtcttcaaagcatcttcgggtgcaactctctgcggtacaaaatctgaaaggaactttaaagtcttctggctggaaacagctgttgaaagattatcgtaaataatggatttcttacgatccttcgcggcattgtgataagcatcctctgcaaacttccccaagaagaactctgaagccttattgatgaggaagacagcctcactggaagggcggatggtggggtcctcngcccgcatcagctgccgcacccgcgccatggagaagctgcacacacccatgtttgccgcagccgccttctggtccttcagcttcttcttcacgggcgtagatgcgcgcgccggcccatncgcgggcgctctcttggggctcttg

SEQ ID NO: 12950 - DNA, 519 bp, Zea mays
  Clone ID: LIB3279-210-Q1-N6-C12
tatttttgtttttgcattttgtagtttttttggtctgtgtatgcctattttttttgtattatgcttttgcctttttttgttttattttaacagctatttttacatctcacctgagataaggtgtgcatgccgttactgtgaaaactcggcctgccattgtacttaacttctcttgaatatatagcctcaaaaggtatcgctcctgagtagatttcttgcagacttcggcccaaagagaggttcactcccattgctctgtatcccaccgaaggttgatgcatggtaacctagactaactgaagttgctgatcttgtcaggagagcttccccagacatccccggcatgcttggatggtacgttgccccctcaagtccaacagaacgaaactgagatgcaagagcatcaatgttagatgtcacaggggtcatcgaaccagaagaactcccagcagaatagttcagttttggaagcaaccaattctcccatgctccacgcccacgcgtacgcggacgcgtggg

SEQ ID NO: 12951 - DNA, 497 bp, Zea mays
  Clone ID: LIB3279-210-Q1-N6-C2
caacgacaatgagagaattttattcccattcaaaagggcatccgccaaagaaagtgaaccatcattccatacagtctacaacctttgtccattggcagtacgcacgaggtgcgactacccgacaactccacatgatattatgcttgtttgttggcacaattccacacatggtacattttgcatcctgacaccaaaaccggtatttaccaatgttctggcttaacgccaggagttctgatctggcaatttacatctacataaacacaatcaatccagcctcctaagcaaatacgcgatttgaacctctttggttagcggcatgattctgtagctgtacagctcggcgaccaagctcggaacgatcttgtacaccggtgggctgccgttgtcctccacaccgatgttcacctcttgcccgaagatcttggctttggcttccaccctgtgttcgatagcacgctccaccgtttcatatgtgaagaggtgcatgagttgat

SEQ ID NO: 12952 - DNA, 421 bp, Zea mays
  Clone ID: LIB3279-210-Q1-N6-C3
ggcaacacgaatcatcagtcttttaccaagatcgcttcgggacgaagcggtgcacgaactaccacacaaaatagacttgtgaaggcggttttacactacttcgccacgccgtctaaaagcgaacaaacagcataaaggtacaaattggactcctccattcctccgccgccactggggccgggcgcgagatacgcctacgcgcgctcgccgcggatgcggcgggcgaactggatgtctttgggcatgatggggacccgcttggcgtggatggcgcaaaggttggtgtcctcgaacagaccgacgaggtaggcctcggcggcttcctggagggccaggacggggtggctctggaaccccagatccgtcttgaagtcctgagcgatcttacggaccaagcgctggaagggcaacttccggatga

SEQ ID NO: 12953 - DNA, 554 bp, Zea mays
  unsure (1)..(554): unsure at all n locations; Clone ID: LIB3279-210-Q1-N6-C5
ggcctagcaattctctgaaaagctttattacatgttcatcgactcgtaactcgtaacaccgtgtctcaccagcaagcggagcgcccatgcaaggtaaataacgtatggtcgccagatgaggttttcagagcctaagaccaggaccttttctgagcctacaaacatccagaggtacatgctcgaaatttcatgagcagcatgtgtgttttgttacattgtaaaatcaagcctctgggagcttgaagatggctcccaaaggtttccagaagtccacctcttcagcatctccagagcagccttcggttgatccataggtaccatgtgaccagcatcgtggaccttcaagaaactcaaaggaccgtggctctttagaacgccagcttctttcccgtcaactgtgaagggcttctcggatgaggacacaaaagcttcctttccagaccattccatagagtttacccaccttgagttcccaagccagttacatatgaggtcatactctncagcataaatcaacaccttgatgtcgctctcaggagttcagggattccaac

SEQ ID NO: 12954 - DNA, 541 bp, Zea mays
  Clone ID: LIB3279-210-Q1-N6-C6
ggactagaggaagatcagccagatctcacgcataacacaaggaaaaatacttgagtacacgttgccaggatgcacggtgacaattgggtacaagatgggcttaaccacgatggcaaacacatcgagaaatttccttgtgccaggttaaaacagacgggcattgtctcaggtctcggaaagcatcactaaacatgtagcatattcacaccgccggccgcataaatacacaagttaaaaacaagcgaagcttcttttttggcgcatgcgttttgccttctctggaggaggcgccaaaccatacgtttccttaggccgactccgcgaaaccaacccttaacttgccgtattcgaagaccgtgtggtagactcccatgaaaacattgcccaggatccagagggggccacgaggtggtgggatgtccatagctgtgaatccactgatgcactgggcagcttgtccttcaccgaccttcagaatgtactgctccggtttcagcttgaacttcttgcctccaatagtgaacgcaatgtcgggcatgga

SEQ ID NO: 12955 - DNA, 560 bp, Zea mays
  Clone ID: LIB3279-210-Q1-N6-C7
ggcgacctcaccagctggcaggagcggcacgccgtgctcgtgctatccaaagctaaggaactcgccaagattcggtatgatctgtgccctcggcacctgaaggataagcagttctggaggatatacttcctgctcgccaagagttacatctcaccgtatgaactacgtgccatacagaaggaaaaactcagacggatggagacagaaaactgcaagccaaaacaagtgatctctgttgaggtggagatgcaagaatcgaagcgcactagtctctcacaagcatcagaagtagatctagaatctcaggtttagttttgcagttatagcttctaacagatctagcttaggtaacgcaatcagtagcccttttatgattcctccacacaccaaatagctccacgagttcttcagatcttggatcgactctcgctagactaccagtccgctgtgtgcttttgtgtactgaaaccaagtaggtcctttcctgcattacgcagcatatgtgcttgttggctgtgctccgatccactgacatgtaaatctagggtatcttgcgcgtg

SEQ ID NO: 12956 - DNA, 483 bp, Zea mays
  Clone ID: LIB3279-210-Q1-N6-C8
atctagttcatatatatagaagctgatgaatgtaatgacatgccccactaatcgcgcgggatgttcctcatcaatccgggggtagctttagttgatttgactcgtaccagtggagagtggagcacatgacatgccaccctacctagtaatcctcactctgccgagtggctcacaggagagcatggagatctggctggtagcattccagattaagcaatgggcggacactagcattatactagtaataaaatgccaagcctagggggtggtccaagatgaacaacacgttccagattcggagaagaggggacaatggcggacgggagctgcggtggatcttctaggggcacttgggccctccttccttggttttccagttgttgtagcaggggcaggcgcccttgttgccgtagaaccccggtggcacccagaggcacttggcgcagcacttgttacataaggtgaggcaggccttcctgtact

SEQ ID NO: 12957 - DNA, 383 bp, Zea mays
  Clone ID: LIB3279-210-Q1-N6-C9
ccccccgggatcctttttttttttggccggggttgggttctggaaaccccggggggttttgggctttcaaaggggggggtttcggccgcccccaggggttccccaaaaattttaaggaaagggggacccccgttttttgggttttttggcccctccgggggccaatggggggtttttcgcctaacagggctccataaaattgggggcccccccgggaaaagggggcctttttttttttcccctttttttgggcctccctcaacaaacaggtttttttgggcaatggggggggcctttaataggttccaatccggggggtggctttttggggggccccgggggttttttttccaaaagaagtttcagggggggggccttttggg

SEQ ID NO: 12958 - DNA, 540 bp, Zea mays
  Clone ID: LIB3279-210-Q1-N6-D1
gaaataaggtgacaatgtcataggttcggtatcaagaacaaaacatcaagtacaagaccaagtttgtaactagataatccatagttgctcaaaaaaatggatggtagggaaaatggcaagtgtccaagcactcgagtctcctggaaattctaagcctaattggaaaatttagaacagccggtacacctttcccatagtgctcttcaggtacaagcatctcacattctgccaattctttttcaagagcgacacgaggaagttgacactcatttgcacattctggaagatctgcttctcatccatgccgcagttgccaacagcaacacccatgcaaagcaccttcttcagctggaacttaactgtagcctttgtctcgttaaccttggactcaagggattcctggtgtgtcaccaaggtagggaattttcctgccttgttaagaccaggaccaagaagacgaggaatttgcttaatgatagcctcagatgcaaggaaagcatggtacttctttgccagcttcttcactagcttcttggtttt

SEQ ID NO: 12959 - DNA, 531 bp, Zea mays
  Clone ID: LIB3279-210-Q1-N6-D10
aaaatgtagcaacaatcagtcaagctacctcacctcatggtaatataacatcttgaacaaccataatacaaaatgaaatgcagttctgtcacgacaacatcgcattcataagcaataccacccatctagtacctagcaagcatcaccacacgaacctcaaactgacgagtactaacagcgatacaaggaatatcatatctgtaccaagcactgcggagaatgacttaggtctcttcctcttcttcctcctcctcctcgtactcctcatcctcggcagtggcgtcctggtactgctgatactcggccaccaggtcgttcatgttactctctgcctcggtgaactccatctcatccataccctcgcctgtgtaccagtgcaagaaagccttcctcctgaacatggccgtgaactgctcgctgacgcggcggaacatctcttggatggaggttgagttgccaacgaatgtggaggacatcttcaggccaattggtggaatgtcacacacactcgacttcacgttgttggggatc

SEQ ID NO: 12960 - DNA, 441 bp, Zea mays
  Clone ID: LIB3279-210-Q1-N6-D11
ggaacaactttttttttgatggggaggacgagtataatacagacacgagacacgacgaacacgaacagcgcgcggcggcagactacgtacaccgtacacgtaccaacagggtgggcgaggaccaggaggctacaagaacacaggcagcagaagaattttttaccaccacaccacgcacgcaccaggtactgggttacaaatcggcaagtcctttatttatctaccatgtttcgatgcctttcgtcttgccttgatccggtgatcgacaccgatcgtcgtagcggtagcagtagagcggaccacatggacacacacgcgcgcgcgcgccattgttggacgggcgaggaataaccgggcgctactgcatggagcactcggcggggaggccctgctggtagcgcttggggtcggtgcagtagttgtagatcatgtacttgcgct

SEQ ID NO: 12961 - DNA, 364 bp, Zea mays
  Clone ID: LIB3279-210-Q1-N6-D12
caaaccccaaaattgggaccataggggaccaacaccaaaggggggggggttcaaaaaaaaacaagccctgggggggttacatgacccatttcctacaaaaccaaaccaccccccccagaaaacccagcaacttttaactccaacccagggggaacttcaccccaagaaaaccctccaaggggcgagcgtccaaccctagggggggggaaacttgggaacggccttgggcccctaaaaaacggggtgcttggcaagctccccggggagcacaaggcccccgggggtttggatctcgcgggaggggagggggggctttttgtttaaccccccaagcttgggggcctccccggccccacccttccgg

SEQ ID NO: 12962 - DNA, 617 bp, Zea mays
  Clone ID: LIB3279-210-Q1-N6-D2
tcgcgatctagaaccttcagttctgtccggcagatatgcaaaagaagtactttgagaaacaatttgagttgtctgaagcagtaaaactgcccatgtttcttcacatgcgtgctgctggttaagacttctgtgaaatcatgacacagaatttgcacagattccctgttggggttacacattccttcactgacttagcagaagattgggataggctactttcttttgagaatatgtttatcggtgttaatggttgctctctgaaaactaacgaaaatcttgaggttctacgaggcattcctgtcgagaggttgatgatagaaatagattctccatattgtgatataataaatactcatgctagaagtccgtatgtaaaatctgtctggccatccaagaagaaagaaaagtatgagccagattcaacagtaaaaggtcgcaatgagccttgtttagtcaggcaagttcttgaggtagtggtcggaagcaaaggaatttctggcgtagaaggcctgagtagaactctgtaccacaacacatgcaggctcttctttcctcaggatctggacgcgtctgctaatgcacaacttgagagtggtactgccgcccctttttttttt

SEQ ID NO: 12963 - DNA, 566 bp, Zea mays
  unsure (1)..(566): unsure at all n locations; Clone ID: LIB3279-210-Q1-N6-D3
aaattgtaaaagttgtgacaaccgtcagattgaagttaaaggaccaggatcgcatatgtgcataaggtacatccatgtgacaccatacactgccttgataccatatagcaataaaaaacaagtggcctaaagaagctagtgctctaggcttgcactattagagccaaactacaaattatattaaatttctgaaatttgatcttttacggacaattgttggtgtttggtagcattgaacatcaaccgctgtgggaagccaatttcaaataatatgaaaagaatagaaaaggacatatacactcgtttttctcctcgcgctagtgagcagtgagttggagccggggcagcagccgtgccgcgtgatcggttcatgacaaatccatgcgccatgagctcatgacagattctccccattgtgggagcaggtacctctgctcgctttgtaggcatgttatatgatgcgcagtgccaaaccatgttgattgttggcgcgcgccaggatcagcttggtcgacgaggtcagcagatcacgagcagtcgcgtgaagacgcttnccaaaaccttat

SEQ ID NO: 12964 - DNA, 417 bp, Zea mays
  Clone ID: LIB3279-210-Q1-N6-D6
atctgcgtgagcaaacatttcgggttccaaacaagcgcacaagtttatgttttacgcttgagcgcacgaggatcgcaaacgacaacactgattttctcattggtcaaaagacacgccaataaaccaagataaatgccaagcaaattagaatccaaagctcacgtttactatagcacatccagcggaaggtacaccgataaacgcctggtgcattttttttgaaacaaaaaagtctacgactggttcacaaccaaaagggcacaatagtaagtgcagcgtccatacatgtgctgtaaggcacaaaagcactcgcaaacaggcaaaaaaaaatctgaccatgatctacgtgacccagtttattgcctgcgcatgcccctgccaccacgtccttgcattgcaccttgaccgcgaccagcc

SEQ ID NO: 12965 - DNA, 416 bp, Zea mays
  Clone ID: LIB3279-210-Q1-N6-D8
cagatctcagaactgaaaattaaaaagaaacaacaaaacacaattaaaagaagaagaaaaaactttacatccaaaggccagcttaaccaaccaccctcaaccggggggggtcacacccacccaacatttgcacatttttctcaactagcattccatgaaacaatagactcaaatatttaacagggactttttttttttttggaactacccttccaccggcagttaaactggtatcacatcaatatttgaagtatcttcgcattttaaaacaagcccatcaaggttggttgggagaacgcacttggcccactgacaaccagttgagatgggctctgatggaggaacaatcatcagaacattgtcattcctttggacaacccccattacacttacaggggtaccttccttgatgtatc

SEQ ID NO: 12966 - DNA, 555 bp, Zea mays
  Clone ID: LIB3279-210-Q1-N6-D9
gagaatgttatcctccaagctggcttaaaagataaccttgctacatattaggtgtcccaaataggtcactgaatatgaatgaaaagaataggctaatatataatggaaacactaaataaaatgggtctaatacatctttctaagggggaaacaacatatttgtttggcatcagatgcatctttactcgtttgtgcatctttacccgtttggtgtgcttgattaatatcccttgatagatggccagacttcgaagaacttaggatttcttgagtagcctgatgacttgtatcctttggttgtttattgcttcgatagaaatttggcaacagcgtggctttgaagcaaaagctatgtcgtgattctttaaacccatgttcattggtgatctttctctctttttctttggttataccatatttctgatgcagtgttggaaatgttgaaccaaatagcttttctttgattttcattatatgtgatgatctttcttcatcgacttgagatgtccttggagcaatttctggtaaagcgctggaaaatttctttcttggtag

SEQ ID NO: 12967 - DNA, 497 bp, Zea mays
  unsure (1)..(497): unsure at all n locations; Clone ID: LIB3279-210-Q1-N6-E1
ggtagcaatcagatacgattgttcttaattatctagaatggcaaacacagccacatggatatattaattgttcctgacatgacatgcagggcaaaactaactaacactcacttaaacgatcatccgagaagagcaattagacaaggccaaaactacttgtgggtaaagcacgtctcgtcgagttcgttctcgacgggcggcggcagctacattatctatcgctcaacgctgacggtgacgttgccgccgccgacgttgctggagacggtgggcagctccacgttcttctcattcttgggggtcgacttgtagtagcagaagtagaggatcagctggatgagtccgaagaatgcgcccagggcgttcgggatcgtgacgtaaaggtcgaagcggatgagcgcgtangccgtccatcagcagccgttgaggaagctcaccagcgacaggaggaagggcatgtactcaacgctcttggtcttgatcactcgactcatgat

SEQ ID NO: 12968 - DNA, 275 bp, Zea mays
  Clone ID: LIB3279-210-Q1-N6-E10
ggggggcaaatttttaattttgggggttttttaaattggttttgggggggggggacctgggggggggggggtttaaaaaaataaaaaatttttttgggcccccgggggggggggttttccctttttaaactttaaaaaaaaaaccccccccccccgggggggtttttttttcccccccttttttaaaaacctaaaaaaggggggaaaattttttttaaaatttggggcgcatgttttaaccaagaaaaaaaagggcggctctttttggggggggg

SEQ ID NO: 12969 - DNA, 371 bp, Zea mays
  Clone ID: LIB3279-210-Q1-N6-E11
cgtcggtcaccttctagattgggggggggatgccgtgtcttgtcttccacaacaagaagaaaaaacagcaaaacaagagcgcacaatacaggggcaacgacgagcccgcccacatgaggggagtggggacagctagaggggcagccccgcctgaagaccggaaagatggctcacataaccggccctagcctaagaagacgaaagactccgcttacgccaatgggtccacggaccggctgggcggcagaacaggcagctaggactaaaactcccccccccccccctacttcttctgcaaaaattacaggggcgctcccacctggggctgggcgcccccacggaagcgccaatgggcgccgcaagtgcctgcg

SEQ ID NO: 12970 - DNA, 578 bp, Zea mays
  unsure (1)..(578): unsure at all n locations; Clone ID: LIB3279-210-Q1-N6-E12
cagaaggaaatggttcttttgatcatagacaagcaaatgattgaacttaaatgtttattggtacacacacagtcacacacacaatcacacacacacagaattgaaattaaattaaaaataagaaacggtgaatctgcggaaagagcacatgctgtgactgagagaggtatttattagttggagttgagattgctcttgcgtagcttgcgctcgtcagagagttgcttggcgaagtcagctagcgactgtgcatttgtgccctcaccgtcgcaggactcgtacagccctgtgtcgatgttcactctcgccactggcttcttgagcagctcctggccgatcgatatcagagactccatgttctccttggtggcgatgtccacggacgatgcgttcccagtcaaagtatcatcctgcatagtacaactggatgcgaaggtacttcttctcgcagtgcagggcctgaaagaggatcgacgcatggatgtcaaccatgtcggaactggcatgcgagaagatgtcgatgataggcgtgaagccgncgttgtagagccactggatgaggccccacttcgcgcact

SEQ ID NO: 12971 - DNA, 413 bp, Zea mays
  Clone ID: LIB3279-210-Q1-N6-E2
gcagaagaacacaaaccattgtcaatttattgtgactggtattatcaggaaagtgaaagcctgcaaaaggatggattccatcctaaatagggacttgttctggtagggacccaggaatcttgtgaaatttccaagggctattgctcccttgagataccaaagaagctaacgcttagcttcggcccatcggggctctgtcctgctgcctaagcctctcgccttcgcggcacaaataaccattgaatttctccttgccgcccaagaggaaaataccggcaaggcccgcggtggcaacccccccccaaatgacgactgtggaccaaagcagcgaccagttgcggtagatcattttcgccttcctcgggttcctctcccgtcccttgcttcgcaaatcgctacggcggtcctcgtcg

SEQ ID NO: 12972 - DNA, 187 bp, Zea mays
  Clone ID: LIB3279-210-Q1-N6-E4
gtacagttcagctgattgagatttgcttcgacttctgacaggatgcagcaccagttgcttcactttgtattatttacattttctactgggaaacaacggtctccgttggtgtcatcttggcccagaaagctccactgcttgcaccagcagtgacgagtcgtccgtcaggtcaaagtggcagcggctg

SEQ ID NO: 12973 - DNA, 614 bp, Zea mays
  unsure (1)..(614): unsure at all n locations; Clone ID: LIB3279-210-Q1-N6-E5
aaaaaaatcataacatcattatgatatttaggtgtgctatccttttttttacctccaattacccaagatttttatctgtggtatcgcatcttaaatctgaaaacgagaagacaaacaaaatcaattttcaagagtctgaacctaaaactgtcttactatcaagtaccaatgtcaattgacaccctagactccacgtatcgagtagccgaatgggtagtagcgcatccaaactagatagatactcatccatttgatacctgcctaagttaacatgcatttcgttgtgcagtactgcagttctaccaatacatgtcaacatcccatagtgaggtgacaaagcaacaggtcacaagggcgtgatcctctttggaaaatcttggcttcagtaccttgcagatttagcaacaagatctgaatactgttcaggcacgaaagatttcactttcaatgatctcttgccatcttggccaggagagtatgctttgatgccaatagctccatgcanattgtcatgtataggcccatatagtaatctttcaccaagccaatactccaaaggccttgnagcgtgttcttgagctttttctactccaggctggcatgcaaggtcagca

SEQ ID NO: 12974 - DNA, 599 bp, Zea mays
  Clone ID: LIB3279-210-Q1-N6-E6
atgcatagggaagaacattcgctctcaacgaagtgtacatcgtatttgattttgggaatgcaattggatacagccatcaaaggaacaccaacacgcgaaaataaatggtaatggcgtgttccagtaagacaatggagtgattcaacagctgttgtttagcatttgatccatgcaatggagttgctctgtattatcattctagtcagttggcactgctaccatcaaatatcttctactagtacattcggaattctgcgtgcctgttcatgctaatcctgcaaaaacatgcatgaagtacatttctcatacggtatcgagtatagaccatctttgtacacgtggagactgcagccactgcaactaaaagcaccagcaacgtttctcacaggaagatcatgacgcagcttgggcagcaccaagtttgttagctcctttgtccagtttcttttttgacaccttttgggatgcttccccttcttggttcttcactactggtttgaactgatatacagaataaataacattcctcctgatttgagccatcatgtctaagaaaagattatatccctcaagtttatactcataaggggatctcgttg

SEQ ID NO: 12975 - DNA, 316 bp, Zea mays
  Clone ID: LIB3279-210-Q1-N6-E7
acgcacaagtagccatctatatactgttaccgaacacatgcaagagaaacaaacgagtgccaacatacatcaacaagaggctgcatggtacaacaagcgtctccagttaaccacctgaagttgacctgggatgggggatgagaagatatttcttctagactttaccctcccaaaggcactcgacagaggggctaccgtcaccgcgattctttgtcgatgccgcgtgcagtaggaggtcccggagatgagctggtggctggaggcccatggcagaggctcgctcccagcgctgaagccgagtaaccggacgcgtggg

SEQ ID NO: 12976 - DNA, 553 bp, Zea mays
  unsure (1)..(553): unsure at all n locations; Clone ID: LIB3279-210-Q1-N6-E8
gcgggcataacatctagagtgtgtgcttaattaaaaacagcggcaaaggcaatggcaatggcaggcagcttcagcgcacgcgcaccggcgccgtgacgaagagaacaacacgaggtgtactagaagataagctatcagaaatcaagaacggcacagtcctggtaaactccccgacatcagcagacacgcatcaggtcgggagatcggatccgtcttactggccctcgggggcggattctttgggggcagcagctgcttccttgatctcatccccgccgtcctcgttggtgtcggaagtccataaggtcaagttgtcacgcaggagctgcatgatcagagtgctgtccttgtaggactcctctcccaggctgtctagctcggagattgcctcatcaaaggcctgctttgcaaggttgcaagcacggtcaggggagttgaggatctcgtagtagaacactgagaagttgagagcaagcccgagcctgatgggggtgggttggagccagatcagncagagcaatatcctgagcagctttgtaggcattcatggtgc

SEQ ID NO: 12977 - DNA, 425 bp, Zea mays
  Clone ID: LIB3279-210-Q1-N6-E9
gaaacacaacacaattcttaaagacatacacgatcgagattcgtaagagtacaaacgttgccgaacggaaagctcacttggaccgagtttaagggggttctgaacacaaataagccaaagcaatagcacacatgttgggtgacgcacattttttttacagcaacaatgggacaatggtccgttaagcaaccagcgtggccgtggccgtggcattggccgggccttttgccttcggagccaccagctgggcgatgtttttcacagaacatattctgccgctggccagtccggccgtcagggccttgacttccattttcaccacattacggggggtgccaatattaggtggatacctggttgcgcagtacaccccgacgggcattaccgccatcccatagatgttcgggggaaccaagcggaatggg

SEQ ID NO: 12978 - DNA, 557 bp, Zea mays
  Clone ID: LIB3279-210-Q1-N6-F1
aaaaagccaggaaactttgggataacaaattcaggatttaagatagaaaaactctggttcacgagtaaatcccaaccagcatagcaacctacgggtgaattaccaaatataaagacaaggagcagtactttccaacataaaacaagggtaaaatctaaacatgactctgggtttcctctggtttcactggccgaaacaatactgggatgactgggcagcctaatcgaagaggctgaagcccatatcatcatcgctttcttccttctcttccaccttctcttctttctttgcctcagctgtaggagcagctccgccagcagcaggtgaagctgccgcaacagcgacaccaccgccaccacatgggactgaagcaaacttctccctgcccgcggcaatgagctcggtgatgtccttaccgctcagttgggacagcaggagttccatcctttcattggcaacttcacagccaactgactccagaatggcagtcaaatcctcagcggaggggctggcgttcccagcgaggacagcaagcaagtaggcagcaacaaacttta

SEQ ID NO: 12979 - DNA, 571 bp, Zea mays
  Clone ID: LIB3279-210-Q1-N6-F10
agctcttgctgattttgtattaacagcagatgagaacacttgcaagacaagaggcgagatattcaaatcgttcacatggatcctaggctcacttgaaaactgttctaatctcctagcaaagcccaagaaccaagcacatattttaactcaggtgcaaaatgtagtgttgaacacaacttccagatactgacagactgtatctagtgcgatttgacgtactcctgcactatgttaaggccttcagattcttcgccgtagtccttgacaacaacacaggagcagcctacaaccttcctcgccttgccctcagagtcgatcttgcaaagcccagcccactctccaagagttttggcgctaggcacagtaaccaggtggacattgtgctcagcgcagagagccttcaccagcttgacataatcaggctggtcgcagtcctcggcaagcacgcagagctgagcggcatgcttctcgatggctttggcagcctcacgaagacccttcacaaggccatcatgagcacctgacttcttcatgacgagctgcagggcagtcatcaggtccatcggttccc

SEQ ID NO: 12980 - DNA, 467 bp, Zea mays
  Clone ID: LIB3279-210-Q1-N6-F12
actgaaaggtgcatccttgaacgaggtaaattggtatttctccaaaaatgcaagatccacacatccaacactgacaggtctaatagcttaggttccaaaagtacatagagtagcatactctgctactgataaagaagctttggtagttcaacccgacgttgccatgtatccaatcagacctcctcgacggtcaaacctgggggaagagattgcttcaacttgtttgccttctcagcatcgaagacgcagagcgtgtacaagtacttggagcagcgcaccttgaacttgacaacatccttgctcctcttgatcttcactgagcgggcatccttcctcctcgcggtgaggaggaaggccttaatctcatggatctgcttcggcatcttctcgcgggacctgggaatcgccgagctcttcttctatcggcggtggctgggatcccacgacaggatggacccacgcgtccg

SEQ ID NO: 12981 - DNA, 551 bp, Zea mays
  unsure (1)..(551): unsure at all n locations; Clone ID: LIB3279-210-Q1-N6-F2
ggcatgaacaacacgtttgtgacagagcagcagtgtagccggcaactggcatgtacatactcgtacaacagagcattggtttcacatcaaaaagaagaagaagaaaccttcctaaataaccgaatgggattacaaggacaatatacaccggcgaatacatttacagcctaaaagaacctctccatgacttcagaatccgacaggagttctttcaacccgataaatttgctgtactggaaggggatccagccaacagcggatacataggcgacaagaaggcaggcacgcttcaaccggctggcaaatactctgatgcaatgcttcctcacagcccacctggcgggagggagcaacaacccatacatacctctgaataagggcgtaatgaacatcgaactcagcatgcccagcacaacacctgctgccacatatacaagcattcgccctgaactgaaatcttctgacacatacatctctgaaaacagtntaagtatccttttgaaaagctccccatcgaagggtcctnaacagtacaattgaatagcttggtc

SEQ ID NO: 12982 - DNA, 557 bp, Zea mays
  Clone ID: LIB3279-210-Q1-N6-F3
gatctaccaaaaaaaccatcacctctatctgattgaacaccgtcaggcacagcacataaatgaccaacaagaactaaattctacgctcgtgaagggtcctggtctaaccattaaaaacaaatcagcagcgggggaagccgcagaggtgacataagctcctattatacactcacaaatattaagagggctcaaaataagcagacgccagaagagctaaaacacgtcaaaaacagggctatgtctcccttcgggtcctccgacgtgggcctgtctcctccttttcatcctctttctcatccttgtcaccactgcttccagcaccgtccgtctccgcggccttgggcttcttcgcctcagctgcaggtttcacaggtgccactggtttcttgccaccaaacaggagcttgaagagaacggtaacgaacacgatgacaacggagaccaaaatgccaatagtgatggtgggctgtttctctcccttctcgataacatcaataatcttggtcttgtagggtgcccagaacggaatatcagcaatcttgtacaggacgtcaaaa

SEQ ID NO: 12983 - DNA, 584 bp, Zea mays
  Clone ID: LIB3279-210-Q1-N6-F4
ggcgacctcaccagctggcaggagcggcacgccgtgctcgtgctatccaaagctaaggaactcgccaagattcggtatgatctgtgccctcggcacctgaaggataagcagttctggaggatatacttcctgctcgccaagagttacatctcaccgtatgaactacgtgccatacagaaggaaaaactcagacgggtggagacagaaaactgcaagccaaaacaagtgatctctgttgaggtggagatgcaagaatcgaagcgcactagtctctcacaagcatcagaagtagatctagaatctcaggtttagttttgcagttatagcttctaacagatctagcttaggtaacgcaatcagtagcccttttatgattcctccacacaccaaatagctccacgagttcttcagatcttggatcgactctcgctagactaccagtccgctgtgtgcttttgtgtactgaaaccaagtaggtcctttcctgcattacgcagcatatgtgcttgttggctgtgctccgatccactgacatgtaaatctagggtatcttgcgcgtgaacaaaacgactgcgtttcatgtg

SEQ ID NO: 12984 - DNA, 551 bp, Zea mays
  Clone ID: LIB3279-210-Q1-N6-F6
aagacacctaaaaatttattatatctaacggtggccaacttagcacgacccgcagtttcagagtggattattacagtacagttgctatgtcaccaacctagtaacaatcggtacaaacttgagccaaatttacaatctcgacggcacccctccagcaacaacaatggtttcagctgtgatgaatgatgcatcgtcagatgccaggaatgcggcagctgccgccatatcttccacggaacccaatctcttaagcatagtcctctcgttaagctttttcctaatggtctcgttgtctacgaagaaactagcaaaccgtgtcggaacaaaatcaggggctatacagttaacacgaatatcgggtcccatctcaccagcaagagccttcgtgagaccaaagagagcggtctttgtaacaccatacattgtcaatccgtgctcgggattgtaaccagcaattgaagaaaaaggatcacagatgaccctgcccgtaggtggggagcagcatcctgattagaagaatagaagccttgacgttaatatcccacaactta

SEQ ID NO: 12985 - DNA, 345 bp, Zea mays
  Clone ID: LIB3279-210-Q1-N6-F7
caaattatattaaatggaaataaattaccctgggggggggggaaggaaaagggggggggaaacaaaacaaacgaaagggaaaaagcaaggaaaaacaaacaaaaaaacggggggggaaaaccccccccgaaaaggggttgcccaaaaaaggaaaaaaaaaaacggggccggggggggccccgggaaaatcggagccggtcacaggggcgaacaccatttttccctaaaggagaaagaataaaaacggggggaaaaaagggggaagggaacccccggggaaaaaagggaggtgcccgaaaagttcccaaaataaaaacctggagcgcaaaaaggaaaaagcggggg

SEQ ID NO: 12986 - DNA, 197 bp, Zea mays
  Clone ID: LIB3279-210-Q1-N6-F8
gggtaaaaaacattattataaaataaaagggaactttttaacttcaacagtaaaaaattaaaggtttcctatttggtagtgggggtgcataaatttaaatgaaaaaaataaaaaaaattttgtgacaataaaaattaaattaagtaaaaaaaaatttaaaaaaaattaaaaaagaatgggggagtttaaaaccgaac

SEQ ID NO: 12987 - DNA, 371 bp, Zea mays
  Clone ID: LIB3279-210-Q1-N6-F9
gatcaataaggacaagtcaatcgatgataggagtaccagttacaagtttcttgtgtccaatcatagatcacagcagcatgcttccggtaattccacaaatatagcacaaggtcagggcactgcgcactagcttttatggaaattacagggattattctagagaaatggagtagcagtccttggcattagcactgatcaatcacaagatattcttagcctgggggccagttcatttgcctgcctccgaggagatgaacgtggatgtggtaaacaaattgacatccacttgggccgtcattgatgacgacccgatagccatcttcaagtccttcctgcttcgcaacaaccttggcaacatagaggagatagcc

SEQ ID NO: 12988 - DNA, 517 bp, Zea mays
  Clone ID: LIB3279-210-Q1-N6-G1
agaacacggacacgtaacgccgtaccccaccaacaccaatgaggctaacctaacgccatggaacaggagtaagggcccaaattattcgaaacaaatgaccctgctggcttttgtgttcaacaaaccatggatctaccaaatctgactcatttcgcgctgccgagctgggtgcggatgagcttggtggcggagaccatgttggtcagggcaggcttcacctccgtgtacttgcgtgtcttgagaccgcagtcagggttcacccagaggatgttggtgtccagcacggcgagcatcttgttgacgcggtccgcgatctcctcggtggaggggatcctgggcgagtggatgtcgtagacacctggaccgattccagctccgtacttcacaccctcgcggaacacggacagtagcttctcgtcggaccgggagttctcgatggtgatcacatctgcgtccatgtcgatgatggagtggatgatgtccttgaagttggagtagcacatatgggtgtggatct

SEQ ID NO: 12989 - DNA, 432 bp, Zea mays
  Clone ID: LIB3279-210-Q1-N6-G10
gggccggaagtttaatcatattggggtgcaaaaaaaaacttgtcatgatccatgagatttacgggtaaagacagtggcccagtttggtcgtcattttccacagaccttttcttggtctcaacctgggggtgcatttaatgttgtttccaaaaaatttaacacgccctttacagataattggtgggggtgtagaacttctggagtttaaacaaaaagaatgggatttgcgcgctgacttgcaagcattgggtattctttagcctccagcaaatgattcatgacgaggcggaggctccttagctgcttccagatttgagcgtgttactgagccagtccaaaccttcaaagagcccctctccctttattgcagatgttttgaaaatcgcccattgacggctcttaattttgtgtaggtctaatgactctgtaatg

SEQ ID NO: 12990 - DNA, 550 bp, Zea mays
  Clone ID: LIB3279-210-Q1-N6-G11
gggtatgacacgcaaattatattgatcctttcaagcaatacttagagcgccaggatacttatagtagtaccaccattctgaaacatagtagcgccaggacgaaatataggatcgtccaaaaacatatccttaacaagagtttaattcaataaaacctcggtgccagaacctagcagacttcacaaaagagcatacttagaacaccctgtatggcttccccatggtgctcttgacgtagaggcatctcacattctgccagttcttcttcagaagggaaacaaggaagttcacgctcatctggatgttctgctggatctgcttctcctccatcgccaagttgccgacggcgacgcccatgcaaaggaccttcttgagctggaacttgacggttgccttagtctcgttcaccttggattcgagggattcctggtgagtaaccagggtcgggaacttgcctgccttgttgagaccaggaccaaggagacggggaatctgcttgatgatggcctctgatgccaagaaagcatggtacttcttggcaagcctctta

SEQ ID NO: 12991 - DNA, 419 bp, Zea mays
  Clone ID: LIB3279-210-Q1-N6-G12
gggggggggggaaaaaaaaaaaaagggaaaaaacccctttggggggcctttttggggggggcccccccccccaaacccaaaaaaaaaaacccccccgggggggggggggaaaaattttggggggcccccccccccccccggggggtttttttttaaaaccctttgggccctttaaaaacgggccttttttggggggggaaaaaaccttttttaaacccccggggaggagggccccccccccccctaggggggggggaaaaaaaaaaaaacccccggggggggcgggggcccttctccccttaaaaaaatttttttcgccttcaaaaaaaaggggtctcccccaggggggggggctttgggaccggcgcccccaaaaaaaaaaaccctcttcggggggaactttttttttttttttaaaa

SEQ ID NO: 12992 - DNA, 515 bp, Zea mays
  Clone ID: LIB3279-210-Q1-N6-G2
ttttttttttttttttttttttttttttttttttttttaacgggaatttcagttctcatagcattatcatgaatctcaaaacataacaggggaaacacgaatcaagccgaggagatagctaccgagtgggtgaagcaagccaggaaacgagcgatcgccgaacagacccttgctctccttcaggggtgtgcttcttcgaccacgttctcatgattttggccagacttttttttttcttccttttggttgcttggatttgccgggttcagtactttgtgaaaaagcttgtttttcccaaaccatgttgaaaatgcctggatggggaacgagaaaaatcagatacaattctttagcagccagccagccactgggtctcaaagtgggggccctgcctaagtttttcatcgggtaaacaaagctaataagttttgccctgtagctacttgctgttcgtgacattttagtgtccaattaaagcaatgtttttttaatgcaattgctgaaggattccttgc

SEQ ID NO: 12993 - DNA, 571 bp, Zea mays
  unsure (1)..(571): unsure at all n locations; Clone ID: LIB3279-210-Q1-N6-G3
atgaaaaccatgcgacaagggcgcggccaagcggggcataaattcgagtgcaacagggtgtaactaatccccacatatccaggcgttcagcggttcacgccatatgatatgagatcccctacagaaagaagacaggcacactggcttcagcccgtgttctgcatcccggcagcgatgcccttcatggtcaggatgagggtgtcctccagccccggggcgtactcgctggtggtgttcagcttcacgagctccgacgccggcttgcccatgtccatgatgtccttcgacaggtggggccgcggcttcacctggaagccagggtccctgatgcgcttcagcgtgtaggcctggcaaacgttcagcgccgtggtgtacgagtcacggatgcgcagcctctgcttcaggtacgggtcgccctccagaaggtgcttgtgcccagcgacctgcaggagaagctgctttgtttcttcgtagttggctctgagacgcgcccctatggccacaggtcctctgaaccagaagctngtcgtacagcgccgcgatgccaggatcacccttggcgaacaccatc

SEQ ID NO: 12994 - DNA, 569 bp, Zea mays
  Clone ID: LIB3279-210-Q1-N6-G4
gaggaacctaacgcaaagtttattttcaagaagagcacaggaatgctcatttccgaacaattcaatgtctcgttacaagcaagcatgctcacacataggcactcaactttcgtcatagaagacacatcactgaacaagcaaacaacccagaacagacttggcttattccattcaccgattgacagggcaaccgtttcaagcagatggcttcatcagggcagcgaccttctggacagacggcctctccatcagaccagaccaccaggccttcacatgcgggtaggcgtcgagcacagatgcgtagggcgtagcgaacaggcagagagtgacagacacatggttcaggtcggcgaggctgaggaagtctccagcaaggtacttgcacttggtcaggcgtgcctcgtacacctctagcaccttcttcagcttctcaaggttctcatccacaactttctggtcggtggttccccccagcataggactgatgaggacctggaagaggatgggattcaatgcagcggtgtactgggtagcctccacctcgatccaaacatccaccattgctgcct

SEQ ID NO: 12995 - DNA, 314 bp, Zea mays
  Clone ID: LIB3279-210-Q1-N6-G5
aattgctggccgataaattgataaaaacaaaggtgcagcaacagctagcttaaatcaagctgcatcatgctagaatcaacggcgcacttttctgaaaaaaaaaggtgaacgcggctaagtttcctggggcgaattttccctggccttaaagtccgaaccgggtggggcactatctggccacgggcccagccggggaaagagccgatcttacaagggccagaacctaagggtggttgagccaacaatctcccgatagagttgacatcacttgggcttgcacaaagggtggcctcccggtgggctgtttccgcttt

SEQ ID NO: 12996 - DNA, 366 bp, Zea mays
  Clone ID: LIB3279-210-Q1-N6-G6
ggaaaccgaaccaaaataccggtttacttaaaacgggggccacgataattttggtcaccaaaaaagggggttaacgggggtaccccggggcggccacaataaattggggagggacggggccagccagcccctggaggagacacacgagactgacacaatccggttaggccacctccttaattttgggggcagggccaccgttttcaggcggggggttcttgttcatgccggcggggccacccatgtggggacccgggccctggtacattttggggatgatgggggtgaaaagggtttccaacttctttattttggaataaaactcgtccgccttggggaggtgggtggggtccaaccagctgatgg

SEQ ID NO: 12997 - DNA, 475 bp, Zea mays
  Clone ID: LIB3279-210-Q1-N6-G7
caggcagagcacaaatttactgaacagttattatgatacatcacacagccatgatggtcactgtttaatgttgtgcaccattagactaactagtaaataacagaaccaccaccatccatcaacttgaatcaacattgggcatagttctgccagcccagtagacattacgcagaacagtacaagtggcatgatataatctggaaccgaataaactcattccagccattcgctaatgtgggtcatgtgctgtccccaacgatgtgatctttgataaacatgacactatgactgaaatcagtattcttcggcagcactagcagcactcaaatccacactaaggtctacagtctttccggtgatcattgtatacatgttcagaacatctgttacagttgtctcaaaatgtgtggtggcatcatagcttgtcgagacaaagcaattatcaagagatggttcattcactggttcatatctg

SEQ ID NO: 12998 - DNA, 294 bp, Zea mays
  unsure (1)..(294): unsure at all n locations; Clone ID: LIB3279-210-Q1-N6-G8
ntttgggtttttttttttttttttttttttttntttttttttttntttttttttttttttttttttttttttttttttggggggaaaaaatttttaataaaaaagaaaagaggtttaaggaagggggggattttttggtttaaagggaaaaggaagggaaaaaaaaaaaaattgaaggggggaagggtccccgtgaataaaaagggaaattttttttgggtttgggcttgggttttgggttggtccggccggggggggcgggttttggttggggggggggggaaaataattttt

SEQ ID NO: 12999 - DNA, 504 bp, Zea mays
  Clone ID: LIB3279-210-Q1-N6-H1
agtgaaatctaacccaacgacaagaacaaagattattatttcgaacttccatagaggtcattgcaccaagaagcatgcgatacaaaatagcacccaaaacactcgaaattctaccttcttattttagggcctattttaccatgaaaactcaaatcatgtagttggattactcaaagggcatatttaaaagcattctttggtacgataagctatatgtgatttatttagtagggggtggtctcccagaattgagcctggagccaatcaattggccccttctccacctggaaagcctttgccaagacatcatccgaaatcggtggctttgatccgaagaccgcattggcgatgggaataaccccagggttctggctgctgagcgccgcgatagcaacgggcggcttgttatagaccgggttgaattggaaatggatgagaccttgggggaatacgaacacatcacccttgttgagcaccttggcaaatagcttgtttgggttggag

SEQ ID NO: 13000 - DNA, 455 bp, Zea mays
  Clone ID: LIB3279-210-Q1-N6-H10
gtagagcatgtagcttccttcatcgtttcaaaagcattacataagcagcaaaaccagaaataatcctctaggtgaataagcagacacaatacgaccccgcacacgtaccacttattaggacagtgacagtgcagtacaaatgataagcaaggggcagatcaagaatcacaacacgtaggagccataaaaaagcatgatagagcgcaggcagaccagaccaaaagcttcttccgaaacagaggaggcgcctcatgcagaagacggcttctccgccttgaggggcttcaccacctcccaggtgaagtcggggtcgtccctcccaaagtgcccgtaggccgccgtcttgaggtagcgcccgttgccgcctttcttgaggtcgagggtgatgatgatcatgccgggcctgaagtcgaagttctccttcacgatcttcaggatcttcttgtcggggatcg

SEQ ID NO: 13001 - DNA, 558 bp, Zea mays
  Clone ID: LIB3279-210-Q1-N6-H11
gacttacacacaaatcattaatggactgaagtagctaaaacgctaaccacagtgcagtgaactgcttgctacacgaaggggtggaaccaggcccagatttacatacagaattttacaagccatagaaccatgccaacacgaaggaatgacaccacacaagagaaccgggcaagggggctcccagattaacttgctaaatagcaaggaataaccacaaaaatgaactggtaaacacatttcccccaggcaaggagctcagggcacctactgacagtacaccaccgtgcatcacactaccttgctgagggaaccgtctcacttgaatcaacagcctcctctgtcgcatttgccttgggactcctctcctccgtgacgcagtccgagctatcaggtccggatgagccatggaacgagatatcaggcttgaacagatcaccattctccagcctggaaagcctctcggtagattctcctctgagcagctcgacgacttcagacattacgggtctctgctctggcttgtcctgggaacaggcgagcccaacgagcaccattcgc

SEQ ID NO: 13002 - DNA, 182 bp, Zea mays
  Clone ID: LIB3279-210-Q1-N6-H12
gcgatctagaacggagaagggagcaaccacgaaagataccattcatgccccaagatgcagactcttctgtgaaaactatgtccaggccatctgattcctcctgggataagatcgctgcaactctgatggcttgtcttatggctattgtgatgttgggtcgattagtcaaagatcttgtcaca

SEQ ID NO: 13003 - DNA, 532 bp, Zea mays
  Clone ID: LIB3279-210-Q1-N6-H2
aaaagtgcaaatccaaggtttccactaagcagtgcacaaataatcaactagtgacatatgctgaactggaatccagtaagcataacagttagtatcggaggttgctaagatatcgttttgacatggtagatggcaaaaagggaaatgcaaaacatcctacggcatagagttgacaaaccaataacttcatgtggagttatctccatcctcaacaatcttctagaccaagcaaacacgacaaacaaataagtaacgacttattttgcccatcttttcagaacaaaaaaagggactgggaaccggaaatatccctaagagatgcttggtggcccagtttcaccatctctgccttgccattggcctgtccgaatttctgcttgcaccaaaagagcccctttctctgcttccttgaaatccccatctttcttcctgccttggtggtggctccataccaccacgagagcgcggtctgtccaccactgtagcatgtggttcctcccctaaactaggtggtgcaagtgctgtaaccctg

SEQ ID NO: 13004 - DNA, 602 bp, Zea mays
  unsure (1)..(602): unsure at all n locations; Clone ID: LIB3279-210-Q1-N6-H3
gatatctcaatgtttcttattcaaaactgtcaatgtttaacgaacaattcgtatatagttactgaaagatggcaatagaaaacaattggatcagctcacacgcggcggttcaatacaacacaaacaacaccatagtttgaaggagacgaaattgcagacgtacatatttcttaacgttttatgttcctgttgtgcgattaaatatgcgtgatcccttgggtgcagcgccatgccgacatctttcgatggttcctttgcagatcgaccatgggacatgtgtgtatgcaaggtttgcaggtaaagtgaatcgttgcttccaaagagaacagaaatgcaacagaacgccaggaattaatggttaatgtaatatgaacctcacaagtacttggatagccaaggaagatctggggattccttgagggcaaatgtcacatcgtcactcggatagttaagctgaaccttctgcaacttgtgcttactaccctcttcacagaggatgatcttgctttaccaagcttgcagcaaattttcaagagagtgtcgtattcaggcaatagttctctgttggcatggcaccaggagaaanctgttgttgctaactt

SEQ ID NO: 13005 - DNA, 578 bp, Zea mays
  Clone ID: LIB3279-210-Q1-N6-H4
ctcagtataaatacccacaataaagttatgaaatcttagatcttacaatgctcatcgacatgacactccactgcagttgagcttatcaatacaagacaaaccacaaccatgttctcgtacgcgcgcaccgaccatgccccatttggggtgcttgttcgggctccgccgccgtacccacaggcctgtcctacccccataatacaactgcgacaggtgatagcagccaacatcatcatggagttggacttgatcggctagacttgatcggctccctattgatgaactacctgtacattgggccgactttgtcacagaggtatacttgatcggctccctattggcgaactacccctacattgtggtaacttcatcacggagctagacttgattagctctctgttgtcgaactaatagctacgttggtggttcatattgagtatctcgacaccgtctactatggttagcgttcctaaaacaggttgaaaacaacataatttgttaatttaatgacatttgatgaagtcttctccccaacagcatgattaagagggtccacacttcaaatgtgtattactctg

SEQ ID NO: 13006 - DNA, 416 bp, Zea mays
  Clone ID: LIB3279-210-Q1-N6-H5
ctacgctcgtgaagggtcctggtctaaccattaaaaacaaatcagcagcgggggaagccgcagaggtgacataagctcctattatacactcacaaatattaagaggtctcaaaataagcagacgccagaagagctaaaacacgtcaaaaacagggctatgtctcccttcgggtcctccgacgtgggcctgtctcctccttttcatcctctttctcatccttggcaccactgcttccagcaccgtccgtctccgcggccttgggcttcttcgcctcagctgcaggtttcacaggtgccactggtttcttgccaccaaacaggagcttgaagagaacggtaacgaacacgatgacaacggagaccaaaatgccaatagtgatgttgggctgtttctctcccttctcgataacatcctg

SEQ ID NO: 13007 - DNA, 336 bp, Zea mays
  unsure (1)..(336): unsure at all n locations; Clone ID: LIB3279-210-Q1-N6-H7
ccgggaaaaaaattgggggggggggggtgaaaactttggggccccccaaaaaagaggggtggcccccctccccagaggcccccccccatttaaaattttccccgtaaaacatgggggggggcctttcttcttttttgggggggggggggaaaaattttttttgggggcggggggcccaaaaattttcccctaatttcctcctaaacacaaaattttttttaaatcccccccattttcaaaaatggggattggggcaagggagatttttattgtaaaaccgggggcctgacttggttgtttnaccagcccaaaggggtcccccctaggggggggggg

SEQ ID NO: 13008 - DNA, 429 bp, Zea mays
  Clone ID: LIB3279-210-Q1-N6-H8
aagaaaaaatatattttttcatcaatggaacaatcaagtacatttattttccgttaccagaaataaatttgaataatccaaggtttggatacctgagaaacacttaacttcatcacaaataaatggtcagttctactggttgcacacttggagataggtatctttttattggggatttattggacaattacttcataaaaaacaaatggtgggccctcagtccaatctggaaccacaaatatatgacattgtcagtagtgaatttggaaatgttcaccccatatgaaattgtctaacacgaaacgccaaattggtgcaaacaaagagcccattactttgcttaactaggaacaccgtatttggaggataataatgatcctactaacgcctcgagatttgcattgatttgagacatttgaagatgagaca

SEQ ID NO: 13009 - DNA, 529 bp, Zea mays
  Clone ID: LIB3279-210-Q1-N6-H9
aaaattatagaataaatcaactcggtgaatgtaaaattttatttcacatgtcaccctacttgctatgttcggtgacatcaagtttccacggcgtgacacgctgaatgttggagtagctgccggtggagaaggcgtagagtaggttgagcatgacaatgaattgggtgtactcctaaagcatcttgtatgggtccaagacatgactcttctcgtcgaatgtcttgtcattgatgttttcaccctgatagatgggaagggtcacgtcgtccctcaccttgaccatggtctacgggcatttgggtgccgaacgtgagcacgtattacatctgcaggagaacgcataagttgccatagatgtcggctctgttaatctcctttcagcattgagttttaaaagtaaaaaaatagtggatttagaaatggtgatagctagttctcttggttaataatctaaattagtgtgaagagtataaatcaattagtaggttagcgaaaacgtataaatcatagagtttgagttttttggaga

SEQ ID NO: 13010 - DNA, 640 bp, Zea mays
  Clone ID: LIB3279-211-Q6-K6-A1
cagatgtgcacgtgtgtgaatcaacaaacccatatgatgtctggtacaagaagatgaaggcctgtgtgacaccccttccagatgtaaaagatgaaaacgacgtagctggaggtgcaatcaaacccttcccagacaggctcaacgcagttcctacaagaatcgctaatggtttggtcccaggcgtttcatcccaggccttccagaaagacaataaaatgtggaagaagcatgtgaagtcttacagcagtgtgaacaagtatctgcttactggtagatacaggaacattatggacatgaatgcacagtacggtggattcgccgcagcaatagagtccccgaaatcttgggtgatgaatgttgtgccgaccatcgcgaagatgcccaccctgagggctgtgtatgagcgaggattgatcggcatatatcatgactggtgtgaggctttctctacttatccaaggacgtatgatcttatccacgctagcggtctttttaccttgtataaaaccaagtgcaacatggaagatgttctcctggagatggaccgcatcttgaggcccgaatgcgccgtcataatacgggacgacgtagacgtcctgaccaaggtgaacagcctagctctgagtatgaggtgggacac

SEQ ID NO: 13011 - DNA, 532 bp, Zea mays
  Clone ID: LIB3279-211-Q6-K6-A10
gctggagactactcctacaacatgcgcaacacgatcaaggacgagaagattgcgtccaagctgccggccgatgacaagaagaagatcgaggacgccatcgacgcggccatcagctggctggacgccaaccagctcgccgaggcggacgagttcgaggacaagatgaaggagctggagagcctctgcaaccccatcatcgccaagatgtaccagggcgcgggtgaagacatgggcggcgctggcggcatggacgaggacgcccccgctggcagcggcggccctggccccaagatcgaggaggtggactaagcggtttgttgtcagtcttgagcgtgctgcagttgctggctggcccagtcgctgccgcgagttatcgtcgtcggtcggtgcggtgtgtccgcttaaactttatttgtggtgggctggtacttttgtggtggttattttttttggacctcgtgatagtcggtcggttccatgttatcgcggctactggcaaaccttaagtgatacggtaattcttcttttcggt

SEQ ID NO: 13012 - DNA, 565 bp, Zea mays
  Clone ID: LIB3279-211-Q6-K6-A11
tcatcgccggcaaccgccgccatcgatcgatcgcccggaaactgacctctaccgatgtctggagccggcgaggaggataagaagcccgcggagggcggcgcccacatcaaccttaaggtcaagggacaggatggcaatgaggtgttctttcgcataaagaggtccacccagctgaagaagctgatgaacgcctattgcgaccgccagtctgtggacatgaatgccattgcattcctgtttgatggccgcaggcttcgcggcgagcagacccctgatgagctggagatggaggacggcgacgagatcgacgccatgcttcaccagaccggaggcagcgttcctagcaccacctaaaagcagcagctgcggagcctcgttttgctctccgccctgcgtagtactaaacaaaagggaaaaagtctttttaaggaacttgtgatgctctggctccttgtgccattgctgagggacatccttagcctttatttagtggtatggtttggtactttgttctgtcatcactcgtttatctatccctaatacatgccgccatgtttgtacttcc

SEQ ID NO: 13013 - DNA, 642 bp, Zea mays
  Clone ID: LIB3279-211-Q6-K6-A12
gccatccctctcatgccggtgggggccacagtttgagaaagctacctacaagaatcgtcagcgcctttacctatctgaacagacggatgggagtgtgcctaatactctggttatcgcaaattgtgaagttgtgaaacctagggttgcagctgctgaacatatctcacagttcaatgaggaagcacggtcaccttttgtaaagaagtacaaaactatagttcatcctggtgaggttaacagaatcagggaacttccacagaacagtaagatcatagccactcacactgacagtccagatgtacttatttgggatgttgaagcacaaccaaatagacatgctgtcctaggagcaagcgagtctcgccctgatctgatattaacaggacataaggaaaatgcagaatttgcgcttgccatgtgtccagcagaaccatatgtcctatcaggaggaaaggacaaatctgttgtcttgtggagcatccaagaccatatatctgcccttggggattcctcatcttctcctggagcatctggcagcaagcagtctattaaaactgcaaatgaaaaggagagccctaaagttgatcctagaggtatatttcatggacatgacagcacggttgaagatgttcagttctgccc

SEQ ID NO: 13014 - DNA, 634 bp, Zea mays
  unsure (1)..(634): unsure at all n locations; Clone ID: LIB3279-211-Q6-K6-A2
tcctcctcctctcctttcctctcctctaggctctagtcctctcgcatccgcagcttccccagccagctagggtttgcagatgacgaccgcggcgcgccccacctgggcgccggccaagggcggcaacgagcaggggggcacccgcatcttcggcccctcccagaagttctcctcccgcgacctcgccgcgcacacctccctcaagccaagaaaagacggtcaacagacccaagaggagttacagaagaggaatctcagggaggaacttgaggaacgtgagcgcaagcactactcttccaaggataagtcctatgccgaagaaagagaccggcggaaaagctctagccatctactcttagaaggttcaaagagagagacagaggataagatagttccacgagaaatcgatgctgatgactccgatgtggagcctaaaagcgatgacgagagcgatgaagatgatgatgacgacgacactgaagctctaatggcagagcttgagaggattaagaaagaaagagccgaggagaagcttagaaaggagcggcaacaagcagaagaggaggccaagatgaaggaggctgaactgatgcggngaaacccgttgattaatatcaacaatgctggctccttc

SEQ ID NO: 13015 - DNA, 634 bp, Zea mays
  Clone ID: LIB3279-211-Q6-K6-A3
tgatgatgaagcatacgctgcttatgatgagctattctcgtatgcttgccccaagttcattacaccgtcgcctccaattctggaccagccgctaacaaactataaccaggatgcataccgtcttcagttgaagttgtttctctatgaagtaaagcagcaacagttgctttctgggattcggagttatctgaagctatattcaacaataaccattagcaaacttgcccaatatatggaagtggatgaagcaacactaaggtcgatcctgatgacatacaagcacaaaatgcatgcagttgacagtgaaagaaagatagtatcaagtgcagactttgacttctacatcgtcgaggatgtgattcatgttgtggagtccaaacctaccaagcgtcatggtgattactttttgagacaaattttgaagtttgaggaaatgattggtgaactggagaaggtacagcttgactgaaatctgatagcgatcatggagagaaatgtcactgtttcctttttgctctcttttgtactccgttgaaaccccatctttttttgtttccttattgactctgaagcccgttgaaaccggccattattaaccgtgtaccgtgtaatgttacttaggccctgtttgttt

SEQ ID NO: 13016 - DNA, 685 bp, Zea mays
  Clone ID: LIB3279-211-Q6-K6-A4
cgacccagcgtccggtcctgcgtggtttgagtgtttgaccacggcagcacgagcagcccgctccactcctcccctgccgaagcaccacacaggcacacagcagaagcgaaaactgcaggaaggccaatcgggcctggcaggcatgcttgcccgctgccgcaggtgaggcgacccgcagccgtccgagacgcaccccggcgcaagcgcgcatccgccatggatccggtgtccgaggagctcgagcgccgcagccgctatctcaactcgctcatccgccgtactaagctcagcgccacccctgctccccctcctcagccggagccggagccggagcacgaggtagcgccacagaatccggagccggagccggagaccgcggttgggaagcgcgaggaggccaaggcggatccagtggtcgttgaggaggagaagcgggaggccaaagtggcgggggacgggaaggggaaagagataaggggaaggacgacgggggtcccaaggaggacaacagcaggaaggtgtcagtgcgggtgcgcgcggccgacatgcccctaccgctgcagcgccgcgcggtccggctcgcctacgaagccatcgtcgccatgccgcgcctcgacaagcagcgcctcgccctcgcgctcaagaagaatttgatacggcatatggtccagcttggcattgcatt

SEQ ID NO: 13017 - DNA, 227 bp, Zea mays
  Clone ID: LIB3279-211-Q6-K6-A5
ctttgataccctatggccgaaaagcataaatatgacgcccggatatccccattttattttgttgaatctggatgtttctttggggtctcaactagactgctccgtatgtacttcaaaaaccatagttttgatgccaaagttgttgcctaggaatttggtactcgggaattggtagcggacgtgaacaatgttaagttttgagcatttaaatttacctttgtcatgat

SEQ ID NO: 13018 - DNA, 620 bp, Zea mays
  Clone ID: LIB3279-211-Q6-K6-A6
cggtcgcgtgggcgcgaggatggacgccgaggccgtcgtctccagggagaccgccggcccggcgcccacctgccgttgcgagatgcagcttcccaagtgcgaccacgtgggctccactgccgtcgtggccgtggtggggcctcgccacctcgtcgtcgccaactgcggcgactcccgcgcggtcctctccagcggaggcgccacgatccctctctcagctgaccacaagcctgaccgccccgacgagctcgaacggatccacgcagcgggagggcgcgtcatcttctgggacggcgcccgcgtcttcggcatgctcgccatgtcccgagccatcggtgacagctacctgaagccgttcgtgatctccgacccggaggtgctggtggtggagaggaaggacggcgaggacgagttcctgatcctggccagcgacgggctgtgggacgtggtgagcaacgaggtggcgtgcaaggtcgtgcgcacctgcctccggaacagggcgccacgcggtggccgggagcagtcgagcccgacctccaacctgagccctatgcagagcagcgccagcggcggcagcagcagcagcagcggggacgaggaggctggtgcgcccagcggcg

SEQ ID NO: 13019 - DNA, 566 bp, Zea mays
  Clone ID: LIB3279-211-Q6-K6-A7
agcagtagaattcatgcagaagctaccatcctttgacgaggactgggccaggcaacgcagtgatgctgatgctgcagacgaagtcctgcgttacgttggagtggtggatacggtgaacaagaggggacaggtggagctacgtaggtacaagagggaccacccgttcgcgcagctctccggctccgacaacatcatcgcattcaccacctcgaggtacaaggagcagccgctaatcgtgcggggcccatgcgcgggcgcggaggtgactgcgggtggcgtcttctgcgacatcctgcggctggcgtcttaccttggcgctccttcttagagcttccacttacagttgtcaatttgaagaggcagatggacagtgccctgcatgatgcctccgtgtttaggcttattatggacttgctcaaagttgttctgaataagtgccaggaaataaggcctctatcttatttaggcctctatcttcggggtagctgactaagtgttgttattgctacggaatccagaattctgtgaattgaaatgaattgtaccgatgaagactgtttgcttgg

SEQ ID NO: 13020 - DNA, 620 bp, Zea mays
  Clone ID: LIB3279-211-Q6-K6-A8
ttcagagccgtacaaggtattgttgactgcttcaaacgtaccattaaggatgaaggtttctcttccttgtggaggggtaacactgctaatgttattcgttacttccctactcaggctttgaactttgcatttaaggactacttcaagaggttgttcaacttcaagaaggatagggatggctattggaagtggtttgctggcaacctggcctctggtggtgctgctggtgcttcctctttgttttttgtgtactccctggactacgcgagaacaaggttggctaatgacgcgaaggctgccaagggaggaggtgaaaggcagttcaatgggcttgtcgatgtctaccgcaagacactcaagtctgatggtattgctgggctttaccgtggatttaacatctcctgtgttggaatcattgtttatcgtggtctgtactttgggctctatgattccatcaagccagttgtccttactggcaacctccaggacaatttctttgccagtttcgctctgggttggctgatcactaatggtgctggtcttgcatcttaccccatcgataccgtccgcagaaggatgatgatgacatctggtgaggctgtcaagtacaagagctcctt

SEQ ID NO: 13021 - DNA, 192 bp, Zea mays
  Clone ID: LIB3279-211-Q6-K6-A9
atctgtctttcctacttggccggtctgttttaccgttagtaaatcctcagctatcgttgtgttcttgtggttcagtcccttgttgtagtgatgcctgcgggttttcctaatgtagtgctgaacggtttcataaactcggatattggtgcatatgtaacagatatagctaagtcaagttgttgcttggtttgc

SEQ ID NO: 13022 - DNA, 654 bp, Zea mays
  unsure (1)..(654): unsure at all n locations; Clone ID: LIB3279-211-Q6-K6-B1
acccacgcgtcctcttttagcgtccgcccacgcgtccggcctctgtgaaaattcaaattcatatcatctctggtgtcaagcaggatggggaacctataggcgatgttgctctccctccatgggcaaagggatcgcctgaagaattcatccacatcaacagagaagcccttgatagtgaatatgtgagctctaatctgcataactggattgacctcatatttggttacaagcagcgtggacaaccagctgttgaggcagcaaacatattttactacgtgacatatgaaggtgcagttgatctgcaaaattggatgacatgttacataaatctgctattgatgatcagatagcaaattttggacagtacaccaatccagattttccggacgaagcatccaagaagagggcctcccatcccaattgctcatccactgtnttttgcaccacagtcgctgacattaacatcaagtgtttgtggtgccgccagccacatgtgtgctgtactatttataagtttgttggagaacactggtgtcttgatgaatggtgggactctttcgtcaggcaagctggggttggcctctcacctgcagtccggtggtaatttcacatattccggtccccggtactttctttggattggttctgtgtttt

SEQ ID NO: 13023 - DNA, 609 bp, Zea mays
  unsure (1)..(609): unsure at all n locations; Clone ID: LIB3279-211-Q6-K6-B10
gcggcggcggcggcgcatcagcggcagcagcatccgaagaggtgaagttcctcaagcccggcaaggccgttatcctcctccaggccgcttcgccggcaggaaggcagttatcgtgcgcgtgttcgaggagggcacccgcgaccgcccctatggccactgcctcgtcgcaggcctcgccaagtacccaaagaaggtgatccgcaaggactccgccaagaagactgcgaagaagtcgcgcgtcaagtgcttcatcaagctcgtcaacttcactcacctcatgcccacccgctacaccctcgacgtcgatttcaaggatgtcgccaccggtgggcccgacgcactctctacccacgacaagaaggtcgccgcctgcaagacggccaaagcgcgccttgaggagaggttcaagaccggcaagaacaggtggttctttaccaagctccgcttctagatgctcggcctcccgaatagtcctgctttagctgtcgatttgttgtatcggacacactccatctctgttttcgtattaccatgaatatttcgtgtttagtcctggggctctcagagaaaatttgctaagaatgccgntgttgtgttacatgtttttcg

SEQ ID NO: 13024 - DNA, 651 bp, Zea mays
  Clone ID: LIB3279-211-Q6-K6-B11
gttccggcgatggtgcacggcggctacccgcgccgcgacgccgccgtccgccggcccaagtcctcgtcctccgccgtagttgccgaccgcaagcggaagtggaccgccgccgccaagaacacctcacttaaaaaccagatccgttccactgagcgctttctccacaaggaccttcctgatgacattagggttgctcaagagaagaaactggaagaactgaagaggcaacaagagcttcagaatcaactcgttgttcagcgaagtacagttgagagatagaaagataaaattctttgagaggcggaagattgagaggatgataaggcgccttgagaagcagcaacgttcaaatggtgatggtttcagcaataatttgtcaaaattgtgagaaaatcttgaatatgtcagattcttcccaaagaatgaaaaatatgtctcgcttttcactggagggaatagctcagatattattcaagagaggaataaatggtgtaaacatatcaaggagaatctcatggctactgcagcaaactaaaaagatttagaagagctaacaagcgatgatgataccttggatgtgagtgatgatgactttatgtctggaagttcaagcaatgaagaggctgatgatgagtgggactgacaaatgct

SEQ ID NO: 13025 - DNA, 637 bp, Zea mays
  Clone ID: LIB3279-211-Q6-K6-B12
tctctgccccctcgatctccatatcgccttcgcaattcctccgtgtagcgcccctgtcctgggcgagcacgagcgcgcgtgcgcgcccagatctgcgcggtctcgccggcgatggcgtgcattaagagcgcgcatcgggcggcgctaacggcgctggcgccggacgcgccgtacctcgccgcgggcaccatgaccggcgccgtcgacttgagcttctccgcatccgccaacatcgagatcttccgcctcgacttccagtccgactccacggacttgccgatcctcgcctccgcgccctccccggaccgcttcaaccgcctctcctggtcgcgcccaggcgccgtcgagggcgactccttcgcgctcggactcctcgctgggggcctcagcgacggctccgttgccgtgtggaacccactgagcatgatcagctccgaggggaaagcggaggacgccatggtcgcgcgccttgagaagcacaccggaccggtgtgtggactggagttcagcgagctcacgccgaatcggctcgcttctggggctgagcagggggagctttgcatctgggatctcaagaatcccgttgagccaatcgtgtacccgccactcaagagtgttgggtcccatgcccaagctg

SEQ ID NO: 13026 - DNA, 671 bp, Zea mays
  Clone ID: LIB3279-211-Q6-K6-B2
ccggttcgacccagcgtccggtttcgagcgccgcccttttttttttttttttttttttttgcaagcacatcaacctgccccttgtctctaattatcttggtaatctgcgacacaacaaagtattcaatgttgtcaaatagcatacacgatgtccccacttgctttccaggtcaagatcggcatctgagtctaggtcctccatgtcatcgtcgaggtcaatgtcatcattcagaaactgattgagtccacgtgaaccaactgctggaatgttcgcctcagccagatccatctgcatgaactcattcatgctctgcatcggttgttcaggctcctcgtactgcttcctcatcgtgctgtcatccattaggtcagctaggaggttcttcaagaaccatggatggtttcttatctcagggatggtgatcgtcagcatcacgtatggcgtcactccgcatgaccacacatcagcaacctttccattgtattccttctccagaagaacctcatgagcaatgtatgcaggagttcccactgtagattttgggttaatagatccatcagtgaagttgatttcccccccaatataggttcgatgcatagttgtcaaaataccttcttcacaactcctttgtattttggtttttggcttttcgcctatttttttagtgtgt

SEQ ID NO: 13027 - DNA, 667 bp, Zea mays
  unsure (1)..(667): unsure at all n locations; Clone ID: LIB3279-211-Q6-K6-B3
attttgcatctacccanaatataagcacatggcttctaggatgggatctgaatatttaggaaagatgctttcaaagcatttggaacaagtgatcaaatcaaggattccggggatccaatctcttataacaaagacaattgcagagctggaaactgaacttaatcggcttggaaaacccattgctaatgatgctggggggaagctgtacacgatcatggaaatatgccgtatgtttgatggtatttacaaagagcatctggatggagtgcgccctggcggagagaaagtttaccatgtcttcgacaatcaatttcctgtagctattaaacgattgcagtttgataaacaactctctatggaaaatgtgaggaagcttataacagaggctgatggataccagcctcacttgatagctccagaacaaggatatagacgccttatagaatcttgtcttattagtatcagaggtcctgctgaggcggctgttgacgcggtccatgcaattctcaaggaccttgtccgcaaggctatcaatgaaacacatgaactgaagcagtttcccacccttcgtgtggaagtaggcaatgcagcttttgagtcattggatagaatgagggatgaaagcaagaaaaaacattaaagctagttgacatggaatgcagctact

SEQ ID NO: 13028 - DNA, 615 bp, Zea mays
  Clone ID: LIB3279-211-Q6-K6-B4
gttgtaatctagttcacacagcttgtgtaatggtgatagttcaatagggaaagagttccgtcgaaagactcgccccggtcaagacctgaggtcagcgatgccactcaaaaccatgcaactcatgtgcttccatcatttgagttttctacagtttcacctccatcaattatcacggaaggttctagtggagggccatcggagaaagagaattaccgatttggatgtaactgagggtgatcttccatggtggtgtgtggactgcattactctcaatcgatatccaaaggagaatacaaaatgcgggttttatttacaccctgctgaaggctcgcctgcaccaaacataactcaagggaagcttagtgctccacggatattgcgaattcacaaggtacctaactatgtggttgagaaactcgttcttgacaaaccattggatggaggctctgatgcgtttgttatgggattgagttctgctcaatcacagctctcagttctagatagttcttcgcggcttggactaaagccatggcaaaaaacaaagccatgtattgagatattgtgcaataaccaggttctatcaccagagatgagtttggctactgtgcgaacata

SEQ ID NO: 13029 - DNA, 664 bp, Zea mays
  Clone ID: LIB3279-211-Q6-K6-B5
ctgtcgcgtggggtttatgaactagtttccaagatcggagaagcaatttcatactgtgcaaaagcaatttcgctatgcaagtcacgcatacagagtcctgaaaagttccaaggatgctttgttggctggtatagatggtgatgcatctgctgctgaagctgaaggaggctcagaaaaatctgccgttgaaaaagagctagagcagcttactagcatattgcctgatcttgagaagaagcttgaggacctgtctgaagcaaacccaagcgctgacatggatgagatggtgaaggcaattgtgtccagggtaactgatgtgatgccaaaagctgcatcttttacttcttcccagatggcaacctcaagcaatggattcgactcctcggttatgtctacagcagcgacaaccggaagctctggaagcaccgtgactgaccttggggttgtaggcagaggcgtcaaacgagctagcatcaagccgatctctgctgaacctgctgctaagaaacctgcacttgattcaccatctcaacaaggtgacagcagcatcaactctgaggttgttcctgcaacgcagactggagacgagtcagtatctaagtaaattacaatttcattagccctactgtaatgttaacttgctggaacatattagctgctatgt

SEQ ID NO: 13030 - DNA, 134 bp, Zea mays
  Clone ID: LIB3279-211-Q6-K6-B6
cggtcgcgtgggctggctccttgtgccattgctgagggacatccttagcctttgtttagtagtatggtttggtactttgttctgtcatcactcgtttatctatccctaatacatgccgccatgattgtactccc

SEQ ID NO: 13031 - DNA, 632 bp, Zea mays
  Clone ID: LIB3279-211-Q6-K6-B7
cgctcgtcgtctacggcacagagggctccaaggtcgtcaaggccttccgcaacctccccggcgtggacgtcgccaacgtcgagcgcctcaacctgctcgaccttgcccccggtggccacctcgggcgctttgtgatctggaccgagagcgcgttcaagaagctcgaggaggtgtatgggagctttgacgcgccgtcgcagaagaagaagggctttgttctgccgaggcccaagatggccaacgctgacctgggcaggattatcaactctgacgaggtgcagtctgtggttaagccactcaacaaggaggtgaagcgcagggagaagaggaagaacccgctcacgaacatggctgctgtgctcaagctcaacccctacctcggcactgcccggaagatggccacccttgctgaggctgcccgagtcaaggcccggaaggagaagcttgattccaagaggaccaagcttacctcggagactgccaaggtcaaggctgccggcaaggcgtggtacaagaccatggtctcggacagtgactacaccgagtttgagaacttcaccaagtggctcggagtgacgcagtgaagcggcctttgaggcctagttaagttttgagtagttgtgtcgctgaac

SEQ ID NO: 13032 - DNA, 655 bp, Zea mays
  unsure (1)..(655): unsure at all n locations; Clone ID: LIB3279-211-Q6-K6-B8
cccggtntcgacccacgccgtccgtcaacgtatctcagccaagtacaactttaagaggttcatctgatgtgttcaggaggtccttaatttctgctggcatttctcattctagaagttcaagcatcccattgcagcaccgtggaaattcatccacatcacatgagattaggaatcatcagccaggatcaagctctcgtgcacatcagcagcaccccttaagacccggtcattcctctgtagacaggcagagctctggttacttggaccttcagtcttttatgcagaccatagcttcaagggaaggaggcagaccaatgtcagagatccgcaatgtcttcgatcagattcgtcaggggagaaatgcacgattggaggatttgcttctcattgaccggtcacttattatgagacgagctaatttgattgatagacatcgggatatgaggcttgatgtggataatatgtcctatgaggaattgctggcactaggtgaacgcattgggtacgtaaacacaggacttactgaagaaaagattttgagtaacttgaaacaatggaaatgtgtcttaaaatcattggatgatcctccaacaagtgttgaaccatgctgtatttgccaggaagactatgtggaaggcgaggaccctggcaggct

SEQ ID NO: 13033 - DNA, 633 bp, Zea mays
  unsure (1)..(633): unsure at all n locations; Clone ID: LIB3279-211-Q6-K6-B9
ccgggttcgacccaacgcgtccgttttcgcgtccgtccacgcgtccgcccacgcgtccgcccacgcgtccgcccacgcgtgcgttcggagaatacatcgctggacttcttggttgggtaatgatgccaatcacgtcttgctgctggtgtacgtctggaacaacactagaaagatctatgcagatgtgacacatgggtgtgagtgatgatctcgactactacgacggattctgataatatctggttttgtattatctgtggtcttgattatctgcgtcacaaaaattgcaaaatcatctgtggagaatgcattggctgagaatggacagctccatgtaggaacatcgcagtttccaggtgtaacctctaccttggatctgcaacaacctcttgtaatcaagattgacacatcaaatgaagaccacgagaagtaaaagcgttgagtctacaatctcagatgtaaattctttggttgtagattcggcagactgtctatacacccatactctggtgaggcccgttaatgggtaaaaaagacatcatccccccttccaaaaaagggaatgaagtttagtttactgataaaaaaaaaaaaaaaaaaannnnnnnnaaaaaaaaaanannannnannnna

SEQ ID NO: 13034 - DNA, 183 bp, Zea mays
  Clone ID: LIB3279-211-Q6-K6-C1
cgggttgaccccgcgtccggtttcatgttacacactctttatctcccttaataactctgctagaaaccttaattctgctgttcggcttaaatttttacactactcaggccaggtatctttttctaccaaaacttatgtgcataattatgattaatgaggctatagttggtgatccatgaaaat

SEQ ID NO: 13035 - DNA, 513 bp, Zea mays
  unsure (1)..(513): unsure at all n locations; Clone ID: LIB3279-211-Q6-K6-C10
ttgncattgagcagtacatatccaaacaaatgatgctttcacaagacagacatcttgctttctatggagtcgatccaggatcaagcagccttactgctccattcaaccaaggaatcgtgcagccagcaatgatgtgcaacatttctaatcctgccgatgttttgcacggaactattcatgacgtgtcaacaatgaaccagataccttccatgtgggaaggacttcagagcatacctcagatgaacttcaaccctggtgtggcagctgatagcggcaccaacaactctggctccatgaagatcgaacagtgagctgctgtatagtagcttcgaaattgttgtgtgaatcactgaatcatcgtaaagcgctctcgagatgaagctttttttgtatagctggaggcctaaccatttatgctggattcctgcggttgctcccatactgtgcggcacattgtttatggtatggcatatggatcgtgtacagctggagctgaagaactgattccactgt

SEQ ID NO: 13036 - DNA, 609 bp, Zea mays
  Clone ID: LIB3279-211-Q6-K6-C11
cccagcgtccgccccgcgtccgcgacgcggcagcgaggaggaagcaaaggaaaggggatatgtcgaggccgcccaacaggagcgacgcgcacctctccgccgaggacgaggcggcgctggaggccgaggtgcgggagtactacgacgacgcggcgccaaagcgccacaccaagccctcccgcagcgagcactccgccgtgtacgtcgacgcgctcgtcccggacgtcggcggcaactcccacccggagctggacaagttccaagagctggaagcacacaccgagaggttggtgtacgagggcgccaatgtgggagatgagttcgtggagacggagtactacaaggacctcggcggcgtcggcgagcagcaccacacgaccggaacgggtttcatcaagatggacaaagctaaaggcgcccccttcaaactgtctgaagatcccaatgcagaggagcgacatgcttcttgcaggggaaaccctgctaccaacgagtggatcccgtcagctaacacggtgtacccggcgtcagacaagccaagcagaagcgacagctgagggactgtatatctccagccatgggaattcagacgagtgctttccgccatta

SEQ ID NO: 13037 - DNA, 304 bp, Zea mays
  Clone ID: LIB3279-211-Q6-K6-C12
gcggccccggatgaataagtggtggaaatgctgcaggaggccagggacagctgagtggtctggttcctctgctcaatgatgtgtggttggctgcttggaacttggaacttggaagtcgaggcgagaaactctgaactgatcatcgttggagttcgagtatggagtccatccggtagcgtttgattctctgtatatattcggtaattagtatcccgatcatgcgccatggatcactggatgttcggtcttggagcaatgtctggaactctggatgcgtctttagcaaagcaattcggtgttctgc

SEQ ID NO: 13038 - DNA, 673 bp, Zea mays
  unsure (1)..(673): unsure at all n locations; Clone ID: LIB3279-211-Q6-K6-C2
cccagcgtccgcggacgcgtgggngaagagaactgcagaaagccgtcctattgtccctagaaagtttgacaaagataggaaattcacaactgataggatgggacgccagctttcatccatgggtatggatcctagtgctgccatgaatagaattcgcagtcagtctaggggtcgcaagcgtgagaggtcagtgagcagagctgcagcggatggtgacggtatggagatagatggccagcaaagcaacaagaaattgcgtcggacatcaaggtctaggtctaggtctaggtcacgtgctcctgaggaagtccttcctggagaaggattcaaggactctgagcagaagaaaaaggctatcaagaaagcaaaggccgctactaggaacaggaacaaggaagctcgtcgtggagaggctgaccgtgttattcccactttaaaaccaaagcatttgttttctgggaaacgcactcttggaaagacaagcaggcgataagctcagtacctcactggatctggtagtaaaggactggtgcaattttggtgtgagcaatttgatgaaacgggagcttttatgtctagcacttatgtatgctacttatttatgaaatgtcttgctgttgctgtatcatggtcctctttaagacatnttactagtttatacatgtattacttc

SEQ ID NO: 13039 - DNA, 645 bp, Zea mays
  Clone ID: LIB3279-211-Q6-K6-C3
ccggttcgaccccgcgtccgccccgcgtccgcccacgcgtccgcagccttttgcaaactcagagagggacccgatggcacccaaggcggagaagaagccggcggcgaagaagcccgcagaggaggagcccgcggccccggcggagaaggcccccgctgggaagaagccgaaggcggagaagcggctcccggcgggaaaatccgccggcaaggaaggcggtgttgacaagaaggggcggaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaggcggccaagctcgcccgctacaacaagaagcccaccatcacctcccgggagatccagacctccgtccgcctcgttctacccggcgagctcgccaagcacgccgtctcggagggcaccaaggccgtcaccaagttcacctcgtcctaagctcctttcgagtaggtccttaagcgccgtggcgccttttgactgtatggaatgtttgtcatctgaaagttgatctgagcagtgcaatatataattctggcatactattctcg

SEQ ID NO: 13040 - DNA, 672 bp, Zea mays
  unsure (1)..(672): unsure at all n locations; Clone ID: LIB3279-211-Q6-K6-C4
cagtagtagggaagagcaccaagtaccttcggcgcccgttcaggatccacatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaaggagttcagctacagcaagatcctcaaagatctcaagaaagagttctgctgcaatggtacagtggtccaggacccagaacttggacaggtcattcagctccagggtgatcagaggaagaacgtctcgaatttcctcgtccaggccggcattgtgaagaaggagcacatcaagattcatggtttctgagcaaccgccgggtccatagcaaaccaaccctgcatgcagggccagcttattatatataatatctgaggtggagcatatctatctggctgtgtactgcaagcaggcctagtacgccgcctgcgcgttcctnctattacacatataggcccctccctgcgtgtatgcttgttaccgtcgtgtc

SEQ ID NO: 13041 - DNA, 630 bp, Zea mays
  Clone ID: LIB3279-211-Q6-K6-C5
ggcgccggcgtgctcgtgatctcaacccaggcgtgcctccgctccggtcacccgtcactccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgcgccaccggaggcaacaagaccaagacccctggacctggtgcccagtctgccctcagggcgcttgctcgttccggaatgaaaatcggacgcattgaggacgttaccccggtccccactgacagcactcgcagaaagggcggtaggaggggaaggaggctgtaggctctgcgtgccatttgccggctcttggcgggtggccattatgaagttagccctctctgggtggtgttgctgttttctgtgtttgtcaagacgagctttaattttgct

SEQ ID NO: 13042 - DNA, 664 bp, Zea mays
  Clone ID: LIB3279-211-Q6-K6-C6
acatatgttaggtgaagtgcgaggaagtaattcgaggtgcatggcctcaacactagtgcgaactgggtttgtacggggatctatgacccaaggaaatggctgttatcagcaccgctgcacgaacaactcactagaggttgctgttgatgggatctggaagtcatgtccgcaatctggtgggcctgttcagtttccaggattcaacggggaattaatttgtccgatgtatcatgagttgtgtactactgtaccagttccaatgactggccaatgtccaaagtcatgcagttttaacggtgactgcattgatggaacctgtcactgctttcctggttttcatggccatgactgcagcagaagatcttgcccagacaagtgcagtaaccatggtacatgcaaagctaatgggatctgtgaatgtcaaagtggatggacagggattgactgctctacagcggtttgcgatgaacaatgtagtttacatggaggggtttgtgataatggtaaatgtgaattccgttgttcagattatgcaggctacacatgtcagaagggttctgcaatactgcccagtctgtcaatgtgtcatgatgtacttgttagagattcagatgggcagcattgtgcgccaagtgagctcagtatactacagcagcttgaaact

SEQ ID NO: 13043 - DNA, 610 bp, Zea mays
  Clone ID: LIB3279-211-Q6-K6-C7
tatttttgaactcccggtccggcaaccctccccagccagcgttccactcactccggcatcgcttcgaatctccgcgcggcggcgggaccgcgtgaccgacgcgcggcgctgccccttcagaaagccgcatggacgccgccgaccccctctgcgccatctcctcgactgcgcgactccttccgcggacccttggccccgccatcgggccttccccctcgaacccccgcgacgcgctcctcgaggccatcgcactcgcccggtctctgaaagggtctgaggagctggttaagcaggctacaatggtgccgaaggagcacggggacatccaggctctctaccatgatgatggagtgaaaggctggcctcctgcaaatggcagcaaagagcaacagggaagaaggccagcactggatcgtaaacgggctcggtttgctatgaaggacactggaagcaaaccggtgcctgttgtggaccaatctaagttatcaaatatttcagatccaatcacattcttcatgaccttggatcggcttgaagaagccgaggaggagatcaaacggctaaatggagaggcagaaaaagcacattgaattttgatcctgtagatgaa

SEQ ID NO: 13044 - DNA, 604 bp, Zea mays
  Clone ID: LIB3279-211-Q6-K6-C8
cccggtcgacccagcgtccgggttcttgaactttgaactcaaagacttcacactagagcacagctggagattcactgaaacatatcagaacaaggaagagccagcttatggtcgagtcaatttcagcgctccaacggaaggagaagtcactgcaggaggagaacaaggttctgcagaaggagctcgcggagaagcagaaagaccagcggcagcaagtgcaacgggaccgaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttcctgctg

SEQ ID NO: 13045 - DNA, 670 bp, Zea mays
  Clone ID: LIB3279-211-Q6-K6-C9
cccccggttcgacccagcgtccgtccgtcgccccaggtaatttcggcggcgccggcgtgctcgtgatctcaaccaaggcgtgtctccgctccggtcacccgtcactccacgcaaacatgtcgaggaggaagaccagggagccaaaggaggagaacgtcacccttggacccactgtccgtgaaggagagtatgtctttggtgttgctcacatctttgcatccttcaatgacactttcattcatatcaccgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgtgccaccggaggcaacaagaccaagacccccggacctggtgcccagtctgccctcagggcgcttgctcgttctgggatgaaaatcggacgcattgaggatgttaccccggtccccacggacagcactcgcagaaagggcggtaggaggggaaggaggctgtaggcatctctggcggctcttgccggctcttggcggcatgaagctagtcctctctgggtggtgttgctgttttctgtgtttgtcaagacaagcttattttgctc

SEQ ID NO: 13046 - DNA, 635 bp, Zea mays
  Clone ID: LIB3279-211-Q6-K6-D1
cggcggcgccggcgtgctcgtgatctcaacccaaggcgtgcctccgctccggtcacccgtcactccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgcgccaccggaggcaacaagaccaagacccctggacctggtgcccagtctgccctcagggcgcttgctcgttccggaatgaaaatcggacgcattgaggacgttaccccggtccccactgacagcactcgcagaaagggcggtaggaggggaaggaggctgtaggctctgcgtgccatttgccggctcttggcgggtggccattatgaagttagccctctctgggtggtgttgctgttttctgtgtttgtcaagacgagctttaattttgct

SEQ ID NO: 13047 - DNA, 577 bp, Zea mays
  Clone ID: LIB3279-211-Q6-K6-D10
ctcacgctttcgcccacgcatccgatcgggttcttaaagaagcagaagatgtggagtgaaagttgttagtggcgtggaaatgtttattagacaagccatgggtcaatttgagcatttcaccggtggtctagaaactcctgaaagcctgatgcgtgaggattgcagcaaaatacacctatcaggctaatggcgaaaacctatttttgatgaatatttgcccaaagattttctcgggctgagtgaataaatgtttggcagatatcatgtttgctgttatgttacatttagccaacttgtcacctgcacactgtaagattatgccgccatgctataatgttcttgaacctgcaataaaatagtagccagaataaagattaacattagaaccaacgttcttatgaccaaggtggaaaatatgcatgaaacaatgattcatatggcagttgtttcagtgctgatcatggcatttatactgtcctgcataatatcattgtacggttgacgatggaatatttatttttttggaaaaatgaaattttattgatacctcagcataatatcaagattatactgttac

SEQ ID NO: 13048 - DNA, 626 bp, Zea mays
  unsure (1)..(626): unsure at all n locations; Clone ID: LIB3279-211-Q6-K6-D11
gcaaaacttggtgcttcaaacagggatgatgccttctacaggtacaagatgcccagaatgattaccaagatagaaggccgtggtaatggtatcaagacaaatgttgtgaacatggttgacatagcaaaagcacttgccaggccagcttcctacacaaccaagtactttggatgtgagcttggtgcacagtccaaatttgatgagaagacagggatttccttggttaatggggctcatgatactgcaaagctggctggtctccttgaggtattcatcaagaagtatgtccaatgttatgggtgtgggaatcctgagactgagattctcatctcaaagacccagatgatatcattgaaatgtgcagcctgtgggttcgtctcagatgttgatatgagggacaagctcacaaccttcatcctgaaaaacccaccataacagaagaagggcggaaaagacaagaaggccatgaggagagctgagaaggaacgcctgaaggaaggtgaggctgctgatgaggagcagaagaaactgaagaaggatgcaaagaagaagggttccaaggattccactgctnaaggtttgaagaagaggctactactgctactggctctgatgaggaccactca

SEQ ID NO: 13049 - DNA, 654 bp, Zea mays
  unsure (1)..(654): unsure at all n locations; Clone ID: LIB3279-211-Q6-K6-D12
catacccccagcgcggcggtgccggtgcgagcagagcagccggagggcctgtcggatccgccgccgtcaagatgaatgacgccgatgtatccaagcagatccagcagatggtgcggttcatccgccaggaggccgacgagaaggccaacgagatctccgtctccgccgaggaggaattcaacattgagaagttgcagcttgttgaagctgagaaaaagaagatcaggcaagagtatgaacgcaaagagaagcaggttgaagtacgcaagaaaattgagtactctatgcagttgaatgcttctcgcatcaaagttcttcaagctcaggatgatctagttaacaaaatgaaagacgatgccatgaaggaacttctccttgtcagccacaaccaccatgaatacaagaaccttttgaaagacctaatcattcagggtttgctccgtttgaaagagccagcagtattgctccgttgccgcaaggatgatcaccatcatgtggaatcagtgctgcattcagcaaagcatgagtatgcatcaaaagcagatgtccatgaaccagagatatttgttgatcatgatgtatacctgccacctgccccaagccatcatgatgctcatggccagttntgctctggaggtattgtattggcttctc

SEQ ID NO: 13050 - DNA, 627 bp, Zea mays
  Clone ID: LIB3279-211-Q6-K6-D2
gcgcgttcctggacgcgaggagcccgcggtggggcgggctcggcaagttcctgcgcgccaagtacctgtcgctggtgcacgcgcggatggagacggccttcttcgggcggctggagcagcgcggcatcgtgagcgccgggcccgggttcccggagagctcgtggttcgcggacttcgcggagatggcgcgccgcgtgtggctgctgcactgcctcttcttcgcgttcgacggcggcgccgaggaggacggcgcgtccatcttccaggtgcgcacgggggcgcgattctcggaggtgtacatggagagcgccagcgacgggcgcgccggcgacgacgccgaggaccgcgtggtcggcttcaccgttctgccggggttcagagtcgggcggacactgatccagtgccgcgtctacctgtccaagccggggcggcggccgtgatcgatgatggctcgtggctgtgagagaccgaagagagaagaagatgatgggagggggaatagtgcccattttgggtcggccgtcgaggtctcccgccggcagccggccggggcagtggccattatgatgatgatgacgggggtggctatgtatgtaaatctatccagacatgtagggatgttctaat

SEQ ID NO: 13051 - DNA, 550 bp, Zea mays
  Clone ID: LIB3279-211-Q6-K6-D3
cgtaaatgtagtagttaaggcacaatactatagaccttatgacctgtgtttgactaaccaatgttctttatttttttactagttatatgtcacttaggtgctttattttgtttactagttatccgatgattcatagatggtttgcttaaatggtttcacttaggtgcttttgatataatcatgtacttatgtttaattgggaattttgggatacacttacaactagtaagtcaggcgttgttaataaaatattgacctactaaaatacttaccgcttatccatatcctaccttgttgactttgcattattcctcccacttgctgagccccaaccataagtgagctcaccccttgctaatattttgatcagagggtgatgatgaagacattgcagatgatatcgacgagtactaagtctaacgatgcgcgagtcacatttctgtggaagagtgtccatgtttaattacgccgtactttgataattatacttgttaagatactttgatctagatgatgtaataaagttactctactccctttatcttttgat

SEQ ID NO: 13052 - DNA, 524 bp, Zea mays
  Clone ID: LIB3279-211-Q6-K6-D4
ccggttcgacccagcgtccgttagagtcagaatttggaactaggcagagcagcgataaatctattataactcgaccagactactattatgatatggaattaggtggagtgtacgtgttaggttcattctgtgtgaattcaggcagaagcttgaaaacgaaatgaccaatcatggtcacttgtggaaatgtaaactacttcgtagattctttattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccttttgaagaaccaaattttacgcccccggtttggaaggataaaattttttttttgggtccccaaaattaattacaccgggccgctttttaaaacctgggtgttggaaaaacccgggggttaccaaaattaattctttttagaaaaaatcccttt

SEQ ID NO: 13053 - DNA, 372 bp, Zea mays
  Clone ID: LIB3279-211-Q6-K6-D5
ctcacgcgtccgcgatacttgagtgggacggaaggtgattgtgacgaaggaaaagacattacgaagctatgcacagaagagcttcgacataacggcggaaagggaaaccgacttaaagatgaaaaaccagattagacctcgaagaattactatagagttatttataaacgtaaagggcattaatgtaatcttgcatgggctgcgacccgcgcctataaatagatgaacagtactcccgtactgttcacgctgactcggcatttgcttttggcgccatacttgtattttcactccttcaagccgaaggtacatttgtaatttaatattgtttgtacaaataagataaatggaaatagattaataataatgttc

SEQ ID NO: 13054 - DNA, 634 bp, Zea mays
  Clone ID: LIB3279-211-Q6-K6-D6
gcggtagtaagacgccgtcgcggtcgcgtacacgaagccggggcgcggcctgatcaaggtgaacggcgtcccgattgagctgatccgaccggagatgctccgcctcaaggccttcgagcccatcctgctggcggggcggtcccggttcaaggacatcgacatgcggatccgcgtccgcggcggcgggaagacgtcgcagatctacgccatccgccaggccgtcgccaaggggctcgtcgcctactaccagaagtacgtcgacgaggccgccaagaaggagatcaaggacatctttacccgctacgatcgcaccctcctcgtcgctgacccccggcgctgcgagccgaagaagttcggcggacgtggtgcccgcgccaggttccagaagtcgtaccgttgagcggctgcctgctccatctcgatttttcagatcgttgtgggtgttcttcgctttatttcctatcaatggatctgcttatctggttctatatctagctgctgctttaccataatgtttagactttaatgcctagcctgaaaccttgtttgcaatgtgaaattaatgtgagagattatgaagactattttggctagtccctctattatgattttcatcattccagtattgagaatt

SEQ ID NO: 13055 - DNA, 444 bp, Zea mays
  Clone ID: LIB3279-211-Q6-K6-D7
ctctcgcgtccggtgtgggcgcggctcctacccggcggcggtgaagccgcgacgatccaacggagtagaggcgccatggctgctcccgaagcgcccgcatgctacgtcgggatcgcgcggcagtccgccgccttccgccttatgaagcaaatgggatgggaagaaggtgaaggccttggcaaagacaagcaaggcataaaaggtcatgttagggtgaaaaacaagcaggacacactaggtgttggtgtagatagccctcataacaaatgggtatacgataccacccaatttgacaacatattgaagaaactgaaagtgcaatcagctaatcctgttcaagaagaggttgcagctgtagaaagtgattcacctgacatcacacccaagaaagacatatcagcaaaacatgaagttactaaagttactcgacctcaaggaagatac

SEQ ID NO: 13056 - DNA, 634 bp, Zea mays
  unsure (1)..(634): unsure at all n locations; Clone ID: LIB3279-211-Q6-K6-D8
ttgtactttatctccggnaattgtggggtgaacctagtgaggatcttactaccaaaccaagataccttgttacatttacagtgggatactctcaaaaggcaaacattgatgcagcggtgaaaaagttttcagataacttcacaattatgttgttccattatgatggtcggacaactgagtgggatgaatttgaatggtcaaaaagggccgtccatgtgagtgtcacaaagcaaaccaaatggtggtatgccaaacgatttctacatcctgacattgttgcccgctacgactacatatttatctgggacgaagatcttggtgtcgaacattttaatgcagaggcgtacattaagcttgttaggaagcatgggcttgagatctctcagcctggtttggagcccgataaaggtttgacatggcaaatgactaaacgaagaggtgatcaggaagtccacaaagtaactgaggagagacctggctggtgtagcgaccctcacctgccaccatgtgcagcgtttgttgaaattatggcaactgtattctcaagggatgcatggcgctgtgtatggcatatgattcagaacgacttggtccatggatggggccttgattttgctcttaggaatgtgtggag

SEQ ID NO: 13057 - DNA, 640 bp, Zea mays
  Clone ID: LIB3279-211-Q6-K6-D9
ttctccttcccttccctcctcgctcaaaaagccaacgcaaccgcttctcctcctcctccgcctcctccggtccctcccctactccccccagcacgcctcagcctgcattccgccacccacgcgactgatcgacgacttccccattcccgccccgcaactcgcagggctctgggctcggaggaaccgagggcgggggacctccgaccggggccgggcgacatgttgggcgacctcctctccaggatcctcctgctcctgttcggctacgccatgccggcgttcgagtgcttcaagacggtcgaggcgcgccccaacgacgcccgcatgctgcgcttctggtgccagtactggattatcgtggccatggtgatagctgttgagagcgtgatctcttggatgccaatgtattcagaaatgaagctagctttctttgtgtacctgtggtaccccaaaactaagggaagtgacgttgtatatgacacctttcttcgccccatagttatgcaatatgaaccgaacatcgagcagagattgctccatctaagggcaaaatctgggcagttaatttccttctacatgaagaaatttgcggataaaggaacagccttcttcatggatgtcctccgttatgtcgtatctg

SEQ ID NO: 13058 - DNA, 491 bp, Zea mays
  unsure (1)..(491): unsure at all n locations; Clone ID: LIB3279-211-Q6-K6-E1
gtttcatgttacacactttttatctcccttaataactctgctagaaaccttagttctgctgtttggcttagatttttacactactcaggccaggtatctttttctaccaaaacttatgtgcataattatgattaatgtggctttagtagttgatccatgaaaattgtcaatcatcaaccatttcttttcctggaaccgttgtagtgtacaagagatcaagctttggtttgtagacaatggtgccctggctagaaccgcgaggattgggcctatttcctgactgtctagttattgtctcagaagtctggtttagataaggttctgtttccgcggcaaactattagatacctttgcagttgcggagttctgtaattgatgtattatttatgcagatagtgtagtctaactatgcaaactaatatatgatctgtttcagagttttgngaaaaaaaaaaaaaaaaaaaaaaaaaaaannaaaaaaaannnnnang

SEQ ID NO: 13059 - DNA, 626 bp, Zea mays
  unsure (1)..(626): unsure at all n locations; Clone ID: LIB3279-211-Q6-K6-E10
cccacagcaccaccaaaccaaaccaaaccaataggcaattagctcgagcaaagaggcagcaaaaacaagccaaaaggcaacacccgcggcgacgcaagagggagaagcgagcgtgcagcggtcctcctctcgatccacatggccatggcggcagcggacggcaagagccggaggttcgcgctggcctgcggggtgctgagccagtacgtcaaggccgagcagcagcagcagcagcagatggcggccccgcgcgccccggccaccacgaccctgagcctgatgcccggcgcggacgtcggcgccgacgagcagcaggagccggccgccgcgagggacgaggagatgcccgggcccgcccccgccgcggcgccgccgctgaccatcttctacggcggcagggtggtggtgttcgaggacttcccggcggagaaggcggccgaggtcatgcgcctcgcggccggcgacgacctgcccatcgcccggaaggcgtcgctgcagcggttcctggccaagcgcaaagatcgcctcgtcgagcgcgcgccctacgcccgcccgtcgtcccccgcggaggcggtcaagccggcctcgggctcggcctcggcctnctggctcgggctccgcagcac

SEQ ID NO: 13060 - DNA, 659 bp, Zea mays
  unsure (1)..(659): unsure at all n locations; Clone ID: LIB3279-211-Q6-K6-E11
cccagcgtccgatcaaggagcgagattcaaaaatcttgaactagatgcactcagccaagtacaaccacatgataccatagcatgtaacgatgatctgctgtctttacagtctgatgcagaccaactgctcttggagaagatggaggcagagattcagtgttttatcctgacaagagcttcgcacgattggaaactcctggccaagaatcaatttgctcttaacgaggcacagaaatcccttctgacggatcacaaatccttagaaaccaaattgcggcatgccgagaacagggcgatgatgctggaggatatggtggataaactagactcgcaatgcaaggagctgtctgagatttcagaagttctgaagctgcaggccagagctagcagagcctccttgttctgctcggtccagtttatactgctatgcatagccatcgggaccatcctcgttcgcttcctgccgccttctccggagattgtacctacttgaggttagagaattaggccaatcagcccagcctttgattaggcattgttgcaatattgttcactgttacttgttaggcatcaatcgccttacaaattttcgtctttgtaccatcaactcgattttgctagtaacttcttatgaatatgaatntactgtacttctggct

SEQ ID NO: 13061 - DNA, 603 bp, Zea mays
  unsure (1)..(603): unsure at all n locations; Clone ID: LIB3279-211-Q6-K6-E12
cggtcgcgtgggttccatacgaccataccctacctccaaattcccaattgtcaacctctcctcagagttcgagtgaccatgtcggggcgcggaagggcgggaaggggctgggcaagggcggcgcgaagcgtcaccgcaaggtcctccgcgacaacatccagggcattacgaagccggcgatccggaggctggcgagaaggggcggcgtgaagcgcatctcggggctcatctacgaggagacccgcggcgtgctcaagatcttcctcgagaatgtcattcgcgacgctgtcacctacacggagcacgcccgccgtaagaccgtcaccgccatggacgtcgtctacgcgctcaagcggcagggccgcaccctctacggatttggcggctgaggggtcaggnggtgtccgccagctgctgctggtcgtggcagaagtcttgggtcgcggtcacgaaatggagtgattcgagagtattcttgcccatgggcttagtttcgtaggcttatcactctagactctagtgccttggtccagtagtagcatacgacttgtactgcatttctttgttctgaacctctaaattgatgaaatgtggattcacttg

SEQ ID NO: 13062 - DNA, 624 bp, Zea mays
  Clone ID: LIB3279-211-Q6-K6-E2
ccccgcgtccgcccacgcgtccgcccacgcgtccgcccacgcgtccggcgtaccgcgacctcatcgatcaccttcagctttcaatcatggccgacgtcgatgtcgaaccggaggttgccgccggcgctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcgctcatcaagaaactgcgcaaggcgaaaaaggatgctcctgctggtgagaagcccgagccagtcaagacacatctccgtaacatgatcattgtccctgagatgattggaagcattgttggggtctacaacggcaagaccttcaaccaggttgagatcaagcctgagatgatcggccactaccttgctgagttctccatctcctacaagccggtcaagcacggcaggcccggtatcggtgccacccactcctcgcggtttattcctctgaaatgagctgttactcggctctttagtatcccaagagtccgttggcaatgttcattcagatttttctacttctttagtatcc

SEQ ID NO: 13063 - DNA, 461 bp, Zea mays
  Clone ID: LIB3279-211-Q6-K6-E3
gcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcggttaggtcgcccctctcccggtggcgaattacgtggtggcggtggcggtcgtgttgtgttcttggtctagttagtctgtgttgtctttatcggtgctgttttctgtggtggttgtactgcatcgttctagtttctagtccatgtgctgtaatatctcgctgctgtaatcaatggaatgtcctcgtttcaagcct

SEQ ID NO: 13064 - DNA, 452 bp, Zea mays
  Clone ID: LIB3279-211-Q6-K6-E4
gtaaaaggttaactttatctctagggctaagcttcaattcgacatctgcccattcttcagtcttaatgtcgttgccgccgagtacaatagtgattccccggtgcatccacaccaaggatttcatcaccaccagccccatcaacgactacaatggtgaagagtttgtcttctactctacaaggaagtaccgtgccaaaaaactcaataatagagtaccacaccaaccaaaatggctaattgttgccactagagagaatgtatagcctattatgtctggcacttagtgaatcgatagctttaagggcaagttatgcactcgagtgactacaatagggaagggaggccttccaaggcaagaaagtgctcgttgtcggttgtgataacacctttccaaaaataatgttcatgcctacattgtttgttcgtcattgggtaaaacctttgctatattt

SEQ ID NO: 13065 - DNA, 617 bp, Zea mays
  Clone ID: LIB3279-211-Q6-K6-E5
ttttcgcgtgggttccaattcatggcagatggttccaatgtcaggagctacctatattgtgaggatgtggctgaagcttttgaggttgttcttcacaaaggggaggttggacatgtgtataatattggtactgtgaaggagaggagggtgattgatgtggccaaagacatttgcaggctctttggcttggatactgaaaaataatcaggtttgttgagaacaggcccttcaatgaccagaggtacttcttggatgatcagaagcttaagagactgggatgggcagagcgcacaccatgggaagagggcttgaagaagacaatcgagtggtacaccaccaatcctgattactggggagatgtcactggtgctttgctccctcacccaaggatgttgatgattcctggagttgaaaggcataactggactgaggatatcaaatctctgacttcttcaccagctgaagctagcacaacagctcctgcaaccagtgccaaaaggaccactgctgcccctcaaaagcctttgtacaagttcttaatctatggcaggactggatggattggtggcctccttgggaagatttgtgacaagcaagggataccatatgaatatggg

SEQ ID NO: 13066 - DNA, 655 bp, Zea mays
  Clone ID: LIB3279-211-Q6-K6-E6
gccgccgccgctcccgctcccatctcgtgttccgcttcttgcagccgtcgccgcgaagcgctccagagaacttccgtcaacatgggggaagacacgtggtatgggagccgggcgcaagctcaagacccaccgcaggaaccagcggtgggctgacaaggcatacaagaagagccatttgggcaatgagtggaagaaacccttcgctgggtcatcccatgccaagggcattgtcctggagaagattggtattgaggccaagcagcccaactccgctatccgtaagtgtgctcgtgttcagcttgttaagaatggcaagaagattgctgccttcgtgccaaatgacggttgtttgaactacattgaggaaaatgatgaggtcttgattgctggatttggtcgtaaggggcacgctgtgggagatattcctggtgtccggttcaaggtcgtcaaggtttccggtgtgtctctgcttgcccttttcaaggagaagaaagagaagccaaggtcttagattgctcttgctaccaaaatcagcaagcgtggagttgaaacgggagggcgttagatgattaagaagaatggttgcttgctatgtttgcagtgcattcgtgcaattgttaacctaagaatttgttggtgaaaacgatttcttttc

SEQ ID NO: 13067 - DNA, 650 bp, Zea mays
  Clone ID: LIB3279-211-Q6-K6-E7
gcgaccctccctccttcgctccttccgcgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggcttggatgtggacaacctctatgtttcacacatccaggtgaatcaagcccagaagcagaggcgccgcacctaccgtgctcacgggcgcatcaatccctacatgtcctcaccttgccacattgagctgatcttgtcagagaaggaagagcctgtgaagaaagaggctgacaacattgtcgcagcaaggaagcagtgaagtatatcagcatgctgatcgaggccattttgtcgaatattatagccgtagctcttttatgtaccttttcaggcagccttgcc

SEQ ID NO: 13068 - DNA, 666 bp, Zea mays
  Clone ID: LIB3279-211-Q6-K6-E8
ccccgcgtccgctcgtccaagtactccaagctcctgtgcggcctgtgttctgctgccgcctctggtccacatctccccgccgccgccccgtcgtctgccgacacctttagcgctgggaaggatcacaggggatcggcgcgaggcgggggacctgcggtttttgtcgcccggatggcggcggagcgatgacactggcgtcgggagcggcgcggcgttgggatgcggacgatctgcgatgtgtgcgagagcgcaccggcggtgctcttctgtgcggccgacgaggcagcgctttgccggccctgcgacgagaaggtacacatgtgtaacaagcttgctagtcggcatgtgagagttggacttgcagaccctaataaacttgtccggtgtgatatatgtgaaaattcacccgctttcttctactgtgagatagacggcacctcactttgcctgagctgtgatatgactgttcatgttggtggcaagcgaacccatggaagatacctgctcctaaggcaaagggttgaatttccaggagataaaccgggccatatggatgacgtgcctatggaaatccaagatcctgaaaaccagagagaccagaaaaagcccccaaggagcaaacggcataccaccataacggcgatgatccggccactgatggcaact

SEQ ID NO: 13069 - DNA, 543 bp, Zea mays
  Clone ID: LIB3279-211-Q6-K6-E9
cgtaccgaccccaaacaattccaaattcaacccgggctgagtggttggaccgacgttggcagtgccagatcgaatcggactctgggctcgcgtgcagcccaccggcgagcagccagaagctatatttttgatgcccatctgatccgatgcgtggtgtggcgccgtctccgcttttactagatcatcagtagccagctcatgtagccaagcctggtcatggtagccaagcccatcccggtcctctcccggcgtgttactccctacgcaccgtaggtccggcgatggcgggcgtcggctccgcgctgggtaggctctacctctacggctacaactgggtcgatttcttcggatgggcgcatgtgctgtactacgcggccctgacgctgtgtacgagcggacacaatgccgtttatgccgacgacaataggccggtgcatgttgcgcagacaggcaccataatggagatagctcatgggctcgtagggttggcgaggactcccggttatgcaacatcttcacaaattgaatccaaacagatactta

SEQ ID NO: 13070 - DNA, 651 bp, Zea mays
  Clone ID: LIB3279-211-Q6-K6-F1
cccagcgtccgcccagcgtccgtcttaggagccactttagctcttgctcagagagatattaaaagaagcttagcctattctacaatgtctcaattgggttatatgatgttagctctaggtataggttcttatcaagctgctttattccatttgatcactcatgcttattcgaaagctttattgttcttaggatccggatccgttattcattcaatggaacctcttgttggatattcaccagataaaagtcagaatatggttcttatgggtggtttaagaaaatacgttccaattacaagaactacttttttatgtggtacactttctctttgtggtattccacctcttgcttgcttctggtccaaagatgaaatccttagtaatagttggttgtattcacccttttttggaataatagcctcttttactgcaggattaactgcattttatatgtttcggatatatttacttacttttgatgggtatttgcgtgttcattttcaaaattacagtagtactaaagaaggttcgttgtattcaatatccttatggggaaaaatatatccaaaggagtcaatagggattttgttttatcaacaatgaagagtggagtttcttttttttcacaaaaataccaaaaatcctgctaat

SEQ ID NO: 13071 - DNA, 413 bp, Zea mays
  Clone ID: LIB3279-211-Q6-K6-F10
tttattggtgactgttgaagaaggttccctcaacatgggattggtgccgagattgcatgtctgttgtagaagaagctttgagtaccttgatgccccagttgagaggatcgctggagctgatgtacctatgccctatgctgccaaccttgagagaatggctgttccacaggtcgatgacattgtgcgggcagcaaagcgggcctgctacagggcagtaccaatggccgcagctgcctgattggtgtacagacctttctgtttttcttcctcagttttcgctctctggcagcaagaaacatgtagtattcataaagtgccggcaaattggccggaccccatactccaagcgagctagtttttgtagatctgctatggtgtgctttattccgttagtcgatatatgttgcattgtt

SEQ ID NO: 13072 - DNA, 664 bp, Zea mays
  Clone ID: LIB3279-211-Q6-K6-F11
gtcgacccagcgtccgttttgttggtcgtacatacaaaggattgtttcttcgattaaggagtatggcgcttttgtggagttcaatggtggacaacaaggcttacttcatatttcggagttgtcacatcaaccggttacgaaagtctcggatgttgtaactcttgggcaatctctctctctgagatgcattggacaggacatgcggggtaacattaaactttcacttaaagcaaccttaccccaaccacgtatcaagaaggatttgaaaaataaggatcctttgccaagtgaagttactggttgggctgctgtggagaacatgagtagtgtggatgttgatgctcagctatcaagtaccgaacatgaaaatggcacaactgaggaggcagctgcattttcgactccttcagttataattcgaagtgctgctgactgtgatgctcaagatgatgcaaatggttctaagaagcgggcgaaggttgcaaagtcatctcctagaccaaataaaccagccagcgaatgccatgatgttaggaaagctaccgctaagaaagctacaggtgccactaccaagaaaactaagaaagtaaagattgaggaatctgtgagtaatggactagaaaccagtggttctgatgttccagaacagagtgctgacaacact

SEQ ID NO: 13073 - DNA, 641 bp, Zea mays
  unsure (1)..(641): unsure at all n locations; Clone ID: LIB3279-211-Q6-K6-F12
gcaagnacgacgtgatcgagagcggcgctggcggcggcgagttcgctgccaaggactacacggaccctcccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtcggcgtcgggtgccgacgcggcgtgcggcggcgtgggggtgctgggcatcgcctgggccttcggcggcatgatcttcgtcctcgtctactgcaccgccggcatctcggggggccacatcaaccccgccgtcaccttcggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctccggctactcccgcggcaccggcctcggcgccgagatcatcggcaccttcgtgctcgtctacaccgtcttctccgccaccgaccccaagcgcaacgcccgcgactcccacgtnccggttctggctcccctccccatcggcttc

SEQ ID NO: 13074 - DNA, 573 bp, Zea mays
  unsure (1)..(573): unsure at all n locations; Clone ID: LIB3279-211-Q6-K6-F2
ctctgcgtccgcggacgcgtgggcggacgcgtggggccgcggcgtctgggcagctagaaccattgcttcagcgcagcaacccgacaacgaaagcatgttcgatcagtaaagtcccgaaactgaaactgtaccccactgggcctgtgaataatccactgaacagcttggtgaacgggtactacccaaatggcactgggatccacacctagaagcgtagcgcttagcgatggtttggttggtatttgctgctatggtttttttgcttgtacccctcctttttcatgtgttcctttttttcagtttgttatttgtctctgatcaactgagagaagagaaggctaagattcagcaagcccccagctccagcgacacatggttccgacatttttaacgaggaacgccttccagtccgttgaagcgagctagccatagggtggtgaggtctagtgtgatgttgttgttgtttttttctctttcctttttttttttggcctggaactaaggcgcgaagtgtnttgagtagcgctcgtngagcctggaagaatttatctaaactatttgtccattatggga

SEQ ID NO: 13075 - DNA, 498 bp, Zea mays
  Clone ID: LIB3279-211-Q6-K6-F3
gttagtttaagagcacggtcagattctcgccatagacgagatctttgagtgtaaccctacaacaatcaagaactgtggcatctggctgtgttaccagtgcaggacaggttaccacgacctgcacaaggagtaccgtaataccaccctgaatggtgccatggagcagatgtacaatgagacggcttcctgtcatcgtgtggtcaccctacatacagatcatcaagacggcaacaatcaactttaagctttgcaaaagggacaacaccaagcagttccacaattcaaagttcaagtttcctttggtttactgcaacaagtcaggccaccaaataggaagctgaagaccaccttcaaggctttaaggcccaacttgttcgtgttatccaacttgccctgacaccctcccaaatctgtgaggctgtcagtctggtggtttgctagttcagggtaatgcaatctacatgcaacctattgtttctaagttctagttggaggtcc

SEQ ID NO: 13076 - DNA, 658 bp, Zea mays
  Clone ID: LIB3279-211-Q6-K6-F4
gtcgaccccgcgtccgcgtcatcgtttcgcgtccgcctcagcccgccgcaaggagaggtaagttcaggagacatcttcgagaactgaatggctcctaaagctgctcctgccaagaagggtgatgccaagacccaggccttgaaggttgccaaggctgtgaagtctggggcagccaagaagaagaccaagaagatccgcacgtctgtgacatttcaccgccccacgaccctgaagaaggctagggaccccaagtacccacgaatcagcactaccggaaggaacaagcttgatcagtaccaaattctcaagtacccccttaccacagaatcagcgatgaagaagattgaagataacaacactctggtcttcattgttgacctcaaggcagacaagaagaagatcaaggctgccgtcaagaagatgtatgacatccaggcaaagaaggtcaacaccttgatcaggcctgatgggaagaagaaggcttacgtgaagctgactcccgactatgatgctcttgatgtggccaacaaaatcggcatcatctaagtgctgcattaggcatcctagttcatctgttgtgtcctagttctatgtgaaaccagagttttgtagctatggctctcaatcgttccattaccatgtgttatgcacacttctg

SEQ ID NO: 13077 - DNA, 568 bp, Zea mays
  Clone ID: LIB3279-211-Q6-K6-F5
cccagcgtccgcccacgcgtccgcggacgcgtgggcaaaatcaagtccggcttccaagaagagcaaggatgacgatgattctgatgaggacgagactgatgattctaacgaggacgagacagacgattctgatgagggtgagggtttgtctcctgaagaaggcgatgatgatgattcaagtgatgaagatgataccagtgacgatgaggaggaagacacttcaactcctaagaagcatgaggcaggcaagaagagagctgctgaaagtttcgtgctgaaaactcctctatctgataagaaagcaaaagttgccacgccgtcagctcagaagacaggtgtgccattgaacggactaacaaaactgtcgtcgaagattgtataggtgtgactctgttcaaggatagtcttgaggttctagaacagaagagtagtggtgtgcatcagtgtatctgtttacaggataatagtggttggttaggtgtgtgcagaaaaagttagcgttatggtttgtatgtgatacatattaactgtgccttggaatgttcatgtgttgtcctgatttcgtgtg

SEQ ID NO: 13078 - DNA, 655 bp, Zea mays
  Clone ID: LIB3279-211-Q6-K6-F6
ggccgctatcgtgaccgggaacaacaactgcgagtaggccacggtggagacctcgggcacggcgatagggtcctccgggagatgggcactacacggcaagacagccctcgtcaccggcggcacccgcggcatcgggcgtgcggtagtggaggagctggcggcgctgggggcggccgtgcacacatgctcccggaaggcggaggagctcggcgagcgcatcaaggagtgggaggccaggggattcagcgttaccgggtccgtctgcgacctctccgagagggaccagcgggagcggttgctccgcgaggttgccgaccgcttcggcggcaagctcaacatcctcgtaaacaatgtaggaacaaacataaggaaaccaactactgagtttactgcagaggaatactcgtttctgatggctactaatcttgaatctgcatatcacttgtgccaaattgcacatcctcttttgaaattatctgggtcaggcagcattatattcatatcatctgttgctggagcgataggaatctttagtggaactatatatgctatgactaaaggtgccattaaccagctaaccaagaatttagcttgtgaatgggctaaggacaacataagagccaactctgtcgctccgtggtacatcaccacttca

SEQ ID NO: 13079 - DNA, 651 bp, Zea mays
  unsure (1)..(651): unsure at all n locations; Clone ID: LIB3279-211-Q6-K6-F7
catgaatctgggagatccagnagtactggagacgatatggatgaaagctcttgaaaactgctcgtcccctccacttcaaaatctactactcaaggatggaaagctatcatctctgtacacaacccaaggtgtggcggttgctgagctacagttctgccatcctgaggttgtcccaacgtcaaagaacttctggaagccactatgtgcatctctgcagaatctgctgaggtgcagcgtcgacatccgaatcaacctatctcctatctccggtaacggggcgggatccaaggactcgtccgtcagccttgtcatggagtcaagagaagaagaccgcgaggcacaggacccagccacctcaaactgcagaaccgtggtgtcatccgggagagactgcccttccccacccttggggcaggccaaggagagatcgtcccacatcctggggtgcctccatggcggcgcgggtggcgacgccgtggacaccgagccgaggatcctgagctaccagaagatctccgttgtccctgcagcatccaccccaggaaacactcccctgaaagccgctgccgccgctgccggagacgagtcaaaggttgatgatggcggggttcgtcctggctgctgctcgcacattttaccctgtggtgcttg

SEQ ID NO: 13080 - DNA, 656 bp, Zea mays
  Clone ID: LIB3279-211-Q6-K6-F8
ttctgcgtccggttccccagtccccaccccgaccggctggtcctcctcctttccccgcgccatcctcgaggcatcgccggcgccgcaacttcgttcaggaggaagcccgcacccggccccgatccgatggccaacagcaacctcccgcggcgtatcatcaaggagacgcagcgactgctcagcgagccagcgccggggatcagcgcgtcgccctcggaggagaacatgcgctacttcaacgttatgatccttgggccggcgcagtcgccctatgaaggtggagtttttaagcttgaactctttttacctgaggaatatcccatggctgccccaaaggttaggtttctgaccaagatttatcatcccaacattgacaagcttggtaggatatgcctcgacattctcaaggacaaatggagcccagcacttcagattcgaacagttcttttgagtatacaggctctactgagtgcaccaaatccagatgaccctctctccgataacattgcaaagcactggaaatccaatgaggtagaagctgttgaaacagccaaggagtggactcgcctgtatgcgagcggtgcatgagagcgcagtgctgttctttgtgtaataaccccatcatacttcagtcctaatccgttgccatttgcttg

SEQ ID NO: 13081 - DNA, 671 bp, Zea mays
  Clone ID: LIB3279-211-Q6-K6-F9
cccggtcgacccagcgtccgttcaaacccaatcaccgctccctccaaatcccattccctccgcccagaccagctcgcgaaatggacggcggcggcgcgaaggcgaagaaggcggctgctgggcgaaagctaggcggcggcgggccgaagaggaagccggtgtcgcggtcagttaaggccgggctccagttccccgtgggccgcatcggacggtacctgaagaaagggcggtacgcgcagcgcgtgggcacgggcgctcccgtgttcctggccgccgtcctcgagtacctcgccgctgaggtcctggagctggctggcaacgcggcgcgcgacaacaagaaaacccgcatcatcccgcgccacctcctcctcgccatccgcaacgacgaggagctcggcaagctgctgggtggggtcaccatcgcgcacggcggtgtgctgcccaacattaaccccgtcctcctccccaagaaggccgccgagagggccgagaaggccgctgccgctggccccaagtcccccaagaaggccgccgccaagtcgcctaagaagtagtgactcgtcttgctctcactcatcccgttctgagatcagcttgtgtttgtggtcgtggacgccttttaccattttgcaagtgtgtgtagcgatgcgtcgtctgaactatatgtgcta

SEQ ID NO: 13082 - DNA, 682 bp, Zea mays
  unsure (1)..(682): unsure at all n locations; Clone ID: LIB3279-211-Q6-K6-G1
gtcgacccagcgtccgcggtcgcgtgggcggcggaggaagggggaaagagagggcagagcagcaacagtacatcgagcgagggagtagagcaaattgaatcaggtttcgtgtcgattcggaggctttcgcttctgcttgcggagttgcggtggagatttgaggcctgcggcgacgatggcacctgcggaatccggggagaaggcgaccagcttcgccatggcctgcagcctgctcagccgctacgtcaggcagaacggtgccgcggctgccgatctcggcctcgctatcagagctgaatccgatgcaaagaggacgtcgacggacatggaaaagggggagacggggaaggagaccatggatctcttcccccagatcgctggattcggctcggaggctgccacgaaggaagcccctgatgcgagggagccagagaagcgccaactgactatcttctatggcgggaaggtccttgtgttcgatgacttccctgctgagaaggcaaaagacctgatgcaaatggccagcaagggttcatccgtagcccagaaccctggcctgctgcctccttccacagctgcaaccgttactgacagcaccaagatcgcagcagtgccagccgcaccaattgctgtggccaacgcccagaagagtgcagcagatataccgcnagctcccaaggca

SEQ ID NO: 13083 - DNA, 388 bp, Zea mays
  Clone ID: LIB3279-211-Q6-K6-G10
gcgccactggcgggtggttctgcctctggtctggtgtgtttgtgtgtggtcacacttgccagctagcagaggcgcctgcttgtacctagattactgtttccattgtcgtcgtcatcggctaacattgtcataatgtcagtttgggtaatgttagattaagtaattattgtgttctgtgttctttcttgtttgttgcctttctttggtgtgtttttgttattgttggtctgtttccattgttgttgctttggcattgtcagtgcccgccagccctgaaaattgccgtttgggtgggtttgcgtgtactccgtattatgatgttgggctgcacattgtagctgggaatgtttgccaaagaatggaatgggcatgcggtggttgttggtgg

SEQ ID NO: 13084 - DNA, 316 bp, Zea mays
  Clone ID: LIB3279-211-Q6-K6-G11
cccccggttcgacccagcgtccgcggtcgcgtgggccactacttcccaattgtaggatacgggaagtaagcgtccgtttcacctaggcacccgaattgggctgccctggtgtacaagctatgttggagtgggctctttgttagaaggttagtctgactgaaaggggagtggacctggtggtgaaagttggatggtagatttttcgttttcaccgcttaagaattagtgattggaatgaatgtgtaaagattgatgtgtgttgtacacactctttacagaatcatttcaatgggagcccgtgttgtgttctttgctc

SEQ ID NO: 13085 - DNA, 629 bp, Zea mays
  Clone ID: LIB3279-211-Q6-K6-G12
cagtcgacatcgtgcgcccggcaaggcaagaggaggcggcttgcgcggggggcatcgtgcaatggcgcggcggtgcccgtgcaggctgctgctagccgtggcggcggcggccgtgctcgtggccgcggcagcgcaggcgcaggagacgtgctcggggaccgtccccgcgccgccgcgccgcggggcgcgggtgtccgtggccagcttcggcggcgcgggcgacggacggacgctcaacacggcggcgttcgcgcgcgccgtcgccagcatcgagcgccgcgccgcgccgggcggggcggagctctacgtgccgcccggggtgtggctcacggggcccttcaacctcacctcgcgcatgacgctcttcctcgcgcgcggcgccgtcatccgcgccacgcaggacacatcaagctggcctctgattgaaccgctgccctcatacgggagaggacgtgagctgcccggcggaagatacacaagtttaatccatggcaatgggcttcaggatgttgtcatcacaggcgagaatggaactattgatggtcaaggcagcgcgtggtgggatatgtggaagaacaggacactgctctacacaaggcctcaccttcttgagctgatgagctcttctg

SEQ ID NO: 13086 - DNA, 648 bp, Zea mays
  Clone ID: LIB3279-211-Q6-K6-G2
gccgccacctctccttcggcatcgacgaggcgaaaccctagcgccggagtcccgctccctcctcccacgacccatggcgtcggatatggcgtacgcgccgccgatgaaggcgggcaaggccgggttcgaagctggcatgatggatccgcagcacaggatccgcatcacgctctcctccaagagcgtcaagaacctcgagaaagtctgcggggatctggtgaagggcgccaagggtaaggagctcaaggtcaagggccccgtgcggatgcctaccaaggtgctccacatcaccaccaggaagtctccctgtggcgaaggtaccaacacctgggatcgctttgagatgaggattcacaagagggtgatcgatctcgtcagtacaccagacgttgtcaagcagatcacctcaatcaccattgaaccaggtgtcgaggttgaggtgactatcagtgacgcttaatatggtagccttatcatttcaaaaggcttctagtgaacaggatattttcaattcctagtgagaacttgtgtaacagaggaatccaagtatttcatatcaaagtttaaaagtcttatcgagggttcgcggtatggatgtatcctgtttcaaatgatttctcctaatgtatgaatgaaaacggttaatgg

SEQ ID NO: 13087 - DNA, 633 bp, Zea mays
  Clone ID: LIB3279-211-Q6-K6-G3
ccggttcgacccagcgtccgcttatgggtgcgagggttgtagcgagggttataggaacgccatagacaaactggaggacattgtccgccaatctggccagccatctggcctgagggctgttcagaacactggtgaccatactgtcgctgatgggatcactggggggcccaccactggtacattcactaattacttcaagacgtctttaatggtgactcttatggtcatactgactgaccataagactgaccatgagtcagttatggagaacattctggggatcatcttgagcatcgctttctgtgacattgactatgccatgctgggcgtccatatgaacatcacagggaagaacaaggtgaggaacatgatttgatttctgttcaggatggtgctcaagatgatggtgactatgatgggcactatcctttgtgaagacatgggggaagtgatggtctacctgtacctatacaaagacccagaggaagcagaggaacctgacgaggaagctgactttgccgctgagtctgactaccaaagtgctgaccaatgaactgatcatcagggtgacctatcatgggacctctgatgctgctgctcctactgttgctgatagtggtgctgatcggggtg

SEQ ID NO: 13088 - DNA, 601 bp, Zea mays
  Clone ID: LIB3279-211-Q6-K6-G4
gtcgacccagcgtccgttgcgagcggggccctttttttttttttttttttttttttttgtcagataatttgctttatttaacaacttaagagacaaaaggttcatatttagctagcctcaaaatatgtttgccaggcacagataccgtatatgcatatggaaaggtgaaaatgggttgaactaaaactgagcaaagaaatgacattgacagattatacaacccatcatgggaaaattcaactgcgacaagccgcagcaacttggaggacatcccatttagtatctgtgggaaagcttctcctgctctttgtaccacatggcgtattggtaggtgccgacgacgggggtgaggaggagcgtggcggagatccagttctcggtgaccttgtggtggatcttggtggtgatgtccttccacagccccggcatcaccttctgctggaagggcgacagcgcgtacaccaccgccttcatccgcaccggcgtcttccccattttcccccgcgtcgccggccggagtttctcctcttgggacgggatgctccgatcgcctcgcgtacgccaatgggtggcttctggttgtgggtcgttcgctcggcgg

SEQ ID NO: 13089 - DNA, 631 bp, Zea mays
  Clone ID: LIB3279-211-Q6-K6-G5
cactctcaatagccatctctatggctctgataacccctcgctcaattggaagcagaggctggaggtttgcatcggagcagcaagggggttgcactaccttcacactggatctgcgaaggccatcatccatcgtgatgtcaagtccgcaaacatcttgctcgacgagaacctcctcgccaaggtcgctgactttgggctatcgaagactgggcctgagctcgaccaaactcatgtcagcactgcagtgaagggcagcttcgggtacctggatcctgaatatttccggaggcagcagctgaccgagaagtcggatgtctactctttcggtgttgttttgcttgaggttctttgtgcaaggccagtgatcgaccccacgctgccgagggagatggtgaacctggccgagtgggggatgaagtggcagaagagaggagagctgcaccagatcatcgatcagaggatctcgggcacaatcaggccggactctctgaggaagtttggcgagaccgtggagaagtgcctggcagactacggcgtggagcggccgtcgatgggagacgtcctctggaacctggagtacgttctgcagcttcaggacgccgattcgacggtctcggatgtcaacagcatg

SEQ ID NO: 13090 - DNA, 660 bp, Zea mays
  unsure (1)..(660): unsure at all n locations; Clone ID: LIB3279-211-Q6-K6-G6
cgtccgttttcttctctctctgctcctccgcctccgcctgatccatccaagacaggnatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaaaagtgtatcaccaaagaattgctaccgagacattcacctggcttgagctggcttttgctat

SEQ ID NO: 13091 - DNA, 634 bp, Zea mays
  Clone ID: LIB3279-211-Q6-K6-G9
gtaactttttgagcccatctacgacgagactgatggggctgatgggtatgtctccgtagaggtgtctcctaggttggcaaatgacactcaaggaactgttgaagcggcaaagtggttacacaaagtggtcaaccgccccaatgtctacataaagatcccagctactgcagaatgtgttccttccatccaggaagttatcgctaatggcattagcgtcaacgtcacgcttattttctcaattgcgagatatgaggctgtgattgatgcttacctcgatgggctagaggcttctggcttgagtgacttatcccgagttactagcgttgcatccttctttgtcagccgagtggacacccttattgacaaaatgcttgacaagattggaacacctgaggcccttgccttgagaggaaaggctgcagtagcgcaggccaaactagcaaatcggctctaccagaagaaattctctggcccaaggtgggaggcgttggccaagaaaggtgccaagaaacaaatgttgttgtgggcatccaccggtgtcaagaacccagcttatcctgacactctttatgtggacagtctcatcggacctgacacggtcaacacgatgcccgaccaatctttgcaagcattc

SEQ ID NO: 13092 - DNA, 633 bp, Zea mays
  Clone ID: LIB3279-211-Q6-K6-H1
cgcaaatagcgtcttccaagcttgtagggttaccggatcggaggagcatccccgcctaggtcaccacagccatggttcgcggatcgctaggcaagcttgcgtcgcgcgccctctccgtcgccgggagatggcagcaccagcagcttcgccgcctcaacatccacgagtaccagggtgcggagttgatggggaagtacggtatcaacgtacccaggggtgcggcggcggggtccgtacaggaggtcaatgacgccttgaagaacatcttccccagtgagaaagagatagttgttaaaagtcaaatccttgctggtggccgagggctgggaactttcaaaagtgggctgcaaggaggtgtccatattgttaaggctgaggaagctgaaagcattgcacgtaaaatgttaggccagattctggtaacgaaacaaactggtccggagggaaagattgtgagcaaggtctacttgtgtgagaaactgtctctcactaatgagatgtattttgccattacccttgataggaaaactgctggtccgctcattattgcttgcagcaagggaggaaccagtattgaagatcttgcggagaagtatcctgatatgattatcaaggttcctgttgatgtattta

SEQ ID NO: 13093 - DNA, 631 bp, Zea mays
  unsure (1)..(631): unsure at all n locations; Clone ID: LIB3279-211-Q6-K6-H10
tttcacgcgtccgcttacaggcagcttttgctgacaactgctggtcttggtgaatatatttctggcgctattcttttcgaggagaccctttatcaatcaactacagacggcaagaagtttgttgactgcttgaaggatcagaatatcatgcctggcatcaaggttgacaagggtttggttccattgcctggatccaacaatgaatcatggtgccaaggtcttgatggtttggcttcaaggtgtgctgagtactataagcagggggcgcgcttcgcaaagtggaggactgttgttagcatcccttgtggtccatctgcattagcagtcaaggaagcagcatggggacttgctcgatatgctgctattgctcaggataatggtttagtgccaattgtggagccagagattcttcttgatggagaccatgggatcgagggagctcttgaggtggcagagaaagtgtggtctgaggtgtttttctacttagccgagaacaatgttctgtttgagggtatcctgctgaagcctagcatggtcacccctggagctgagcacaaggagaaggcttctccagaagccattgcaaagtacacgctaacaatgctcagaaggagatacctnccgctgttcc

SEQ ID NO: 13094 - DNA, 626 bp, Zea mays
  Clone ID: LIB3279-211-Q6-K6-H11
gcctcgggtcaaaccctaagcagggcagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccatgaatccctcgaatccaatgtgaacgagactaatgcaaccgtcaagttccagctcaagaaggtcctttgcatgggcgtcgccgtcggcaacttggcgatggaggagaagcagatccagcagaacatccagatgagcgtgaacttccttgtttaccttct

SEQ ID NO: 13095 - DNA, 536 bp, Zea mays
  unsure (1)..(536): unsure at all n locations; Clone ID: LIB3279-211-Q6-K6-H12
cggccgcgtgggtcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaaaaagcagtgctggtgcggcgagtgcaccagctggtcgggcgtgtggacctgcgacgacctcctcaccaagtgcgccgccacctgcaagaactgcgtccccgtgtccacggacaagggggccatcaagtacaggtgccgcgacttcctccccgaaaactgcggctgcaagatccactagagactcatccaattccaccatggccgcgcgccacagcggcacagccgatggatccttccatgttcctccgtccgtccgccttgctacaagcaggcagccacaccaataagctagctcttgttgntgttttgtatgtttgattgggtgtcccttcccagncgagatggaataaaataaatcatcaggcgcc

SEQ ID NO: 13096 - DNA, 661 bp, Zea mays
  Clone ID: LIB3279-211-Q6-K6-H2
gtcgacccagcgtccgcagtactcacttcaagctacttagccatactaacacttataactaagttttgtggctattagtgtttgattttttacaggatcacctattcaccacccttcaggtgctctcacctttgaatgaggatgggagtcctttactcactgataatcattgggcaattgttgaaaaagtgttatctttcttagaattgttttatgaatcaattgttgcattgtctagtgtctactatcctactagtactttaatgttgcatcacattcttaggatagctagacatctaaatgcatttgagaatgatatattgctaagatgtgctgttgttcctatgaaagataaattcttgaaatactagagagacattccaattttgtatgcagttgcatttattttggatcctagagctaaaatgaggggttttaacaaagtccttatcaagttatctagtttaactggtactgattactctaggcttccatttgatgttcgtactaagctaaccaaggtatttcagttgtatgagaccaaatttggtgacacacgcatgcgtggcgcccaccaaccatcatctcacctatctggtaagaaagaattggcatgggatgacatttattgtgatgatgaccttgatggtgagttctctac

SEQ ID NO: 13097 - DNA, 623 bp, Zea mays
  unsure (1)..(623): unsure at all n locations; Clone ID: LIB3279-211-Q6-K6-H3
caaaatttctgaggactgctatagatatggaagcgaaataatgcaagcgacgaagcccttagaaaagcagcatcactatacggaggtgctttgagaaatattgagaaagagtatgaagatttcaacagaattttatcttctcagactatagacccattgagagcaatggctatgggtggacccctggaagatgctcgtggtcttgcacagcgctatagcaggatgagacatgaagctgagatcctctctactgaaattgctagaagaaaggcacgggtaagagaagctccaattgctgagcacactacaaagcttcagcaatcagaagctagaatgatagagcacaaagcaagcatggnccgtgttaggaaaggaagcagcagctgcgcttgcagctgttgagtctcaacaacaacgggtgacccttcagcggctggttggcgcggcggaagcagaaaagttattccatctgagattagctgctatacttgatgacgttgaggcagagatgtcctctgagaagcaaaggagagaatctgcaccacctatcatatcttcacataagcgtgctgagaaagcccagtacttccttgctngagtaatgcataatttcaatggaacca

SEQ ID NO: 13098 - DNA, 605 bp, Zea mays
  unsure (1)..(605): unsure at all n locations; Clone ID: LIB3279-211-Q6-K6-H4
atggacccctcgccagttagttagctctctggctgaanatgctagttctattgatggagttgtaatattttgaaactctttgttttgaaatatttactgtgtcaactgatttgaatcctcatgttgtacagaatatagtaggccgtctttcgtttttttggcttactccgtatgctgcatgaccgataatagcagcagacattattaactgtaatacaaatagtagttttttctcgttgaacaaaatgttttggtactcaaactgaccacccatgtactataaatagacccctgaggcaaggatgtagggagatctcatagcagcacaaaaccagattccttcctcactcacgtgaagtgtcagcaaacaacagctgcacataccactggcagttcaacaataacatttatgcacattagcactcattggaaattctttttgtatagaatggattaataattgttaatactatgtccaaatgatacctgattttctgaatgaagccgcaaggacaaagaactacagtggagcagagttggaaggtgttgtcaaaagtgctgtctcgtttgctttgaaccggcagataaccatggacgacctcact

SEQ ID NO: 13099 - DNA, 635 bp, Zea mays
  unsure (1)..(635): unsure at all n locations; Clone ID: LIB3279-211-Q6-K6-H5
cccacgcgtccgcagccccttaaccctcgttcctctagccgtctcgcgcagccacagcctccatttctcctccgacggcggtgcggctagctcaaccatggcggactccaaggccacctcggcggtcaccctccgcactcgcaagttcatgaccaaccgcctgctggcccgcaaacaatttgtgcttgaggttatccaccccggccgcgccaacgtctccaaggcggagttgaaggagaggcttgccaagatgtacgaggtgaaggaccccaacaccatcttcgtcttcaagttccgcacccacttcggtggaggcaagtccactggcttcggcctcatctacgataacctcgagtctgccaagaagttcgagcccaaataccgcctcatcaggaatggtcttgctactaaggttgagaagtcccgcaagcaaatgaaagagcggaagaacagggccaagaagatccgtggtgtcaagaagaccaaggctggtgacgccaagaagaagtaaacagtcatttatatttctgtattactgtcctgaactctgggtggtcgtctagttgcaatgtncataattatggtcgtgttagggtttgttccgcactcagcagtaagtgaagttttgtaattcc

SEQ ID NO: 13100 - DNA, 447 bp, Zea mays
  unsure (1)..(447): unsure at all n locations; Clone ID: LIB3279-211-Q6-K6-H6
ttctttactgcagatgatcaggcgcctgatgccgatgaagcttccttgctcatcgccattatcgaagattagnctccatnngttccgaaggcnnntctctaggggtcgtccccccagnncgatgatcatatatcatcatgctnngagccggnaaacctgaaaacaataaagaaaagcaagcagctggtcatagtaaacatcatgtagcgaggcttagtagattggggttttttttcccgttagaatcagtccacatgtcctcgacacgggctatatttgttctagattatttttccagtagtaagccatgtgtccatggacagtccacagcgcgacgtctaatgtaacaacatcatcaaggttcttttgactatcccataagaaaccattccttaagacaaccgatattgtgagttgataaccatgtatcacttccttttctctttt

SEQ ID NO: 13101 - DNA, 679 bp, Zea mays
  Clone ID: LIB3279-211-Q6-K6-H7
cccccccggttcgacccagcgtccgttgtcgcgtgggttgtctccccctccatcgccgcgtcgccgttgccgtctccgtcgtccccacgtccgcctcctcgtcgcgtccacgtccgtgtccgcgtccgcccgcccccgccgagaagcggaagcagcgggggcgacgagccctctaatgccaccccgtgggcgagccccgactggctcacgtctctctcgcgcgcggtcggccggagcggcggcgacgactcggggatccccgtcgcgtccgccaagctcgatgatgtgcgggacctcctcggcggcgcgctcttcctgccgctcttcaagtggttccgcgaggaagggcccgtgtaccgccttgccgcggggccacaggactttgtcatcgtcagcgaccccgccgtcgccaggcacgtgttgcgtgggtacggctcacgctacgctaagggactagtcgctgaagtctccgagttcctcttcggctccggcttcgccatcgcagaaggcgacttatggacggtgagacgcagagctgttgtgccttccctgcacaaaagatttctgtccattatcgtggacaaggtattttgtaaatgtgctgagagactaatagacaaacttgagccatatgctttgagtggggaacctgtcaatatggaagcgaggttttctcagt

SEQ ID NO: 13102 - DNA, 600 bp, Zea mays
  Clone ID: LIB3279-211-Q6-K6-H8
ttcccaatctcccctacccataaaaatcccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggacgcaccctctacggcttcggaggctaggctaggcgcctcttcatagtcggggactggttaggggacatgtctctgtgtgatgctttctgtggtattattgctgcaatagccgtgtaatccatcgcttctgcaatgaagcgctcggaagcatgctacgtatgttgtgtctgtgggtgattgtatttctggtagtaacagtgattgttcctgaattttggataatacaagctcattcgcagtagtttctgttgt

SEQ ID NO: 13103 - DNA, 656 bp, Zea mays
  Clone ID: LIB3279-211-Q6-K6-H9
attgtacagcgccaagaggaggtcgccaccgacgaggccttcacgcccatcaagcaggacaccaagaagggcaaccttcgatactacccgtacaacattaactggaactatgggttacttcctcaaacatgggaggacccaacttctgcaaattctgaggttgaaggagcatttggggataatgatcctgttgatgttgttgagataggtgaaaggcgtgccaatgtcggggatgttcttaaggttaagccattggcagctttagcaatgattgatgagggagagcttgactggaaaattgtggccatttctttggatgacccgaaagcatctcttgtgaacgacgtggatgatgttgagaagcattttccggggacactgactgccatcagagactggttcagagactacaagatacctgatggaaagcctgctaacaaatttggtctgggcaacaagcccgcaagcaaggaatacgccctgaaggtcattcaagagaccaacgaatcatgggagaaattggtaaagaggaatattcccgctggagagctctcgttggcctgattttggcccatgggaagacaccacattcttttgaactgctttcgtgagcatgtcgttttgtatgctgtgaccatgcttcttcgtttgcattc

SEQ ID NO: 13104 - DNA, 595 bp, Zea mays
  Clone ID: LIB3279-211-Q6-N6-A1
gtccaaagaaaacatgtatttctcgcttacataaagctagtctacttaatacgttacacccgaatctgtacgaggaccgtaaagaaatttccaaagatacaagctttttgaaaagagtacacgaccaaagaagattatgtggttgcagtgatcaccagcgagcacggtatcctggctgcttcagtgctaccccctacggacatattcggttacaccaatccataaggggattggtgaggtttaaatcctcttctagtcatttttaactagaaaaggatttaatcccctccaatccgcttctgaattgttgtaaccgaacaagccctacaagggttgatcatttaagctaatccttgtttgtcgggtaaggtttggttgcagaattcctcatgttagagcctcatgaaacgtgcttgcttcaagctacagccgtctgcttaccaccaacccagtattgcttcacggcatacaagatcttctcgcgcacgagggggccatcctcgtgatcaaccatcttcgtgtcccacctcatacccagagcgaggctgttcaccttggtcaggacgtctacgtcgtcccgtattatgacggcgcc

SEQ ID NO: 13105 - DNA, 565 bp, Zea mays
  Clone ID: LIB3279-211-Q6-N6-A11
ggaagtacaaacatggcggcatgtattagggatagataaacgagtgatgacagaacaaagtaccaaaccataccactaaataaaggctaaggatgtccctcagcaatggcacaaggagccagagcatcacaagttccttaaaaagactttttcccttttgtttagtactacgcagggcggagagcaaaacgaggctccgcagctgctgcttttaggtggtgctaggaacgctgcctccggtctggtgaagcatggcgtcgatctcgtcgccgtcctccatctccagctcatcaggggtctgctcgccgcgaagcctgcggccatcaaacaggaatgcaatggcattcatgtccacagactggcggtcgcaataggcgttcatcagcttcttcagctgggtggacctctttatgcgaaagaacacctcattgccatcctgtcccttgaccttaaggttgatgtgggcgccgccctccgcgggcttcttatcctcctcgccggctccagacatcggtagaggtcagtttccgggcgatcgatcgatggcggcggttgccggcgctgt

SEQ ID NO: 13106 - DNA, 593 bp, Zea mays
  Clone ID: LIB3279-211-Q6-N6-A12
aaaaacaagcaattgctgacaatctcatttgatccaatacaccaatctggaacaattgttgacgatatccggcagtatcccaatagctggcccacagacatccggctctgacgcgtttgcggacatactagtttactcgtacagcaggtttaacacaagctcacaaaagcacaagcccctcaagggtacagctctaggagcatcagaggacagattcaatgtcaactggggctcatacttatggccaggaaactacatcacctactcagtttccacaggattgcattccgcaggtaacccacatgactcaattcttcggtgcacagctggccaagtgagccttgaaattctccagctctgcaagaacttcatcctctgggcggtagatcaaatcactcatgcgccaaatctgcagtgttccacctccaccagtgctctcgccatcatcagagacactgacaattgtccaaggatctgacgaattccagtggaagtctacaatcttatccctatgaccagcatgctgaaagaaaagcccggctgggacattagaatttttcttcttccccaccttctcatgatcccacacgttt

SEQ ID NO: 13107 - DNA, 565 bp, Zea mays
  Clone ID: LIB3279-211-Q6-N6-A2
gtcacattcaactaggatatgcattgctcagcataactttgttaagtagtagacatatgtttacactcttgtttcatacaacaacacaataatgatctttcgctcatacacaaacatgataacgatgaggggctccaggctgaattgtgaacgacggaagcgtcacttcatgtacctctgaagaaatttacggtggaaatcactcctgatggtgtcgttgatgaaccgtttcggtgtcttggtctctcctcgtgcttgattcttgaataccacgtcgtcgtcccaccttctcttaacactgaaggagccagcattgttgatattaatcaacgggtttccccgcatcagttcagcctccttcatcttggcctcctcttctgcttgttgccgctcctttctaagcttctcctcggctctttctttcttaatcctctcaagctctgccattagagcttcagtgtcgtcgtcatcatcatcttcatcgctctcgtcatcgcttttaggctccacatcggagtcatcagcatcgatttctcgtggaactatcttatcctctgtctctctc

SEQ ID NO: 13108 - DNA, 589 bp, Zea mays
  Clone ID: LIB3279-211-Q6-N6-A3
aaacaaacagggcctaagtaacattacacggtacacggttaataatggccggtttcaacgggcttcagagtcaataaggaaacaaaaaagatggggtttcaacggggtacaaaagagagcaaaaaggaaacagtgacatttctctccatgatcgctatcagatttcagtcaagctgtaccttctccagttcaccaatcatttcctcaaacttcaaaatttgtctcaaaaagtaatcaccatgacgcttggtaggtttggactccacaacatgaatcacatcctcgacgatgtaaaagtcaaagtctgcacttgatactatctttctttcactgtcaactgcatgcattttgtgcttgtatgtcatcaggatcgaccttagtgttgcttcatccacttccatatattgggcaagtttgctaatggttattgttgaatatagcttcagataactccgaatcccaaaaagcaactgttgctgctttacttcatagagaaacaacttcaactgaagaccgtatgcatcctggttatagtttgttagcggctggtccacaattggaggcgaccgtgtaatgaacttggggcaag

SEQ ID NO: 13109 - DNA, 593 bp, Zea mays
  unsure (1)..(593): unsure at all n locations; Clone ID: LIB3279-211-Q6-N6-A4
aacaggatgcatctactgattccattgcgattgcgaacaaggctacaaggcattacaagatgcgaaagaaaattcccctcgcgcggaagaactgagctgagtcaagctacaactctgaaagctaatgttaaggtccacatggccgattagtgcacagtacatggaacaaacttagctacagcagattagttctacatatttgcattggggggtgggggcgatgatcgttctactctccttacccttctacagttaaatgtcgaatacagaatgcgctagctagtagactgtttcatggcccctcatcgcggatgggctaatggctcgacagcggttctgaagaggagaatataggccttgtcgacggagaagtacaagaaaccgcccagagagtgagtgacataggaaccaaagcttgttccaacaatgcaatgccaagctggaccatatgccgtatcaaattccttcttgagcgcgagggcgaggcgcttgctgtcgaggcgcggcatggcgactatggcttcgtaggcgagccggaccgcgcggcgctgcagcggtaggggcatgtcngccgcgcgcacccgcactgacac

SEQ ID NO: 13110 - DNA, 229 bp, Zea mays
  Clone ID: LIB3279-211-Q6-N6-A5
atcatgacaaaggtaaatttaaatgctcaaaacttaacattgttcacgtccgctaccaattcccgagtaccaaattcctaggcaacaactttggcatcaaaactatggtttttgaagtacatacggagcagtctagttgagaccccaaagaaacatccagattcaacaaaataaaatggggatatccgggcgtcatatttatgcattttcggccatagggtactcaaag

SEQ ID NO: 13111 - DNA, 575 bp, Zea mays
  Clone ID: LIB3279-211-Q6-N6-A6
gaaggtgaactgggctctcccattcgaacttacggacggccaggaaaccaaaccaaccaagaacggctagtccatcggagccaccaccgatcacgatcgcgggcgccgcctgaggttgacgacgacgacgctgacgttgtcggcgctctgccgcgccagcgctagcttggtcagcaggatcgccgcctcggcgcacgccctgtcctcggcgctctcgccgtcgctctcggaccccgcgccgtcgccgctgggcgcaccagcctcctcgtccccgctgctgctgctgctgccgccgctggcgctgctctgcctagggctcaggttggaggtcgggctcgactgctcccggccaccgcgtggcgccctgttccggaggcaggtgcgcacgaccttgcacgccacctcgttgctcaccacgtcccacagcccgtcgctggccaggatcaggaactcgtcctcgccgtccttcctctccaccaccagcacctgcgggtcggagatcacgaacggcttcaggtagctgtcaccgatggctcgggacatggcgagcatgccgaaaacgcgggcgccgtccc

SEQ ID NO: 13112 - DNA, 566 bp, Zea mays
  Clone ID: LIB3279-211-Q6-N6-A7
ccaagcaaacagtcttcatcgggacaattcatttcaattcacagaattctggattccgtagcaataacaacacttagtcagctaccccgaagatagaggcctaaataagatagaggccttatttcctggcacttattcagaacaactttgagcaagtccataataagcctaaacacgggggcgtcatgcagggcactgtccatctgcctcttcaaattgacaactgtaagtggaagctctaagaaggagcgccaaggtaagacgccagccgcaggatgtcgcaaaagacgccacccgcagtcacctccgcgcccgcgcctgggccccgcacgattagcggctgctccttgtacctcgaggtggtgaatgcgatgatgttgtcggagccggagagctgcgcgaacgggtggtccctcttgtacctacgtagctccacctgtcccctcttgttcaccgtatccaccactccaacgtaacgcaggacttcgtctgcagcatcagcatcactgcgttgcctggcccagtcctcgtcaaaggatggtagcttctgcatgaattcatctgct

SEQ ID NO: 13113 - DNA, 442 bp, Zea mays
  Clone ID: LIB3279-211-Q6-N6-A8
gggggggggcaacccatccctttcttaaaacagggggggggggggaaaaaaaatgcccgcggggaaaacgaggggggaactttttaaccaaaaaaggtttggggggcccgggcccccccctggggggggatgccccgggggggggggaacaaaggtcccctccaaaaaaaatggggggaaaaaacccccccctacaggaaaaattaatttcttcgggggggaagggaaaaacttcccccctccccggtgggaaagggccgggaaaaaaaacgggtctggggggggattatttttcccctttaaaaccccgggggagcccgtcttttttccaaaaaaaaagatccggagctgggaattccccaaaaccccccccccccagcattggcccaaaaaatttacccccacccccttgaaaggggcgggggccccttttttttaaaaa

SEQ ID NO: 13114 - DNA, 208 bp, Zea mays
  Clone ID: LIB3279-211-Q6-N6-A9
gggaaaccaagcaacaacttggcttaacttttttggggacatatgccccaatttccggggttatgaaaccggtcagcccttcattgggaaaacccggggggcttactccaacagggggcgggaccccaagaacacaacggtgggggggggtttctaacgggaaaacaaaccggccaagggggaaaaacaaatcgggcccggggggccc

SEQ ID NO: 13115 - DNA, 245 bp, Zea mays
  unsure (1)..(245): unsure at all n locations; Clone ID: LIB3279-211-Q6-N6-B1
ctctgctgntgctttcttgcgctttgtttctccttgctggcgctttttcctttcgtgcttgctcttgcgttggctctggtttctggtgttggtgcttcgcggtcgcgtgctgtggcttggttctccctcggggtggaggggggggggtgggccttgcgctggctgtgcctgcctgcctggtggtggctttgtgttttgtgcttggctctcgggctggcccgtgttcctttgtctgcttgggtgct

SEQ ID NO: 13116 - DNA, 486 bp, Zea mays
  Clone ID: LIB3279-211-Q6-N6-B10
atcacgaaaacatgtaacacaacaacgggatatcttaacaaatttatctttgagagccccaggactaaacacgaaatattcatgggaatacgaaaacagagatggggggggtccgatacaacaaatcgacagctaaagcaggacttttcggggggccgagcatttaaaagcggggcttggtaaaaaaccacctgttcttgccgggcttgaacctctcctaaaggggcgctttggccgttttgcaggcggggacctttttgtcgggggtagaaagggcgtcgggcccaccgggggcgacatccttgaaatcgacctccagggtgtagcgggtgggcatgaggggagtgaagttgaccagcttgatgaaacacttgacgcgcgactttttcgcagtctttttgggggagtccttgcggatcaccttttttgggtacttggcgaggcctgcgacgaggcagtggccataggggcggtcgcgggtgccct

SEQ ID NO: 13117 - DNA, 622 bp, Zea mays
  Clone ID: LIB3279-211-Q6-N6-B11
agctactgtttgtgcagatctccacttatgatatacggacaacatatcaggtgcaaactaaggatgcaggtgggaggaactttctaaaaattcatgttttaaaacaacactccccaccaccctctttacattgatttgcacactttgcaccgataggttagtctgcaaccgatatgtttctcctgttgatggttatgaacttatgatttataatacccaatgaataaactctgatagatcgcccgtttgatggcagcaaaatataggtttcacagcagcatccaaggtgccgcaagaggatctataatttaagtggaagtagccatatcatgactaataaacttgaaacccatagtgaagtttgaaaaactaggatacacaaaaaaagtactagacgtggttcatcctatgttttctaaaatatgacctcaaaaaagatgcacaaaaaaggtctatgttgtgaaatgtggatgcaaagttataccggcttccttttctttttatgcctccttttgcagcgtggtttaattgcatcagaatttgaactcagattactgttattatccccaggtcgatttggtactcttctatttttaaatgattcaccgcttgtgctgtttga

SEQ ID NO: 13118 - DNA, 620 bp, Zea mays
  Clone ID: LIB3279-211-Q6-N6-B12
tcgcgatctaaacgggatgtgaggaagaccattttaccagtgaaggtcaaagttccaattagcacttgcgggtagttcactaataatctctccactaacagtgtcccaacaaattgtcctattgtcttttgaacatgtaagcaagaatgaactatcataggggcaccacgacatagcgattacaccttttgaatggccaacaaattctcttactggtgaaatggtcttcctcacatcccaaactctcagtgagggagagttgtcatcgtctgatgcaacaatcagctgggtggacatatctggattccattgaagcacagagcatttccttctatttgaatctgaaaaactagtcagtggtttctggttccttaaatcccaaacaactgtcatcccattactcgaagttgaggcaactatatgttgaaacttgggattccaggataaacaagagatttcagcttgggcatgggacccaacactcttgagtggcgggtacacgattggctcaacgggattcttgagatcccagatgcaaagctccccctgctcacccccagaagcgagccgattcggcgtgagctcgctgaactccagtccacacaccggttccgggtgct

SEQ ID NO: 13119 - DNA, 612 bp, Zea mays
  Clone ID: LIB3279-211-Q6-N6-B2
tcgcgatctagaacctgttgacttcggacgagaacgccaccggccccgacgggggcaaccgtaggcgtgagttcctcctgaacgctccgtcgccggagcgcgcgaccaaggggagcatccggcttcgttccgaggccgcagccggtggctccaggaagagcgacggtagcagccatgcccctgaggggaaccgtgagaagctggggaaggtgaagctcaagattcgtaatgtgctaccgaaaccgaaccctgatacgtcgcctgtgaagcccccacggcctgtagattcgcggcaccagcaaaagcatggccatctgaaggaaggcacaaaagattctgacaggccaacctcttcacgagacaagaaagccagaaaggagaggtcgattcaagaaacaatggcacaggagcaagcagacaaatttcagagagaacctacttcagatcctcgcactcatttgtcgccgcactcaacgccacatcgccctcttcaatcttcatcgagccattctctagctgggcaaccaagggagcatctacttttgacagactggagtatttttgttagctcaaaaagactggtttctggtgacacatttattttcttgagtg

SEQ ID NO: 13120 - DNA, 624 bp, Zea mays
  Clone ID: LIB3279-211-Q6-N6-B3
catgcagctgcacatagatggaacgaaagcgcgatgtacgaacttgttcgagatacaagtgccccccgagatcctcaagcacaaggaacatgacaccgtacagctccggtgatatataaaatgacctgacctacaacacgaaaaatcagctatatatgccccagaataggagagagaatcgccagacaaggggtaagaacagatatcttggccatcaggactatttggaccatgcaacggcatcaatttcggattgggcactccggtacagctcgagcctctttgcaaggttagttctgcgttccatgactgctgggtcttcgtcaagaagtttggaaagctgcttcatctctcttgctccaagttcagtgaagaagtgatcgagcagcgagcgcttggcctctcgcacttgacaataaacaatagattttgggatggagttcctcaaggtcgaacacaccatattaacatatgacagaacagtttgtccaattcgtctaagataagagtcattatatctatcaaaaatagagtggcttggatttccacccttctcaacatcctgaggaagcttcctgaagaaaactactgtcaagtagctgcattccatgtcaactagcttta

SEQ ID NO: 13121 - DNA, 474 bp, Zea mays
  Clone ID: LIB3279-211-Q6-N6-B4
gtcaaaaaacagctttattgctcccgacatcccgagcaccttttacgctaacagaaccaagaggatgcgacagggttaaatccaatgatgcccgtcggaacgtcacgggctgggccgggaaccaggccgtttttttaccaactttatcaaagaaaaacgaagaaaatccgtttgacctttattaagggcccgaattttatacgtgcacaagcagggggccttatacctgggctatgatccatcttactaccagggcaagatcaggaagggactttacaaaggaagcaaacgaatgcgggattttaggagaaagggtcccggatcccaagaacaaaatgtttatgacggtttcctctctaaaacaagggggtcttcaaccacaccgtttatggggcaggcatgctgaaaaccatgtgaactgaaacccggatcatttgggggggacctctctgaaaagaagaaacaaaaacccgg

SEQ ID NO: 13122 - DNA, 134 bp, Zea mays
  Clone ID: LIB3279-211-Q6-N6-B6
gggagtacaatcatggcggcatgtattagggatagataaacgagtgatgacagaacaaagtaccaaaccatactactaaacaaaggctaaggatgtccctcagcaatggcacaaggagccagcccacgcgtccg

SEQ ID NO: 13123 - DNA, 581 bp, Zea mays
  unsure (1)..(581): unsure at all n locations; Clone ID: LIB3279-211-Q6-N6-B7
atgtgcacaaatccataccataatccagataattggttcgaacatgcaaatactatgctcccacggcaatggagaaataaaacgaacatgcaggcttaaagtccacagataggcaacttgttgtgaagacgcaggataagacagattgataaaaatactatttcgtctcaatacaagttcagcgacacaactactcaaaacttaactaggcctcaaaggccgcttcactgcgtcactccgagccacttggtgaagttctcaaactcggtgtagtcactgtccgagaccatggtcttgtaccacgccttgccggcagccttgaccttggcagtctccgaggtaagcttggtcctcttggaatcaagcttctccttccgggccttgactcgggcagcctcagcaagggtggccatcttccgggcagtgccgaggtaggggttgagcttgagcacagcagccatgttcgtgagcgggttcttcctcttctccctgcgcttcaccttcttgttgggtggcgtaaccacagactgcacctcgtcngagttgataatcctgcccaggtcagcgttggccatttgggc

SEQ ID NO: 13124 - DNA, 445 bp, Zea mays
  Clone ID: LIB3279-211-Q6-N6-B9
gggggggggggggggggcttcccttttgggggggggggggggggggcctttttccccctttcgggggcccccccggggggggggggtttttcgcggggccccccggggggccccccggggtttgcgcctgggggggggggccccccccctttttttttcggggggggcttttggggggggcccccctggtttcccggggggggggcggtcccccggggggggggtcccccggggcgcgggggggcccccccggggggcgcctcttttcggggccgggctcctcccttgtgggttttgcgttttggggggggcggctttttgcgccccccttttttcccccccccggtttttttgcgcccgcggggggggggggcggggcccccccccatgtggcccctctggtgttctttttgtggtgggccccgcgccccccggtgcggggggg

SEQ ID NO: 13125 - DNA, 423 bp, Zea mays
  Clone ID: LIB3279-211-Q6-N6-C1
ggcaaagcaagaataatctcatctcttatcgatttgaattaaaaccagatgacaacaccataaacaaaacatttagaattccaaattgctcatatcctcatgggctcttgtagtaaattgtcctaatctcctagcaagcccaagacgcaagcataatattaagcccagatccaaatgtagagtattactgaaacgtgttacatctagtgcgacttgacatactcctgcactatgttaaggccctcagattcttcaccgtagtccttgacaacgacacaggagcagcctacaaccttccttgccttgccctcggagtcaatcttgcaaagcccagcccactcgccaagagtcttagcagcaggaacagtgacaaggtgaacattgtgttcagcacagagcgccttcaccagcttgacataatct

SEQ ID NO: 13126 - DNA, 607 bp, Zea mays
  unsure (1)..(607): unsure at all n locations; Clone ID: LIB3279-211-Q6-N6-C11
gactgctgaaccacgattagaacttcattccttgccatttacagccagaacacagaggtctaactcgtagcacgcttaatttgttccacgtaagaatcacaagaatctcgacgcagaacagtaaagatacgggggacaaccagtgtggtttcttattctaatggcggaaagcactcgtctgaattcccatggctggagatatacagtccctcagctgtcgcttctgcttggcttgtctgacgccgggtacaccgtgttagctgacgggatccactcgttggtagcagggtttcccctgcaagaagcatgtcgctcctctgcattgggatcttcagacagtttgaagggggcgcctttagctttgtccatcttgatgaaacccgttccggtcgtgtggtgctgctcgccgacgccgccgaggtccttgtagtactccgtctccacgaactcatctcccacattggcgccctcgtacaccaacctctcggtgtgtgcttccagctcttggaacttgtccagctccgggtgggagttgccgccgacgtccgggacgagcgcgtcgacgtacacggnggagtgctcgctgcgggagggcttggtgtggcgc

SEQ ID NO: 13127 - DNA, 305 bp, Zea mays
  Clone ID: LIB3279-211-Q6-N6-C12
gcagaacaccgaattgctttgctaaagacgcatccagagttccagacattgctccaagaccgaacatccagtgatccatggcgcatgatcgggatactaattaccgaatatatacagagaatcaaacgctaccggatggactccatactcgaactccaacgatgatcagttcagagtttctcgcctcgacttccaagttccaagttccaagcagccaaccacacatcattgagcagaggaaccagaccactcagctgtccctggcctcctgcagcatttccaccaccttcttcatccggggccgc

SEQ ID NO: 13128 - DNA, 621 bp, Zea mays
  Clone ID: LIB3279-211-Q6-N6-C2
aagagaatcaaacaccagaaagctaatatatagtaacccaaccaattcgaagtaatacatgtataaactagtaaaactgtcttaaagaggaccatgatacagcaacagcaagacatttcataaataagtagcatacataagtgctagacataaaagctcccgtttcatcaaattgctcacaccaaaattgcaccagtcctttactaccagatccagtgaggtactgagcttatcgcctgcttgtctttccaagagtgcgtttcccagaaaacaaatgctttggttttaaagtgggaataacacggtcagcctctccacgacgagcttccttgttcctgttcctagtagcggcctttgctttcttgatagcctttttcttctgctcagagtccttgaatccttctccaggaaggacttcctcaggagcacgtgacctagacctagacctagaccttgatgtccgacgcaatttcttgttgctttgctggccatctatctccataccgtcaccatccgctgcagctctgctcactgacctctcacgcttgcgacccctagactgactgcgaattctattcatggcagcactaggatccatacccatggatgaaagctggcgtc

SEQ ID NO: 13129 - DNA, 496 bp, Zea mays
  Clone ID: LIB3279-211-Q6-N6-C3
ggggaaaaaaggaggcccaaattatttattgccccggtcaaatcaactttaaaatgaaaaaaattccatacaggcaaaagggcccccggggcttaagggcccccccaaaaggggcctaggacgaggggaacttggggacggccttggggccccccaaaacggggggcttgggaagccccccgggtaaaaaaagggggacggaggtttggatcccccgggaggggaaggggggctttttgttgaaacggggaaacttggccccctccccggggaactttttaaaaaagtccttgaaaaaagagttcaaaaaggacaaggccctggaggaaaagcccatgtccgggggcccccggttaaacaccttaaaaaaggaaaatttggacctttccaccctttttttgggctttttccccccctttttggaaacacccccttccttggcgggggattttcccgccgggagccgcttttccccctttgggtttttcccaagggg

SEQ ID NO: 13130 - DNA, 522 bp, Zea mays
  Clone ID: LIB3279-211-Q6-N6-C4
accaaatagcgtttattcaaacatgttctgataaagaagcaagccatcgatgttcgatggagcctcgtagtacaaggttcgacacgacggtaacaagcatacacccagggaggggcctatttgtgtaataggaggaacgcgcaggcggggtactaggcctgcttgcagtacacagccagatagatatgctccacctcagatattatatataataagctggccctgcatgcagggttggtttgctatggacccggcggttgctcaaaaaccatgaatcttgatgtgctccttcttcacaatgccggcctggacgaggaaattcgagacgttcttcctctgatcaccctggagctgaatgacctgtccaagttctgggtcctggaccactgtaccattgcagcagaactctttcttgagatctttgaggatcttgctgtagctgaactccttcttcaatccctggacggtggtcaggctcttgcgaccattacgctgctggatgcgcacgtgtacgtagtcctt

SEQ ID NO: 13131 - DNA, 599 bp, Zea mays
  Clone ID: LIB3279-211-Q6-N6-C6
cccattgaaatgattctgtaaagagtgtgtacaacacacatcaatctttacacattcattccaatcactaattcttaagcggtgaaaacgaaaaatctaccatccaactttcaccaccaggtccactccccttttcatgtcagactaaccttctaacaaagagcccactccaacatagcttgtacaccagggcagcccatcttcgggtgcctaggtgaaacggacgcttacttcccgtatcctacaattgggaagtagtggatgaaatggggaaaaaagagaaaataatttggggtggaaaatactttacacaaacgctgagcttctaccagagccataacggaagaagcttcacagatgttatagccagaaagacttcttctcgccatatcctgtgcacggaacacccttctcttcttcttcccttttgctaaaaagggtctggtctgaacaatccagacccgctccacaagctgtattgtacaattcgcatgcagagtagcatacccggagcctgttgtccccatcctcgtcacaccgttgaattgagatccagcaggctagccgctttgcagctgctgcacagttggcattgttga

SEQ ID NO: 13132 - DNA, 622 bp, Zea mays
  unsure (1)..(622): unsure at all n locations; Clone ID: LIB3279-211-Q6-N6-D1
cactacggaagattactctagtacactttatagatagagtgaaaatgcatacataaacatgacgagccaattcctcagccaaaaaacattatccatgcaacatcatataggttcgagtaacggtaaacggtcatccacatagagcaaaattaaagctcgtcttgacaaacacagaaaacagcaacaccacccagagagggctaacttcataatggccacccgccaagagccggcaaatggcacgcagagcctacagcctccttcccctcctaccgccctttctgcgagtgctgtcagtggggaccggggtaacgtcctcaatgcgtccgattttcattccggaacgagcaagcgccctgagggcagactgggcaccaggtccaggggtcttggtcttgttgcctccggtggcgcgaagcttaatgtgcagtgcagtaatgccaagctccttgcagcgctgtgcgacgtcttgagcagcaagcatagcagcgtaaggtgacgactcgtcacggtcagccttcaccttcatgccaccggtgatccgaaccagagtttccctnccagacaaatcagtgatatgaatgaaggtgtcattgaaggatgcaaagatgtgagcgacacc

SEQ ID NO: 13133 - DNA, 518 bp, Zea mays
  Clone ID: LIB3279-211-Q6-N6-D10
ggaacagtataatcttggttttattctggggtatcaaaaaattttcctttttccaaaaaaagaaattgccctcggaaccggccaatgaaattttgcaggacagtttaaccgccctgatcagcactgaaccaactgccaactgaatcattggtgggggcatattttccccctggggcatcataacggggggtctaagctgactctttattcttgcaactctttttttgcggggccaagaacactttagcatggcaacataatcttacagggggcaggggacaaggcggctaaatctaacataacagcaaacatgataaccgcaaaacatttattcactcagcccgaaaaaatctttgggcaaatattcatcaaaaataggttttcgcccttagcccgctaggggtattttgctgctatctcacccatcaggctttcaggagcttctataccaccggggaaatgcccaaattgacccatggcttggctaataaacatttccacaccactaacaactttaa

SEQ ID NO: 13134 - DNA, 576 bp, Zea mays
  Clone ID: LIB3279-211-Q6-N6-D11
ccaaaacaaatacttgtttagtagcaatccataagaacataagtaaaccgggacatccaacagacaaccaaactgacgacacaaacaaactgacgacgacacataagagtttgctgcgccacacgacatttaacagttttaaacaccgaccccaggcaggcaaaacaaacttattgaaataatattatcaagtttggccattagcagtagagcaggggggcttcttcactcgtcgtcaccatcttcatcagactcggcactctggagccactcgacgaacggcttggctttcttgacaacctgggagtccttcccagctgcgacagcatcattgtaccagtccacaatggtttcctcgtccaggatatctccatcgtagagggctttgaggacaacgggaacctccttcagcgcctcagggttgcacttcccaccaaaagcctcaatggcctgaaccagaagggtctgggcaccctcatctggcacagcaactgcaaggtacttcttgttcttcacaacctctttggtgaatcccttacccacaccaccaaagagagcctccaggagagcattcat

SEQ ID NO: 13135 - DNA, 622 bp, Zea mays
  Clone ID: LIB3279-211-Q6-N6-D12
cagcttcgcgatggaaagtctggcggtgctttattcttattcctcggagcaaacagagtacaaacagtcggtgctctcggcgacaataatgaaccaataggtagtttgtacataggggatgaataccttaaacaatcaatttgacaaaaacaggcggagttccttatggctgcagtgcaggcgtgcagccggcaaccattacatagaagcagccgtaccatcggcagatgagtcgattaggctgcagtctggccaaaaagaagcttccggatctctggcaatttcttgcggaaaacaacttctagtcttgcgtcaagtgtactctcaaacacaatctttccatctcgagaagccaatacaatacctccagagcaaaactggccatgagcatcatgatggcttggggcaggtggcaggtatacatcatgatcaacaaatatctctggttcatggacatctgcttttgatgcatactcatgctttgctgaatgcagcactgattccacatgatggtgatcatccttgcggcaacggagcaatactgctggctctttcaaacggagcaaaccctgaatgattaggtctttcaaaaggttcttgtattcatgggtggttgtggctg

SEQ ID NO: 13136 - DNA, 549 bp, Zea mays
  Clone ID: LIB3279-211-Q6-N6-D2
ggaactgaaaataccatttatattacggattagaacatccctacatgtctggatagatttacatacatagccacccccgtcatcatcatcataatggccactgccccggccggctgccggcgggagacctcgacggccgacccaaaatgggcactattccccctcccatcatcttcttctctcttcggtctctcacagccacgagccatcatcgatcacggccgccgccccggcttggacaggtagacgcggcactggatcagtgtccgcccgactctgaaccccggcagaacggtgaaaccgaccacgcggtcctcggcgtcgtcgccggcgcgcccgtcgctggcgctctccatgtacacctccgagaatcgcgcccccgtgcgcacctggaagatggacgcgccgtcctcctcggcgccgccgtcgaacgcgaagaagaggcagtgcagcagccacacgcggggcgccatctccgcgaagtccgcgaaccacgagctctccgggaacccgggcccggcgctcacgatgccgcgctgttccagccgc

SEQ ID NO: 13137 - DNA, 549 bp, Zea mays
  Clone ID: LIB3279-211-Q6-N6-D3
atcaaaagataaagggagtagagtaactttattacatcatctagatcaaagtatcttaacaagtataattatcaaagtacggcgtaattaaacatggacactcttccacagaaatgtgactcgcgcatcgttagacttagtactcgtcgatatcatctgcaatgtcttcatcatcaccctctgatcaaaatattagcaaggggtgagctcacttatggttggggctcagcaagtgggaggaataatgcaaagtcaacaaggtaggatatggataagcggtaagtattttagtaggtcaatattttattaacaacgcctgacttactagttgtaagtgtatcccaaaattcccaattaaacataagtacatgattatatcaaaagcacctaagtgaaaccatttaagcaaaccatctatgaatcatcggataactagtaaacaaaataaagcacctaagtgacatataactagtaaaaaaataaagacattggttagtcaaacacaggtcataaggtctatagtattgtgccttaactactacagtttcg

SEQ ID NO: 13138 - DNA, 469 bp, Zea mays
  Clone ID: LIB3279-211-Q6-N6-D4
aaaaaaaaagggggggggggggttaaaattccaaaaggggaaaaagggggggaatttggttaaaaaggttggggcggtttcaaaaaaaagggaacaaaaaaggaacccccaacaaaaatcaaaaaaaaaaaaagggggggggggggaaaaaaaaaatttgggggggggggcctgttccaaaatttgggaaatttaaggggggggggggggaccccggaaattcgggacgggccccggggggggaaccatttttccttaaggggggccaaaaaaaaagggggggaaaaaagggaaaaaagcggttcccggggaaaaaaggaatcccccaaaaaatcccaaaaaaaaaaaaaggggaaaaaaaaaaaggaaaaaccgggggggcccaagggggggaccaaacaaaaaaaaggggggggggcccacggccggttttcggagggaaaaaacggggggcccccttctttaaaaa

SEQ ID NO: 13139 - DNA, 448 bp, Zea mays
  Clone ID: LIB3279-211-Q6-N6-D5
aaaagatcaaaaaaaatgaaattttaaaggttgaaggggccaaaagggaggggagggggagaggggaaggggggggaaaggggggggaggggggaaaagggggggaagggggggggggggggggggggggggggggggggggggggggggggggcgtggaggggcggggggaggttaaaagaggggtaaaaaattaaattgaggtttaaatgggaaagcagtttaaaaattgtgggggttttcggggggtttggaaggcctaatgggggaatggtttgggaggttggtttttttttctttcaaaactttggggccccctggacctttccggggccctgcgccgcaaaccggggaaggcgggcgagggccggcgggggcccccgggtggccccgggggggctttttgggcggcgggtgggcctgggggaaaatggggggaaagggggga

SEQ ID NO: 13140 - DNA, 597 bp, Zea mays
  Clone ID: LIB3279-211-Q6-N6-D6
aattctcaatactggaatgatgaaaatcataatagagggactagccaaaatagtcttcataatctctcacattaatttcacattgcaaacaaggtttcaggctaggcattaaagtctaaacattatggtaaagcagcagctagatatagaaccagataagcagatccattgataggaaataaagcgaagaacacccacaacgatctgaaaaatcgagatggagcaggcagccgctcaacggtacgacttctggaacctggcgcgggcaccacgtccgccgaacttcttcggctcgcagcgccgggggtcagcgacgaggagggtgcgatcgtagcgggtaaagatgtccttgatctccttcttggcggcctcgtcgacgtacttctggtagtaggcgacgagccccttggcgacggcctggcggatggcgtagatctgcgacgtcttcccgccgccgcggacgcggatccgcatgtcgatgtccttgaaccgggaccgccccgccagcaggatgggctcgaaggccttgaggcggagcatctccggtcggatcagctcaatcgggacgccgttcaccttgatcatgccgcgccccgg

SEQ ID NO: 13141 - DNA, 444 bp, Zea mays
  Clone ID: LIB3279-211-Q6-N6-D7
gtatcttccttgaggtcgagtaactttagtaacttcatgttttgctgatatgtctttcttgggtgtgatgtcaggtgaatcactttctacagctgcaacctcttcttgaacaggattagctgattgcactttcagtttcttcaatatgttgtcaaattgggtggtatcgtatacccatttgttatgagggctatctacaccaacacctagtgtgtcctgcttgtttttcaccctaacatgaccttttatgccttgcttgtctttgccaaggccttcaccttcttcccatcccatttgcttcataaggcggaaggcggcggactgccgcgcgatcccgacgtagcatgcgggcgcttcgggagcagccatggcgcctctactccgttggatcgtcgcggcttcaccgccgccgggtaggagccgcgctctctccggacgcgtggg

SEQ ID NO: 13142 - DNA, 502 bp, Zea mays
  Clone ID: LIB3279-211-Q6-N6-D8
ggcccaaagcaaccatttggttggttttaaaacaatgaaacgaaatgacaatttcgattttgcttttgggcaatatatcaaaaaaaaaaggggctccgggttcatgctaaatcgggtacttacacaagagctactctcggcgctacgggggaaaacaagggaagaagattaagaagaggaaaaacggacatcgattctggacaaatctgggtggggggctgcatctttacaaagtcagttgcttatcggacaggaaggggctggggtcacaaaacaaaaaccttggcgtgactcgcgaggggcctgtttgcaggcctgcagggcagctaaactactggcggggcgggcagctaaactaccggcgattttgggggggggatcccgggccccaaggaatatgctttctcagcatcaggcaaccttggtgggaacatcccccattttttacgacagggtgctttaaccccttcccatggggcttttccattttttgccttgccct

SEQ ID NO: 13143 - DNA, 598 bp, Zea mays
  Clone ID: LIB3279-211-Q6-N6-D9
aaaactaaccatttccatcatatcagatttacttgaaccgtactaggtacaaatccatctatccgttcttcacaatggtgaatgtattgctggattttgctatgtactaactcttttccccccatgtggcctgtgcctttgattgattcgttcgttcattctatgtacaaacaatcatccctaaaatcgctcttaataattccctctagtaatgcttgtcgttgggcgcacgccggggctttgcaccgatggcgccacgcagggcctcggccagcacggcggcgtccgggttgctgtcgaagaggggctccggcggcggagatggtggtcggcgcttggtcgcgaaggggctccagccggacttcttgctcctttgctctgcattggatccttcaggtttctcagatacgacataacggaggacatccatgaagaaggctgttcctttatccgcaaaattcttcatgtagaaggaaattaactgcccagattttgcccttagatggagcaatctctgctcgatgttcggttcatattgcataactatggggcgaagaaagtgtcatatacaacgtcacttcccttagttttggggtac

SEQ ID NO: 13144 - DNA, 132 bp, Zea mays
  Clone ID: LIB3279-211-Q6-N6-E1
gaaacagattctattatttatgttggcagaggggggccacactggcggcgtaaagaaaacaaaaatcacagaaccccgaaacggcaaagggaaaaaagagggggcggggggaacagaaccctagcgaaacca

SEQ ID NO: 13145 - DNA, 637 bp, Zea mays
  unsure (1)..(637): unsure at all n locations; Clone ID: LIB3279-211-Q6-N6-E10
ggtccatcttcatctttttttttctattgtcgaatcagatctcacgacagcagcgaaactctcgtaagaaatgaaaaaaaaaacatctctacaatcctctgtctcccatctccatacagccccaaaggcaggcatgatcatgaacccatcattagccaatcaaatcgccactggtcgaggtcgatccagtaaatcacagcgcgatggtgaggcggtcggcttccgtgctgcggagcccgagccaggaggccgaggccgagcccgaggccggcttgaccgcctccgcgggggacgacgggcgggcgtagggcgcgcgctcgacgaggcgatctttgcgcttggccaggaaccgctgcagcgacgccttccgggcgatgggcaggtcgtcgccggccgcgaggcgcatgacctcggccgccttctccgccgggaagtcctcgaacaccaccaccctgccgccgtagaagatggtcagcggcggcgccgcggcgggggcgggcccgggcatctcctcgtccctcgcggcggccggctcctgctgctcgtcggcgccgacgtccgcgccgggcatcaggctcanggtcgtggtggccggggcgcgcggngccgncatctgctgctgctgctgctgctcggc

SEQ ID NO: 13146 - DNA, 591 bp, Zea mays
  Clone ID: LIB3279-211-Q6-N6-E11
agccagaagtacagtaaattcatattcataagaagttactagcaaaatcgagttgatggtacaaagacgaaaatttgtaaggcgattgatgcctaacaagtaacagtgaacaatattgcaacaatgcctaatcaaaggctgggctgattggcctaattctctaacctcaagtaggtacaatctccggagaaggcggcaggaagcgaacgaggatggtcccgatggctatgcatagcagtataaactggaccgagcagaacaaggaggctctgctagctctggcctgcagcttcagaacttctgaaatctcagacagctccttgcattgcgagtctagtttatccaccatatcctccagcatcatcgccctgttctcggcatgccgcaatttggtttctaaggatttgtgatccgtcagaagggatttctgtgcctcgttaagagcaaattgattcttggccaggagtttccaatcgtgcgaagctcttgtcaggataaaacactgaatctctgcctccatcttctccaagagcagttggtctgcatcagactgtaaagacagcagatcatcgttacatgctatggtatcat

SEQ ID NO: 13147 - DNA, 585 bp, Zea mays
  Clone ID: LIB3279-211-Q6-N6-E12
caagtgaatccacatttcatcatatttagaggttcagaacaaagaaatgcagtacaagtcgtatgctactactggaccaaggcactagagtctagagtgataagcctacgaaactaagcccatgggcaagaatactctcgaatcactccatttcgtgaccgcgacccaagacttctgccacgaccagcagcagctggcggacacccctgacccctcagccgccaaatccgtagagggtgcggccctgccgcttgagcgcgtagacgacgtccatggcggtgacggtcttacggcgggcgtgctccgtgtaggtgacagcgtcgcgaatgacattctcgaggaagatcttgagcacgccgcgggtctcctcgtagatgagccccgagatgcgcttcacgccgccccttctcgccagcctccggatcgccggcttcgtaatgccctggatgttgtcgcggaggaccttgcggtgacgcttcgcgccgcccttgcccagccccttcccgccctttccgcgccccgacatggtcactcgaactctgaggagaggttgacaattgggaatttggaggtagggtatggtcg

SEQ ID NO: 13148 - DNA, 587 bp, Zea mays
  Clone ID: LIB3279-211-Q6-N6-E2
agcaactcagcttagatatgattaactcaaatacttccaacaaaacagcataattgtgcaatgcttagctttgaattcttgagctggaatggaacaacacaaatgtcttgggatactaaagaagtagaaaaatctgaatgaacattgccaacggactcttgggatactaaagagccgagtaacagctcatttcagaggaataaaccgcgaggagtgggtggcaccgataccgggcctgccgtgcttgaccggcttgtaggagatggagaactcagcaaggtagtggccgatcatctcaggcttgatctcaacctggttgaaggtcttgccgttgtagaccccaacaatgcttccaatcatctcagggacaatgatcatgttacggagatgtgtcttgactggctcgggcttctcaccagcaggagcatcctttttcgccttgcgcagtttcttgatgagcgccatgggcttcctcttcagacccctctggaaccttctcctggcgcgcgcggggaagagctggacgaggtcgtccgtggacatgtcgagaagcgcatctaggtcgacgccgcggtagctgtacttgc

SEQ ID NO: 13149 - DNA, 452 bp, Zea mays
  Clone ID: LIB3279-211-Q6-N6-E4
aaatatagcaaaggttttacccaatgacgaacaaacaatgtaggcatgaacattatttttggaaaggtgttatcacaaccgacaacgagcactttcttgccttggaaggcctcccttccctattgtagtcactcgagtgcataacttgcccttaaagctatcgattcactaagtgccagacataataggctatacattctctctagtggcaacaattagccattttggttggtgtggtactctattattgagttttttggcacggtacttccttgtagagtagaagacaaactcttcaccattgtagtcgttgatggggctggtggtgatgaaatccttggtgtggatgcaccggggaatcactattgtactcggcggcaacgacattaagactgaagaatgggcagatgtcgaattgaagcttagccctagagataaagttaacctttttc

SEQ ID NO: 13150 - DNA, 537 bp, Zea mays
  Clone ID: LIB3279-211-Q6-N6-E5
aaaatgcacaacagaacgacttattgtgttgtccataaccacatttcaacacatcatccactttttagaacaaaggacatctacgtgttctgttaaaatacgatgcataaaaaaattgacaaacattatagctaatttaatgtttaatagtaactaatacctcgatgcccttcttatcctaaatcctcaattagctggaaccttcctgttaggctcaaagacatatttgatcaaagaatccttgatggacatcagttgagagaactcggccttcaatttcgacgcatccatctcattgttgcttctaggggcgactatgaccttggattgctcttcgagtgtgaagttggtccacttaaaatcaggattgatgtatttcttgtacatctccagaatctcattgtggctgacaacgccagggttggtgaagttccatatgcccctgcagtcccgttttgccatctcaatggagatgggcagaagctcatccaaaattgtcatgctgttgggaatgttcaccaccttgtcgtaacgagc

SEQ ID NO: 13151 - DNA, 578 bp, Zea mays
  Clone ID: LIB3279-211-Q6-N6-E6
gaaaagaaatcgttttcaccaacaaaatcttaggttaacaattgcacgaatgcactgcaaacatagcaagcaaccattcttcttaatcatctaacgccctcccgtttcaactccacgcttgctgattttggtagcaagagcaatctaagaccttggcttctctttcttctccttgaaaagggcaagcagagacacaccggaaaccttgacgaccttgaaccggacaccaggaatatctcccacagcgtgccccttacgaccaaatccagcaatcaagacctcatcattttcctcaatgtagttcaaacaaccgtcatttggcacgaaggcagcaatcttcttgccattcttaacaagctgaacacgagcacacttacggatagcggagttgggctgcttggcctcaataccaatcttctccaggacaatgcccttggcatgggatgacccagcgaagggtttcttccactcattgcccaaatggctcttcttgtatgccttgtcagcccaccgctggttcctgcggtgggtcttgagcttgcgcccggctcccataccacgtgtcttccccatgttga

SEQ ID NO: 13152 - DNA, 550 bp, Zea mays
  Clone ID: LIB3279-211-Q6-N6-E7
ctgactagcttattcttaaaaccaaagaccctaagtaaaccaaattagtccatgcagattaagtgcccagatatcttaagagctattgtattacgagctgaacttacagtccaacacagtggttcagtacagaacatagataatccagatttaaaacatcggtgccggaaacgtctcgagaggcaaggctgcctgaaaaggtacataaaagagctacggctataatacttcgacaaaatggcctcgatcagcatgctgatatacttcactgcttccttgctgcgacaatgttgtcagcctttttcttcacaggctcttccttctctgacaagatcagctcaatgtggcaaggtgaggacatgtagggattgatgcgcccgtgagcacggtaggtgcggcgcctctgcttctgggcttgattcacctggatgtgtgaaacatagaggttgtccacatccaagcctttcacatcagcgttactctcagcattcttcagcaaatccaggatgaacctggctgatttaacgggccagcggccctgcccattgga

SEQ ID NO: 13153 - DNA, 548 bp, Zea mays
  Clone ID: LIB3279-211-Q6-N6-E9
gaaggatgcggaacgcattgccttatttaatcaacatgggaatgccaccccccaactgatgggtgatccggaagcaaactacgatttaaccacgcaacagctgatctctgaaatggtgactccggtacaacacattacgcatacggggcaacccatatgaagagccccattctaggaatatttatcccccgaccactaaattctacaggggatggcgaaaactggaacatgttccggcttacatcacgcaaaccagtccaccgattcccttgcttggcatcatcatgccggtttggcctttgatagcgccttcttcctctgggagagcatgtaacgggacatgtgtgggcttcctggaacatagatcaggagggcaaggacagatgaatataaccaatcgggtgagaagttccatttgctgggcatcctaatacagtatttctacgatgccttcatgtaaggcaaggcaatgtacatcacaccaacttcactagagataccagccggatacaacaacataaaggtgcgtggcctaagccataataacc

SEQ ID NO: 13154 - DNA, 631 bp, Zea mays
  Clone ID: LIB3279-211-Q6-N6-F1
cgccctccccctacatatttgatttcttctcctatacaaaaactagcaagacctactccattggtaattccatcaatgacacctttatcaaaaaaatgcgttagttcggctaatcttcttatacctaggataaaaaccctagtatagaaaaaatctatataaccacgattatatgaccagctgtatatctttttttttacttcatccaaaaagctcttttttggattcttttttacaagggaattttgaaaattcaaattctgaaaaaaaagaataagcagatccataaaagatatatgctatgaatagaccaaaaattgctaaacttacagaagaaattgcattagtgagaaattcatatgaatttatggaagaattagaattttcctggaacaagtttattgaaggagttagccactttgataatatggttaactccaatattctattatcttttactccattatcaaaatggattcctatggatccaatgaacaaagtaaaaagtggtaatataagaagaggaaatagcatagtatttcccgtttcatgaggatagacaaaagtatttttagccccaaaggagtactaaaggatcctatccttattcttgtattagcaggaatttttg

SEQ ID NO: 13155 - DNA, 526 bp, Zea mays
  unsure (1)..(526): unsure at all n locations; Clone ID: LIB3279-211-Q6-N6-F10
cctcccccccctttccgccccccccttttccccccccccccgggggccccccccccccccccggggggggggcccggggccgggggggggggggggcccccccgccgggggggggggggggggcccccgggggggcccccccgggggccccccccctcggggccgcccccccccccggccgccgcgccccgcggccggggggggccgccccccccggggggggccccccggggccccccccccggggccccccccctgccccccccgggccgggcgccgccggggggggcccccccccccccccggcggccccgcggggcccggggcccccgcccccgggccccccggctngcggggggctccggcccccctccccccccccccccccccccccgcnggnnccgccccccccccccccggggggggcccccccccgccccggccccgtcccnggggcgcgcggggggccgcggnctcgggccccgcgcggcgggggggccccacggggccaccgcgggggcccccc

SEQ ID NO: 13156 - DNA, 626 bp, Zea mays
  Clone ID: LIB3279-211-Q6-N6-F11
ggaaactacaaactggaactggattcctgtaagtgggacactctgcttcagtccgtcttacaaagaattcatcgtccctattattttaaccaatagatagataagtaacgtaatcctagttatatataatggctacagcaggttccgatggttcgtactcagtccgtacgctctacacttcatgtgattgacctccattctattcatggttgcacgattaaagaacttgaccaacgcttcaacaacagcgaaagaacaaaacttcgctagccatgtgttccacaagttgattggttagctgctaaggtgtcatttgtatccggttcccaaatggtggcattgctagtccagcaatgagaataacggaatccccttcgcattgaaactagaacatttcactactagttcctgtccaacttcaaattcctttaggccatttgcctcaaatttatgcattccacgcacaccatcactcaactcaagtcctagtccataggctcgaatctggtagacctttgctgtaactacatcacccaacttcattgccccagattggaatttcgtgggactctgattctggtcagaaagtgtgtcagcactctggtctggaacatcagaacccactg

SEQ ID NO: 13157 - DNA, 557 bp, Zea mays
  Clone ID: LIB3279-211-Q6-N6-F12
acatggtaataacaatcattaaatagaaaacagagaccataagagcagagcggaataatcccttgagagtcacgacatgattacattgcaggggaacgaaaccaaaccaaatctcacgcacgcgcgcaacgcagcagctgctgaaacaaaaaaggcgacccgaaccaaccaccggcacccaagtcgatcgatgatgtcattctcctcgctcacgacttcccccgcccgtaggtcgcccgccattgctccacagccaagccccgctcatcacgcgttgctcctgaaggagccgagggccttgatggcgccagcccggaggatgtactggtggtagaaggccgcgatggcagcgcccacgagagggcccacccagaagatccagtggtcgtcccagggcttgtccttgttgtagatgacggcggcgcccaggctcctggccgggttgatgccggtgccggtgacggggatggtggccaggtgcaccatgaacacggcgaagccgatggggaggggatgccagaaccggacgtgggagtcgcgggcgttgcgcttggggt

SEQ ID NO: 13158 - DNA, 414 bp, Zea mays
  Clone ID: LIB3279-211-Q6-N6-F2
gggcccacccttgggggtttcaacccctagataaggtcccccctaaggggcaaaggggggggaaaactttttccggggctttctggggccccccaaaacccttcgcgccttatttccgggcccaaaaaaaaggggggggggaaaaaaaccccccccctccccctgggccccaccccccttggggtggccggcttcaacgggcggggggggggcccccggtaaaaagggccgaaccctgggtccctggggcggggggcctgccgaattttaccctttttttttttaaggggggcggggcccatttcccccccggtaaaaggggacccctgaaaaaggggggggccccggcgaaaaaacccttggggggggtccccaccaaacccttgttaaggcctacccctttgggggggggcc

SEQ ID NO: 13159 - DNA, 499 bp, Zea mays
  Clone ID: LIB3279-211-Q6-N6-F3
ggacctccaactagaacttagaaacaataggttgcatgtagattgcattaccctgaactagcaaaccaccagactgacagcctcacagatttgggagggtgtcagggcaagttggataacacgaacaagttgggccttaaagccttgaaggtggtcttcagcttcctatttggtggcctgacttgttgcagtaaaccaaaggaaacttgaactttgaattgtggaactgcttggtgttgtcccttttgcaaagcttaaagttgattgttgccgtcttgatgatctgtatgtagggtgaccacacgatgacaggaagccgtctcattgtacatctgctccatggcaccattcagggtggtattacggtactccttgtgcaggtcgtggtaacctgtcctgcactggtaacacagccagatgccacagttcttgattgttgtagggttacactcaaagatctcgtctatggcgagaatctgaccgttgctcttaaaccttc

SEQ ID NO: 13160 - DNA, 610 bp, Zea mays
  unsure (1)..(610): unsure at all n locations; Clone ID: LIB3279-211-Q6-N6-F4
agttcaaaaggtcacttggatgatatcaaattcagaagtgtgcataacacatggtaatggaacgattgagagccatagctacaaaactctggtttcacatagaactaggacacaacagatgaactaggatgcctaatgcagcacttagatgatgccgattttgttggccacatcaagagcatcatagtcgggagtcagcttcacgtaagccttcttcttcccatcaggcctgatcaaggtgttgaccttctttgcctggatgtcatacatcttcttgacggcagccttgatcttcttcttgtctgccttgaggtcaacaatgaagaccagagtgttgttatcttcaatcttcttcatcgctgattctgtggtaagggggtacttgagaatttggtactgatcaagcttgttccttccggtagtgctgattcgtgggtacttggggtccctagccttcttcagggtcgtggggcggtgaaatgtcacagacgtgcggatcttcttggtcttcttcttggctgccccagacttcacagccttggcaaccttcaaggcctgngtcttggcatcacccttcttggcaggagcagctttaggagccatttcagct

SEQ ID NO: 13161 - DNA, 571 bp, Zea mays
  Clone ID: LIB3279-211-Q6-N6-F5
cacacgaaatcaggacaacacatgaacattccaaggcacagttaatatgtatcacatacaaaccataacgctaaactttttctgcacacacctaaccaaccactattatcctgtaaacagatacactgatgcacaccactactcttctgttctagaacctcaagactatccttgaacagagtcacacctatacaatcttcgacgacagttttgttagtccgttcaatggcacacctgtcttctgagctgacggcgtggcaacttttgctttcttatcagatagaggagttttcagcacgaaactttcagcagctctcttcttgcctgcctcatgcttcttaggagttgaagtgtcttcctcctcatcgtcactggtatcatcttcatcacttgaatcatcatcatcgccttcttcaggagacaaaccctcaccctcatcagaatcgtctgtctcgtcctcgttagaatcatcagtctcgtcctcatcagaatcatcgtcatccttgctcttcttggaagccggacttgattttgcccacgcgtccgcggacgcgtgggcggacgcgtgggc

SEQ ID NO: 13162 - DNA, 615 bp, Zea mays
  unsure (1)..(615): unsure at all n locations; Clone ID: LIB3279-211-Q6-N6-F6
gatctaaacacaacgttcttcacattgccctgatagaattatgtaatgtaatgaacagtatcaacatgacaaccttacctttacatacattttattagattttttttctcaacaaccaagaacaacagctattgtcgtttcctcagcacaaagaaacatggcagctgccgcctagggcttgggagggtaaaacccgttcacagtcatacctccgtcgaccgcaatcgtctggccgctaatataagtggaacccggcatgcaaagaaaagcaacaagtgccgatacttctccaggttctccgacacgtccaagcggagttcgactcacaacttgttcctcaaagttcttatttgccaaaattccttccgtaagtgaagtggtgatgtaccacggagcgacagagttggctcttatgttgtccttagcccattcacaagctaaattcttggttagctggttaatggcacctttagtcatagcatatatagttccactaaagattcctatcgctccagcaacagatgatatgaatataatgctgcctgacccantaatttcaaaaaaggatgtgcaatttggcacaagtgatatgcagattcaagattagtagccatc

SEQ ID NO: 13163 - DNA, 608 bp, Zea mays
  Clone ID: LIB3279-211-Q6-N6-F7
aacgcgcgccatcaaacatacaattataaatatggtatgctaccaagaaaatttaagcatccgactacaaaataacctttatgttagcgaccgatgcacatgtaactgtgtctttgaccaccccatcggaggcgagctacagtaaacaggtggtcacacttgacagtctgaactactgcccccatctccagcttgaactaacagcagaggattgctctgtccctaatctgctgcaaactaccctgcttcccccttcgccttgcagtccggtccgatcttgcagaagcagcagctgaacagcttggcacggcgtttctcccgcgtccggggcttttgacggggagcgcaagcaccacagggtaaaatgtgcgagcagcagccaggacgaaccccgccatcatcaacctttgactcgtctccggcagcggcggcagcggctttcaggggagtgtttcctggggtggatgctgcagggacaacggagatcttctggtagctcaggatcctcggctcggtgtccacggcgtcgccacccgcgccgccatggaggcaccccaggatgtgggacgatctctccttggcctgccccaaggtggggaagggcagtc

SEQ ID NO: 13164 - DNA, 518 bp, Zea mays
  Clone ID: LIB3279-211-Q6-N6-F8
aactgcaagttctaccacatatactgattagtcaaaggtgcccaaaggtaaagggaaccgaccacaggtgtacaaccaaacaattcaaagtggtagtcatttaaagacttcattccatggcaaatatctccagtctatttttatcaagcaaatggcaacggattaggactgaagtatgatggggttattacacaaagaacagcactgcgctctcatgcaccgctcgcatacaggcgagtccactccttggctgtttcaacagcttctacctcattggatttccagtgctttgcaatgttatcggaaagagggtcatctggatttggtgcactcagtagagcctgtatactcaaaaaaactgttcgaatctgaagtgctgggctccatttgtccttgagaatgtcgaggcatatcctaccaagcttgtcaatgttgggatgataaatcttggtcaaaaacctaacctttggggcagccatgggatattcctcaggtaaaaagattcaagcttaaaaact

SEQ ID NO: 13165 - DNA, 559 bp, Zea mays
  Clone ID: LIB3279-211-Q6-N6-F9
aagcatcaaagaaagcaagacacttcctcttgttcccattaaacttccatggggacccatcaccaagcaccactagagctaggaattaaactagaacttaggtcaatcgtagcacattatagttcagacgacgcatcgctacacacacttgcaaaatggtaaaaggcgtccacgaccacaaacacaagctgatctcagaacgggatgagtgagagcaagacgagtcactacttcttaggcgacttggcggcggccttcttgggggacttggggccagcggcagcggccttctcggccctctcggcggccttcttggggaggaggacggggttaatgttgggcagcacaccgccgtgcgcgatggtgaccccacccagcagcttgccgagctcctcgtcgttgcggatggcgaggaggaggtggcgcgggatgatgcgggttttcttgttgtcgcgcgccgcgttgccagccagctccaggacctcagcggcgaggtactcgaggacggcggccaggaacacgggagcgcccgtgcccacgcgctgcgcgtaccgccctt

SEQ ID NO: 13166 - DNA, 577 bp, Zea mays
  Clone ID: LIB3279-211-Q6-N6-G1
aaaaaaaaaatcatatagcatgtatctgtgaaaataaatagctttgtgacactgacacgcaccagtgccaaagccaaacaacacagaacatcccaagatgccaacttgttctagcaactactacattacattttcatctttctaaaatggccacttgggtcaggccagcaaaggctgatcagccaaacctgccccagcgccggtaatccttactgaagtccgtcattagctgtgttctttactttcgtacaacctatttatccatgcgaaaaaaaaacccggaatgataggggcccaaaacagaacacttccacacatggctgttgagtatcgcagttttgaagatggtgatgctggatcatcgatcactggctcgcctccttggacaagctcagatcaggattggcgatctgaggtcccagcccaagccatggctgaccatccgacatctccttcttcacaggtgtaacatctgaaggggaacccgggtacggtgctttcgcagtaaggcgatcctttctcttctcaaggaacctgcgaagagatgccttgggagcctgcggtatatctgctgcac

SEQ ID NO: 13167 - DNA, 56 bp, Zea mays
  unsure (1)..(56): unsure at all n locations; Clone ID: LIB3279-211-Q6-N6-G10
gggggggtgggtntgaggggtttttaggtggcggcggggggggggattttgggggg

SEQ ID NO: 13168 - DNA, 605 bp, Zea mays
  unsure (1)..(605): unsure at all n locations; Clone ID: LIB3279-211-Q6-N6-G12
tttttnttttttcaggtaaataagaaaaccagtgacacttttttgttcagtcctatacgagtcaagaattattctcttcgtatagagaggttcaaataaattagtaaaaccaaattaattttcgggaagataaatacttgggtgcccaagctttaaagcaccagtatacatactcgtagatacagaagcatagcagcagctcagctagctggcaaagcatcaaagcgaatttgtacagaagctcgtcccagacgttgaagtcagttctgtgcatggtgacggctgcacgtcgagagcgccaccgctgacagcctcgcacttccacggccagacaggtgcgccaccagtgaacttgacgttcgacaggcagatccgggagaaggccgagttggggatgcccttgatcagcccagcctccctgacgttctggccctggacattctttaccgtaagggcgtcgacgatcgggagcgcactccggttgtagctgtcgtcggggtgattgccgacatcgccaacgatccgcaggccgtaccggacgttatccagcgtcacaatccgagaagtgatgttcctgatgaagccgcccctgcctgtgttggtct

SEQ ID NO: 13169 - DNA, 582 bp, Zea mays
  Clone ID: LIB3279-211-Q6-N6-G2
ccattaaccgttttcattcatacattaggagaaatcatttgaaacaggatacatccataccgcgaaccctcgataagacttttaaactttgatatgaaatacttggattcctctgttacacaagttctcactaggaattgaaaatatcctgttcactagaagccttttgaaatgataaggctaccatattaagcgtcactgatagtcacctcaacctcgacacctggttcaatggtgattgaggtgatctgcttgacaacgtctggtgtactgacgagatcgatcaccctcttgtgaatcctcatctcaaagcgatcccaggtgttggtaccttcgccacagggagacttcctggtggtgatgtggagcaccttggtaggcatccgcacggggcccttgaccttgagctccttacccttggcgcccttcaccagatccccgcagactttctcgaggttcttgacgctcttggaggagagcgtgatgcggatcctgtgctgcggatccatcatgccagcttcgaacccggccttgcccgccttcatcggcggcgcgtacgccatatccgacgccatgggtcgt

SEQ ID NO: 13170 - DNA, 596 bp, Zea mays
  unsure (1)..(596): unsure at all n locations; Clone ID: LIB3279-211-Q6-N6-G3
gagtcacaaggatcgtttcacacgctctttccagttttaagattaaccaaaaatttccatgccagcaacgttggacaacagggtcagctagaaagccccaaaacagaagtgctcaaagcaaagcaaagcatagctatagcagatgccaaaagattctggacatctagacttcacaaaaaatactgaacttaagctgcagaagactagacttcacaaaaaatactgaacttaagctgcagaagactagacttcactactgaacttaagctgcataagacaggtctcatagtagactatgcctactcccagccttgggctgtcggcggggctgcttggtcccaaccagtaggagcaaccactggaggtacagtgccgtccgcaggtacaggggccccggcttgatcccagccttcaccggtaggaactggagccggagcagcaccccaatcagcaccagtaggagcaacaggcggcgcagccacatcagaggtccactgatcaccaccccactgatcagttccttggtaatcagtgattgcggcaaactcaggggccgcggcagcttcctcctnctgctnctttgcttcctctgggtc

SEQ ID NO: 13171 - DNA, 607 bp, Zea mays
  Clone ID: LIB3279-211-Q6-N6-G4
tcgcgatctacatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattttgaggctagctaaatatgaaccttttgtctcttaagttgttaaataaagcaaattatctgacaaaaaaaaaaaaaaaaaaaaaaaaaggccccgctcgc

SEQ ID NO: 13172 - DNA, 578 bp, Zea mays
  unsure (1)..(578): unsure at all n locations; Clone ID: LIB3279-211-Q6-N6-G6
ccaaaccaacttattgataattaatactagaaagtagagagacatgaaagcatagaaatatacagggtccagaatgtaaccaccgataatgataagtcaggtgggtacgacacccagcaaccccttgcacgctatagcaaaagccagctcaagccaggtgaatgtctcggtagcaatcctttggggatacacttcttttccgatttaagttgagatacagtagggttccgtctccaaagccaaggaagttacttggggccaacatccttcaacgcgcagatctgctcctcccccatcgcagactggacagtcacaacaagatccttcccgctttcgaacccttccttaatctgggccacaagagtctcatcagttgggagtctaagatcatccttagtgttgccatctgaagtaagaaggctcacaaatccatcctcagaaatatcaatcagctgatactcagtacggttcacatgcggaatgtcacagttgtgtgatgaaggaacaatatcttcaagctttttcccattgaatatgtctatggcgaccnagtgggatttggcgttgccatgcttacc

SEQ ID NO: 13173 - DNA, 599 bp, Zea mays
  Clone ID: LIB3279-211-Q6-N6-G7
gaatggaacaaccgccaccctctttgttaaagattgtatcctccagtattacatgttacagctttatatatatatataaatcacacacccagacattgtacaagagtcccaatgaggcacaagagttccaagctcgttatgggttgaatgctggaaccgatcggccgaccgatctggcaaatcaatttacctgtcaatcccctcaatcttgtcttcaacctccgaatagagctccctgagcctgtccaggttctcctccgttgtctcccagtagcctctgccactggcttccaggaaggtctgcaccaacttcctgaacgaattggggttggtgtccatgagcctcttcctcatcgcctcgtcctcgatgaacgtggagttggcctcctcgtagacccagttgtcgacctgcccagacgtggcgctccacccgacggtgttggtgagccgcttctcgatctccctgaccccctcgtacccgctcttcatcatcccctcgtaccacttggggttcagcagcttggtcctcgcgtcgaggcgcaccgtctccgacagcgtcctcacctgggcgttcgccgtggtggtgtccgctatgtacg

SEQ ID NO: 13174 - DNA, 469 bp, Zea mays
  Clone ID: LIB3279-211-Q6-N6-H1
gaaaggcaattcaacataatgatttttttatgattcatggggggaaatcatttttaacccgagatcacagcgttcctgccctggcaatgtaacaaaataaaccggccctggcaatgtccaaaataaactggcaacgtaaaccctgtcaacgaaatttttagcccctaggggagcagcctatgccctctgaaccaaaagggaaattgatttgcaattgccaaactagcagctgcccaatggccccgataaatgtttatcaacatgaaaccacaaagtttcggccctggcaatgtttaacaggaaaactaggtcaaaataaccccacttcaaaaaagttgcagttcgcgacttttgccccagcccgaaatccctaaaaaaacactgctcatcttgtcccagtgaaaaaaaaagcttcaaattgatacactatagttatttgacggatgcttttacagctttctctgcccca

SEQ ID NO: 13175 - DNA, 467 bp, Zea mays
  Clone ID: LIB3279-211-Q6-N6-H10
gcttgtcgcatatgggaacttagcatccatcgcctcaaatataggaatagaattcaccagattacatgttcgttctcaagggtctacatgagttctaaagaccaatttgctgctagatgtcgggggcaccaacaatttgggtattattcacccgagcgggcccaaataataataataataacaccaaaacgctacaattattattatgtcatggaaacatctcgctggcacattagtaggggtagcccttctggaacatgcctttcttgggatcatcggtctcgccctcaccagtgtagcgaccgagctgggccagcgagttggcctttgcgcgcaccagcagggccttctgcgctgcctccacgttctcagggcgcccttgccatgtcttcagcaccgagttctgcagagcccgggcctaggagaaccacacatgccatggggtcaaagactgggtcattgcattc

SEQ ID NO: 13176 - DNA, 573 bp, Zea mays
  Clone ID: LIB3279-211-Q6-N6-H11
caagcaatacttagagcgccaggatacttatagtagtaccaccattctgaaacatagtagcgccaggacgaaatataggatcgtccaaaaacatatccttaacaagagtttaattcaataaaacctcggtgccagaacctagcagacttcacaaaagagcatacttagaacaccctgtatggcttccccatggggctcttgacgtagaggcatctcacattctgccagttcttcttcagaagggaaacaaggaagttcacgctcatctggatgttctgctggatctgcttctcctccatcgccaagttgccgacggcgacgcccatgcaaaggaccttcttgagctggaacttgacggttgccttagtctcgttcaccttggattcgagggattcctggtgagtaaccagggtcgggaacttgcctgccttgttgagaccaggaccaaggagacggggaatctgcttgatgatggcctctgatgccaagaaagcatggtacttcttggcaagcctcttaacaagcttcttgttcttgttcattttcttgagagcctcaacatccatgtagtca

SEQ ID NO: 13177 - DNA, 570 bp, Zea mays
  unsure (1)..(570): unsure at all n locations; Clone ID: LIB3279-211-Q6-N6-H12
atgcacgccgtaccgtaagccttggnatcctnctnanaancggccccgccctcttnnttttttnntttttttnnttttttttttttnttttttttttttnttttttttttntttttttttttggcccccggtggtttatttttttccctcccgcctgggaaggggccccccncccaacctcccaaacacccccaagagccagcccattggggtggctgcccgcttgtncccgggcggccgggcggggggccctgggagggtccatcggctgtgcccctggggcccccggccctggggggnttgggtgggcccctngggggtcttgcagccccagntnncgggggggaagtcccggcacccggccttggtggcccccttggcccgggcccccgggccccannncttgccgggggcggcccccctggnggggagggcgncgccgggcccccccccccaccagctggggcnctcgccccccccgccccggttnttcnncnncggccctgcngggcctttggcccccgcccccgggccccaaagggcctgaaaaacctgggtcccccaccgggg

SEQ ID NO: 13178 - DNA, 580 bp, Zea mays
  Clone ID: LIB3279-211-Q6-N6-H2
acataaacacagatatgaaattataattaggagttgttagtgcaatggccgcctcattaaaaaccttcttaggtaaaaactcacacctcgtgagaaaaccctaagaaggaaaaaagagtgcagcccagctccaaagtttataggttcattacagtccattacagtgtacagatcattagttcaatacaactcataaaacataagactagtaggttgcaagactaagcattttcatcatccctagttgattgtgttgctggatcatcaagcataggttgtcgtgctcagcttcaagttcttgtgtgtcttcctccacactgtgttgtaggtgaccatcagcaagttcccaatccttgatgcatgataatatctctaccatattaggagctagacgacgtcgacgctcttcaatcaccctgccagcaagactaaaggtagactcagaggaaatagtagatgctggcactgtcaagacatctttagctagtagtgaaagataggataagttaacttatgctgatgccaccaagaaaggacattgaagtcctcatcaaactcagtgatagtaccactgtctaag

SEQ ID NO: 13179 - DNA, 544 bp, Zea mays
  Clone ID: LIB3279-211-Q6-N6-H3
aggagacagatcaaagctctgatggccgaatgggctcattaaaaacatattggacagaactactggtacaccctatcctaacgaaaaaaaagggcaagaaccaatttacactcgaaatttggcagtaaaggaaagctcagtcaacatgacctacgctgccgcaagcagtagcacactggggacacatgcaaagggacattttcgtcaatgtgcgcccaggcacaggcacaggcgcagagcacgtgccgacatattttattccaagtctacaccaccacaagaacataggatgcacaagataccccctacggggcatcaaaccaatcagaagttagatacagccttgcagctccccaatgccgaaccaaactggttatcagtggaaacagatggccccccttatgatcttatacttgagggaagactttattcggggggatattctcgcgcctttcaacataggcagccggaaaccacccagccttcccttgggattctccttccgcccagccgttgggagcaatctgacgaacaacaacataat

SEQ ID NO: 13180 - DNA, 551 bp, Zea mays
  Clone ID: LIB3279-211-Q6-N6-H4
ctgaggtctatagctggatcctgtagaaacatcgtcatacaatacaaaaaacgctatatcgtggaattcgcctctggtcaaatccaacagctctagtaggcgcaccaaacaaaaacaacacatcaaaccactcttaacacgctgtaaggatgccacaaggggtgatgaagcacaggtgcaaataacctcctactggatacctagggtccatgcgggctcagtaacggataatatcactcaagatgctgaagaaatgggtgatatctatcttgtcttctccggcataaattgcttctgcacttcctccggttggcccctgcgcagccatctcaacaagcgtgtacagcttcttgattggcatatcatccagtgcttctgctgctgcatcaaggtccccgccatcgaacacatcaagatgatgcaatacctttttcgcatcctcctttttcagcttggggacatggtatgtcacagagaacacgtcacacattccaacagattctaggaagccaacctcgcttgttgttccaatcacaagcaggtttttcccc

SEQ ID NO: 13181 - DNA, 528 bp, Zea mays
  Clone ID: LIB3279-211-Q6-N6-H5
ggcttgcaaatgacacaactgcatgacaaaatagccttctcatctcacaacatgctacagccaatccgggtaggttcacatccaggaattacaaaacttcacttactgctgagtgcggaacaaaacctaacacgaccataattatgacattgcaactagacgaccacccagagttcaggacagtaatacagaaatataaatgactgtttacttcttcttggcgtcaccagccttggtcttcttgacaccacggatcttcttggccctgttcttccgctctttcatttgcttgcgggacttctcaaccttagtagcaagaccattcctgatgaggcggtatttgggctcgaacttcttggcagactcgaggttatcgtagatgaggccgaagccagtggacttgcctccaccgaagtgggtgcggaacttgaagaccaagatggtgttggggtccttcacctcgtacatcttggcaagcctctccttcaactccgccttggagaccttggcgcggccggggtggataac

SEQ ID NO: 13182 - DNA, 80 bp, Zea mays
  Clone ID: LIB3279-211-Q6-N6-H6
ctctctctctctctctctctctctctctctctctctctctctctctctctctctctctctctctctctctctctctctct

SEQ ID NO: 13183 - DNA, 532 bp, Zea mays
  Clone ID: LIB3279-211-Q6-N6-H8
acaacagaaactactgcgaatgagcttgtgttatccaaaattcaggaacaatcactgttactaccatgaaatacaatcacccacagacacaacatacgtagcatgcttccgagcgcttcattgcagaagcgatggattacacggctattgcagcaataataccacagaaagcatcacacagagacatgtcccctaaccagtccccgactatgaagaggcgcctagcctagcctccgaagccgtagagggtgcgtccctggcgcttgagcgcgtagacgacgtccatggcggtcacggtcttgcggcgcgcgtgctcggtgtaggtgacggcgtcgcggatgacgttctcgagaaagatcttgagcacgccgcgggtctcctcgtagatgagccccgagatgcgcttcacgccacccctcctagccagcctccggatcgccggcttggtgatgccctggatgttgtcgcggagcaccttccggtggcgcttcgcgccgcccttgcccagacccttgccgcccttgccgcgccc

SEQ ID NO: 13184 - DNA, 650 bp, Zea mays
  unsure (1)..(650): unsure at all n locations; Clone ID: LIB3279-211-Q6-N6-H9
cacgcgtactaacttggaccttagacggcgcctttttttttttttttgttagaaaattgctgcacagactgaccattacttgagaaacactccttgccgttctggtaaactcgcaccagatnattattcatccgacaagatcatttttgttaaacagttcgtaaaaggtttggaatgcaaacgaagaagcatggtcacagcatacaaaacgacatgctcacgaaagcagttcaaaagaatgtggtgtcttcccatgggccaaaatcaggccaacgagagctctccagcgggaatattcctctttaccaatttctcccatgattcgttggtctcttgaatgaccttcagggcgtattccttgcttgcgggcttgttgcccagaccaaatttgttagcaggctttccatcaggtatcttgtagtctctgaaccagtctctgatggcagtcagtgtccccggaaaatgcttctcaacatcatccacgtcgttcacaagagatgctttcgggtcatccaaagaaatggccacaattttccagtcaagctctccctcatcaatcattgctaaagctgccaatggcttaaccttaagaacatccccgacattggcacgcctttcacctatctcaacaacatcaacaggatcattat

SEQ ID NO: 13185 - DNA, 667 bp, Zea mays
  unsure (1)..(667): unsure at all n locations; Clone ID: LIB3279-212-Q6-K6-A1
ctcttttgctcctccgccagcttcatggtggacgacatgcccatcagggacttccgcaacctggagagcaagggggtggcgttccccaagagccagccgatgcggctctactccagcctgtggaacgcggacgactgggcgacgcagggcgggcgcgtcaagacggactggtcccacgcccccttctccgcctcctaccgcgggttcaaggccgacgcttgcgtcgccgtcgcgggcggccggacccgctgcggcgccaccgtcggcaccgagggcaccggcgcccccgcctccgccgccggcgccggggactggtacaaccaggagctggacctcaccctgcagcagcggatgcgctgggtgcagcgcaagtacatgatctacaactactgcaccgaccccaagcgctaccagcagggcctccccgccgagtgctccatgcagtagcgcccggttattcctcgcccgtccaacaatggcgcgcgcgcgcgtgtgtgtgcatgtggtccgctctactgctaccgctacgacgatcggtgtcgatcaccggatcaaggcaagacgaaaggcatcgaaacatggtagataaaataaaggacttgacgattgtaacgcantanctggtgcgtgcgtggtgtggtggtaagaaattcttctgctggctgtg

SEQ ID NO: 13186 - DNA, 571 bp, Zea mays
  Clone ID: LIB3279-212-Q6-K6-A10
catccacggcatcatggaggccatgccacaggtggcgccatctacggcgcggtccgcgtccccgacggacactttcctgaggtcctcggtatcgtccacgccgcagccgctggcgaagctgaaggacatctgcctcgacgacgagatctccatggtgacgccgcccgccggcaggctgaaggatagtgacgacgccatggaggacccctcgtgctccaacaactcgtccatggacgacggctgtggcgccgggacggcagagagcgcggcccggaagcacgggtgcggcaacgggaggctcatcaacatctgctttggcgcgcagggcctcaccgtggaggactcggcgagcgggcagcagacgagcaagatgttcaagcagcagtgcctcagggtgtcctgattgacggcgtggtgtctcgactacaacagcgtggtgtgattggtttggtgtctcgcgtgcagctatgtgtgcttgtttgctttgctccttgcacagccagcggtgaactggtgatccaatgaacttgtgcttgtgttaactgtgacgttgacgaatccacagctcttt

SEQ ID NO: 13187 - DNA, 614 bp, Zea mays
  Clone ID: LIB3279-212-Q6-K6-A11
gggacagcctgactcctcgttgggctgatcttgatataaatcagcatgtcaataatgttaaatacattgcgtggattcttgagagtgcaccgatttctatttttgagaatcatgagctggcgagcattgtgctggattacaaaagggagtgtgtccgcgatagtgtgctgcagtcacacacctctgtccatgaggattgcaacattgagtctggagaaacaaccttgcactgtgagcatgtgctgagccttgaatcaggtccgaccatagtgaaggcccggaccatgtggaggcctaagggaaccaaggcccaagaaacagcggttccatcttcattctgattattgtcagatgttcgagatggtgactttggcagaagaatggttactagcatcctctattggaagcaaatcacacggaccgcgacctaaactaatttaactatgaagtgtgaccaatagaggagatataagtggtggggtcacaatggaggagacaaaggaggcctcctgtgcatggttttctgttttcgcctttggagttctttcttacgacaatcttgggtcgcacaaatgggtgttgtaagtattgatctgtagctacaaatgtatgat

SEQ ID NO: 13188 - DNA, 654 bp, Zea mays
  Clone ID: LIB3279-212-Q6-K6-A12
atcgctgcccacatcgttctgagatccagatgtagctcttgcagagggcgaagatgactgtttgattctgggaacggttgactcatatggtcatcttattgtatctcgtttggacatcgtggctgatggacatcctattcagtaccacctcgtgattgtggtgttggggaaggcagttgggctggggtatgctttagcccaatgcagcaatccatggtagctgttgctcgtcagttgtgcaagaccattgatatctatgatcaagatattcatgttcggagtttacgcacgtaagttcactcatgcaataattttggcattgtgccaatctgtccaactgccttttttataaaaaaagtcagattccgctgataaatgacatctttcagataaataaatgctaacccatgacatttttggctacagatagagcctatattacaagctactgcatacccaaaatgactctagcttcctcatcgactcttaatgatctttgtatgcacaatctttttattcaaaggaggctgctgtggattcaacacataaaccatgagttcttttagcagcatccattatctcacaattgcagactgtaatttgcacgatttagggggtaaaacttaacttgcaggctatggtatccatcttcgt

SEQ ID NO: 13189 - DNA, 609 bp, Zea mays
  Clone ID: LIB3279-212-Q6-K6-A2
ccccgcgtccgggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctactgcggtggcggcggctaccgtggtggcggcggcggctaccgtggtggtggcggcggctactgcggtggcaaccgtggcggcggctacggcaactccgaccggaactggaggaactgagcggtggggcccgcgcggccaagttatcctgttcgcta

SEQ ID NO: 13190 - DNA, 647 bp, Zea mays
  Clone ID: LIB3279-212-Q6-K6-A3
ccccgcgtccgaaatattgatataatatacatgaatagttcttgtatgagcatgttcagatgtgtctttgagatgttggaggaacacaaaggagaaaatcgctttagtcacattatgatcaacatgtcgtgttagtatattttttatatttgaaagtataatgtgttatctaactataaggtgatcttcgtctctattggcattatgataaaaaactagcaaaaaatgtcgtgagtctaatgttatcattagagtcaaatgttatcattaaatatatatagataggactgtacttgcgttggactctaggcttaagctatgtatatatatatatatatgctagtattaggacatcatattataataagtattatttcaagaagaccatccgattggtgcggctacgtcaaacgttcgcgccatgactgcaacattctagtggccaatgttgttgacttcaggcaaatcacgatggagatgctctctcgactagagctcgggacgacagggctcaagaccctcacgcgcgaggtgatgggcttgctcatcgacaagcccaagcatgtgacgctcagcaggtggacaaaacgttcttttggcccccacaggtctagtacgtcgtcgttgttgatgtctatgggttctac

SEQ ID NO: 13191 - DNA, 479 bp, Zea mays
  Clone ID: LIB3279-212-Q6-K6-A4
cacaaactaacgtccagagttaaaaaactaacgagcacgagttcaagtgtttagagataaccaccacttgggtggttagagctttgaccgctgccgccaccaccaccaggaggagggaacgcgaagagggagtcaacaaatccagtccctgctgcgggatcaaacccactaccacccgcttggggcgtaacctatgcaagcaaatatcaacacgttaaatgcaaatatcaaaaagtatacaagtgtataaattaatcgacagttatcaaacgtactctatctctaggtgcaggtatatgtgtcggaggggtgttgaactgtggtggcggagctggtgagtttgcaaactggctccattgtggtggcagtggaaaatttgttgccatgccctgttgctgcattaactgttaaatatatgtgttaatattgaagatgttgtattgaaatataataatttagagttcggattatgtgtactc

SEQ ID NO: 13192 - DNA, 601 bp, Zea mays
  unsure (1)..(601): unsure at all n locations; Clone ID: LIB3279-212-Q6-K6-A5
gntccctcgncaccganaaagagaggccacgagagagagcaagagaagagcctcggatcgtgggagattagcactatcacgtctcggtctgtgctcacgtctcgtgcttgtgagaggtcctgtggtgtgcggtgggctcccagcgtgttgacaggcgggagaaaacacccccgaagcttgtggccgcgctcaccagtgtgggcggtcagcgccgcgccgtggacaccctctgggctacgagctccgtgcggtcacgaggatttgaagaatcaccctggtaactggaatctcaagtgccagacaatgagcagcccgtggttcctgagtgtgttgccgaagatcttcttgagcaacaacctggtgaaggttgtccccactgtactcagtgttcaggaggagatgctggcaacatggaggactttgaggagtttcaagactatgatgagttctagtttattttagtggcaaacccccagtcagctgcctgtgaaggcctgatatgtttcgtattttcgcactttgatgatattaatgactatgctatgtattagactctgtggatgtcttggacatcttattgtaataaaagtacctttccact

SEQ ID NO: 13193 - DNA, 641 bp, Zea mays
  unsure (1)..(641): unsure at all n locations; Clone ID: LIB3279-212-Q6-K6-A6
gngtgtattagaggagcgccctgcccaagcaaagagaaaccgcggcgcgagaagagggaggaagggcagacgggcgagcaggatgagagagatcatcagcatccacatcggccaggccgggatccaggtcggcaacgcctgctgggagctctactgcctcgagcacggcatcgagcccgatggcaccatgcccagtgataccacggttggcgtcgcacatgatgccttcaacacgttcttcagcgagaccggttctggcaagcatgtgccgagggccatcttcgtcgaccttgagcccactgtcattgatgaggttcgcactggctcgtaccgccaactcttccacccagagcagctcatctcgggcaaggaagacgcagctaacaactttgcccgtggccactacactgttgggaaggagattgtcgatctatgcctggaccgtgtgcgcaagcttgcagacaactgcactgggctgcagggattcttggtgttcaatgctgttggtggtgggactggctctggacttgggtcacttttattggagcgcctttcagttgattatggcaagaaatccaagcttggtttcaccatttatccttccccacaggtgtcaacagctgttgtagagccatacaaca

SEQ ID NO: 13194 - DNA, 579 bp, Zea mays
  Clone ID: LIB3279-212-Q6-K6-A7
cggacgcgtggggttgatatagttagtatatggcagcctgctgagaacattatcatgattcgctggatcgcccacggcattcctcgagtaccttgggatgggcatggccgcttcgatggtgcttctgtgtataaactcgacaaggatggtaagatctacgagcataaggtccacaatgtggctatgaatccaccaacgaagttcaaggtcctaccagtccatgagctaatcagatcacttggttgcccctctactgcaaaaccaacttattttgaagcttcatcacaatatctgtgcgctgggccatcttatttgagattagcttggataagatgctacatctcattgtgccgcatgctttcgctcgcaaatctgggagaaggatagcctgggtttagtgatacctccaaattttgtattttcagtatgacagcacacatgttactaagtactattgagtcatgacagttgtatatatgaacactgatagtttatagaataagacctcttagttaaggtgtacaacacttgttattgattgttataagcatcagtcagcaaactagtctgacatgtttc

SEQ ID NO: 13195 - DNA, 636 bp, Zea mays
  Clone ID: LIB3279-212-Q6-K6-A8
ccgcaggcagcatctgcatctctcgcccacctgcgctccgcctgctgctgctggtggtagggaggcggagaaggaggcccttgcgcccgcccgccggccggatcagagccgtagcaaccaccacccatggcggacgtgcacgaacctttggtgcgccgtaagaggaagaaggttttggggggctacttggtgaagttccgatggatcctcgtgatcttcgtggtccttcctatttcaactctgatctacttcaacatcttcctgggcgacatgtggtccgccatgaagtcggagaagaagcgccagaagcagcacgacgagaacgtgcagaaggtcgtgaagcggctcaagcagaggaacccgaagaaggatggtcttgtttgcacggccaggaagccctggatcgctgttggcatgcgcaacgtggactacaagcgtgcgaggcatttcgaggtcgacctttcttccttcaggaacatccttgagatcgacaaagagaggatggttgccaaggtcgagccccttgtcaacatgggtcagataaccagagctacctgcccaatgaaccttgcccttgcggtcgtcgccgagctcgacgacctcactgttggtggggctgatcaacggttaccggat

SEQ ID NO: 13196 - DNA, 659 bp, Zea mays
  unsure (1)..(659): unsure at all n locations; Clone ID: LIB3279-212-Q6-K6-A9
cccagcgtccgacgatcgcaacacaatccaaagacgacgcgggggagcgagcgataaagccagaacaagaggagcgatccagaggagaagacgaaagagtcaggggagctgctaaggaccgatggccgaccccagctattggatagggatggacatcgaaacctccgtcacgatgctcgtcatcggtctcgccaccgccgtcgtgagcgtgtgcctcttcttcattttcatgtgcatcgtgcaatggtggtactcgccacggatgcgcgtcttcaggctcggcggcgtcaccaccctgaggcagaacctggactacacctgcaccctgtgccaaaacagcatggaggccggcgagaaggtccgcacgctctcctgcgaccacgtgttccactgcggcggcagcgtcaagtgcgagggaatcgaccactgccttcgcactggaccgatggagcgctgcccgacctgttaccgggttccccatcccgtgccctggaagcggacaccgncaccgtcgccaccagcacctacaccttcacagggagcattggcggcagcgctaccacctttgcggctcccgttgtcgacgcgggatttggacgaggcgctgctgcgttgggagcaaatccagaaactagcgggagcgtcgtcatcagcatcgc

SEQ ID NO: 13197 - DNA, 588 bp, Zea mays
  unsure (1)..(588): unsure at all n locations; Clone ID: LIB3279-212-Q6-K6-B1
cccacgcgtccgcacacttgtctgaaacgtgaaagagaccctccgagatcgtcagaccgtcctcctttccccatggccaccaccctcgccaggagcagcagcagcaacggccacggacgccgccacgaggcgtccaccacctcgtcttcgtcgtcctcctccacagcctcggctcagaggcggaggggggagtcgcagtcgcagtcgcagcaccaggccgccgccgccgtcccggagacgccgggtccgggtccggcgctgcagttcctcgcgagccccgcgcaccaccaccacccccagacccagctcgtcgccccgaggaggtcggtgccgtccaagtgggaggacgcggagaagtggctgcggcagtcgtcgtcgttgtcgtcctcgggttccgaccaccacctccacggcaacgcgagggccgccttctccaggcagcggagcggcgggctcggacaccgaggcggcgccggaggcggtggcgacgagaagagcgcancggtggcggtgaggaggtcggtggacgcgctccgggacgcccactcgctcgcgctgtacgcggcgccggcagcggaggtgctcctc

SEQ ID NO: 13198 - DNA, 571 bp, Zea mays
  Clone ID: LIB3279-212-Q6-K6-B10
ccccgcgtccgcactaacttaccttccaacaaatccattcgatcctgcgctgctgctggacatctcgatttctttcgcagattgacgatgaactggagattcaagcgacgaaccggaagcacggtgacgaagctctcaccgagctggtcatggcgatgttctatgttgccccagaagatgagcggacgggcactcaaagaagagaaaattgctgctcgtagtgctatactgccgatgctccaagctgaagaggatgaaagatttgtcaaagagtggaagaagtatcttgaggaggaggcgaggattatgaaagatgttccagggtggaaggttggcgagagtgtgtacaattccgggaaatggatgcccccggccaccggtgagctccgccctgaggtgtggtaagggcctgttgtaggcattgagaatgcaatcatgtcatgagggcatgaataaggctatcagacatgggcatccttctttgttcactaaggatcagctgttcaaatacctgtatctattttactcttatgaaatctggctggttaataatatgaagccgacgctttgc

SEQ ID NO: 13199 - DNA, 541 bp, Zea mays
  Clone ID: LIB3279-212-Q6-K6-B11
gcgtttcccatctcgtgattctacacttctaccgttccactctcgtgcgctcttgttttcttctctccgttgccgccctacgtcaggtgcccaattctccattttcgggcccttctccagcgacgagcacccgccagaggattatggattggctggggcagaaacgcgcggagatgctgatgcaggtgctgctggtggcgtctgcggtggtggcgttcctggtgggctacgtgcgcgcggacttccagctcatgctgctcgtctacgccggcggcgtcgtgctcacggctctggtcaccgtccccaactggcctttctacaaccgtaacccgctcaagtggctcgacgctgccgaggccgagcgccacccgcggccccaggtcagcgccgcccccgcggcagggggtaagaagaggtccgggaagaacaagtagttggtcgatgtgtgtgttcttggtcgacctgactcaacctgtttaagatctattcgcagaactaatcaattataaaaagagatattgagatatttgacagttttcgt

SEQ ID NO: 13200 - DNA, 650 bp, Zea mays
  Clone ID: LIB3279-212-Q6-K6-B12
cccagcgtccgaaagattggctcggaggtgccagggaaaatgaagggaagcccatcgagagtatctttgatctagctgagatggctgtcgatgagatgcgggatctcttacaactatcgaactctcagctgcaagacatcattgaattcatcaagcggttccccaatgttgatatgacctatgaggtccgtgagggtgatgatataagcgctggtgacaatgtaaccgtgcaggtaactctggagcgtgacatgactaacgtttcatctgaggttggtccagtccatgcgccaaggtttcccaagcctaaggaagaaggctggtggctggtgattggggacagctccacaaaccagttactggcaatcaaaagagtggcactccagaagagggcgagagtgaaacttgagttttctgctccggcagaggctgggagaaaggactacatgatttacttgatgtcagactcttacttgggctgcgatcaggagtatgaattcaccgttgatgtcaaggatgctggaggggattgatgatgaagaccgtgacactatgtcgcatagaagtagaattgtgtgtgtactgtaacgcgatattggaacattctgtgttgtaacctcgaacatgtgggagctgtaacttattttgcc

SEQ ID NO: 13201 - DNA, 603 bp, Zea mays
  Clone ID: LIB3279-212-Q6-K6-B2
gtgtgctttacaaaatctttctaaatgcaacctcatgggtggccagaaaaggtaaatccagggcaatgctctaaattgcaaaagaacggactggagaaattgacaagaggtcacttattacacctgtactgctaatagtcacctgttttacatggttagtggactcggctgattttctcgaggtgaataacaagattgtacgcagagatagtggacttcgcaaagcagcatcagtcagtttttaatagcattttaagggagaacatgactggaactaatttgctcacgttggagcaacttaccatggagggttctattctcagcaaggtttgtgcgtatgaagaaaatgaggaatgcaactacattcaagatctattttccttgatgcatactctttttagcgttgactttgggatactaaattttatgcaatcaccaaacatgatctgagaatcaggaattcataattgatagcatttggactttgcttcagccttgtctctcacctttatgttctcgctacaaggaaaaacatgcgatttcaaggttcatatgggccttacagtgatcagcagcacccaacactacaaatggattctgatc

SEQ ID NO: 13202 - DNA, 173 bp, Zea mays
  Clone ID: LIB3279-212-Q6-K6-B3
gttccttatgattttggctgttagatgccgatcaacaatgtaccaccttccccagttgaaagggggaaagccaagatagtattatcaatagaaacctagcttcaagaatgtcgtgactatatatatgtatgatattaagacgagatttgataagggtggcatagcaagtcctg

SEQ ID NO: 13203 - DNA, 666 bp, Zea mays
  unsure (1)..(666): unsure at all n locations; Clone ID: LIB3279-212-Q6-K6-B4
cccagcgtccngatagccctcccctgctccgccacctcctcggatcccgaccaccccacccccaccccagacaacaggttgatggaggctaagatgggacgcttcttcgagtccgtgagcaatttcttcaccggaggcgaccacatcccctggtgcgaccgcgacctcatcgccggctgtgaaggagagcttgtcaatgctgcaaatgaggaacagaggaatgaaagccttatgaggttgtcatgggcccttgtgcactccaggcagacagacgatgtaaaccgtggaatcagcatgcttcaagcttctttggataattctgccagtcctctgcagactagggaaaagctgtacttgttggctgttggattctacaggattggcgactactcaaaaagcaggcaacttgcagatcgttgtttggagattcaagcggattggcggcaggccatatcgctgaagaaggcaatagaagataaaattgccaaagatggtctgattggaataggaattgcgacaactgcggtcggacttctggttggtggaattgcagctgctgttgccaggaagaagtgaggtcaatatattggatcggcagctcattgaactaggggagctcccgtctctgtaattccaacttttctgttgttaccttggtgatattac

SEQ ID NO: 13204 - DNA, 670 bp, Zea mays
  Clone ID: LIB3279-212-Q6-K6-B5
aataggcacaaaagtagcccagtgcctggccaaaagagtgactgcagtagctcactccaaaaggcaggcatttttgactgggttgatgcttcgagtgatgatgaatgcacagccattatgacttccatggaaaaaacaaaggatccaagctaatactcaagcgaagaatttgacctcccagagatatggtggtcgtggatcaattgccactgttggttccatatcagattgtactggcggtaagtcaggcttgaattcttctaaaaagccagaacctgttggttctaccgatgatttatatgatattggtccatatactcagatggcagctgaagccatggaagcactgtccaatgcatcaactgtcaattatgtagtcagggagaatgcacatcctgaaagctcagttcttagaacaaacatgggaaaagaaagcaaagccaataagatatgttttgagttgtcacttcaaaagcgaattggtggaagttcaagctctgtgaaaaagcatcccagcaagttaaaagacaagaagagtcgaaaacagatgacaaggaaagcaaaaggaagcatagacagtaccactatagaaggagatacaaatcatgaggtgtctgaaggagttaagggatctggtgcaagtgattcaaatgttgtaggttctaatgct

SEQ ID NO: 13205 - DNA, 649 bp, Zea mays
  Clone ID: LIB3279-212-Q6-K6-B6
tagctctattttgggaaacttagtaaaccttaacattgaggactttgtggatgactactattcaattgagaggttcaaaatggcttatcagtttgtggtcgctccgatgggtgacaagactcaatggccaaaatttgaccctgggtttaaaatggttcctccaaagctagaaaggcctgctggtagaccaagaaagaaaagaatcaaggctagtggagaggcaggaaaaagaggcccatatcagtgcaaaaggtgttttcagtttggacatatagagaagggttgtactgctactcaagctgaattagaacaagagcttccaccacctcatccaaagaaaccaaaaaaaacaaagaaaatccaaatctgaagctgttgaagtctctatggttgatgtcgagccatctcaaaccgacggtgttccaaaagtgatgtctagcccaggtgtaacaacaagaagcatgtcttctgcttctccaactagtccaggtcctacaacaaggaggaaggcatccatctcaccaggaggaattaatcggaggctcattattagctagatatagtagttgtcattctctattttgtgtgtgggcatggctgtgcaactattttgtgtaactatttttccgctatgcaacactatgtctga

SEQ ID NO: 13206 - DNA, 642 bp, Zea mays
  Clone ID: LIB3279-212-Q6-K6-B7
ttcggggtcttctctcgtccctgtccccctccagcaccgccgccgccgccaccgcgccgcaacctcgccatggcacgccctccgtcggcggccctcaagccgccgtatccggccttccaatcccatcccagcgatctcgagctcgtcaactcctatctccgtccctgggtcgagaccggcgtcaagaccggcgcgttcatccacgacgcagacgtgtacgccgctgaccccaactacctcacccgtcagttcgcgccggcggtggcccatgacggcgagcgggcgtggtacttctacaccccgctgcgccacaagagcgtccacgggacgcggaagacgcgcaccgtggccaccggcggcgggtgctggcacaacgaggcgaaagctaggcccgtgtacatggtctccaacgggatgcaccagattgcgcatcgccagagcttctccttcgtcgagaaggatggcggcgtgcgggtccgcacgggttggctcatgatggaactccgcctcgtcgaggacggcgccgccgggcagaaaccggaggaggacggcgacctcgggagtcgcgtcctgtgcaaggtgtaccgcagcccgcgcaaccccgagccaagcggtatcgaagccgcgacggcgcccgggcag

SEQ ID NO: 13207 - DNA, 457 bp, Zea mays
  Clone ID: LIB3279-212-Q6-K6-B8
ggggtccagggtccaaatagtcaaaaaatggggtcgttctacccctaacagtctagggcaggggcttttggacatagttacctattggggggaagggaaccctgtctggggttaccattaaaaacaagaaaagaagaaatgccttcaccaacgatcagtaaaacaaaacatggaacgcctccagtcatccgatatttacagtcacttgcgggggccaagataaaggggctgatactctggtctatttgccggacaaagcaaacagaagcaccagcaaatagcttggggctttcgcaccacaactggagactttttccaaatggttcaattcttcaacaattgggggggtaggcaggccaacaaacagccggtttggaaacaatcaaatcactggaaaaacatttctggaaaaagggattttccctggcgcttggtcaagataacaacatggaagcct

SEQ ID NO: 13208 - DNA, 650 bp, Zea mays
  Clone ID: LIB3279-212-Q6-K6-B9
cccagcgtccgcacaaacacaacaagctaagaagctacgtagctgaattctgagagtataaacacaaaagcgagtgcaaaaccaaatggctgcctcgacctacttccttcttgttgctttcctagcattggtcacttctcatgccattgcttctgatcctagcccgctccaagacttctggggggccgacaaagactctccggtgaaggtgaatggatttgtttgcaaggatcccatggctgtgaacgctgacgacttctttaaggctgcaaaacttgaccagccaagggacacctccaagagcaaggtgggatccaacgttactttgatcaatgtcatgcagctgcttggactcaacacgttggggatctcgttggctcgcattgactacgcaccattaggtcagaatcctccgcacacacacccacgtgccactgagatcctcaccgtgcttgaagggacactctacgtcggatttgtcacctccaaccaagctgacagaagcaacaagctatttgccaaggttctcaacaagggcgatgtgtttgtattcccccaaggactaatccacttccagttcaacccagtacatgacaagccagcagtcgcgctcgctgctctaagtagccagaaccctggagctattacta

SEQ ID NO: 13209 - DNA, 643 bp, Zea mays
  Clone ID: LIB3279-212-Q6-K6-C1
cggacgcgtgggctcctttccccaaggccaaaaccgaccccgctccacgcctccactcccagccccagcggatcttctcgagcggcggccggcgatggcagcgagcaacatcgggatgatggacggagcctacttcgtcgggcgcaacgagatcctcgcgtggatcaacactacgctgcacctcggcctctccaaggtggaggaggcggcgtcaggcgcggttgcgtgccaactgatggacgcggcgcatcccggcgccgtgccgatgcacaaggtcaacttcgacgccaagacggagtacgacatgatccagaactacaaggtcctgcaggatgtgttcaacaagctcaagatcactaagcatatagaggtgaacaagctaatcaaaggaagaccccttgacaatctggagttcatgcagtggatgaaacgatattgtgattctgtcaatggtggcttcatgagcagctacaatgcttctgagagaagggaaagcagcaaagggggaaaggagacgaacagaagggcatcggtgccctctcacacaccggccaagtctgcatccacaggtcacaaggctcaagcatcacatggcgctaagcgggcaagcgggcagacggcgggtgcaccacagcgcagtgct

SEQ ID NO: 13210 - DNA, 628 bp, Zea mays
  Clone ID: LIB3279-212-Q6-K6-C10
cggttacatccgcaaagcgcacacgtcgaatcttccagggctctaaacacgatcgcaagcagacagagttactctttcctgcaaacgatcaggcatatggcgtctatgatttcagacccgatggcgaaggctatgcccaagatcagcatgcagagctgaggtccagagctttccatcacgccgacgatgcctttgcagactcggttagcgcggacttctcggaagcgacatcaagtgaatggtcgctgtttaccagctccgacgagtcctcgttcaccaccgagagcacaagggattcgttcagcgtcgtggactacggagacaacgccggcctggatccgatttcctccatattcgggccaagctatgctccggagcacggtgctcccggcagtttcgtctcgcgcacaaggttctcaccttccagtccacagacaaggtacttctcggagagcacaggctttgtctcggactcttccatgccggcccacccccacggcattgtacatagaggaaggtatccggatagtagggcgtgcgcctcttctgcggaaccgcttgcgtcggcggcgcatcagcggagcgggtatggccggtacccccttagtcgagaggttttgttcaaaca

SEQ ID NO: 13211 - DNA, 195 bp, Zea mays
  unsure (1)..(195): unsure at all n locations; Clone ID: LIB3279-212-Q6-K6-C11
cggccgcgtgggcataattaggccagcctttagaagtttagttgtggccttgaaattttgcatgtaactggtacttaagctgttccaactgccaattttgacataaatacttatatacattgctgatgtatattgtagctttgatacatgagcattttatcttgcaaaaatgatatacagtgtagtgcagttncc

SEQ ID NO: 13212 - DNA, 583 bp, Zea mays
  Clone ID: LIB3279-212-Q6-K6-C12
attcactcacacagcaaatacccacagtccacagcaagaaccgaagagttcggaaacatcggaaagatcccgatcatcggcgacctgacgggcagcaacaagaatgcgcacctcaagggcaacctggtgctcatgcgcaagaccgtgctcggcttcgacgtcaccagcatcgccggctccctcatggacggcctcggcgagttcctcggccgcggcgtcacctgccaactcgtcagctccaccgtcgtcgaccccaacaacgggaaccgcgggaaggtgggtcaggaggcgagcctggagcagtggctgctgcacccgccgccgcttctggccggcgaggaccagttccgcgtcaccttcgactgggaggtggagaagcacggcgtcccgggcgccatcatcgtgaagaacaaccacgcctccgagttcttcctcaagaccatcaccatcgacgacgtccccggccacggccccatcgtcttcgtcgccaactcatgggtgtacccgcagtacaagtaccgctacaaccgcgtcttcttctccaacgacacgtacctccccagccagatgccggcggcgctga

SEQ ID NO: 13213 - DNA, 656 bp, Zea mays
  Clone ID: LIB3279-212-Q6-K6-C2
ggccaggcccgccaccgccctccctccccccgcgaccgcgactctgcgagcacgacgagacccacggacccacctcgatccagatccagccaactgcgcgcgtcggcgttaccccttcctcctcgacgccactgccgtggagcggggatcatccgcctgaaccgggtcgaccgcttcgttccttggtggtgggtagctgattgggggagctcagaaccttacacttacaactatgttctccttgttctatggtctatggaagcacgtcttcagcaaggcagagttccatgtgcttatcctcggagttcataaggctggcaagacgaccttgctagaaaagttgaagtcgatctacttgaagggagaagggcttccgcatgatcgtattgttccaacagttggccttaatattgggcgtattgaagatgcaaatgtaaagcttgttttctgggatctgggaggccagcctggcctacgaacaatatgggagaaatattatgaggaagcccatgctgtaatatatgttatcgactctgcttctgcatcatcatttgaggatgctaaatctgctctcgagaaattctccgtcatgaagatctgcatggagcgccaatacttatatttgcaaacaagcaggattcaccagcagctgtcac

SEQ ID NO: 13214 - DNA, 621 bp, Zea mays
  Clone ID: LIB3279-212-Q6-K6-C3
gaattctctcggtctctaccaaaaaacagcgacctctaacgcttagctagctctttgtgtcagcgcctgagcatcgagctattggcatggcgcactccaccaccttggccctggtgattgtcgttgtgctggcgctcacctttggtgccacggtcagtgtctccgctcccgtgaacaagtcgtgcgtcagcggtagcgccggcgccagcgtgagcattggctacggcggggcaagagccagcgccggcgctggcgtgtcccttggcgccgacgcgtaccggagcacgtgcccccgtgccgaggagatcatccgtgcggccgttgagagggccgtcgctgccgacccacgcatggcagcgtctctcctgcgcctccatttccatgactgcttcgtcaacggctgtgacggctccgttcttctggacgacaagccgttcttcatcggcgagaagacggctgtgcccaacgccaactcaatcaggggcttcgaggtcattgacgccatcaagaccgagctggagcgggagtgcccagatacagtttcctgtgccgacctccttgccatcgctgcccgtgactccgtcgttgtgtctggcgggccgagctgggagattgaggtcg

SEQ ID NO: 13215 - DNA, 643 bp, Zea mays
  unsure (1)..(643): unsure at all n locations; Clone ID: LIB3279-212-Q6-K6-C4
gtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtagggacttcatttgcactgtgtgctgtagcatgctcgtgtctagatctgtggatgggatgtgtcctgctctagtttcgnncttgtgtcttattgtatgttcgtcttcatc

SEQ ID NO: 13216 - DNA, 547 bp, Zea mays
  unsure (1)..(547): unsure at all n locations; Clone ID: LIB3279-212-Q6-K6-C5
cggacgcgtggngaaaaaaacaatgtcgtcgtttcctagaagggcatgtcaatactcaataggcaccgcgtgcctagcgccggctaccgcgactgtggcgtcggcggctgggaccagcggccctagggtttcaacgcatctgtcgacgggagctagggcgtcgccgccgtcaatgtcgcggcactcccactctttttcgtcaaccgcatcgagcggagggccacctgtgtcgccgctttcttgcatttgttttgcttcgcatttcgaacaggttcagagatggacccttgcgcatcaaagaaaaaccagacgccaaatcttttaggaactgaagattttctcagatcatcagcaaccttttaagttgtggaatgccctctgtataattatatatacctgctcaactcttttgaagataatgtaaatatagcaactagcttcaaatattgcaacaactatattacctcttgccgctgctcacttaactctgttttatattattatataagcctattatgctcaaaanaaaaaaaaaaaaannaaanna

SEQ ID NO: 13217 - DNA, 256 bp, Zea mays
  Clone ID: LIB3279-212-Q6-K6-C6
ggaggtcggtgctgagttcgatgagggcgaggatggcgacgagggtgacgagtactagagaagtttgctgatgacgcagcatcaggccagtgtgctgcccttatcccgtgatctgccgagagttgctcctgctatcgtgttatgtgtgtctgttctgaagtattgtgtggtttacaacacctgatgttgtaagagttgttaattcccctgcattgctaccgggttattgagaataattatggctgtttacgttgtt

SEQ ID NO: 13218 - DNA, 639 bp, Zea mays
  Clone ID: LIB3279-212-Q6-K6-C7
cctggtttcgtttccacccactgtgttgagattgttcctctatttgaagaggaagattatgggaaagaagcttattgtagacgctatatcagaggttgatctctacaagtttcctccctgggatctccctgaaaagtcctctcttcgaagcaaagatcttgaatggttcttctttggggctcgtgacaagaagtaccctaatgggtctaggacaaaccgtgccacaccaaatggttactggaagactagtggaaaggatagaataattatgcttaactctcgcactgttggaatgaagaaaacattgatatttcatgaaggcaagccccctaagggtgatagaactgattgggtgatgtatgaatacaaaatggaagatgaatatttggtttctactggtttctcaaaggatacttatgtactctgcaaaattttcaagaaaagtggccttggtccaaggattggggagcaatatggggctccgtttgacgaagccgaatgggacaatgcagaagctgaaacctctatatttcctttgatgacctcttcagaagtagtgaacccaacagagggaccacacactcagcctgttgcccctgctggtgctcttcaggaacctctacataattcatctgctac

SEQ ID NO: 13219 - DNA, 650 bp, Zea mays
  unsure (1)..(650): unsure at all n locations; Clone ID: LIB3279-212-Q6-K6-C8
cccagtgtccgccccgcgtccgcccacgcgtccgccacctccgacctcgcgcgagacgagcaagcccaagttggccggagcagcagcagccgccgtggcgtccggggtctcggcccggccggccgcgccgatgagggcttctgcgggacgccgcgctcggctgtcggtggtgcgggccgcgatatccctcgagaagggcgagaaggcgtacacggtgcagaagtccgaggagatcttcaacgccgccaaggagctgatgcctggaggtgttaactcgccagtccgtgccttcaaatctgttggtgggcagccagtagtgttcgactctgtaaagggttctcgtatgtgggatgttgatgggaatgagtacattgattacgttggttcctggggtcctgcaatcatcggccatgcagatgataaggttaatgctgcattgattgaaactctgaagaaaggaactagctttggtgctccatgtttgctggagaacgtattggctgagatggtcatctctgccgtgccaagtatcgaaatggtccgctttgtcaactcanggacagaagcctgcatgggagcgctccgcctcgtgcgcgcattcaccgggcgggagaaagacatcaagttcgaaagctgctaccatgggcatg

SEQ ID NO: 13220 - DNA, 634 bp, Zea mays
  Clone ID: LIB3279-212-Q6-K6-D1
cggacgcgtgggctcgtcttcttatccatacaaaattgctaaaaaattaatgagaggatggttgcatgggccaaaaatttaaggtttcggatccacttgaagagggttgcaggcttgggccagttgttagtgaaggacagtatgagaagattaagaagttcatatcgaatgccaaaagccaaggtgctactattctgactggaggtgttagacctgcgcatcttgagaaggggttctttattgaaccaactattattactgatatcaccacatcaatggaaatctggagggaggaagtctttggtccagtcctgtgcgttaaagaatttagcactgaagatgaagccatcgaacttgccaacgatacacagtatggtttggctggtgctgtaatttctggtgatcgggagcgctgccagaggttatctgaggagattgacgctggatgcatctgggtaaactgctcgcaaccctgcttctgccaagctccctggggcgggaacaagcgcagtggatttggacgtgagcttggagaaggggcattgataactacctgagcgtcaagcaagtcacggagtacatctctgatgagccgtggggatggtaccaatcccccttcaagctgtaaactggc

SEQ ID NO: 13221 - DNA, 640 bp, Zea mays
  Clone ID: LIB3279-212-Q6-K6-D10
cgaaacacttggggcatcttatgaccgttacttgcgcaatgggatggcctccgtcggtgcaaatgacacttctagggctgccgggatgggtgctggattggctgcagggatgactgcagggatgggtgctggaatggctgcagggatggctggctatggtgttgatggtcagcgtatgatgggtgttgttggtatggacagcagagggatgggatatggtggcagacctgagccacctcttccgcctgatgcatcaagcactctatatattgagggcttacctgcaaactgcacacgacgggaggtttcacatatatttcgcccatttgttggttttcgtgaagttcgtcttgtcaacaaggagtccagacatcctggtggagatccacatgtgttgtgtttcgtcgattttgacaaccctgctcaggctacaattgctctggaagcattacaaggttataagtttgacgaacacgagcgtgattcagcccatttgcgtctgcaattctcacgctttcccggtccaaggtcagctggtgggcctcgcggtaggcgttaagacgtgcggacctcgtggttgccgaacctatcgtttatacgagcgatccaactacggtgggctaacgcttcgatatgcgct

SEQ ID NO: 13222 - DNA, 623 bp, Zea mays
  Clone ID: LIB3279-212-Q6-K6-D11
ctcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaatgcggccagcgccggcagcaaggagcccaagtcccccaagaagggcgccaagtcccccaagaaggcttagaaagtagggacttcatttgcactgtgtgctgtagcatgctcgtgtctagatctgtggatgggatgtgtcctgctctagtttc

SEQ ID NO: 13223 - DNA, 603 bp, Zea mays
  unsure (1)..(603): unsure at all n locations; Clone ID: LIB3279-212-Q6-K6-D12
cgcgttcacgagccagnaatagaagagaggctaaccaccgcagcggctgcgacctgcgagtgcgacaacctccgcggaggagttggagccggcggcggggatatttgcttgcccggctggggttgcggcggaaggagggagagacaaccggcgatggcggcgtccgcgaggcccggggatagggcgaccagcttcgccgtcgcgtgcagcctcctcagccgcttcgtccgccagaacggcgtcgcggctgccgagctaggcctcaggatcaaaggcgaggtcgagcagcagaggacgccggcgacaactaacttgctccccggagcggagggcgaggaggtcgaaaggaggaaggagaccatggagctgttcccgcagagcgtcgggttcagcatcaaggatgctgccgcccctagggaggagcaaggagataaagagaagccagagcagctcacaatcttctatggcgggaaggtgctggtatttgacgatttccccgccgacaaggcaaaggatctgatgcagctggccagcaagggcagcccagtggtacagaacgttgttttgcctcaaccctctgcagctgctgctgtcactactgac

SEQ ID NO: 13224 - DNA, 533 bp, Zea mays
  Clone ID: LIB3279-212-Q6-K6-D2
attaaaacgcacatgtggattgctagctactactccagcttgttgcatcccactttcactccctctgctagttaacaagtggcagcattacacgcggttgagggggcagcagcatgcaggcgaggcgaaggcgacgcgcttttttgtcggcgtgccgtggcgctgctccagtgctccgtgccgtgtgtgtccctgcgcagcggcagcccatgccatcaaattgaaactaggggggccacagccacagacacagacacaggcgggcgcgggtggcccccgggcactggtctcgtcccagcctcggaggcgagctcgtggccggacagctggcgctactatacgagctcctcgacccccccacatccacatgatccacaacccctcctcgcagtcgcatttgcccacgagtggagttagggtgtgtttggtttgacttttggctttggcttttgcccccctaaaagccaaaagccaaccaaagggctggatccaggaagtaactttttctaaaagccgactttcttgtagtgcaa

SEQ ID NO: 13225 - DNA, 654 bp, Zea mays
  Clone ID: LIB3279-212-Q6-K6-D3
atctttgcaagccgtccaagtcgctgcagccgccgccgccgacgccatggggaaactcggagccaagtccgactacgagagtctccgcgacgcccgcatctccgagaacatggcccggatggagatgctcggccttctccgctgcgcgggggagctcagcgacatcgcctccgcctgcagcgcaccgcgcggcagggagcgcgacgcctcggaagacccccaggccacgggtgacgagcatgaccccgctccgccgctccggccgcctcctcgccgcgacgccgacccgcccgaccggatccgcgtcgacgcaccgctgttccactcggctgaatggacagggcacaggagttctgagtaagttgacggcggcgggatcggaggaggaggatgatacatgggaagatgataaggaggggaagtgggcggtggcggtggccaaggagagggtacaggcgctgcaagagaggcggtgcgacagcagggggaggggcggcgcgtacgactctgttcttggaatctgctgccatttctgcaggcagaagatattgtgcggcgaggaggactgcaagcgctgcggggaaggagacctgaagcagccatgcttaggaaagacggagtgctcatcttgccattcttctaatgggatactct

SEQ ID NO: 13226 - DNA, 638 bp, Zea mays
  Clone ID: LIB3279-212-Q6-K6-D4
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgagggcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctc

SEQ ID NO: 13227 - DNA, 663 bp, Zea mays
  unsure (1)..(663): unsure at all n locations; Clone ID: LIB3279-212-Q6-K6-D5
ggcgccaactcgctcgcctccggctactcccgcggcaccggcctcggcgccgagatcatcggcaccttcgtgctcgtctacaccgtcttctccgccaccgaccccaagcgcaacgcccgcgactcccacgtcccggttctggctcccctccccatcggcttcgccgtgttcatggggggggggggcaccatccccgtcaccggcaccggcatcaacccggccaggagcctgggcgccgccgtcatctacaacaaggacaagccctgggacgaccactggatcttctgggtgggccctctcgtgggcgctgccatcgcggccttctaccaccagtacatcctccgggctggcgccatcaaggccctcggctccttcaggagcaacgcgtgatgagcggggcttggctgtggagcaatggcgggcgacctacgggcgggggaagtcgtgagcgaggagaatgacatcatcgatcgacttgggtgccggtggttggttcgggtcgccttttttgtttcagcagctgctgcgttgcgcgcgtgcgtgagatttggtttggtttcgttcccctgcaatgtaatcatgtcgtgactctcaagggattattccgctctgctcttatgggctctgntttctatttaatgattgttattaccatgtagcagt

SEQ ID NO: 13228 - DNA, 646 bp, Zea mays
  Clone ID: LIB3279-212-Q6-K6-D6
ccccgcgtccgcccacgcgtccgcccacgcgtccgtttgcatccactgattttcaaggaagctggccttccagataatactttgttgacttacaagttgaagaacggagaggcactactgcaagggtataagcagggagcaggtattgtctgcaattgttgcaatcaagaggtttccccttcggaatttgaaaaacacgctggcatggggaaaagacgacaaccgtatcaaaacatttatacatcacaaggattaacactccatgatgttgctctgcaactgcatcatttgaatttgaattcaaatggatttagcaatgctagtgtttccagcttcagtgactacccaaaccttacttcttcaggttgtggcaaagaaccttctgtcagtggacctattgtccccctgaaacggactttacaagaaagagtggtccaaacagagagttgctatttctgtgggtatggccacacagagcttggaaaaattgatccaaacatgattgtcttctgtaaccagtgtgagagaccatgccacgtgaaatgttacaatagtagagttgtaaaaaagaaggtgcctctggaaattttgaaagactacttgtgttttcacttcttgtgctgccaagaatgtcagtcacttcgtg

SEQ ID NO: 13229 - DNA, 634 bp, Zea mays
  Clone ID: LIB3279-212-Q6-K6-D7
cagaggtgtgctcccgtgccttctttatgttctgagacggttaaagatcatctccttcacaaatagtgatccatcagtgccttctgattcactattctttgtgccgtttaggttattgttgcgcaccacacctctttccttggcttatttactctacatgctagcttcgatggagtgggggcgtggagttaacgttcctatgtatacaactctacggcgcacaacagtcgtgtttacaatgacaatggagtatttcctggcaaagcagaagcacaccccacctataataggcagtgtggctttgattgtattcggagcatttgttgctggagctcgagacttgtcatttgatgctcgtgggtatgctattgtctttgtggccaacattacgacagctgtttatcttgctaccataaaccgtataggaaaatctagtggccttaatagctttggcctgatgtggtgcaatggtcttgtctgtggaccttcagtactgttcttgacttatattgagggtgacctaaagaggaccatggaatttccataccttcattctcttgggtttcaggttgtgcttctattttcgtgcatcttagcgtttctactgaactacaccctcttctgggaacacatc

SEQ ID NO: 13230 - DNA, 286 bp, Zea mays
  Clone ID: LIB3279-212-Q6-K6-D8
ctttaaggagtttgacaacgacaatatctgtggcactgtctacgttgtcatgtagatgttcgtcgtgctcaccttcggcatccaaatgcccatggatcgtggtcaagttaccccatctacaccataatcagagacaacatgcaaaacaagattgttttacctttcaattagacattacgctgggtgacattcagcgcgtaacgcaatggaaccttgatgtcaacgagcatagtgagtagggtgacatgtgaaataaaatcttccatgcacttagttgatttatttt

SEQ ID NO: 13231 - DNA, 671 bp, Zea mays
  Clone ID: LIB3279-212-Q6-K6-D9
gcgtactcggcaaacctggcttcaagtgcatcatggcggagtctgatctgttgtgcatgttgctgatgtgtgggactggaatgatatcccaagtcaacatttgctccaggattcgaaaggtggccttcagatttatgacctacaaaggacctggatgttttgctgctgctgccaccatgatggccaccacaaaggaggccaagttgatgagtggactgctgaggaacagatgtagggaaaataatggtccattttcaaggagtgtctttatcaggaaatggaccattgcagctatgttcagaatatgtgaggaatgttctcctgtggaagagtctacagggggctacactgctactaaattgatacttgatggatctgatgacaagaatccttgtgataaggaactagttaataaggacaacctgctgcagaggaacaagataaatcaaaaataccaaggactgttcaaaggaaaaacaactaaatgccgacaccctgtacaaaagcaagaaccaggagatggagcaacgcccgcatcacccagtccggccaatcccatctcaactgtggtgcaaaaactttggtaagaaggaatactgaaggaccttccaaactagcatgaagtgcgggcaccttgcttttcttttgccttctttttgtgaaaactgtgc

SEQ ID NO: 13232 - DNA, 569 bp, Zea mays
  Clone ID: LIB3279-212-Q6-K6-E1
cggacgcttgggcggacacatggggttcaggcggctcccggcggcaaccgtgtgcctgggagcaacgacttatcagtggcgatcttaggcctgatcgacagcgtgtttggtaacgttaagtctgacatctatgacatgggctctgcttccactccttgatggccatcgctaccaagcctccgtgcgtgtctacatacagggatcgagatttgcggccactagcctaaagtgattggatcatgcttgtgattagctctagtcttggtgtgatcatgcatgtgatacctggtgtacaaagtactacgtttctgttctacactgctacccattcacaactttactgtgtagaatcactcacattatatgatttctgaaattaggccgccctccgcctgggcttgagcgccgccgccgactctcgcattgccatgtcgacgacccgcgatcgcagagcagacagccggtccacggcgctcctggccaggcagccgccgagcgcctgggccaagtcgacggccctcggcacgcggaggcccgggaggaaaacgaccacgtcgccgacgctgacc

SEQ ID NO: 13233 - DNA, 667 bp, Zea mays
  Clone ID: LIB3279-212-Q6-K6-E11
cccagcgtccgcccacgcgtccgggagccaaccaattcccgcagcagtttcagaaccagaacttcagtggcggcgcaggagccaaccagttcccgcagcagtttcagaaccagaacttgagtggcccagggaccaaccaattccagcagcagtttccgaaccagaacttcagtggcttcccaaaccaaatgcccatgccctttcttcagaccatgcaccagaccggaatgcctgcaaatccaatgccgttcggtggcagaccaccagcgaaccctccatctggtccagcgtctattgcccctatggggcaaggcaactttggtcagcctccaaatccacaaggatttacgattccggcgccacccggtggagatgggaaacaaggttcgcctccgcagttcagttccaggcagtttcatcaagggagttcgtcatcctttggccggggaaggacgcatcaccgcggtggccggcattcctatggcagaggtggcagaggcggccggcaccccagataggtatctggagctttgcccccggtgtagattcagtatgagtgttccagtcataatcgagacactaaagattatgtaataccagaagtatgtttcttgtaatgttgtttgctgaatggattggacaccccgtcgaatgacagcgtgctggt

SEQ ID NO: 13234 - DNA, 622 bp, Zea mays
  Clone ID: LIB3279-212-Q6-K6-E12
tgtagccataactaaaaagctcatctcgatgcagacaaatgactacaaaagaggtaagaactacgctatctttcgacagccaaaatgataacttacatgggctgagccctaggtagagtagatatgtggatgtcgccctttccctcctcacaaaacactacaccggcggttcacgaggccaagacatgcagattctcactacaccttaaccagcaaacttcacatgaatcttgtttttctagaaagaaaatgtcactacaaagagaacagctgacaagtacgtcatcccccttttctgtaaccttcagtagaattggcaaaatgcagtttctgcttacagctgctatacaaaatgatttgaatctacatgatagtgtaggttatcttacaagatcacatagaaaggagcccggaagcatattatcagaataaaaaactgctcgcgcagcagcatctcatagtgcgcctcaaatgttgcacatcaaagttggtaagtttatttaaatacatacagaggggatcgaggtagaaattagaattagaaagtaccggcatggtcgctatggcggaagtacaggagaacagcaatctgacgctgttcagaaagcacccgcgatgccac

SEQ ID NO: 13235 - DNA, 593 bp, Zea mays
  Clone ID: LIB3279-212-Q6-K6-E2
gtacgactggcctggcggtgagctcaagcagacacttgatctaggtgacactggactccttccccttgaggtgaggtttttacatgatccatcaaaggacactggctatgttggctgtgctttaacaagcaacatggtgagatttttcaagaccgcggatggatcgtggagccatgaggttgctatctctgtgaaaccactgaaggtccgcaactggattctgccggaaatgccaggattgataactgattttgtcatctctcttgatgaccgttatctctactttgtaaattggcttcatggcgatattaggcagtacaacattgaggatcccgcaaagcctttcttggctggacaagtatgggttggtggtcttcttcagaagggcagtgatgtcgtctatgttactgatgatggtcaggaacagcagtataatgtgcctcaagtcaagggtcatcgacttagaggtgggccacagatgattcagctgagcttggatggcaagaggatatacgtgacaaactcacttttcagccgatgggatgagcagtttttcggtgatgatcttgtcaagaagggctcccacatgttgc

SEQ ID NO: 13236 - DNA, 654 bp, Zea mays
  Clone ID: LIB3279-212-Q6-K6-E3
tccggcgctcttccaaatgtcgccctctcaacttttgttgggtccgtctgtggattgtccccggcctccttaccgtcgcgtccaaatcatcctcacaccccgcagcatctccacgccgccacacctcgtcgcgtcgcgtcgtctccgccgagaagatggtcggaccaggcctctacaccgggatcggcaagaagaccagggatctgctgtacaaggactaccagacagaccacaagttcaccctcactacctacagctccaatggcgttgctgtcactgctactagcacaaagaaagctgacctgatcttcagtgagatccattcacagataaagaacaagaacatgaccgtagatgtgaaagcaaactcagagtcaaatatcattactacagttactgtcaatgagattgcaacaccaggactgaagactatcttaagctttgctgttcctgatcagagatctggaaaggttgagcttcagtatttgcatgattatgctggagttaatgcaagcgttagtctgacagccaatcctgtagccaacctctctgctgcctttggcactaaggctctcgcagttggtgcagaaatctcatttgattctgccactgggaacttcaccaaatacaatgctggattgatgttcactcatg

SEQ ID NO: 13237 - DNA, 610 bp, Zea mays
  Clone ID: LIB3279-212-Q6-K6-E4
cccacgcgtccgcggacgcgtgggcgccccccactcagactcagccactgctgcagtccgccggctagtacacgtacgacaggctgtactgaggttcagagttgtaggttgtgatggcgaggcggctgctggcggcgctcgccatagtcgtcgtggccgccgcgctcgcgtgcggcgcgggcgcgcagctctcggcggggttctactcgtcgagctgccccgccgtgcacagcatcgtgcgccaggccatgtcgcaggccgtcacgaacaacacgcgcagcgccgccgccgtgctccgcgtcttcttccacgactgcttcgtcaatggctgcgacgcgtcgctgctgctggacgacacgcccacgacgcccggcgagaagggcgccggccccaacgccggcggctccaccgtcggcttcgacctcatcgacaccatcaaggcgcaggtcgaggccgcctgccccgccaccgtctcctgcgccgacatcctggcgctcaccgcgcgcgacggcgtcaacctgctcggcggcccgagctgggcagtgccgctgggccggcgcgacgcgacgttccccaacagcacgggcgcggcgacggacctcccgggccc

SEQ ID NO: 13238 - DNA, 426 bp, Zea mays
  unsure (1)..(426): unsure at all n locations; Clone ID: LIB3279-212-Q6-K6-E5
tcagtacgcgcggcagcagtagaaggcgagnagcgagaggagttgcaagatggtggcgatgggcgtggacgaggacgaagagcggcggctggacgagcggcccatgcaccagggctgcatggcggggttcctccacctgttcgaccgaccacagatcctctccggccgccgcctccacagggggcggcgccgactcacgtcggtttccagtggctccgcgactccgtccgagcggtcgatgccgctggaccgggcgccgtcgtcgccggacacgacgccgccggccgcgccgcggccgtcgctgcagctttcgccgttggacctcaaggagggagcgggtggcggtggattcggaccaccgcaggcgtggaggctgccacggctgtcgctggacagccgcgcggtggtcgacgccaggggcaagct

SEQ ID NO: 13239 - DNA, 660 bp, Zea mays
  Clone ID: LIB3279-212-Q6-K6-E6
ccgtccccaaatcgaccgagcgaattcaccacagcttctcaccaccgctaccttcgatggcacccaaggcggacaagaagccggcggcgaagaagcctgcagaggaggagcccgcgacagagaaggcggagaaggctccggcggggaagaagcccaaggccgagaagcgcctcccggcgggcaagtccgccggtaaggagggcggcgagggcaagaaggggaaaaagaaagcgaagaagtccgtggagacctacaagatctacatcttcaaggtgctgaagcaggtgcaccccgacatcggcatctcgtccaaggccatgtccatcatgaactccttcatcaacgacatcttcgagaagctcgcggccgagtccgccaagctggcgcgctataacaagaagcccaccgtcacctcccgcgagatccagacctcggtgcgcctcgtcctccccggtgagcttgccaagcacgccgtctccgagggcaccaaggccgtcaccaagttcacttcttcttaggctcatagtactaggctgggtggtgttggtagacgtggctcaatttatctggtaggggtagtgatggatgatatgatctgcgtctatttgagctgttaagactgatgaacattgttccacgtcacgttgtgtttgatgggca

SEQ ID NO: 13240 - DNA, 644 bp, Zea mays
  Clone ID: LIB3279-212-Q6-K6-E7
gctaacgactgagcgagtgccactatccctttgcttgccctggagaggagagggtgcgctatgggcgatacagggagcagctccattctggtgcacattctggtggtcgccctatgcctgaccgcctttggcttcgccgtcgccgccgagcgccgccgcagcacgggttcaatagtcacagggaggtccaatgccacattttgtgtttatgactccgatattgctactggctacggtgttggtgctttcctgtttcttctctcaggccactcactgctcatgggtgttacaagatgcatgtgcttcggtgcaccacttgcaccaggtggaagcagagcatggtccatcatatacttcgcatcgtcatggatcacatttgcagttgctgaggcctgcctaattgccggagcaacaaagaacgcataccacaccaagtatagggatatggtatatgctggtaactggacctgccaaactctgcgcaaaggagtgtttattgccggagcagtcttcgtggtgttcaccatgattttggacgtctacttctacatgtactattctaaggccactagccaagctacaaaaaggatcagtaagacaactcccagcgttggcatgactggctatgcgtgagccacttaatg

SEQ ID NO: 13241 - DNA, 595 bp, Zea mays
  Clone ID: LIB3279-212-Q6-K6-E8
gcaaaccctagcgagcgagagagcccggagccgagagaccagccagccatggcgctgcgtgccctgtacaacgagatccggagcatgaaggtccgcgacgtgccggcttacctgaagccgcgcttgacctgggacaacgtcaagaagagcgccgaccaggccgtcgaccgctacatgggaggagtgcatcgacacgagctcgccggaccctctctaccacgtctgcatcggagggatgatcttctcctacttcgtcaatctgccctgggagcgcgcccacctcgcccacctcgaggagatggagaggaccggtgggaagcactagatccgctgccccgtccctcgccggcagcgcgggaggacgggtgactttcatggggtccattcaggctgatggcttctgttttcttctgctgttgagctactggagtcatgttactttggtcgttggttttgtacccagacagcaagaaactgtccagcttattgtcttgttcctcgcgtcttgtcataagtaacttcaaacaaaggagtgcatgcattgtgattaaaaacgttttcagcaattgagtacgaatattctctttttttttgt

SEQ ID NO: 13242 - DNA, 668 bp, Zea mays
  Clone ID: LIB3279-212-Q6-K6-F1
cggacgcgtgggccgccgcttgcccgcttttgctctctccctcccggctctcggcttcttctacacgctaccgtaaacgcccccctcccggatcccgctagttcttcgccccagcatggccgcctcgtcgaccgccacctccgtccacgacttcatcgtcaaggatgcgagcggcaaagacgttgacctcagcgcctacaaggggaaggttcttctcattgttaacgtcgcatcccagtgtggcttaactaactccaactacactgagctggcccagctctacgagaagtacaaggatcaaggctttgaaatcctggctttcccatgcaaccagtttggtgggcaggagcctggtaccaatgaggagattgtccagtttgcctgcacacgcttcaaggctgagtaccccatcttcgacaaggttgacgtcaacggtaacaatgctgcgcccatctacaagttcctgaaatctagcaaaggtggccttttcggcgacagcatcaagtggaacttttccaagttcttggttgacaaggagggacgtgttgtggatcgctatgctccaaccacttcacctctgagcattgagaaggatatcaagaagctgcttgggagctcttaaacatatctgggtgcaaaactgtagaaaaacatgtatcaacaatgcc

SEQ ID NO: 13243 - DNA, 458 bp, Zea mays
  unsure (1)..(458): unsure at all n locations; Clone ID: LIB3279-212-Q6-K6-F10
gnaaatctgcagatgccactttgatgccgctgcgtgcctgaattaacggttcataaggagtgcctcccttcctttttcttttcttttctttttttgtttcttctgtactttgacttgccaaggatatacatcagtgtttgagctgttccaaacttgcaatgacagactttaaagtgcagtggtgggcagaaaaaaaaaaaaaaaaaaaaaaaaaaaaaaaaaaaaaaaaaaaaaaagaaaaaaggggaaccaaaaataacgggggcccgtcttgcggccccgtgcccccggtcgcgtgcccccgtgtttccggcccccgtccgcggccccccggctccctttcttggccgggccgggcccccccccccccggggcccccgggcttgcccctctcccctcctttcgctctgntgccgggcccccggcgggcgcccttccctngtgcccccccccgcgcg

SEQ ID NO: 13244 - DNA, 448 bp, Zea mays
  Clone ID: LIB3279-212-Q6-K6-F11
gtaaactctggcaaatttcacccacaaaatcacataagatcagcaaacattggaaccaaattggatccgacagctgcggcaaaacaaacacaagtattagcttagtcactgtcctcttcttcccgctcttcatgctgggccacaaccttctctatgaacttcctgcgaacaccttcgaagacattgccccgagatgaatcgctgccaccatgcccatcattcattaccgggtctgactggcaaagggctaacgcaacagctgaaaggaacataacagtgacttagcgcatatagacgaaacccatgtatatcgctgggaaaagaatttctgggacgatgttgaggtaaaggaaagcttccataaattcggtgtaatctaaatgtgaaagtagattccctaatttcttattacacaaaaggatcaatgatatgctaagagcctaagacc

SEQ ID NO: 13245 - DNA, 275 bp, Zea mays
  unsure (1)..(275): unsure at all n locations; Clone ID: LIB3279-212-Q6-K6-F12
gtccttctatagacctccttcaaactagcgaaagacttgtctgagatattcagcactttgggtttccacataggatggataacttggactgttgcaggggctgtccgatgagagcttctctgggtggcgcagtcgggcgggagtccaggaatgaggacagctgcgaatagtgtcgatggttgtgccactgatgtcctcacttgcgcacagaactgcccacagaactgacaccggttactaatcctttgcctgttctttagcctgtttannnncgc

SEQ ID NO: 13246 - DNA, 607 bp, Zea mays
  unsure (1)..(607): unsure at all n locations; Clone ID: LIB3279-212-Q6-K6-F3
ccccgcgtccgcggccgcgtgggngaaaacaaagcttttccgctgccgaccgagcactccgttccatggcgtcgccttcctcgtgggactagcaagcctcgcctcgctggagaccatcaagaagcaagtggcaatcatgtatttgtggccgaaggcgctagaagtacctataatggacccctcaaaagcatcaaaaaagcctgttggaattctacttgtgaaggtcgtaagagcccaaaatttgcgaaagaaggatctgctgggtaaatcagacccatatgtgaaacttaaaatgtcagatgataaacttccatccaagaagactactgtaaagcgcagcaatctcaatccagagtgggatgaagaatttaagtttgttgtgactgatccagaaagccagtctcttgaagttaatgtcttcgactgggaacaggttgggaaacatgaaaagatgggaatgaacatggtcccactgaaagacctcccgccagaggagactaaatttactacccttaacttgctcaagaccatggatccaaatgatgtacaaaatgagaagtctcgtggccagcttactctagaggtcacatacaagcctttcaaggaa

SEQ ID NO: 13247 - DNA, 636 bp, Zea mays
  unsure (1)..(636): unsure at all n locations; Clone ID: LIB3279-212-Q6-K6-F4
gcanagggcgtctacaatcccaanaagctttttggggttaccaccctggatgttgtcagggctaacacatttgtggcgcagaagaagaaccttaagctcatcgatgttgatgtcccagttgttggtggccatgctgggatcacaattctgccgttgctatcaaagaccaggccgtgcgtggccttcacagatgaggaagctgaggagctgacaaagaggatacagaatgccgggacagaggtggtggaggcaaaggctggtgctgggtctgctaccctgtccatggcctacgctgctgccagattcgtcgagtcgtctctccgcgccctggccggtgaccccgatgtttacgagtgcacatttatccagtccgaggcaaccgatctgccattcttcgcaacaagagtcaagctcggcaagagtggtgtcgaatccatcgtttctgccgacctcgagggagtgaccgagtgcgaggccaaggcgcttgacgcgcttaaggccgagttaaagggaagcattgagaagggtgtcgccttcgccagcaaacagcaggaggctgctgcatctgtttgaagtgaagcaagtgaaatggatgtccacaagagaaataaaggacaatggtcttgaatggctttt

SEQ ID NO: 13248 - DNA, 639 bp, Zea mays
  Clone ID: LIB3279-212-Q6-K6-F6
gttgggtgattgggtttattctgaagcttcaaccatgtgtacagtcttctattactcctcgtcgccccaacccacctgtcagtggacccaaatgggtgtaattgagttagtgtgtgcgtgtgttcggccaccagactaggtgaaggtaatagataagccttgtcttggcgagagggaaaggcatctgtaagagaatattgcaactgaactctgaaactactgtctgttgcttcctccaccctactcctgtgttcttgcttcttctcaaatcccattctctaccgcactctgttgacaacgggtgatagccaccagtgaagcggagcggacgaccggcactgtccggctgtccgcaccgcacaccactttagcatgggcacccaccgcccaccgccaccggcgaggcggcacagcgagcagagcacaccatgacacgtatgtatctccccggagcatcgtgaaggtgccatgtccgcacacccttcgttggccttggccatgtcgcttgcagcccgccgacatccaccctttgcctgcgccactcaccgttcatataccgggcagctggagggccgacgacgctgcgtccaggtgcgggcgctataggctcgagcgccttctcaacgactgcatcgttgt

SEQ ID NO: 13249 - DNA, 599 bp, Zea mays
  unsure (1)..(599): unsure at all n locations; Clone ID: LIB3279-212-Q6-K6-F7
ctcgncattcagatcccaatgccttcgatcccttcgctgaggccaatgctggggactctggtgcggcagcagggtcaaaggactacgtacacgtgcgcatccagcagcgtaatggtcgcaagagcctgaccaccgtccagggattgaagaaggagttcagctacagcaagatcctgagggaggggaagaaagagttctgctgcaatggtacagtggtccaggacccagaacttggacaggtcattcagctccagggtgatcagaggaagaacgtctcgaatttcctcgtccaggccggcattgtgaagaaggagcacatcaagattcatggtttctgagcaaccgccgggtccatagcaaaccaaccctgcatgcagggccagcttattatatataatatctgaggtggagcatatctatctggctgtgtactgcaagcaggcctagtacgccgcctgcgcgttcctcctattacacatataggcccctccctgcgtgtatgcttgttaccgtcgtgtcgaaccttgtactacgaggctccatcgaacatcgatggcttgcttctttatcagaacatgtttgaataaacgctatttggt

SEQ ID NO: 13250 - DNA, 631 bp, Zea mays
  Clone ID: LIB3279-212-Q6-K6-F8
cggccgcgtgggttttagccgccgccgctgctcatctcacatccctcgagaagacgcctgctcctcgccgatcgatacgatggccgtcttctccgacctccacaccgccgacggccttaagtccctcgaggctcacctcgccggcaaaacctatgtgtctggtgactccattactaaggaggacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgccgccgctgccaaggcctcttctaaaaagaaagaaagtggtaaatcctccgtccttatggatgtcaaaccatgggacgatgagactgatatgaagaagctggaggaggctgtccgcagtgtccagatggagggtctgacttggggagcatcaaagcttgtgcctgttggatacggcatcaagaagatgactatcatgttgacaatt

SEQ ID NO: 13251 - DNA, 650 bp, Zea mays
  Clone ID: LIB3279-212-Q6-K6-F9
gcttggtgatgcccagcatgttgaggaggccgagaagagggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgaatccaaggtgaacgagactaaggcaaccgtcaagttccagctcaagaaggtcctttgcatgggcgtcgccgtcggcaacttggcgatggaggagaagcagatccagcagaacatccagatgagcgtgaacttccttgtttcccttctgaagaagaactggcagaatgtgagatgcctctacgtcaagagcaccatggggaagccatacagggtgttctaagtatgctcttttgtgaagtctgctaggttctggcaccgaggttttattgaattaaactcttgttaaggatatgtttttggacgatcctatatttcgtcctggcgctactatgtttcagaatggtggtactactataagtatcctggcgctctaagtattgcttgaaaggatcaatataatttgcgtgtcatacccac

SEQ ID NO: 13252 - DNA, 534 bp, Zea mays
  Clone ID: LIB3279-212-Q6-K6-G2
gctgctttgtattgacggatgaagacattcaacttgttggtgctgcttatcctaaggaaacagcaaggtttcaggaagaacagaggctgaaagaagcaagatcaagatcacggaaatccaaatcaagcttagcagacaatgcgtgcaagacacctgaaggcccgagacctagcggggtgcagcttagcatcacagagttctaccgctcgaagaaagcgcagaacgtagaatctgggaagaagccggcgggagaagggcacgccgcgaggggaggctcgagaaaatcgtccgacagggacctcgacaagagcctgccgaagtctgttcggcgccgcctcctcttcgattgctgaggactaggtagcctggcttttttttggtgagcactgcactgtaatcttggtgccactgctgtagatgacctagggaatgcattaacctattttagccggtgtagattgcgcgcggcccattttgtacagggaacagagcatcgtctttgtctaagaggaaatgaagcaggtcttagttcgg

SEQ ID NO: 13253 - DNA, 440 bp, Zea mays
  Clone ID: LIB3279-212-Q6-K6-G3
aggcgaagacgctatcattcgctcgatgccttcgtcgccttcgtcgtctcgcttcaccaacgacgccaaagacgccggtccaatgaggacttcgcgactggacttcgtgggcgtccttcgcccttctccattgcgagacgaaggcaagactccgacgatgtctgctagcctcacgtcctcatcgggtccggaagcccaagggagattcggcccactgtaacgggccccgcaaggataagcgtgttacgggcttcatctgtaatagtcttttctgtaatgacggtctgtaacctcccctggggaatattctaaggatactttgggttcccgagggcataaacgtccttgtttgagcgtggtaggcactcgggcacctataaatactcccgtacagtacccttgaggggacagattaacagagctattgtcgttccccgttg

SEQ ID NO: 13254 - DNA, 564 bp, Zea mays
  Clone ID: LIB3279-212-Q6-K6-G4
cccacacctcccgagctaaccttacctctactctagcttcaattacagttgcaatcacagcgagagctagctagagggccgtgtaaaatgcccatcaatatgatcgtccttaggagccacctggaggtgtaccacccgggcgccctcaagggggcgttcgctgagttcatctctacacctcatgttcgtcttcatctgccagtgctccggcctgggcttcagcatgctctccagcagggtgcccacgaccccggcggccatcatcgcgggcgtggtggcgcacgcgttcgcgctctccttggcgctgttcgtgggcgcgaacatgtgcgccagcctcttcaacccggacgtgaacttcggcgccttcttgggcggctacatcaccctgttcctgaggctcctgtactgggtggtgcacttgctggggtacaccgtggcgtgcttcctgctccgcttcttgatgggcttgtaggccaccggcaccttcaggctgaccttcgtgttgacgtgcgaggcgctggtgctggagatcgtgctgaccttcgggctgatcttcacggtgta

SEQ ID NO: 13255 - DNA, 659 bp, Zea mays
  unsure (1)..(659): unsure at all n locations; Clone ID: LIB3279-212-Q6-K6-G5
accggtccgaacccccggtcgcccagctccgcgaaccgaagagagcagagcttggcaatggagctcccgtggggaatgctgctgccgctgctgctggtcctctccgtctcgtcctcgtcatcgtcgtcggctgctgccacgctcgccgtcagcgctccgcccccactgcctgttcctcctcctcgtcatgctcaagacgccgaaggcgtgctcatcaacggcaacttcgagacggcgccgcggaagctgaacaagaccctgatcgtggggcgccactcgctgccggggtggacggtgcagggccacgtggagtacgtctcgggcggtccccagcccgggggcatgttcttcgcggtgccgcacggcgtgcacgcgctgcgcctcggcagccgcgcgtcggcgtcgcagaacgtgacggtgcggccgggggcgctgtacgcgctcacgttcgcggcgacgcggacgtgcgcgcaggacgaggccctgcgcgtcgcggtggcgccgtcgctctcggcgcccgccgacgtcgccgtgcgcacgctctacagcggcgcgtccgccgacacctgggcctggggcttccgcgcctnctcccccgtcgcgcaggtcacgttcgccaaccccggcgtgcaggaagaccccgcgtgcggcccgctgct

SEQ ID NO: 13256 - DNA, 629 bp, Zea mays
  Clone ID: LIB3279-212-Q6-K6-G6
gctctcgcaagtcgcaagccaccgatttgtttacaggcgccggagctcccgacgacgactgagccatgtgcggcggcgcgatccttgccgagctccgcgagccggcgccgcgccggctcacggagcgggacatctggcagcagaagaagaagcccaagaggggcggcgccggcgggaggcgctcgttcgcggcggaagacgatgaggacttcgaggccgacttcgaggactttgaagccgactccggtgattcggatttggagctcggggaaggggctgacgacgacgtcatcgagatcaagcccttcgccgccaagagtactttctccagagatggcttaagcaccatgactactgctggttatgatgcccctgcagcaaggttggccaaaaggaagaggaagaatcaatacaggggtatccgccagcgcccttggggtaagtgggctgctgagatcagagatccccagaagggcgttcgtgtttggcttggtactttcaatagtccggaggaagctgcaagagcttatgatgctgaagcgcgcaggattcgtggcaagaaggccaaggttaactttcctgatgcaccagcagttggtcagaagtgccgttctagttcagcttctgct

SEQ ID NO: 13257 - DNA, 526 bp, Zea mays
  Clone ID: LIB3279-212-Q6-K6-G7
ggctgaccccccacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcaagaccgtcacagccatggacgtcgtctacgcactcaagcgccagggccgcaccctctacggcttcggcggctaggctaggccggtcgcgcctcgttgtcgtcgctgcggttctattgtttttgcaattcgcaagttgtggctgggtggcgaaaatgctggttactgtaccactagatcaagcatgttgtgcgtgtctgaagaaatgccaattgtgacttgctgtttgttc

SEQ ID NO: 13258 - DNA, 625 bp, Zea mays
  Clone ID: LIB3279-212-Q6-K6-G8
ctcttccatacgaccataccctacctccaaattcccaattgtcaacctctcctcagagttcgagtgaccatgtcggggcgcggaaagggcgggaaggggctgggcaagggcggcgcgaagcgtcaccgcaaggtcctccgcgacaacatccagggcattacgaagccggcgatccggaggctggcgagaaggggcggcgtgaagcgcatctcggggctcatctacgaggagacccgcggcgtgctcaagatcttcctcgagaatgtcattcgcgacgctgtcacctacacggagcacgcccgccgtaagaccgtcaccgccatggacgtcgtctacgcgctcaagcggcagggccgcaccctctacggatttggcggctgaggggtcaggggtgtccgccagctgctgctggtcgtggcagaagtcttgggtcgcggtcacgaaatggagtgattcgagagtattcttgcccatgggcttagtttcgtaggcttatcactctagactctagtgccttggtccagtagtagcatacgacttgtactgcatttctttgttctgaacctctaaatatgatgaaatgtggattcacttgatctcaaaaaaaaaaaaaaaggcggccgct

SEQ ID NO: 13259 - DNA, 660 bp, Zea mays
  unsure (1)..(660): unsure at all n locations; Clone ID: LIB3279-212-Q6-K6-G9
gggctcgcgtccacaaaccacaccagctgctcagacaaaacccaccctggcttctcccaagccgctcctcctgctcgccacctcgttcctgagctgcggcctcctggtggccgccgactacgccccaatgaccctgaccgtggtgaacaactgcccctacccggtgtggccgggcgtgcaggccaactccgggcacgacgtcctggagggcggcggcttcttcctcccgccgctctcccacaagtccttcccggcgccggcccacccctggtccggccgcatctgggcgcgcacgggctgcgcgggcgccggcgcgcagctccactgcgccacgggcgactgcggcgggcggctccagtgcggcgggctcggcggcgcggcgcccgcgacgctggcgcaggtgaacctccaccacggcaacgaccagacctcgtacggcgtgagcgtggtggacggcttcaacgtgggcctgtccgtgaccccgcacgagggccgcggcaactgccccgtcctcgcctgccgcaagaacctcaccgagacctgccccggcgagctgcagctgcgctccccggcccgcagcgtcctcncgtgcaagagccgctgcgaggccttccgcaccgacgagctgtgctgccgcaacatgtacaacagcccgcacac

SEQ ID NO: 13260 - DNA, 330 bp, Zea mays
  unsure (1)..(330): unsure at all n locations; Clone ID: LIB3279-212-Q6-K6-H1
gnaactctgatggtagcatggctcaacccacagtacctgatggtttagggccgattcatccgatggtgcagcagcagccttatttgcaacccagggcaacttttttgccggaccttcatatctatcagctgccttatgttgtaccgttttaagtctgttcgtagatgagaagtagatgagatgttgtgaaggagctgtgtggatgtgggatataatggttccctgccgcaattttccagctttgttagcaagattgtaatgtaatgttggttaattattttgctcatttatgtaagcagttgaactgcaaaatcttctttctaggcagtt

SEQ ID NO: 13261 - DNA, 601 bp, Zea mays
  Clone ID: LIB3279-212-Q6-K6-H10
cctctttttcttctgctactattacattgggggtttgctagacctctctttcctctaccgagtaagacaaagaatgaagagaagaagcccatacagacgtttcggccatataacattgctcatcgtggatcaaatggggaaattcccgaggaaacagctgctgcatacatgagagctgtggaggagaggggcggattttatagagtctgacatccttgctagcaaagatggggccttgatttgttttcatgatgtaacacttgatgatacaactgatgttgccaagcgtaaggaatttgccaatcgaagaagaacctatgaagtggagtggtttaatgttactggatggtttgtagtggacttcacactggaggaacttaaaacacttagagtgaagcagagatactcgtttagagatcaacaatacaatggtatgttttcaatcatcacgtttgaagaattcatttcaattgccctagatgcagacagaactgtcggcatatatcccgagattaaagatccagtttttatcaacaagcatgtcaagtgggctgatgggaaaaagtttgaggacaaatttgtggataccttgccttaaata

SEQ ID NO: 13262 - DNA, 550 bp, Zea mays
  Clone ID: LIB3279-212-Q6-K6-H11
gggggctttacaataacattaatcaccctagcaaattgatcgtgggagctgatttccattgcttcaagaacaagatcgagccaaatgggaagaccctatttgtgcgaatggtggtaaatggaccatcagctgtggaagaggaaaatctgatacattttggctgcacactctgctggctatgattggtgaacaattcgactatggtgatgaaatttgtggcgcagttgtcagtgtgcgtgggaagcaggaaagaattgctatctggacaaaaaatgctgccaatgaagctgctcaggtaagcatcgggaagcagtggaaggaacttctggactacaaggactccattggattcattgttcatgacgatgcaaagaagatggacaaaggcctgaagaaccgttacacggtttgatcctgatgctggaatcccagagagtagtagcagtagctggcccaaatgcatgctggatggttttatctattgctgatgagttgtttaagcaagatctatctaacatgttgcatccattcctgtattgtactccatttt

SEQ ID NO: 13263 - DNA, 625 bp, Zea mays
  unsure (1)..(625): unsure at all n locations; Clone ID: LIB3279-212-Q6-K6-H12
tatccttcaagcgcaagctgcctcctgctgggggggcgggcgtgagaagggatggcgggccgtggcaaggctctcggcgctggcgccgcgaagaaggcaacgtcgaggagctccaaggccggactccagttccccgtcggcaggattgccaggttcctcaaggcgggcaagtacgcggggggggtgggcgccggcgcccccgtgtacctcgccgccgtcctcgagtacctcgcggctgaggttctcgaacttgccgggaacgccgcgagggacaacaagaagacccgcattgtgccgcgccacatccagcttgctgtgcgcaacgacgaggagctgaccaaactgttgggtggtgccaccatcgcgagcggaggtgttatgcctaacatccatcagcatctgctccccaagaaggctgcctcctccaaggccagtgtcgacgacgacgacaactgagactgcttcctgcagaaatgatccgaccaccgccttgttttgtnggaataggatgatgttgtcttccgggaggagtcgggtttgttgggaaggaaaattagattagtatcagtttttttgaatgggatggggacgtggctgtgaatctcaggggtgtatgctcgttgag

SEQ ID NO: 13264 - DNA, 628 bp, Zea mays
  unsure (1)..(628): unsure at all n locations; Clone ID: LIB3279-212-Q6-K6-H2
cggacgcgtgggctcgatctcgcacctagggtttcgtctcgccgctctcgtcctccgcgaagatgccgaagaacaagggtaagggaggcaagaaccggaagcgaggaaagaacgaggctgacgacgacaagcgcgagctcgtcttcaaggaagacgggcaggagtacgcgcaggtgacccggatgctcggcaacgggcggtgcgaggccatctgcgtcgatggcacgcgccgcctctgccatatccggggtaagatgcacaagaaggtctggatcgcggctggggacatcgtcctcgtcggcctccgcgactaccaggacgacaaggccgacgttatcctcaagtacatgaacgacgaggcgcgcctgctcaaggcctacggggagcttcctgacacgctcaggctcaacgagggcgtcgacgtcgatgggcccgaggaaggcgaggagggcagcgactacatccagttcgaggacgaggacatcgacaagatctaagaaatctgttcctgcttacggctacctgtattgttacgtgacgcgttcttctgcttctgcttgcggctacctttattgttacgtgacgtgtactggtatgttgtggtatggtttagcctgngttatcttgt

SEQ ID NO: 13265 - DNA, 642 bp, Zea mays
  unsure (1)..(642): unsure at all n locations; Clone ID: LIB3279-212-Q6-K6-H3
cggncgcgtgggttttaattttgttttggctaccaaaaaaaaaaaaaaacgaatagtttgtcccgaacacggaggacaggtactggtaaagtttgagttacacaggaatacatggcacggctaccgcaaactacttcatcgagcgaccctgcttccttgcgaaatatgaaagcaacgatgcctgcccatccgaagctgcttttacagctttttccttcctggtaagctgagagggcttcatgctagcttcgacttgagtgtcctcgatctttctcttgaatcccaaatcacgttgtgtttccaaagtggcaccagccagagtcatagtatcttcatgctcgatgctccacggtgtctcgaaaacttgtggttccaaggtgacaggttcatcctttatagtacaattagtagtttgcttctctcgggactggtgttggttgccgtcccctccttgattttctactgatccatcgcattccactttcgctgctttgtaagcatgagcaagctcccgtgacatattctcatacttccctgatagatcgtaggcagtcgatttcttggtgaagaattttgaaataggcttatcagtagctccgatatgtacctctttgatgcactcaggtccatcaaaatgatgct

SEQ ID NO: 13266 - DNA, 656 bp, Zea mays
  Clone ID: LIB3279-212-Q6-K6-H4
cccagcgtccgcccacgcgtccgtcttagggagccactttagctcttgctcagagagatattaaaagaagcttagcctattctacaatgtctcaattgggttatatgatgttagctctaggtataggttcttatcaagctgctttattccatttgatcactcatgcttattcgaaagctgggttgtgcttaggatccggatccgttattcattcaatggaacctcttgttggatattcaccagataaaagtcagaatatggttcttatgggtggtttaagaaaatacgttccaattacaagaactacttttttatgtggtacactttctctttgtggtattccacctcttgcttgcttctggtccaaagatgaaatccttagtaatagttggttgtattcacccttttttggaataatagcctcttttactgcaggattaactgcattttatatgtttcggatatatttacttacttttgatgggtatttgcgtgttcattttcaaaattacagtagtactaaagaaggttcgttgtattcaatatccttatggggaaaaagttatccaaaggagtcaatagggattttgttttatcaacaatgaagagtggagtttcttttttttcacaaatataccaaaaattcctgctaatac

SEQ ID NO: 13267 - DNA, 625 bp, Zea mays
  Clone ID: LIB3279-212-Q6-K6-H5
aaaccgcgccccaccgcttccccgttccccaccccgaccgactgctccccctcccccgcaccagcctcaaggcatcgccggcgccgcaacatcgctgaggaagcccgcacccctgcccggatccgatggccaacagcaacctcccgcggcggatcatcaaggagactcagcggctgctgagggagccagcaccggggatcagcgcgtcgccctcggaggagaacatgcgctacttcaacgttatggtccttgggccggcgcagtcgccctatgaaggtggagtttttaagcttgaactctttttacctgaggaatatccaatggctgccccaaaggttaggtttctgacaaagatctatcatcccaacatcgacaagcttggtaggatatgcctcgacattctcaaggacaaatggagcccagcacttcagattcgaacagttcttttgagtatacaggctctactgagtgcgccaaatccagacgaccctctttcggataacattgcaaagcactggaaagccaatgaagtagaagctgtcgaaacagctaaggagtggactcgcctgtatgcgagcggtgcatgagaacgcagtgatgttcttgatgtaataacccatcatac

SEQ ID NO: 13268 - DNA, 636 bp, Zea mays
  Clone ID: LIB3279-212-Q6-K6-H6
ggccggtcaccccatctccaccgccacatccgtcgtcttccgccgccgccgatggcccgcctcttcacgcaaaccctcaccctagcccgccccgccgcctccccctccactaccgccgcatccgcttccctccgtggcctcgccaccaaggtcgagatcatcgagatcgatctcgccgaggaagacgctggctcctcgtcccacggctccccctcctcgtccccatcggtcgaggcggtcgggatccggcgcctggaggaggccatccacggcgtcatggtgcgccgcgccgcgcccgactggctccccttcgtgccgggagggtccttctgggtgcccccactgcgccgccagcacggggtcgccgagctcgtgggccggatcgcggctgccgggggcaccgaagggggcgccggggccgttggtggcgcggtcgaagtcttggagctcgacgcgcccatgacggaggagcaggcgttttgtttctccaccacgcgcggctggccctcggcctctttcttcgtcgaagggaaatctacacatttgaggaaatcgaggaaaggtgcaactcaaactgatgatgaagaaagctgattcgtttgtgctatgttgcaaggggctcctacaagaaaacac

SEQ ID NO: 13269 - DNA, 598 bp, Zea mays
  unsure (1)..(598): unsure at all n locations; Clone ID: LIB3279-212-Q6-K6-H7
gggtcgcgcactcgagaaaagacacgacgcgagggccgtgccgggngaagagaacgcgccgcaccgggcagcgaacgaaaccaagccaagccatggcagccaaccccaaccactgcctccgccgcctcgcctcagctctctcccacggtccccggcctccgactcctcccctatccctgctgtggccccgcctcgcgctctccagctccggcccctccacgggcccgccgccgccgccgccggatgccgtaaggaagggggagggagaggaagcggcggaagctagggccgccgaagccgacgccgaagcggggaaggaggaggagcatgaggccgacggcggtgcgcacgtgaacaaggccaccggcgaggtcggcggcccgcgggggcccgagcccacgaggtacggcgactgggagcgcgccggccgctgctccgatttctgaaccgccgctggccgcgaggtgaggccgtcagcgtcagcacggaacctgtggatgtggttccgtatcgtactgttggatctgtctgtcgtgtgctagtagtgtgcctgttgtcacctgtgcaaagggcggcgttaaatttgcgttttgcttcg

SEQ ID NO: 13270 - DNA, 584 bp, Zea mays
  Clone ID: LIB3279-212-Q6-K6-H8
ccccgcgtccgcccacgcgtccggcccgtcttcaccaaggtcgaccagctcaagccgggcactaacgggcacaccctcaccgtcaaggtcgtcagcgccacccccgtgccgggccgcgcgcgcccgggcgcacccgccgccgcctcgtcccgcgcgccgcgcatcgccgagtgcctcgtgggggacgagaccggcgtcatcgtattcaccgcccgcaacgaccaagttgatttgctgaagcccgatgccacggtgatcttgcgcaatgccaaaatcgacatgttcaaaggatcaatgaggcttgcagtggacaaatgggggcggattgaggctacagagccagccagcttcacagtgaaggaagacaacaacttgtcccttgtagagtatgaattggttaacgtggctgaataaccgtcgaagcgtttctgcccccctttcttctttttcacgcacgccataagatgataagaaaacgaacagcatctcgaagctgagtttatttgttacggtggtcgataaggtcaaggcttctgctgttacacctttggatccaatccattaagatgaattacccttgcatc

SEQ ID NO: 13271 - DNA, 637 bp, Zea mays
  Clone ID: LIB3279-212-Q6-K6-H9
cggctgtgacggctccgttcttctgggcgacgagccgtgcttcatcggcgagaagacggctgtgcccaacgccaactcaatcaggggcttcgaggtcattgacgccatcaagaccgagctggagcgggagtgcccagatacagtttcctgtgccgacctccttgccatcgctgcccgtgactgcgtggttgtgtctggcgggccgagctgggagattgaggtcggccggaaggacagccgcaccgccagcctgcagggcgccaacaccaacctcccagcaccgacgtctggcgtcgacaccctcgtgcagaagttcaggaacgtgggcctctctaccaaggacatggtcgcactctccggcgcgcacaccatcgggaaagcgcggtgcacttcgttcagtgcgcgccttgccggcgccggcggcgtctcggaaggcggcgcgggcgccttcaaggacctcaccttcttgcagtcgctgcagcagctgtgcacggggtcggctgggtccgcgctggcacacctggacctcgccaccccggcgaccttcgacaaccagtactacatcaacctgctctctggcgacggtctgctgccgtcagaccaggcactggcgtcgtcggctgccgtgcctggggta

SEQ ID NO: 13272 - DNA, 562 bp, Zea mays
  Clone ID: LIB3279-212-Q6-N6-A1
ggaacaactttttttttgatggggaggacgagtataatacagacacgagacacgacgaacacgaacagcgcgcggcggcagactacgtacaccgtacacgtaccaacagggtgggcgaggacgaggaggctacaagaacacaggcagcagaagaatttcttaccaccacaccacgcacgcaccagctactgcgttacaaatcgtcaagtcctttatttatctaccatgtttcgatgcctttcgtcttgccttgatccggtgatcgacaccgatcgtcgtagcggtagcagtagagcggaccacatgcacacacacgcgcgcgcgcgccattgttggacgggcgaggaataaccgggcgctactgcatggagcactcggcggggaggccctgctggtagcgcttggggtcggtgcagtagttgtagatcatgtacttgcgctgcacccagcgcatccgctgctgcagggtgaggtccagctcctggttgtaccagtccccggcgccggcggcggaggcgggggcgccggtgccctcggtgccgacggtggcgccgcagcgggt

SEQ ID NO: 13273 - DNA, 561 bp, Zea mays
  Clone ID: LIB3279-212-Q6-N6-A10
aaagagctgtggattcgtcaacgtcacagttaacacaagcacaagttcattggatcaccagttcaccgctggctgtgcaaggagcaaagcaaacaagcacacatagctgcacgcgagacaccaaaccaatcacaccacgctggggtagtcgagacaccacgccgtcaatcaggacaccctgaggcactgctgcttgaacatcttgctcgtctgctgcccgctcgccgagtcctccacggtgaggccctgcgcgccaaagcagatgttgatgagcctcccgttgccgcacccgtgcttccgggccgcgctctctgccgtcccggcgccacagccgtcgtccatggacgagttgttggagcacgaggggtcctccatggcgtcgtcactatccttcatcctgccggcgggcggcgtcaccatggagatctcgtcgtcgaggcagatgtccttcatcttcgccagcggctgcggcgtggacgataccgaggacctcatgaaagtgtccgtcggggacgcggaccgcgccgtatatggcgccagctgtggcatggcctccatgat

SEQ ID NO: 13274 - DNA, 612 bp, Zea mays
  unsure (1)..(612): unsure at all n locations; Clone ID: LIB3279-212-Q6-N6-A11
tcgcatgcacgcgctacgctaagncttggncatccctctagaagcgnngccgccctctttgttttgttttttttcttttttttttttttttttttttttttttttttttctttttttttttttttttttttttggagccccccggagaggggtagtagtatcaattttaatatcagcaaatacaatatagtatgagattctgaatgggtatgggggggaaaaaactgttttaatggggcctacaacatatgggcatagccccaaaaggaacatgggtgggaagcaatcacccccccatcaaacatttggggctccagatcaatacttacaacacccatttgggccacccaaaattggcggaaaaaaaaaccccaaaggggaaaacaaaaaaccatgcacaggagggcccctttggcccccccattgggaccccaccacttatatctcccctattgggcacacttcaaaggtaaattaatttaaggcgcgggcccggggatttgcttccaaaaaaggaggctagaaaccattcttttgccaaaggcaccattttgaacatttggcaataatcaaaatgaaaaaggaacccctgtttcttgggccctgggtccc

SEQ ID NO: 13275 - DNA, 574 bp, Zea mays
  Clone ID: LIB3279-212-Q6-N6-A2
tcgcgatctagaactttttttttttttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgccgtagccgccgcctccacggccaccaccgtacccgccgccgccgccgcctccacggccgccgcgggactgggcctcgttgacggtgatgttgcggccgtccagctccttgccgttcatgccctcgatggcgttccgcatcg

SEQ ID NO: 13276 - DNA, 566 bp, Zea mays
  Clone ID: LIB3279-212-Q6-N6-A5
agtggaaaggtacttttattacaataagatgtccaagacatccacagagtctaatacatagcatagtcattaatatcatcaaagtgcgaaaatacgaaacatatcaggccttcacaggcagctgactgggggtttgccactaaaataaactagaactcatcatagtcttgaaactcctcaaagtcctccatgttgccagcatctcctcctgaacactgagtacagtggggacaaccttcaccaggttgttgctcaagaagatcttcggcaacacactcaggaaccacgggctgctcattgtctggcacttgagattccagttaccagggtgattcttcaaatcctcgtgaccgcacggagctcgtagcccagagggtgtccacggcgcggcgctgaccgcccacactggtgagcgcggccagaagcttcgggggtgttttctcccgcctgtcaacacgctgggagcccaccgcacaccacaggacctctcacaagcacgagacgtgagcacagaccgagacgtgatagtgctaatctcccacgatccgaggctcttctcttgctct

SEQ ID NO: 13277 - DNA, 489 bp, Zea mays
  Clone ID: LIB3279-212-Q6-N6-A6
gaacaacaatcatggccaatagggggcctccaacaatttatcacaaaatacaaaatgggaaacacacagcagcagcacccaatggagtggacccatacagagggtgctcaaaataactcaaccattaagcaccagcgaactaattattaaccggctactcaatagtcatcgccctcgtcaccctcgtcatttgcaccctttgcgccgacttcctcatagtccttctcaagagcagccaagtcctcacgggcctcggaaaactcacccttttccataccctcaccgacgtaccagtgaacaaacccccccttggcgtacataagggcgaacttgtgatcgatgcgcgaaaacacctcaacaacggcagtgttgttgctgatcatacacacgggaccctggacctttgccaggtcgcctccagggacaacaaacgggggctggtagttgatgccacacttgaatccgggggggcaccagtccacaaactgg

SEQ ID NO: 13278 - DNA, 499 bp, Zea mays
  Clone ID: LIB3279-212-Q6-N6-A8
ccccgaatcaatcggaaagatccccttggggaattttaaaaaaaaaaaacaagggggggcataaacgacgggggggggggggccgaccgaccgaccgaccacgagcttaaaggggtctaattaaaagggcttcagacagaccccccctacatccataaagttctaataaaaaggggctaagcaaaacgaccacgagctttaggccccctcgcccgggggggccggctccagtaggggcgcctccgcctcctgaacctccttttccgggtggggccccttttgggacttggggtacaccctcataaacgggcccccccccccgtactttgggggggggggctcgtagggcgacccgtcaaacatgccccaaaagtccttttggttcagctcccacaccccgtactgggggtgggagctggggtttttgataagccactgttccagccggggcacagcctccgggccgttaaacccctcccccctaaacaccgccccgggg

SEQ ID NO: 13279 - DNA, 602 bp, Zea mays
  Clone ID: LIB3279-212-Q6-N6-A9
aagagcacatgaaaaccaaggatctattcatgctgatgtaagaactaacaagtcatcgttcattggcattcagacatttggttcattaaggtggactcaactctgaagtcctaacaaaagagcaggaacgcagctaagctcgatgagttcgaaggaagcaaaagcggaaacaactaaggagtacttgatgaactggtcctgagtctctgaccatcagaaagacgcactaccctcgatcagtttcaacgaagcagaaaacaaaatgacgaaagaatcctagaagaacatctccacgaactgacccagctcgagatcgccgcacacaggacgtgctgtgtcaacaccgtcccatccaggcttgatcacgcacgcgtgtctactgcgatgacggcgcctcaggtagtatctcgtcgtccgccggaagcggcaacacctcctccttgtccgacgtcgacgtccgcgggtggcgccgatgcagcgatgctgatgacgacgcttccgctagtttctggatttgctcccaacgcagcagcgcctcgtccaaatcccgcgtcgacaacgggagccgcaaagtggtagcgctgccgccaatgctccctgtg

SEQ ID NO: 13280 - DNA, 635 bp, Zea mays
  unsure (1)..(635): unsure at all n locations; Clone ID: LIB3279-212-Q6-N6-B1
gcgccgcagctgctggaggtgctgcgcccgcgccgtggcgcgccactcccccgcgcgccgctgcaccgtcgtcatccgccgcatcagcttctcctctaggttgcaccgcatcttctggatcttcacctccagctttcttgactgcgcttcagccttggcgctctccaggttaacccaggcctggatcttcgcctcttccctctgatacctgatgcagctcttggccctgtcgtcgtcatcccaacggcagtcgccgccgccgctgccgcgtctatcgcaggctgtcccgccgacggtggcctcgaagtgcctgaggctcttggacacgtcctcgtcgtcgtcctcctcctcctccttggagctccagccgacgagcgtggcgtgggcgccgaaccgcgcgcccaggtccagcttggcgaggcggaatcccgccagctccgagatgtccgtcccgccgccgccgccggtgtacggcaccagcgggcccgacgaccggctagccggcgtgttgtgccgcgccggggacgcgctcttgagcggcgtgtggcacgagctgccccagcgcgtcatcttcgtgccgacgtccctcctncgctggcggctgccgtcgtcgtcgtcggcggcggcgcccgtcg

SEQ ID NO: 13281 - DNA, 471 bp, Zea mays
  Clone ID: LIB3279-212-Q6-N6-B10
ggggggcaacggggggggggggggggggtaccccccccctttttttaggggaaaaaaaaccccggggttttgaacccgggcccccttgggaaaaaaaagaggggcccccgggggggggccccttttaacccccccgagagggggggggtttttaaagggccaaaaaggggcccccccccccccggggggggggccccccgggggggggggggcccccttcccgggggggggaaaacctttgcccccccccccccccggaaaaatttttaaaaaaccccccccccccccaaaaaaacctttcccccttttggaaaaattttttcccccttttaattggggcaaccgggaaaatacccccaaaaaaaaaaatttttttttttttggggccccccccccttttttttggggggcaaaaaaaaatcccccccccccacccgggggaaggactccccccccggcccccgggggggg

SEQ ID NO: 13282 - DNA, 541 bp, Zea mays
  Clone ID: LIB3279-212-Q6-N6-B11
acgaaaactgtcaaatatctcaatatctctttttataattgattagttctgcgaatagatcttaaacaggttgagtcaggtcgaccaagaacacacacatcgaccaactacttgttcttcccggacctcttcttaccccctgccgggggggcggcgctgacctggggccgcgggtggcgctcggcctcggcagcgtcgagccacttgagcgggttacggttgtagaaaggccagttggggacggtgaccagagccgtgagcacgacgccgccggcgtagacgagcagcatgagctggaagtccgcgcgcacgtagcccaccaggaacgccaccaccgcagacgccaccagcagcacctgcatcagcatctccgcgcgtttctgccccagccaatccataatcctctggcgggtgctcgtcgctggagaagggcccgaaaatggagaattgggcacctgacgtagggcggcaacggagagaagaaaacaagagcgcacgagagtggaacggtagaagtgtagaatcacgagatgggaaacgc

SEQ ID NO: 13283 - DNA, 566 bp, Zea mays
  Clone ID: LIB3279-212-Q6-N6-B12
gtgttttttttttttttttttttttttttttttttttttttttttttttttttgcaaaataagttacagcttccacatgttcgagggtcccacccagaatggtccaatatcgggttacagtccacacacaattctacttttttgcgacatggggggggggggttcatcatcaatcccctccagcatccttggcatcaacggggaattcatacccctggtcgccgcccaaggaagagtctgccctcaaggaaatcatgtagtcctttctcccagcctctgccggggcagaaaactcaagtttcactctcgccctcttctggagggccactcttttgattgccagtaactgggttggggagctgtccccaatcaccagccaccagcctttttccttaggcttgggaaaccttggcgcctggactggacccacctcagatgaaaccttagtcatgtcaccctccaaagttacctgcacgggtacattggcaccagcgcttatttcatcaccctcacggacctcatagggcatatcaacattgggggaaccgcttggtgaattcaatgat

SEQ ID NO: 13284 - DNA, 411 bp, Zea mays
  Clone ID: LIB3279-212-Q6-N6-B2
ggaagggaacccccaaaaaataacattttactcttaaaacatgacatacaccccattgccccaaggcaaaagggggggggtttttatcagagaccccacacaacaatgggtaaaaaatgcaaaaaaaggggggggggccacccaaaaaaacatggccattgaaaaggccggggccctaaaatggggaagggtccgaaggggaaatcccttaagggaaaaacgggtcgggggaacaactggaaacgaccaccaactttgtcctttttaaaagagccctaggctttccaaaaaacgaaggggttcatcaccaaaatgaaaaaagaccccttgcaaaatgatcctcctgtaaaataaatgaggaaaataggaacgggccattccgccctttggaggaaaagggtaatgaattgg

SEQ ID NO: 13285 - DNA, 173 bp, Zea mays
  Clone ID: LIB3279-212-Q6-N6-B3
caggacttgctatgccacccttatcaaatctcgtcttaatatcatacatatatatagtcacgacattcttgaagctaggtttctattgataatactatcttggctttccccctttcaactggggaaggtggtacattggggggcggcatctaacatccaaaatcataaggaac

SEQ ID NO: 13286 - DNA, 578 bp, Zea mays
  unsure (1)..(578): unsure at all n locations; Clone ID: LIB3279-212-Q6-N6-B4
gtcacaatggtgttatcattatcatacgattacttcgtacatataaagagtggcaattcaactgtaatatcaccaaggtaacaacagaaaagttggaattacagagacgggagctcccctagttcaatgagctgccggtccaatatattgacctcacttcttcctggcaacagcagctgcaattccaccaaccagaagtccgaccgcagttgtcgcaattcctattccaatcagaccatctttggcaattttatcttctattgccttcttcagcgatatggcctgccgccaatccgcttgaatctccaaacaacgatctgcaagttgcctgctttttgagtagtcgccaatcctgtagaatccaacagccaacaagtacagcttttccctagtctgcagaggactggcagaattatccaaagaagcttgaagcatgctgattccacggtttacatcgtctgtctgcctggagtgcacaagggcccatgacaacctcataaggctttcattcctctgttcctcatttgcagcattgacaagctctcncttcacagccgcgatgaggtcgcggtcgcacc

SEQ ID NO: 13287 - DNA, 581 bp, Zea mays
  Clone ID: LIB3279-212-Q6-N6-B5
gagattcatcaacagaccattaaatattgtttttgatatctataactaacgtattgagccactacctttgtttgcattttgatggtttccttatccatgctatggctcaacaggacatggactttggacatgtttcttctttgcctgcttgtctgcaaaactagagatgcttcatttcttaacagactgacaagttctctggaacctggtgatttcacaagtcctctcttcagtggcttctttgatacttgtgtcctaaaatgggagcatttactgtttagctctcccagtggtcctctgtttgtcaagctggagttatgatcttcctgtgcagatgtgaattgtttttctactctggcaagctggtttaaatcagggccagatacactaactggttttgttgttgatacatcaactacttctttacttttggatcttggtgtagttgagctcccagctttattgaattgaacttttgaacttcttgagataaacatataggtcctcttccttttagggcacattacagcattagaacctacaacatttgaatcacttgcaccagatcccttaactccttc

SEQ ID NO: 13288 - DNA, 561 bp, Zea mays
  Clone ID: LIB3279-212-Q6-N6-B7
gtgtaaattcgtacgccttatgtcttggtttcacgattacatcaccgttgcagcaatagacacggttacttctaacgaattcttaatccaaaatcttcttatttcgttcttccaaataacagacgagaaaccatgggtctggttcccaggatttgtctgggcaggaaggaaccctggatctcacaggaactgatggaaccgaacccgaacatccttctgtgaagactcacccgtcccgccttgatcaggcgcggcggtggccgactcgtccttcgcgagccccgtttccgatttggactccgccatgttcagtgttagcatgagatgggtgccgcaccgagggcagtgcatatccgtcgtagaaaccggagtgccaggggagctgctgccgtcggcctttctcctcttgcgcaccgccgcggacgtctcggtggagacctccccgatctccgtcttttccttgcgtccgggcgccaccgcggaccggccggagatctcgtcgttcggcgcgctatggcgactaggtgccgccaccgtcgcgtcgctggattccacctcgtc

SEQ ID NO: 13289 - DNA, 584 bp, Zea mays
  Clone ID: LIB3279-212-Q6-N6-B8
tcgcgatctagtttagctggattgacaccatcagtcataattatccaccaccattagatgctcatgtggttgcttctgttatgactgtatggagcaagcttcaaccagagtatgctgctaatatgtggaaagaagcccttaacaaacggcttggggctaagggtcttgacctttctgaaatcatagtggaatcagagaaacgtgggataacatttgacaagttactaactgttcctgagaacgatagctgggtctatgaagatggtcagtcagcatcttgtgtggctttcgtccttatgatgtacaaggaggctggactctttgaccctattaccagctctattgaagttactgaattcacaataaaagatgcttatatcctcaacttttttgaggacaactcgacccgacttccggagtggggcaacaaggatgacgatgtgaagcttgccttttgccagatcaagggcaaggaccggatggagctgcctggatacaacaccatgaaaccctatgcccacatgaacgagaggagtgcatgcctgcctgcaaattgcaacaaggataaaggctgatagtgccta

SEQ ID NO: 13290 - DNA, 578 bp, Zea mays
  Clone ID: LIB3279-212-Q6-N6-C1
gttcaccaccaaacaacacatgaaatacgaaaccacgaaccaatccaacagaaagacgagacacccattttgtagagatgacagtttctttagctgaaactcgtcagcggggatccacacagctgcacgtccgagatgtcggagagcctctgccttgagctggacgacataccaaactcgtccaggtccgagatgctctttctcttgtgcgccgcctcttgcttcggcctctcctcggacgcctccatgatggggctcagggctggagcctgctgctgagggtcctcctctgatgtgtagagtatgttctggatagcatggaccggcacgtgctcaacctcagggttttggcacaagatctcaatgtcccgcagcttggaaaagtagaaatctctctccttctccaggctatccacaaggagcttcagctcagttatttgttcgtcataagctggtccactagagttggctacaggtgatggcttaacactgcgctgtggtgcacccgccgtctgcccgcttgcccgcttagcgccatgtgatgcttgagccttgtgacctgtggatgcagacttggc

SEQ ID NO: 13291 - DNA, 587 bp, Zea mays
  Clone ID: LIB3279-212-Q6-N6-C10
aatgaaatgtgagccgattacatttggcaaaaaccagatgtttgaacaaaaccatctcgactaagggggtaccggccatacccgctccgctgatgcgccgccgacgcaagcggttccgcagaagaggcgcacgccctactatccggataccttcctctatgtacaatgccgtgggggtgggccggcatggaagagtccgagacaaagcctgtgctctccgagaagtaccttgtctgtggactggaaggtgagaaccttgtgcgcgagacgaaactgccgggagcaccgtgctccggagcatagcttggcccgaatatggaggaaatcggatccaggccggcgttgtctccgtagtccacgacgctgaacgaatcccttgtgctctcggtggtgaacgaggactcgtcggagctggtaaacagcgaccattcacttgatgtcgcttccgagaagtccgcgctaaccgagtctgcaaaggcatcgtcggcgtgatggaaagctctggacctcagctctgcatgctgatcttgggcatagccttcgccatcgggtctgaaatcatagacgccatatgcctgatcgtttgc

SEQ ID NO: 13292 - DNA, 207 bp, Zea mays
  Clone ID: LIB3279-212-Q6-N6-C11
gggaccggccaacgggttttaatttttgcaagaaaaaagggggggggggggaaggcccaatttacctcagcaagggttttaagtttttttggcaaaatgggggggggggacaggttaaggccccgttccctgcaaatttttcaggggcccaactaaacttttaaaggggggcctaattttgcccacccctcccggggcccggggggg

SEQ ID NO: 13293 - DNA, 537 bp, Zea mays
  Clone ID: LIB3279-212-Q6-N6-C12
ggcgcgggtaggggtggtgcttggagccgccgaggacggggcgcgggtttttggcgtcggggttgccgaggtcgttgtagacgtcgtagcggtagacgcggtcgtgctcctggtacgggccctgctggtcgtcgcccctcatgttgcggagctcgtcgtcgcggtaaggcttcatcgccgccggcatctggctggggaggtacgtgtcgttggagaagaagacgcggttgtagcggtacttgtactgcgggtacacccatgagttggcgacgaatacgatggggccgtggccggggacgtcgtcgatggtgatggtcttgaggaagaactcggaggcgtggttgttcttcacgatgatggcgcccgggacgccgtgcttctccacctcccagtcgaaggtgacgcggaactggtcctcgccggccataagcggcggcgggtgcagcagccactgctccaggctcgcctcctgacccaccttcccgcggttcccgttgttggggtcgacgacggtggagctgacgagttggcatgtga

SEQ ID NO: 13294 - DNA, 633 bp, Zea mays
  Clone ID: LIB3279-212-Q6-N6-C2
gatatcacaatgtatttgtttcttttgataaaagtcacatgactctcgatgaacaagacgaatgtacaagtcatctttatgctccacgatgtcactccgtatatccaagcataatcgcatgaacatgaatccctacaactttagatacacaatcttaagtgctacgcaggtcaacaaacccaagcaacggtcacccctgccattgctacaatggacaccctactacaaaactgcaagagcagcacaaccaagaaatcttttctggggatcccgtgactgaaaggacaaggctccacccggacaagcgtctctattcatggagttaacagaagccatcctcctcagatgctttgcatttggaaaatcacaggtgatagccctgaattgaggtgttaaatcttcccagctgcttctgtacgcgcccttagtgcctcggtgcgtttactcctctccatttcttccaccaaccagtcaacgccatgtttgatccccgtcccattgaaggcagatccagcctggaacatgcatggcctctcgtctaactccttaagagcagatgtctagccaattcttcctccgtgacagctgctggtgaatcctgcttgtttgcaaatataagtattggcgctccat

SEQ ID NO: 13295 - DNA, 511 bp, Zea mays
  Clone ID: LIB3279-212-Q6-N6-C3
aaacgatggccattatcataattcccatgccaaagccgattattttttaacccaaacaaacttactggcttgacttagctgataacaaatcagcaatgcaagccgcacggacgaccagatagttgagcgtgagcatgcatgactttattcggagctgttcaccacccggcagttccgggggacctcgccgttggtgccgacgcccggtgcaagcctccccatccgcagcatggactccgcgaagtcctggaaaaatacggaggcgtcaaaggcgtaggtggcgacaaggctggcgacgtccgcctttaccccaggcacgggagccgacgaccccagtgcctggtctgacggcagcagaccgtcgccagagagcaggttgatgtaatactggttgtcgaaggtcgccggggtggcgaggtccaagtgtgccagcgcggacccagccgaccccgtgcacagttgctgcagcgactgcaagaaggtgaggtccttgaaggcgcccgcgccgcct

SEQ ID NO: 13296 - DNA, 605 bp, Zea mays
  Clone ID: LIB3279-212-Q6-N6-C4
agtacacaacgagctctgattgctgaagatcttctcgatgaagacgaacatacaataagacacaaggacgaaactagagcaggacacatcccatccacagatctagacacgagcatgctacagcacacagtgcaaatgaagggcctactttctaagccttcttgggggacttggcgcccttcttgggggacttgggctccttgctgccggcgctggccgccttctccgccgccttcttgggcaggagcacggagtggatgttggggaggacgccgccgtgcgcgatggtgacgcctgccagcagcttcccgagctcctcgtcgttgcggatcgccaggagcacgtggcgcgggatgatgcgcgtcttcttgttgtctttcgccgcgttccctgccaactccagaacctcggcggcgaggtactccaggacggcggcgaggtagacgggggcgccagtgcccacgcgctgcgcgtaccggcccttcttcaggtagcgcccgatccggccgacggggaactgcagcccggccttgacggaccgcgtcaccgacttcttcctggggccgcctgccttgcgcccggccgcacccttctttcccttgcta

SEQ ID NO: 13297 - DNA, 509 bp, Zea mays
  Clone ID: LIB3279-212-Q6-N6-C5
ggggcctaataggcttatttaataatataaaacaaagttaagggagccgcggcaagagggaatatagttgttgcaatattggaagctagttgctatatttacattatcttcaaaagaggggggccgggttttttaattatacagagggcattccacaactaaaaagggggctgatgatctgaaaaaatcttcagttcctaaaaaattgggcggctggtttttttttgatgcccaaggggccatttttgaacctgttcgaaatgcgaagcaaaacaaatgcaaaaaagcggcgacccagggggccctcccctcgatgcgggtgacaaaaaaaaggggagggccccgacattgacggggggaaccccctaactcccgtggacagatgcgttgaaaccctagggccgctggtcccaacccccgaccccacaatcccggtaaccggcgctaggcacccggggcctattgagtattgacatgcccttctaggaaaaaccacattgatttttttc

SEQ ID NO: 13298 - DNA, 256 bp, Zea mays
  Clone ID: LIB3279-212-Q6-N6-C6
aacaacgtaaacagccataattattctcaataacccggtagcaatgcaggggaattaacaactcttacaacatcaggggttgtaaaccacacaatacttcagaacagacgcacgtaacacgatagcaggagcaactctcggcagatcacgggataagggcagcacactggcctgatgctgcgtcatcagcaaacttctctagtactcgtcaccctcgtcgccatcctcgcccttatcgaactcagcaccgacctcc

SEQ ID NO: 13299 - DNA, 607 bp, Zea mays
  Clone ID: LIB3279-212-Q6-N6-C9
gacaacaaataatttggttcatcatgacataacactagagggtgactggttacaacttacaacagatactttacacggcactaagctcctacaactgccgcgtcatcacattacgaatacacaacactacaacagtcgtacaagaaatttcccagatcactgtaagtcttaacgcgcaaaatcggcgttagatagtactgtatcaccgaaacagtgcgggtacatgggaatgctccagggcattttccttggcgaaggcagcccaccagcgtctcagcagtaaaacatgacacgcttgacgttctccttgagagcaggtaggggcctgacctcgacactccccgcccctctcgtgctgcgtgccgcacctggtggggggccacgggcaccgctggccagtgacccgctgtcagaggtgtctggctccatgtagaagcgagctctgaaggctgcaagatgagcatagtacgccgggggcacgatggacacggagcgggtgcacctagcgtacgtgtagcacaggttattcgtcagggtctgcagctcgtcagctgtgaacttgttctcgtcccacagaacatggtagtgagcagggcggctcgttccc

SEQ ID NO: 13300 - DNA, 640 bp, Zea mays
  unsure (1)..(640): unsure at all n locations; Clone ID: LIB3279-212-Q6-N6-D1
gacaaaatccacctcttataatggcacagttccaaaatttttggtttcaactcaactctcgcctttatcctgcagatgtgcctttttcaccatgtcattcaatgtgatacacgggttcgttctgtatagcatcgagatatatttattctaccgaaacagacaaattttcgtcttgccagtttacagcttggagggggattggtaccatccccacggctcatcagagatgtactccgtgacttgcttgacgctcaggtagttatcaatgcccccttctccaagctcacgtccaaatccactgcgcttgttcccgccccagggagcttggcagaagcagggttgcgagcagtttacccagatgcatccagcgtcaatctcctcagataacctctggcagcgctcccgatcaccagaaattacagcaccagccaaaccatactgtgtatcgttggcaagttcgatggcttcatcttcagtgctaaattctttaacgcacaggactggaccaaagacttcctccctccagatttccattgatgtggtgatatcagtaataatagttggttcaataaagaaacccttctcaagagcgcaggtctaacacctncagtcagaatagtagcaccttggcttttggcat

SEQ ID NO: 13301 - DNA, 439 bp, Zea mays
  Clone ID: LIB3279-212-Q6-N6-D10
aaaaaagggggggggggggggaaaaaaacaaaaatgttccgggggggaaacggggggggaaatttcccgggcccccaaaattgtggggggggaaaaaccgggggggaaaaaaatttcccggcccaaaaaaatttggggggtttaaaaaaaatgggggaaaaaaaacttttgggggtggccccttccccccttcccaaaaggggggggcaaaccctaaaaaacccccccccaaaatttccccctttttaaaggggggccccccccgggggggggcccccctaaaaaaaaaagggggggaaaacaaaaggggccccccttttaaccccccccgggggggcccccaattttcctttggccggaaaaaggggaaaatttccaacccaaaagggggtaaaaaaccccggggtggaaaaaattaaaacccttgattgccccccaa

SEQ ID NO: 13302 - DNA, 538 bp, Zea mays
  Clone ID: LIB3279-212-Q6-N6-D11
agggattccacaaaaccattaaattcaacaatttgacgaattgcagaatcagaacgagaaacagaacatggggaacattagtacacaacgagctctgattgctgaagatcttctggggggggacgaacatacaataagacacaagggcgaaactagagcaggacacatcccatccacagatctagacacgagcatgctacagcacacagggcaaatgaagtccctactttctaagccttcttgggggacttggcgcccttcttgggggacttgggctccttgctgccggcgctggccgccttttccgccgcctttttgggcaggagcacggagtggatgttggggaggacccccccctgcgcgatggtgacccctgccagcagcttcccgagctcctcgtcgttgcggatcgccaggagcacgtggcgcgggatgatgcgcgtcttcttgttgtctttcgccgcgttccctgccaactccagaacctcggcggcgaggtactccatgacgggggcgaggtatacgggggcgccagtgc

SEQ ID NO: 13303 - DNA, 544 bp, Zea mays
  Clone ID: LIB3279-212-Q6-N6-D12
ggggggtgggtttttttttttttttttttttttttttttttttttttttttttttttttttttttttttttttttttttgggggggggtaatcagggccccttccaataatcacttggtctggttacatcaggggtggccccaaacgggggggggggggggaaaatacatttccctcacatcgccctttcggtttccttagcgggggccattcagaggcgccgggggttaaccccccccaaaaacttcttttcgccccccgggggggggcatttgacggggtacttttctttacctccaaaactttgcgacagggggggggggaacccccaccttggcgaaccccaaaaccccataaccaaaaatatttatgggttctgaacaccatctaggggcaaagcaaaccccaggtcatggggggggcccttgctgggcccccttattatggggggggggggggggccctcctgggggtcagggtggaattcacgggtttcgggcctaatccgagccctgggggggtctcaggctccttcttggctggg

SEQ ID NO: 13304 - DNA, 439 bp, Zea mays
  Clone ID: LIB3279-212-Q6-N6-D2
gccccccaagaaaggcgggttttaaaaaaggtacttcccgggcccccccctttgggggggtttgggcttttaggggggcaaaagcccaagccaaaaggcaaaccaaaccccccctaactcccctcgggggcaaatgccactgcgaggggggggtggggatcatggggatggggggggggccaggagcccttttagtagccccagctgtccggccacaagcccccctccgagggtgggaccaaacccgggcccgggggccccccccccccccctgggtctgggtctggggctggggcccccctagtttcaatttgatggcatgggctgcccctgcccagggacccccccgggacggggcactggagcagcgccccgggacccccacaaaaaagcgcggggcctttccctcgcctgggtggtggtgccccctcaaccgggg

SEQ ID NO: 13305 - DNA, 577 bp, Zea mays
  Clone ID: LIB3279-212-Q6-N6-D3
acaataaacagacatgctgccactcagaagtcagaaggccgctgaggttgttctctgaaacatcagactaccgagagttcctagcttcacattcttcttgggccaaaaagtctaactcatttcaacagaaacattttctcctagaggctaagatgcctactatcggaactgccagacaaacggactctcgctataacctctaccaatctaccatcatcactaagccactgcagaagtgaaacatgcaaaaccatacgtcgtcagacaacagactgccactacaatctctatgtcatcatcgtcgctgtagaagtgaacgtgccaacaccattacaccagtcgtcatcagaaagcttgtcgcttcagcctgtccatcagaaggtgcgcaactgactcgtatccttgctcccttgcattatatatggcaatcccagtcggtggtatcttccgcttcttcaagcagaaggagctgttgcatatccagaatttcttgatacccttctcctcaacgcagtgagggcacagccagttcttgttcttccgcacctcttccatctcttcgccgtacctaactttc

SEQ ID NO: 13306 - DNA, 572 bp, Zea mays
  unsure (1)..(572): unsure at all n locations; Clone ID: LIB3279-212-Q6-N6-D4
gcagcaccaagaagcaccatttttttccttaggatttaacttagaataaagcctgacgggggtaacagcacccatcgatccgcagtccatgctggttgatgcatgggtctgctggagccgaggatgaacacagcactaacagctgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgccgtagccgccgcctccacggccaccaccgtacccgccgccgccgtcgcctccacggncgccgngggactgggcctcgttgacggtgatgttgcggccgtccagctccttgccgttcatgccctcgatggcgttccgcatcgcct

SEQ ID NO: 13307 - DNA, 604 bp, Zea mays
  Clone ID: LIB3279-212-Q6-N6-D6
agacatgcatacaaactacactcataatttaaataatgaatgtatgtttagcctaaaacgaattatatttcaggatgaaaagagtagtataatcaaacattaattaaattggctcaagcaagtggtttctgcaccaagactaggttcttgaacatcaccaaagggtgcgactccagcatggacttattctcatcggctgataaaatggtgaacccgagtttatctgaccagatttgtgccatttcagggtcaacaggtgccataagaaggcttacattacaggctctcaaatttgtctcgattgactctaggagaagtctgaagtagcccttttttctgcactcgctacgagtagcaataaggaccagttctgcagcatgttccacgcgcactttcagaatcgcagcagacacaacatgcgtacttgcagttaacactacacaatacattcctcgaaaatccttctctccttctctattttttccataaaccatatctgagatgtcactgtgcgcatcagtagattccaaaaatgcatctttgaagatgtcgatgacctgagacaagtagagtttaacatccctacttgcgtcagcgctactta

SEQ ID NO: 13308 - DNA, 464 bp, Zea mays
  Clone ID: LIB3279-212-Q6-N6-D7
ggaggaatcgggtttcagccagatcggttggcatcacgggccctttccaaaagttcattgttttcggggggtcgccgggggtaaccaaacctttttcatgggaaacccctattcggggttaaaagaaaaaccgggttaaaagaaaaacccccctaaagcaaccgcaaaatttcgggataccctatttccctggcagttttgggggggccatgagggccggggttcaatccctatgggacccccacaaaatttccccccaaggggcaaatagcaaaaacaacccccccttggtaaacacaccggcccccgaagggaatttcccgctacctccccctggtcttgcggggggcctcccatcccgatcccaaaaagcccagcccccggcccgtaaccttgggggggtcaaaagggagaccccccaatagcccccaacccattccaacggggaaaaaaccccccaaggg

SEQ ID NO: 13309 - DNA, 286 bp, Zea mays
  Clone ID: LIB3279-212-Q6-N6-D8
aaaataaatcaactaagggcctggaaaattttatttcacatggcaccctactcactttgcccgttgacatcaaggggccattgcgttcccccccgaatgtcatctagcggaatggctaattgaaagggaaaacaatcttgttttgcatggtggctctgattatgggggaaatgggggaacttgacccccatccatgggcatttggatgcccaaggggagccccacaaacatttacatgacaacgtaaacagggccacaaatattggcggtggcaaaccccttaaaa

SEQ ID NO: 13310 - DNA, 587 bp, Zea mays
  Clone ID: LIB3279-212-Q6-N6-D9
aagatccaaaccctcaaatagattcatcagaggcttttggtttttgaatcaccggttcattatttgagtccatcaggcatttctcatgtaacatgattgagacgacaaaagaaaagagagtcaaaagatactacacgaagcattccagagatgcttctaacacttagccagcattgtcgctaagcacacgttttcacaaaaagaaggcaaaagaaaagcaaggggcccgcacttcatgctagtttggaaggtccttcagtattccttcttaccaaagtttttgcaccacagttgagatgggattggccggactgggtgatgcgggcgttgctccatctcctggttcttgcttttgtacagggtgtcggcatttagttgtttttcctttgaacagtccttggtatttttgatttatcttgttcctctgcagcaggttgtccttattaactagttccttatcacaaggattcttgtcatcagatccatcaagtatcaatttagtagcagtgtagccccctgtagactcttccacaggagaacacttcctcacatattctgaacatagctgccatggtccatttcctgat

SEQ ID NO: 13311 - DNA, 559 bp, Zea mays
  Clone ID: LIB3279-212-Q6-N6-E1
attatgtactctttatgagaataagttgtttatttcgtccatctgttccacattcacactccaacagttgagtccctcctctccctatcccccccagttgccttatgtgggggcgtcctagctacaaccatacctgcgtgcgccggcagcgagaaaggaccagctaccggccgtgacgttcttctcaccgtacgtcgccgagggattagataaactaagcagggcgctgcacgaggatggggtgcggggcgtcgagccagaaggacgccggggcgccgcggaggcggccggtcagcgtcggcgacgtggtcgttttcctcccgggcctccgcgtgccgagggccgtcgacttggcccaggcgctcggcggctgcctggccaggagcgccgtggaccggctgtctgctctgcgatcgcgggtcgtcgacatggcaatgcgagagtcggcggcggcgctcaagcccatgcggagggcggcggcaccgcacggtgtgtagagaccgggtggtgtggtatacagcgccgtggattggtgacctaatttttgtctgcagctgga

SEQ ID NO: 13312 - DNA, 570 bp, Zea mays
  Clone ID: LIB3279-212-Q6-N6-E10
aacatgtaacaacaaaatagttaaaaagccaagaaactttgggataaccaattcaggatatataagacagaaaaactctggttcacgagtaaatcccaaccagcatagcaatctacggctgaattaccaaatataaagacaaggagcagtctttccagtactttccaacataaaacaagcttaaaatctaaacatgactctggttttcctctggtttcactgcccaaaacaatactgtgatgactgtgcagcctagtcgaagaggctgaagcccatatcatcatcgctttcttccttctcttccaccttctcttctttctttgcctcagctgcagaagcagctccgccagcagcaggtgcagctgccgcaacagcgacaccgccgccaccacatgggactgaagcaaacttctccctgcccgcggcaatgagctcggtgatgtccttaccgctcagttgggacagcaggagttccatcttttcattgtcaacttcacagccaactgactccagaatggcagtcaaatcgtcagcggaggggctggcgttcccagcgagcggacgcgtggg

SEQ ID NO: 13313 - DNA, 582 bp, Zea mays
  Clone ID: LIB3279-212-Q6-N6-E12
actataattgcaattgcgactgctacgaccggattattatttttatgagacacagtcctgtagatactaccgatccaaaaaaaaaaaaaaaactcgctctagattctctgtccatgccgtcaggttgggaactgtgttctacggattccagaatcctacaaattcgcgccttgtcatgcctgcgtgcgtgctcggtgtccgtggcatcgcgggtgctttctgaacagcgtcagattgctgttctcctgtacttccgccatagcgaccatgccggtactttctaattctaatttctacctcgatcccctctgtatgtatttaaataaacttaccaactttgatgtgcaacatttgaggcgcactatgagatgctgctgcgcgagcagttttttattctgataatatgcttccgggctcctttctatgtgatcttgtaagataacctacactatcatgtagattcaaatcattttgtatagcagctgtaagcagaaactgcattttgccaattctactgaaggttacagaaaagggggatgacgtacttgtcagctgttctctttgtagtgacattttctttct

SEQ ID NO: 13314 - DNA, 595 bp, Zea mays
  Clone ID: LIB3279-212-Q6-N6-E2
agaatcaggacttcttttattaatctagagttctcatgaaaccacgccttattccactggcaacagtcgcagtacaagacggaacaccgcacggataccatgttaattacagtgcatacaacagggattctccagcagcctgttaattacgccgaatccttgacctcagatccatatatcagaggtgcagtccccaccaggatatctcatctcgtgggccagggcaggaccatcaggctcggtgccaaaatcgacgaagaagttggggttgacagccaggcctcctttctcggtgtcgacatcgatctgcaacatgtgggagcccttcttgacaagatcatcaccgaaaaactgctcatcccatcggctgaaaagtgagtttgtcacgtatatcctcttgccatccaagctcagctgaatcatctgtggcccacctctaagtcgatgacccttgacttgaggcacattatactgctgttcctgaccatcatcagtaacatagacgacatcactgcccttctgaagaagacaccaacccatacttgtccagccaagaaagctttgcgggatcctcaatgttgtactgcctaatatc

SEQ ID NO: 13315 - DNA, 475 bp, Zea mays
  Clone ID: LIB3279-212-Q6-N6-E3
agaaaactgaaccccccctaccttaattggcaatggccccatcaaccattggaaacaagttcaaaattttactgggggggggtttttttggaagttgctcatttaacagagcgcttagcagatgacccaaaaatttcctcaatgaaacatttcgcagttcatgaaatcaacagactggaacgaccaaaagatgccggtaaccccaacagttttgttttccccagctgacctgatttgacccaaacagtcatgcttggaccttaaaaaaaaaaatagtcttgataatcaatcaggggttgggggccacagcaattccaacctttgagcttttttaaatgggttttgtttcgacctcagccgagatggggaccagggactttggcctccacttatgctggatcagggggctggctttgcccgagttgttgatgcctgccttcaaaacggttagtgggtccaaagtgtgctgcccccc

SEQ ID NO: 13316 - DNA, 553 bp, Zea mays
  Clone ID: LIB3279-212-Q6-N6-E4
cgaaattcgaaatcgttgaaggaatgcaaattctacaactccttgtgggggaaaaagagcagtaccaattcaaaatggtggcattcaccgtcctgaactcacgaattcgaattcaccgtcctgcaggggagcctgacctcccccgcggaacccgtgagcgggccgatgttgccgagcctgaccatggacgcggcgaattccgacgagaaggcgtcggcgttggtgccgtaaaggcgcacgagcgagtcgagtgcgccgttgctgaagagctcctggtccgagtgcagcaggccggcgccggccatgaggctccggtagtagccgttgtcaaactggtcgggggtgagcgagtcgagcggcgcgagcgcgtcgtcggcgtcggcccccgaggacgacgggcaggcctggcgctgctgcgcggcgaacgccgggctcacgttgtcgtcgcagtaaacgcgggtgcggaagctggcgcatcgcgccatccccaccgtgtgcgcgcccgacagcgccgcgaggtcgcgcgggcccaggcccttggcggcgaacccgg

SEQ ID NO: 13317 - DNA, 426 bp, Zea mays
  Clone ID: LIB3279-212-Q6-N6-E5
agcttgcccctggcgtcgaccaccgcgcggctgtccagcgacagccgtggcagcctccacgcctgcggtggtccgaatccaccgccacccgctccctccttgaggtccaacggcgaaagctgcagcgacggccgcggcgcggccggcggcgtgggggggggggacgactgcgcccggtccagcggcatcgaccgctcggacggagtcgcggagccactggaaaccgacgtgagtcggcgctgcgagctgtggaggcggcggccggagaggatctgtggtcggtcgaacaggtggaggaaccccgccatgcagccctggtgcatgggccgctcgtccagccgccgctcttcgtcctcgtccacgcccatcgccaccatcttgcaactcctctcgcgtctcgccttcctctgctgccgcgcgctctgg

SEQ ID NO: 13318 - DNA, 515 bp, Zea mays
  unsure (1)..(515): unsure at all n locations; Clone ID: LIB3279-212-Q6-N6-E6
catacttgttccatgtcagacacagttctgcagtcttaacaacgggatctggaacaatgcccatcaaacacaacgggacggggaacaaggttcatcagtcttaacagctcaaatggacccagatcatttcatccatcactacccctaccagataaattgagccacgtttaccaacaccacccagcctagtactatgagcctaaaaaaaagtgaacttggggacggccttggtgccctcggaaacggggtgcttggcaagctcaccggggaggacaaggcccaccgaggtctggatctcgcgggaggggacggggggctttttgttatagcgcgccagtttggcggactcggccgcgagcttttcaaaaatgtcgttgatgaaggagttcatgatggacatggccttggacaaaatgccgatgtcggggtgcacctgcttcagcaccttgaagatgtaaatcttgtaggtctccacggacttcttcgttttttttttccccttnttgccctcgccg

SEQ ID NO: 13319 - DNA, 602 bp, Zea mays
  Clone ID: LIB3279-212-Q6-N6-E7
atcccaaatcactcactgcagtgttacctgaaaatagaacaaacatagaaatagttgcagtggtacaaaaacgacacaaaaaaagaaatagttgtttttctaatcagaccgggactttcattaagtggctcaggcgtgggcagtcatgccaacgctgggagttgtcttactgatcctttttgtagcttggctagtggccttagaatagtacatgtagaagtagacgtccaaaatcatggtgaacaccacgaagactgctccggcaataaacactcctttgcgcagagtttggcaggtccagttaccagcatataccatatccctatacttggtgtggtatgcgttctttgttgctccggcaattaggcaggcctcagcaactgcaaatgtgatccatgacgatgcgaagtatatgatggaccatgctctgcttccacctggtgcaagtggtgcaccgaagcacatgcatcttgtaacacccatgagcagtgagtggcctgagagaagaaaaggaaagcaccaacaccgtagccagtagcaatatcggagtcataaacacaaaatgtggcattggagctgtctgtgactattgaacccgtgct

SEQ ID NO: 13320 - DNA, 593 bp, Zea mays
  Clone ID: LIB3279-212-Q6-N6-E8
acaaaaaaaaaagaatattcgtactcaattgctgaaaacgtttttaatcacaatgcatgcactcctttgtttgaagttacttatgacaagacgcgaggaacaagacaataagctggacagtttcttgctgtctgggtgcagaaccaacgaccaaagtaacatgactccagtagctcaacagcagaagaaaacagaagccatcagcctgaatggaccccatgaaagtcacccgtcctcccgcgctgccggcgagggacggggcagcggatctagtgcttcccaccggtcctctccatctcctcgaggtgggcgaggtgggcgcgctcccagggcagattgacgaagtaggagaagatcatccctccgatgcagacgtggtagagagggtccggcgagctcgtgtcgatgtacttctcgatgtagcggtcgacggcctggtcggcgctcttcttgacgttgtcccaggtcaagcgcggcttcaggtaagccggcacgtcgcggaccttcatgctccggatctcgttgtacagggcacgcagcgccatggctggctggtctctcggctccgggctctctcgctcgctagggtttgc

SEQ ID NO: 13321 - DNA, 534 bp, Zea mays
  Clone ID: LIB3279-212-Q6-N6-F1
gcaacctctcaagtacggcaatacttaattaatacagcttatcatatattttatcgctcaaggcattgttgatacatgtttttctacagttttgcacccagatattgtttaagagctcccaagcagcttcttgatatccttctcaatgctcaaaggtgaagtggttggagcatagcgatccacaacacgtccctccttgtcaaccaagaacttggaaaagttccacttgatgctgtcgccgaaaaggccacctttgctagatttcaagaacttgtaaatgggcgcagcattgttaccgttgacctcaaccttgtcgaagatggggtactcagccttgaagcgtgtgcaggcaaactggacaatctcctcattggtaccaggctcctgcccaccaaactggttgcatgggaaagccaggatttcaaagccttgatccttgtacttctcgtaaagctgggccagctcagtgtagttggagttagttaagccacactgggatgcgacgttaacaatgagaagaaccttccccttgta

SEQ ID NO: 13322 - DNA, 527 bp, Zea mays
  unsure (1)..(527): unsure at all n locations; Clone ID: LIB3279-212-Q6-N6-F10
ctctgtgagggcgggccccgggaagcggggacgggcggggggggggcggggcccccccggggggccatccacggccgggcccggggggggcgggggggacacgggagggaagggcaagggggggggggggcgccccgaaccggaaggggggcaggcggggggcgcgggggggggggggggggcgggaccggggggggggggcccggggccctcccggccggccccggggggcggagcggggccgcctggggggggggggggtggagcgggggggggggcggggcgggggcgcgccccccgccgcccggggcccccccctcagggcccaaggccccaaagccggaggcgggagggacaaaacctggggggcccaaaggggaagcgccccccgcccaacgggaatgcggcaagggccgcttcccctgtggcnaaacccttcccccccgccgccccgggtggggggcagaagcccgggggggggggggcctggatcgggggccccggggggggggggactgtccccaaag

SEQ ID NO: 13323 - DNA, 449 bp, Zea mays
  Clone ID: LIB3279-212-Q6-N6-F11
ggtcttaggctcttagcatatcattgatccttttgtgtataagaaatagggaatctactttcacatttagattacaccaaatttatggaagctttcctttacctaaacatcgtgccagaaattcttttcccagggatgtacatgggtttcgtctatatgcgctaagtcactgttatgttcctttcagctgttgcgttagccctttgccagtcagacccggtactgaatgatgggcatggtggcagcgattcatctaggggcaatgtcttccaaggtgttcgcaggaagttcataaagaaggttgtggcccatcatgaagagcgggaagaagaggacagtgactaagctaatacttgtgtttgttttccgcagcgtggcggatccaattcggttccaatgttcactgatcttatgtgatttttgtgggtgaaatttgccagagttttcca

SEQ ID NO: 13324 - DNA, 599 bp, Zea mays
  Clone ID: LIB3279-212-Q6-N6-F3
gtacctaaaatcctctcattattcacttttgaataagggaattttagtccctctaatcctcttcggtttttggactccaaaactagcccatagtgtttctagtaaatctgagcaattaaaagctgaaaaactcagcgggtgggggggaacaaagggaatatctacatgagctcaattacaggtatccgcaaactcagcacaagaatattcatatgtataccacattcaggtattcgtgttctttctgtctaggaagttctccactgcaactcaatttggatctgaccattttttgagtctatgagatggtacttctcattaattctcttgttactgatcacgtctgcaaggttgacatcaatgtagcccaaagtttccttgccatatatcagccctttcttcggggctttacttaggacttcaacatgtagtttatcatttacaggaggctcctcacacacaaactcgaatccatcctcccatcgtggatccctattcttcttgatgaccctcgttttcttctcttcgcctttgaaaatatttttgcataggggtttgtatggtgcttcccctcaagatctttggcttcatgaacataa

SEQ ID NO: 13325 - DNA, 556 bp, Zea mays
  Clone ID: LIB3279-212-Q6-N6-F4
caatacaagtgtttttattagcttctttgtagttcgtaaactcgaacaagctacaaacagaaccacaatacaagagtagaaaaaaatagatatgtggtgttaagcaggggcgggggtagaaacatgcgataacttggggggggtggatgtccagtccccgcgtagtaattagaaactaacagcaacagcaaccatatctgcgtcttcctcctacacgttgacgccaaaacaaaaaaactctaggctgcaaaacttaaaagccattcaagaccattggccctttattctcttggggacatccatttcacttgcttcacttcaaacagatgcagcaacctcctgctgtttgctggcgaaggcgacacccttctcaatgcttccctttaactcggccttaagcgcgtcaagcgccttggcctcgcactcggtcactccctcgaggtcggcagaaacgatggattcgacaccactcttgccgagcttgactcttgttgcgaagaaggcagatcggttgcctcggactggataaatgtgcactcgtaaacatcggggtcac

SEQ ID NO: 13326 - DNA, 482 bp, Zea mays
  unsure (1)..(482): unsure at all n locations; Clone ID: LIB3279-212-Q6-N6-F5
aaaaacgaaattcccacgtattttttaaccactttatatccttttacaagtataacccatgctttatcctttccacatcataccagtacacgttacgtaacaataaaggtagccgcaagcagaagcgggggggggggggcacgtaacaatacaggcagccgtaagcaggaacagattgcttagatctgggggatggcctcgccctccaactggatgtagccgctgccctcctagccttcctcgggcccatcgacgtcgacgccctcgttgagcctgagcgtgttaggaagctcccagaatgccttgagcaggcgcgcctcgtcggtcatgtacttgaggataacgtcggccttgccgtcctgggagtcgcggaggcccacgagggcgatgtccccagccgcgatccacaccttgttgtgcatcttaccccttatatggcagaggcggcgcgtgccataaacgcaaatggcctngtaccgccc

SEQ ID NO: 13327 - DNA, 591 bp, Zea mays
  Clone ID: LIB3279-212-Q6-N6-F6
ggcggtgcggaatgtgcgagttggcgcgggcggcagaccacgtggatgtcacggtgcggcgggcgaggtggccgagcgccatggcgtggtcgtggtggagagcacgttgcagacgcggtacaacgatgcagtcgttgaggaggcgctcgagcctatagcgcccgcacctggacgcagcgtcgtcggccctccagctgcccggtatatgaacggtgagtggcgcaggcaaagggtggatgtcggcgggctgcaagcgacatggccaaggccaacgaagggtgtgcggacatggcaccttcacgatgctccggggagatacatacgtgtcatggtgtgctctgctcgctgtgccgcctcgccggtggcggtgggcggtgggtgcccatgctaaagtggtgtgcggtgcggacagccggacagtgccggtcgtccgctccgcttcactggtggctatcacccgttgtcaacagagtgcggtagagaatgggatttgagaagaagcaagaacacaggagtagggtggaggaagcaacagacagtagtttcagagttcagttgcaatattctcttacagatgcctttccctctcgc

SEQ ID NO: 13328 - DNA, 558 bp, Zea mays
  Clone ID: LIB3279-212-Q6-N6-F7
accaaatagcgtttattcaaacatgttctgataaagaagcaagccatcgatgttcgatggagcctcgtagtacaaggttcgacacgacggtaacaagcatacacgcagggaggggcctatatgtgtaatggggggaacgcgcaggcggcgtactaggcctgcttgcagtacacagccagatagatatgctccacctcagatattatatataataagctggccctgcatgcagggttggtttgctatggacccggcggttgctcagaaaccatgaatcttgatgtgctccttcttcacaatgccggcctggacgaggaaattcgagacgttcttcctctgatcaccctggagctgaatgacctgtccaagttctgggtcctggaccactgtaccattgcagcagaactctttcttgagatctttgaggatcttgctgtagctgaactccttcttcaatccctggacggtggtcaggctcttgcgaccattacgctgctggatgcgcacgtgtacgtagtcctttgaccctgctgccgcaccagagtccccagcattggc

SEQ ID NO: 13329 - DNA, 589 bp, Zea mays
  Clone ID: LIB3279-212-Q6-N6-F8
aagataaatgtatattgaaaaaaactggcaccactcaacaataaactcagaccaagatgtttataatagactcagctccgaacaacatttctgtaatagactagaagggataaactggcatcccagcacaaactgggcgagctgagccgctgccgttgcccaatctcagaaactgaactctagatcttgttgaaagccacaatgtcgcaactctggacgtactcattgatgggctcttgcgtaaggtggtcctcaattagagtgtcgatggacacaagatcgtcgacaattgtcaacatgatagtcatcttcttgatgccgtatccaacaggcacaagctttgatgctccccaagtcagaccctccatctggacactgcggacagcctcctccagcttcttcatatcagtctcatcgtcccatggtttgacatccataaggacggaggatttaccactttctttctttttagaagaggccttggcagcggcggcacgctcatcagctgccttcttgtcctcctcagtttcatcaccaaaaagatcaaggtcatcatcatcctcagcctcatccgcaggagcagctgccg

SEQ ID NO: 13330 - DNA, 595 bp, Zea mays
  Clone ID: LIB3279-212-Q6-N6-G10
catcagggcaaaggtttaatttaaatgctcaaaacttaacattgttcacgtccactgccacttcaccgtaccaaattcctaggcaactttagcatcaaaactatgttttttgaagtacatagggagacccaacataacattcagaatcaacgaaatagagtggagatatccagagggcatcatatttatgcattttcggtcatagggtactcaaagaccacatctttcccacacagcctgcggtagaccgcagtgcaggtctccagcttgtattcagtgttgttcctctcctttgggtccaagaaaatcttgataatcttggaaccatccagacggtatctgacacgcttccccacaatctcagctgggtagacaacatcctccaagatgccatcgtgaacagcagtcagagtcctggtgcgagggcgcagaacagctgaacccttcttgggtggcctcacaatcctccgtgtagcaacaattaccacatccttgccgctgaatttcttctccagctccctgacgagtctgacatggatcttcctgaaggccttgcgcaggcggtatgggacgtgaatgacaacagccttcctac

SEQ ID NO: 13331 - DNA, 615 bp, Zea mays
  Clone ID: LIB3279-212-Q6-N6-G12
aaaagcacagttgagttaccacccttaaatatcatcaacagtcagaacatagaaacaaatgtacttccattcaatagcagaacttgccaatggttttcgctgtgagcatgcatccatgccagatcaagacttcatgtgcggcaaaagcaatgaaatgtcgtgttacctccatcgctgcagaaggaaactaagtgggggcaaatccaacgattattacaacacaggttttacatttctcatctgactatctgtgttcccaaaaaagagtagctacttctaaacaggtcactacaatttcgcctgaacttcccgcagcctcactttttaacctcttcatactctgcctccggcgcctggtcaccgccaccctgaggtccagatcccgactgcgagttgccagagccaccacctgacatgtgctgaccaatcttcgagacagccttgttggcagcctcaagcttggccttgatcttctcgatgtcatccgaggccatctcctggcggaggtcagcgatggctgcctcgatctcggatgcaagctctgccgggatcttgtccctgtactctcccagactcttctcgatgctgtagatagtggtgtccgcagtgttcctg

SEQ ID NO: 13332 - DNA, 534 bp, Zea mays
  Clone ID: LIB3279-212-Q6-N6-G2
ccgaactaagacctgcttcatttcctcttagacaaagacgatgctctgttccctgtacaaaatgggccgcgcgcaatctacaccggctaaaataggttaatgcattccctaggtcatctacagcagtggcaccaagattacagtgcagtgctcaccaaaaaaaagccaggctacctagtcctcagcaatcgaagaggaggcggcgccgaacagacttcggcaggctcttgtcgaggtccctgtcggacgattttctcgagcctcccctcgcggggtgcccttctcccgccggcttcttcccagattctacgttctgcgctttcttcgagcggtagaactctgtgatgctaagctgcaccccgctaggtctcgggccttcaggtgtcttgcacgcattgtctgctaagcttgatttggatttccgtgatcttgatcttgcttctttcagcctctgttcttcctgaaaccttgctgtttccttaggataagcagcaccaacaagttgaatgtcttcatccgtcaatacaaagcagc

SEQ ID NO: 13333 - DNA, 440 bp, Zea mays
  Clone ID: LIB3279-212-Q6-N6-G3
caacggggaacgacaatagctctgttaatctgtcccctcaagggtactgtacgggagtatttataggtgcccgagtgcctaccacgctcaaacaaggacgtttatgccctcgggaacccaaagtatccttagaatattccccaggggaggttacagaccgtcattacagaaaagactattacagatgaagcccgtaacacgcttatccttgcggggcccgttacagtgggccgaatctcccttgggcttccggacccgatgaggacgtgaggctagcagacatcgtcggagtcttgccttcgtctcgcaatggagaagggcgaaggacgcccacaaagtccagtcgcgaagtcctcattggaccggcgtctttggcgtcgttggtgaagcgagacgacgaaggcgacgaaggcatcgagcgaatgatagcgtcttcgcct

SEQ ID NO: 13334 - DNA, 491 bp, Zea mays
  Clone ID: LIB3279-212-Q6-N6-G4
aatgcacaaatcttacagaagcaaacgggtccggattcacgggtacaagcagctcagcctgacggggacgactggtggtccaaggaaaagcaaacgatgcgagcggggccggggcagcggcggcctgagacagtcgacgatgcatgcacgtgcccgagagaaactaaacgatcgacggcgagcggggaaagagagctggatgctagctgcgcacccctgggtcgggcggcttcggcttttaatagtcgggggaggggagctgctcgtgggtgtgggagatgaaaagcagctcgtaaatgaccccggcgaggccccccccgatgaggggccccacccattacacccactggtagccccactcccagctgacgagggcggggcccaaggacacgggggggttcatggaccccccgtcgaaggcgccccccaccaggatgttggcccccacgatgaaacccatggcaatgggggcgatggtgcccaagctgccc

SEQ ID NO: 13335 - DNA, 595 bp, Zea mays
  unsure (1)..(595): unsure at all n locations; Clone ID: LIB3279-212-Q6-N6-G5
cacagcacagcacaccacgatcacattccgaagggtccagaattcgaccacactttcacaacccaccacaccaaatcacgaggagcacagctacagacgacgagcagagcagaccgtcactcggcgctctcacgatgcattggactacgccttgacaggcacaaccttgacctggtccagcacggggccgcagagcgagacgccgtcggtgaccttggtgtggtagtaggagctgtagaaggtgaggcgggtgcggacgccgccggccacgaacctgaacgccgccgtcttgaacccacctttcccggcggaatcgaacggcaccttctgcgtgacgttgcccgcgaacgcctccacaagcatagagccgtggcagccgttccgggcgtcgccgacggcgaacgacaggttgtaggcgcggttgggcacggtgcggatgacctgcgcgatggcgctctcccgcccggccaccagctccaccgngtactgccccgcggggacagagaagtgggccgcgtcgatgaatcgcaccgccttgagcgactcgatgatccagccgggcagcggcgacgtcgcgtccttctgcttggggggc

SEQ ID NO: 13336 - DNA, 601 bp, Zea mays
  unsure (1)..(601): unsure at all n locations; Clone ID: LIB3279-212-Q6-N6-G6
ttttntttttttataaaaggcatgtttggccacatatccataaatcataatgttaaaccatatactgtaacaacgaaagaagggggaaaacaaaatggtaaaatggttcagtctcataaatggctctcatacagagatagttaaaatagggaacaggtcgataaccaaagagtttcagaatgcgacttctgcatctgagctagacacgagcatatgctaccccaaggtgccaagcaggtgcttcccaatctcccagtctttattccctagtccctatgtacatagtcctatggccaagcttcaaattcctcagaagaaatcgccagcgatgggcatgtcatcgaaggtccagaggtccatattgctaccaagatcctgtgatccatcaaggttcagaaggctatcaattgaatcacttgcaccgccatccataagaaacctcatataggattccaaatctgtcagcccatcagtgagatcaacagcattgttctccaggacaggaggcaccatcgagctgtttgaattggagttgacaaatacagactcatcgccttcagcaatagtgggaatgggagcaatggatgtgatgtctggtgtc

SEQ ID NO: 13337 - DNA, 528 bp, Zea mays
  Clone ID: LIB3279-212-Q6-N6-G7
gaacaaacagcaagtcacaattggcatttcttcagacacgcacaacatgcttgatctagtggtacagtaaccagcattttcgccacccagccacaacttgcgaattgcaaaaacaatagaaccgcagcgacgacaacgaggcgcgaccggcctagcctagccgccgaagccgtagagggtgcggccctggcgcttgagtgcgtagacgacgtccatggctgtgacggtcttgcggcgcgcgtgctcggtgtaggtgacggcgtcgcggatcacgttctccaggaagatcttgaggacgccgcgggtctcctcgtagatgagcccggagatgcgcttcacgccgcccctgcgcgccagccgccggatcgccggcttcgtgatcccctggatgttgtcgcggagcaccttccggtggcgcttcgctccgcccttgcccaggcccttcccgcccttgccgcgccccgacatcttcgccgcggagactagaggggatcgggagattttcgcttgctgttggtggggtcagcc

SEQ ID NO: 13338 - DNA, 586 bp, Zea mays
  Clone ID: LIB3279-212-Q6-N6-G8
gagatcaagtgaatccacatttcatcatatttagaggttcagaacaaagaaatgcagtacaagtcgtatgctactactggaccaaggcactagagtctagagtgataagcctacgaaactaagcccatgggcaagaatactctcgaatcactccatttcgtgaccgcgacccaagacttctgccacgaccagcagcagctggcggacacccctgacccctcagccgccaaatccgtagagggtgcggccctgccgcttgagcgcgtagacgacgtccatggcggtgacggtcttacggcgggcgtgctccgtgtaggtgacagcgtcgcgaatgacattctcgaggaagatcttgagcacgccgcgggtctcctcgtagatgagccccgagatgcgcttcacgccgccccttctcgccagcctccggatcgccggcttcgtaatgccctggatgttgtcgcggaggaccttgcggtgacgcttcgcgccgcccttgcccagccccttcccgccctttccgcgccccgacatggtcactcgaactctgaggagaggttgacaattgggaatttggaggtagggtatg

SEQ ID NO: 13339 - DNA, 329 bp, Zea mays
  Clone ID: LIB3279-212-Q6-N6-H1
aactgcctagaaagaaattttgcagttcaactgcttacataaatgagcaaaataattaaccaacattacattacaatcttgctaacaaagctggaaaattgcggcagggaaccattatatcccacatccacacagctccttcacaacatctcatctacttctcatctacgaacagacttaaaacggtacaacataaggcagctgatagatatgaaggtccggcaaaaaagttgccctgggttgcaaataaggctgctgctgcaccatcggatgaatcggccctaaaccatcaggtactgtgggttgagccatgctaccatcagagcttc

SEQ ID NO: 13340 - DNA, 437 bp, Zea mays
  Clone ID: LIB3279-212-Q6-N6-H10
aacaaggcccaaccagaaacaacccggttttttaaccttgcaaaggcacagggggggggggggccgccccggatgaaggggtcgggggcccttgccgttcggttaaaaaaagcccaaacatttttcaaaaacggggggctggtcagagacctttatttgcggggatcattggggtaatttttactaggggggtttttgcagcctcatccttccggggggggggggtcaatttttgggccccgggaaggggtcccgggaaatttgtaaacagtccattaacccccacagggtttttccaaaagtcgttttctttgggggggtcttgaaaaaattgaagggcaagaaccgggtctccttcctgtgcgggtttgggtgtacccggggattattagcctgtgccccggcgacaagaacactaggggggcttaaatattttc

SEQ ID NO: 13341 - DNA, 583 bp, Zea mays
  Clone ID: LIB3279-212-Q6-N6-H12
ggtgtggggtgtcacgaagtccttccatttctttctcaacgagcatacaaccctgagattcacagccacgttcccactcccattcaaaaaaactgatactaatctaattttccttcccaacaaacccgactcctccccgaagacaacatgggggggggggggcaaaacaaggcggtggtcggatcatttctgcaggaagcagtctcagttgtcgtcgtcgtcgacactggccttggaggaggcagccttcttggggagcagatgctgatggatgttaggcataacacctccgctcgcgatggtggcaccacccaacagtttggtcagctcctcgtcgttgcgcacagcaagctggatgtggcgcggcacaatgcgggtcttcttgttgtccctcgcggcgttcccggcaagttcgagaacctcagccgcgaggtactcgaggacggcggcgaggtacacgggggcgccggcgccgacgcgctccgcgtacttgcccgccttgaggaacctggcaatcctgccgacggggaactggagtccggccttggagctcctcgacgttgccttcttcgcggggccagcg

SEQ ID NO: 13342 - DNA, 519 bp, Zea mays
  Clone ID: LIB3279-212-Q6-N6-H2
aaaaacgaaattacccacgattatttaaccacttcagatccttttacaagataacccaggctaaaccataccacaacataccagtacacgtcacgtaacaataaaggtagccgcaagcagaagcagaagaacgcgtgacgtaacaatacaggtagccgtaagcaggaacagatttcttagatcttggcgatgtcctcgtcctcgaactggatgtagtcgctgccctcctcgccttcctcgggcccatcgacgtcgacgccctcgttgagcctgagcgtgtcaggaagctccccgtaggccttgagcaggcgcgcctcgtcgttcatgtacttgaggataacgtcggccttgtcgtcctggtagtcgcggaggccgacgaggacgatgtccccagccgcgatccagaccttcttgtgcatcttaccccggatatggcagaggcggcgcgtgccatcgacgcagatggcctcgcaccgcccgttgccgagcatccgggtcacctgcgcgtactcctgcccg

SEQ ID NO: 13343 - DNA, 626 bp, Zea mays
  Clone ID: LIB3279-212-Q6-N6-H3
tcgcgatctagaacgttatcttaggcagtaaggactatgttgatgcttggttaaatgatgtttctgtaaaacttgaagaaattactgcaccttacgaaggagctgatctggtttggtatccagtgacatccgcattgggtaaagcatcatttgatggacctgagtgcatcaaagaggtacatatcggagctactgataagcctatttcaaaattcttcaccaagaaatcgactgcctacgatctatcagggaagtatgagaatatgtcacgggagcttgctcatgcttacaaagcagcgaaagtggaatgcgatggatcagtagaaaatcaaggaggggacggcaaccaacaccagtcccgagagaagcaaactactaattgtactataaaggatgaacctgtcaccttggaaccacaagttttcgagacaccgtggagcatcgagcatgaagatactatgactctggctggtgccactttggaaacacaacgtgatttgggattcaagagaaagatcgaggacactcaagtcgaagctagcatgaagccctctcagcttaccagggaaggaaaaagctgtaaaagcagcttcggatgggcaggcatcgttgctttcatatttcgc

SEQ ID NO: 13344 - DNA, 591 bp, Zea mays
  Clone ID: LIB3279-212-Q6-N6-H4
cgccctccccctacatatttgatttcttctcctatacaaaaactagcaagacctactccattggtaattccatcaatgacacctttatcaaaaaaatgcgttagttcggctaatcttcttatacctaggataaaaaccctggggtgggaaaaaatctatataaccacgattatatgaccagctgtatatctttttttttacttcatccaaaaagctcttttttggattcttttttacaagggaattttgaaaattcaaattctgaaaaaaaagaataagcagatccataaaagatatatgctatgaatagaccaaaaattgctaaacttacagaagaaattgcattagtgagaaattcatatgaatttatggaagaattagaattttcctggaacaagtttattgaaggagttagccactttgataatatggttaactccaatattctattatcttttactccattatcaaaatggattcctatggatccaatgaacaaagtaaaaagtggtaatataagaagaggaaatagcatagtatttcccgtttcatgaggatagacaaaagtatttttagccccaagggagtact

SEQ ID NO: 13345 - DNA, 574 bp, Zea mays
  Clone ID: LIB3279-212-Q6-N6-H5
acatgaagtaacaaatatattacagtatcagcaagttctaccacagatactgatttgtcaaaggtgccccaaggtaaagggaaccgaccacaggtgtacaaccaaacaattcagagtgatagtcatgtagagacttcattccatgggaaatatctccagcctattttttatcaagcaaatggcaatagatgaggactgaagtatgatgggttattacatcaagaacatcactgcgttctcatgcaccgctcgcatacaggcgagtccactccttagctgtttcgacagcttctacttcattggctttccagtgctttgcaatgttatccgaaagagggtcgtctggatttggcgcactcagtagagcctgtatactcaaaagaactgttcgaatctgaagtgctgggctccatttgtccttgagaatgtcgaggcatatcctaccaagcttgtcgatgttgggatgatagatctttgtcagaaacctaacctttggggcagccattggatattcctcaggtaaaaagagttcaagcttaaaaactccaccttcatagggcgactgcgccggccc

SEQ ID NO: 13346 - DNA, 582 bp, Zea mays
  unsure (1)..(582): unsure at all n locations; Clone ID: LIB3279-212-Q6-N6-H6
gggcagagatgcttgcataaattttacattgttcctagttggcacaggaagccatccagaatctttgtttagagtacagcttctggattgatgctgagcccagctttgaatgtaccgtagcacacattgggggcacagctccatgcaatgcttattacaaccgaaggctttgtgccaggacttgatacaacaaccacctgagattcagaccgaatttacagatttatcttccaagacggatgaggcagcatcaaccgtagcaggtgccatggtttaccagcaataggctccttgcatccatatctacattaatcttggcagtcatccaagtctgcactgtgttttcttgtaggagccccttgcaacatagcacaaacgaatcagctttcttcatcatcagtttgagttgcacctttcctcgatttcctcaaatgtgtagatttcccttcgacgaataaagaggccgagggccatccgcgcgtggtggagaaacaaaacgcctgctcctccgtcatgggcgcgtcgagctccaagacttngaccgcgccaccaacgggcccggggcccccttcggtgcccccg

SEQ ID NO: 13347 - DNA, 554 bp, Zea mays
  Clone ID: LIB3279-212-Q6-N6-H7
cgatctgaactttttgagccgagtactggcaactttgttttttccccagaagacgaagcaaaacgcaaatttaacgcccccctttgcacaggggggagggggggccctactagcccacgacagacagatccaacagtccgatacggaaccacatccacaggttccgggctgaccctgacggcctcacctggggggcagggggggttcaaaaatcggagcaggggccggggccctcccagtcgccgaaccttgggggctcgggcccccgggggccgccgacctcgccgggggccttgttcacgtgcgcaccgccgtgggcctaatgctcctcctccttccccgttttggggtgggtttcgggggccctagtttccgccgtttcctttccctcccccttccttacgggatccggggggggggggggggggcccttggaggggcccgatctggaaagcccaaggcgggggaaaaggagggataggggaggagtccgaggccggggaccgtgggaaaaaagcttaagcaaggcggccgaagcagtggttggggttggc

SEQ ID NO: 13348 - DNA, 553 bp, Zea mays
  Clone ID: LIB3279-212-Q6-N6-H8
gatgcaagggtaattcatcttaatggattggatccaaaggtgtaacagcagaagccttgaccttatcgaccaccgtaacaaataaactcagcttcgagatgctgttcgttttcttatcatcttatggcgtgcgtgaaaaagaagaaaggggggcagaaacgcttcgacggttattcagccacgttaaccaattcatactctacaagggacaagttgttgtcttccttcactgtgaagctggctggctctgtagcctcaatccgcccccatttgtccactgcaagcctcattgatcctttgaacatgtcgattttggcattgcgcaagatcaccgtggcatcgggcttcagcaaatcaacttggtcgttgcgggcggtgaatacgatgacgccggtctcgtccccgacgaggcactcggcgatgcgcggcgcgcgggacgaggcggcggcgggtgcgcccgggcgcgcgcggcccggcacgggggtggcgctgacgaccttgacggtgagggtgtgcccgttagtgcccggcttgagctggtcgaccttggtga

SEQ ID NO: 13349 - DNA, 520 bp, Zea mays
  Clone ID: LIB3279-212-Q6-N6-H9
ctaatggcttaaaaatatttatttgggaacagcagagtccgtagcgtagatagtccattagtccatcaagacccctactagtagctttttaaacgatggcccttgtggtggttcccatgccaaagccgattattttttaacccaaacaaacttactggcttgacttagctggtaacaaatcagcaatgcaagccgcacgggccaccagatagttgagcgtgagcatgcatgactttattcggagctgttcaccacccggcagttccggcggacctcgccgttggtgcccacccccggggcaagcctccccatccgcagcatggactccgcgaagtcctggaaaaatacggaggcgtcaaaggcgtaggtggcgacaaggctggggacttccgcctttaccccaggcacgggagccgacaaccccagtgcctggtctgacggcagcaaaccgtcgccagagagcaggttgatgtaatactggttgtcaaaggtccccggggtggcgaggtccatgtgtgcc

SEQ ID NO: 13350 - DNA, 621 bp, Zea mays
  unsure (1)..(621): unsure at all n locations; Clone ID: LIB3279-213-Q6-K6-A1
cccacgcgtccgcccacgcgtccggtcggttcacttctccaggtaaggaaagggttcgtactcatggcgccgccgcagccaaagtcgggcctcttcgttggcatcaacaagggtcatgtcgtcaccaagcgcgagctgcctccccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaactcacaagagggcaaagaagaagagagaggagatggcgggcgtcctcaggaagatgaggtcggctggtacgcacactgacaagaagaaatagagagcatttcaagttcatggagcctgccagagattatgttccagtgtctgattttccatacatgtagaacctaatagacatgtcaaagtattatgtatcgaaccagctcatgggattttgctccttccaatgcatccagggtttatgtatcgaaccagtttatgggatcttgctcctattccaatgcatccatggtttgtgaatctnttgctttgggttgct

SEQ ID NO: 13351 - DNA, 646 bp, Zea mays
  Clone ID: LIB3279-213-Q6-K6-A11
gcctgtggtgctttatccttttcacaaacggaccctaaggaaaaacgtctgtgattgtgaaaattgaaaatacaatttaaatatgaaaataattttaacttttaacagaaatatgcaaatacaatttaaatgaattaatatttaatttttaacaataatatgcaaatacaatttaaatgaattataatagcacacatagataactagagagattttaaattaattggcaaccacaattcatagtcgatcatacatgataacaaatacaatttgattcatacaatttttcatgaactaccattttttcgcatgtatggctttaagttcttatcaattttcttttccacacgtttgattctctctggaccgttaaagacgaacatctcttcatacttattgtattcctcatcttggtctcccacattctcaactccaacaattttttgctttccagaaataactacatgcatcttctcatctgctggatcgagtacatataacacttgtgcaacacattcggcgagaacccacgggtcatctttatatcctactttctttaagtctaccagtgcgagttcgtagttatccactatcacccccagggttgttgtaccaattgcacttaaatagggtattttcatgcttg

SEQ ID NO: 13352 - DNA, 614 bp, Zea mays
  unsure (1)..(614): unsure at all n locations; Clone ID: LIB3279-213-Q6-K6-A2
gtgtccggcaacagaaattccctanagtggtcgtggctaccgctatgctactggacgtggaatgcctgatcctggcatgcataatgttggtgctgtgatgccatctccatatgagatgggagggatggcaatgagagatgctggtgtctcacaacctgttccaattggggcactagccactgcgcttgctaacgcctcaccagatcagcaaagactgatgcttggtgagaacctgtatcctcttgttgaacagctggagcgtgagcaggctgccaaggtcactggcatgcttttggagatggaccagacggaggttcttcacctgctggagtcgccagatgctctcaaggctaaggttgctgaagccatggaggttctccgctcagcccagcatctccagcagagcaatgcctccaccgagcagcagctggctaatctatcactgaatgatggcgtcctctccagctgaatgtttctgatgattcagaaattgctggcaatgtttgcttgatacctatctttagaatgcaattactttgtttactttattggaaatttaggtgctgctctataattagctgaactaaggggtgggatttaattgccttgaattg

SEQ ID NO: 13353 - DNA, 638 bp, Zea mays
  Clone ID: LIB3279-213-Q6-K6-A3
ccccgcgtccggtcaaattagtcaccttcagttatcagtttttcacttctcatttttattgggaggatttggtgaattttagtggcgggcagagctttcttcgatcatcggtcctcatttttatggatttggatggttggggacttgggggtatcttaactttatccttgttgaaaaaggctataaacttgggagttcctgtgagatattcctttcttgggaggatttgatcttgcttctgttggttcctggtgagttggttgagatgaaaggagtactatgctaactcatcgaggaaagaacagtacagccagtactactctgaggaagagctgacatttctatgctttcctttggagtctgttcctccaagaatctatgcaaaagtgctcctcatctaagtatatctatccagttcaagttgttgtggttcatcttatcatctgtgtatctggatatctcgtgtatctgtgtgtaatgcgcgcactctgcaagaaggaagaatttgtgcaaaacgggtggtagttcagaactttctttgcacaggagaagctcagttccgccttgcagatccaaattggccgatggcgcaaccctgaattccagcattttgaggattgggaaaccacaggaaacac

SEQ ID NO: 13354 - DNA, 577 bp, Zea mays
  Clone ID: LIB3279-213-Q6-K6-A4
cggaggaggagttgtgccaagccacaatgggtatctcgcgtgactcgatgcacaagcgccgagccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtaccctttgaccacacattggagagcaatttggcagtggacggttgctggcatgcat

SEQ ID NO: 13355 - DNA, 611 bp, Zea mays
  unsure (1)..(611): unsure at all n locations; Clone ID: LIB3279-213-Q6-K6-A6
tccgggnaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacattgctgagaacgagggcgaggaagaagattagattgcactacgcttatattttagtattgaactcgttgcattttgatacctgtacccgtagtttcgcaaatgtcccatgttatggtgtgggatgggtaatttgaagaatccttatttactgaatctttgcaaaaagctttttgtgggcag

SEQ ID NO: 13356 - DNA, 576 bp, Zea mays
  Clone ID: LIB3279-213-Q6-K6-A7
acaaatccccccgcacgcctccgcagccgacgatgaccaccgccgcggacgactaccaccactccgacggattcgtcatgcccgacgtcctcgccaaggccgggaggcctgctacaaggcacgggatgccttctacgcgtgcatcgagaagcacgcggacaaaaagcccaccgagatcgccaccatgggcctcctctaccccgccgactgcaaaaagtcccgcgccgacttcgtcagcaactgccgccccacctgggtcaagcacttcgaccggcagtactccgccaagaagcgggtgcagaggttgctcgacggcgatggggaccgccggggccccatgtcgctgccccagccctacaccttcaagcaataggtagtcttcctgtggttcagatcttggtattgagttcaattggatcagtgctacgttggtgtctagatgctatagtattggtttcaggctttgtgtcatttagctggatgcatatgtgatgtgtaccagtacattgctctgaatgctaatggatcagcgaatctgtatgtggatttatcaatatcaggatatccctcattggc

SEQ ID NO: 13357 - DNA, 281 bp, Zea mays
  Clone ID: LIB3279-213-Q6-K6-A8
gcagcaccaagtagcaccatttttttccttaggatttaacttagaataaagcctgacgggggtaacagcacccatcgatccgcagtccatgctggttgatgcatgggtctgctggagccgtgggtgaacacagctctaacaactgatacagagcgaccttcaatcaaaaacacaggtggggctcagcaaacacgtgacgaacgaagatgaacactttggactggggtaaacaacacggtttcgaacaggataactgggctcgtcgggccctaccgttcagt

SEQ ID NO: 13358 - DNA, 621 bp, Zea mays
  Clone ID: LIB3279-213-Q6-K6-A9
ccgtcgtcttcttcctcgacgcctcataggctcatagggttctccaaattctaaatcgttgcaagcgaaaccaccaaaactgtactcacaaccctcgtctgcgctgcgccaccactcccccgtggcggcttgtagttgtagaagttcccggaaccagacaacccctaggcgctgagttttctgatagcggcttcggatatctcgtcgtgggcggccatggcgggcccgtgctgagtgcggggcgggagcaggtgaaggtctccgagctcgagatctcgatgcagattcgggagggcccggcgcggcggcaaggcgccgtccgccgctggggcgctgcggtcgcccatgtccgccatgatgctcgctatgttcgctactatggcctccttctacgtcgccggtcgattgtggcaggatgctcagaaccgacttcatctcattaaggagctcgacagacgaacaggccaggggcaatcagcaatatctgtggatgataccttgaaggttgttgcatgcaggcagcaagggaagcggttggcatcacttgagatggagctggctgcagcaaagcataaaggttttgttggcaaatatactcctgagacaaatggaactcattct

SEQ ID NO: 13359 - DNA, 557 bp, Zea mays
  Clone ID: LIB3279-213-Q6-K6-B1
ccccgcgtccgcggacgcgtgggcgccagccagccatcgtcacactggtgagctctgcagtctgcactctgcttagctccgagcttcagtgccttcgttgttagctgttagctccacagtccacagttccacacacacgtccagctgcactgcaccaatggccgccgtcgaggtccaggtcccgactgccgctcccgtcgaggaggctgctgctgctgctgcagcgggagtggaggctgcccagctggccgccgtcgagaccccgaacgaggagaccgctgctccggcggcggagaccgaggtcgtcgccgctaaggagccggtgtcggccgaggccgagactgagtccaaggaggtcgaggtcgaggccgaggccgtagctgaggctgagccgaccgaggcagagcccaaggaagcagagcccgaggccgccgcgccggcagcagagacggaggctgctgctgccccggtcgaggctgctgagccggagatagccgacaagaccaaagtagcggttgactgtggaggctaaccaggaggagggggaggcattgact

SEQ ID NO: 13360 - DNA, 308 bp, Zea mays
  Clone ID: LIB3279-213-Q6-K6-B10
ccccgcgtccgcggacgcgtgggcggacgcgtgggcggacgcgtgggagcagcatcgctaccggtagatattcatgcgtctatcgtctacccgcccctgaaaaccctagttatatatatatatatatatatatatagacatatgctgattgtaacctaattagcctgcatccagttaagcagggactgcctactctgctaggaggacgtgtgtaatcatgtggcctgcgcaaacagtaatttgtgctaggtgctgtgtattcatgctgctctgataatcgtgtcgtggggataatatatcctatttat

SEQ ID NO: 13361 - DNA, 646 bp, Zea mays
  Clone ID: LIB3279-213-Q6-K6-B11
cattcctccccaaaaacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcagcggtgtgatcctcttcgaggagaccctctaccagaagaccaaggatggcaagccttttgtcgatgtcctcaaggagggaggcgtcctccctggcatcaaggtcgacaagggcaccattgaggttgttggcaccgacaaggagaccaccacccagggccacgatgacctcggcaggcgctgcgctaagtactacgaggccggtgcccgctttgccaagtggcgtgctgttctcaggattggccccaacgagccgtcacagcttgccattgacctgaatgctcagggtctggctcgctacgccatcatctgccaagagaacggtctggtgccaattgttgagcctgagatccttgttgatggccctcatgacattgatcgctgcg

SEQ ID NO: 13362 - DNA, 660 bp, Zea mays
  Clone ID: LIB3279-213-Q6-K6-B2
cgcacaccagatcgcctcctcctcctccccctcggatcaggagctcgcgaaagcctcgagccttttataacgagtgcttcctcctcttcgtcctcctccccctaccatggctactcgtcctctccatccatgtcccaagattcttacatgcctacaccttcttacaccagctacgccacctcgcctcttcccactcccgccgctgcctcctcgcagcttccgccactctactcgtcgccttatgcggcgccgtgcatgaccggccagatgggcctgaaccagctcggcccggcccagatccagcagatccaggcccagttcatgttccagcagcagcagcagcagaggggcctgcacgcggcgttcctgggcccgcgggcgcagccgatgaagcagtccgggtcgccgccgccgctggcgccggcgccggcgcagtcgaagctgtaccgcggcgtgcggcagcgccactggggcaagtgggtggcggagatccgtctcccgaagaaccgcacgcggctgtggctcggcaccttcgacaccgccgaggacgcggcgctcgcctacgacaaggcggccttccgcctccgcggcgacacggcgcgcctcaacttcccgggcctccggcgcggcggcgcgcacctcgccggcccgctgcacgcg

SEQ ID NO: 13363 - DNA, 559 bp, Zea mays
  Clone ID: LIB3279-213-Q6-K6-B3
ctgtttctgggttggctctttgacattggagctgggattggtgaacgggtgacaacatggtggattggcctgctgcttgttctgttggtgggttggttgtgttctattataaatgggggagctttatacagaagaaagagagtgagcatgctgatggccctgtccagctttccaagtttcttggacgggacaaagaaaaggaagaaggtactcaacggagtgcaatctctggtaaaaagataatgatgaagcttgagaagacaaaggaagacaaggcagcagagagcaagcggaacgaactgttgaagtttctgaatgccagttacgattgatgtgttcgaatcgctggcgcggaaagtgcaaaatgcccttttttatcgtctttgcactggtgcttttggtgatacttaagttataagcgttttgtttcttgtctataacttggccaccaaagttttgttatgctcaactagcgactgagtgaaggtttacatgcaattgatttgaattcttgtttgccagtcatggatttgcagcttttaaacccatcctttttgtg

SEQ ID NO: 13364 - DNA, 582 bp, Zea mays
  Clone ID: LIB3279-213-Q6-K6-B4
cgggcgcgtggggggcggtatcccaacgaactaccatggggaggtagtggatatcaagggtgataatccagatgctgctatccctggtctaatggctgctgcagaagcaccctgtgcatatgaccatggtgcaaataggctaggcgcacattcacttcttgcacatatgtgcttttggcagagcttgtgcaaacagggtatcacatatttctaaaccaggtgagaagcataaacctttggaaaaagatgctggagagaagaccatagcctggttggacaagctgaggaatgcgaatgggtcattgccaacttccaagatccgtctcaacatgcaacgtgttatgcaaaataatgctgctgtgttccgtacacaagaaacacttgaactaagttgtgaactgattagcaaaacatgggaaagtttccatgatgtgaagctcagcgaccagagtctcatttggaactctgacttgatagagaccctgaagctggaaatcttttgataaacgcatgcataactatgtattctgcaaaagctcggaaggaaagcagaagaactcatgctcgtgaagatctcacgac

SEQ ID NO: 13365 - DNA, 614 bp, Zea mays
  unsure (1)..(614): unsure at all n locations; Clone ID: LIB3279-213-Q6-K6-B7
attccattcgttcctccctgggttggcgttggcacgacgatcgacggtgacagcggccggggcctcggcggtgtccctgacctcgctggtggcgggggcgatggggcgcagtgcgccacgcgacgggtggtgcagtcccgctgccacacggaggaagtcgagcccggccattttgtccgcaagtgcgagaagacggagcagctcctccgcgactgcgtcggcaggccctctgaactggtggaatccaaaactgaaaacactgaagaagatgtcacagaagaaatgaagagcggttcactttctcttgggtttccaagaaacgagcccttcgcattccctggactccgcagtgacatggaagcccttgagaaagacttctttgggagcctagggaacgtcctggatgaagctgagcggatggccaacagcttcgtcagatcttttggttttccacctgctcatgacagcggatcaagtccatttcgaagacagcctgctgagaggcatattgaggaagataccgcaaagaataagactgagagcgactactcagaattcangagcaagatttcagatgtgtaagcagctgtagagctgcagttatctggcctgtg

SEQ ID NO: 13366 - DNA, 629 bp, Zea mays
  unsure (1)..(629): unsure at all n locations; Clone ID: LIB3279-213-Q6-K6-B8
gtgtccggccattctccccctcccgcgccccgagaagcgctgcgggcctcacctgcccgtcctcctgcctctcaggaaccgcggttcaggaaggaagggaaggcaagtgcctgccggggctcagcaccgatggcgtacagggcggaggacgactacgactacctcttcaaggtcgttctcatcggcgactctggcgtcggcaaatccaacctgctctccaggttcacgcgcaacgagttcagcctagagtccaagtccaccatcggggtcgagtttgctaccaggagcatcagggtcgacgacaaggtcgtcaaggcccagatctgggacactgctggccaggagaggtatcgggcaattacaagtgcgtactaatagaggggctgttggagcacttgtcgtgtatgatgtgacacgccatgtgacctttgagaatgtggagaggtggttaaaggagctccgggatcacactgatgcaaacattgtcatcatgcttgttggcaacaaagctgatctgcgacaccttagagctgtatccgtggaggaatgccaaggcttcgccgagagggaaagcacattcttcatggaaacatccgcactggnatccatgaatgtcgagagcgctttca

SEQ ID NO: 13367 - DNA, 156 bp, Zea mays
  Clone ID: LIB3279-213-Q6-K6-C1
cgtaataatacgagatgttttaagcggttgaacattacggtggtgtaatcagagtaatctgttgctgttaaggtgcattgttgtatgaattgtctctacccgagtagaagaatcagaccattcgggattctatgatcatagtacattttttgcttg

SEQ ID NO: 13368 - DNA, 668 bp, Zea mays
  Clone ID: LIB3279-213-Q6-K6-C10
cacatggtaacatacaatgattatgtttagttagacaacggactcccactcccagaagtcgcaggctcgcagcagtggctgcatcgttgtttggtagatgaatttataggttctgcaacctgcttttaatccatttcatgaaaaatgcattttgagtggctcagtaccatgctatgccaaattatggataagagtaaactgatatattctagaatcatattaaccaacgaaaatagagttgcatctttcttgagagcacccacccaattgaatgcatatgcagcaacatgcacagataaaatgttttataaatatggtttcttctgctcggtagaatgtatttttcaaatccttgtaaaaaaagaatgttaattttcatgttttgccttttgttttcttaaccatcttgatgcagcaagtaccagaaaactctgtttttgtgatgggagataaccgaaacaacagctacgattcacatgtgtggggccctcttccagcaaaaaacatattggggagatcaatttttcggtattggcctcctggtcgaatagggggtactaccaagggttgcttcagccctgaattaagccctggagcaaagccaggatcacttactgatgtcaaatcgacaaagtaggagattgagaaagtagttttggtggtgcctg

SEQ ID NO: 13369 - DNA, 670 bp, Zea mays
  Clone ID: LIB3279-213-Q6-K6-C11
gttaattttatttcatggccttggtgatttgaacacatgttcttgtaggttgaatagaagagaagagtagaagcaccaagttgtaccaatggggcgtggaaaagtagagctgaagaagattgagaatccaacaaaccgccaagttaccttctccaagaggcggatggggttgttcaagaaggcaaacgagctagccattctttgtgatgcgcaaatcagagtcatcatattctctggcagtggcaggatgtacgagtactccagccctccatggaggtgcgtgaagcattatttatttatttatttatgtatttatttctgaagcttgtttagtacagtaacatataaggtttagctttattctgctataaggtttaatgagttcaaaagattcatgagagcttcagaactgatttgcaattattcctgccaactacaatcttacaactacaatcttatgtttagtacagtaacatcagaagagacgatgattaggtgtgtggtataagaccggtatcatatattcttattgccagcggttaatagtttcaatagttattatttatgactgagcacccatgaggggttttacgacgtttttatatcgtgctatatatcactgcagcttctggttgcagaatagcaagcgtctttgataggtacctgaaag

SEQ ID NO: 13370 - DNA, 596 bp, Zea mays
  Clone ID: LIB3279-213-Q6-K6-C2
cggacgcgtgggcggacgcgtggggccgtcgtgcgctcgctacccctctccctcgaggcctttgccggcgaagagcgcccagtcgcccaccaggatgaagtttgttgctgcctacctgcttgctgtcctcgctgggaactccagcccctctgccgaggacttgacagccattctggagtcagttggctgtgaagttgacaatgaaaagatggaactccttctgtcccaactgagcggtaaggacattaccgagctcattgccgccggcagggagaagtttgcttcagtcccatgtggcggtggcggtgtggctgtcgcggcagctgcccctgctgctggcggcgctcctgcagctgaggcgaagaaagaagagaaggtggaggagaaggaagaaagtgatgacgacatgggcttcagcctcttcgactaagcttgtgcaatagtcaagaatattgtttttgagtcgcggaagcagaggggataaaaatcttagtcatgtttggactttaactttgttttatgttggaaagtacttgaaagactttcctgtggtaattctaggcgtaggttgctgtgctggttggggtttactggtg

SEQ ID NO: 13371 - DNA, 124 bp, Zea mays
  Clone ID: LIB3279-213-Q6-K6-C3
cggacgcgtgggttttttttatttttattttaaagaacgtctttttgtataggatgctgcaagcatgtacgcatggtactagctacaagcatatatagaataacaaatcaaaattcatgtgatg

SEQ ID NO: 13372 - DNA, 644 bp, Zea mays
  Clone ID: LIB3279-213-Q6-K6-C4
agaaaatccaagctgggcttcactgtgtacccatctccccaggtgtcaacctctgttgtggagccttacaacagcgtcctctccactcactcactcctggagcacactgatgtctctatcctgctcgacaacgaggccatctatgacatctgcaggcgctccctcgacattgagaggcccaactactccaacctgaatcgccttgtgtctcaggtgatctcatctctgactgcttccctgaggttcgatggtgccctcaatgtggatgtgaacgagttccagaccaacctggttccttacccgaggatccacttcatgctctcctcctacgcaccggtgatctcttctgcgaaggccttccacgagcagctgtctgtggcggagatcaccagcagcgcgttcgagccggcttccatgatggtcaagtgcgacccacggcacggcaagtacatggcttgctgcctgatgtaccgcggcgacgtggtgcccaaggacgtgaacgccgcggtggccaccatcaagacgaagcgcaccatccagttcgtggactggtgcccgacggggttcaagtgcggcatcaactaccaggcgccaacagtggtgccgggtgccgacctcgccaagtgcagcgtgccgtgtgcatg

SEQ ID NO: 13373 - DNA, 602 bp, Zea mays
  unsure (1)..(602): unsure at all n locations; Clone ID: LIB3279-213-Q6-K6-C5
gtgccagttcatacaaagatgttgatccaaaactggtgagngaaaagaagatcgtagtctctgcagatgatggaatccgagtggatacttctcttgcagtcctgtcaaaactcaaaccagcattttcaaaggatggcagcactactgctgggaatgcaagccaagtgagcgatggcgctggggccgtcttgctaatgagacgggatgttgctatgaagaagggtcttccagttcttggtgtctttaggacctttgccgctgttggagttgatccagctgtcatgggtattggtcctgccgttgcaatccctgcagcagtgaaagctgctggccttcagatggatgatattgatcttttcgaaatcaacgaggcttttgcatctcagtatgtctactgctgcaagaagttggaacttgatcctgctaaagtcaatgttaatggcggtgcaatggctcttggacatcctttgggtgctacaggtgcacggtgcgtcagtactcttctcaatgagatgaagcgccgcggcaaggattgccggttcggagtgatttctatgtgcataggttctgggatgggtgccgctgctgtgttcgagcgggga

SEQ ID NO: 13374 - DNA, 255 bp, Zea mays
  Clone ID: LIB3279-213-Q6-K6-C6
ggcagcgagttccggttccccgaccaaccgacggcagctgctgctgcggccgatcccttcgcatccgctgcagcagcagctgacgatgatgacttatacagttaaattagcagtcctgtgttgtgacgcatattgagtactttgcttcgttatatgcttattatagtagactacgtgcaaaacgcggagtcgctgtacctatatagatacttaagttaatattttggtacgatcctctgaatcgtgccatgagcc

SEQ ID NO: 13375 - DNA, 652 bp, Zea mays
  Clone ID: LIB3279-213-Q6-K6-C7
cctaactccaaaaaccctcgctctcctctcaggccgccgccgcagctgacgacgcagccgaggtggagcggctttacgagctcggcgagcgcctctcctccgccaatgacaagtccgagcatgcggcggactacgaggcgattattgcagcggtgaagggacagagtgccaaggcgaagcagctcgcagcgcagcttatccccaggttcttccggagcttccctgcactcggcacgcgcgccatgtcagccatgttcgatctcgtcgatatggaggagctcgcgatcagaatacaagctattcgtggctttccacttcttggcaaagatactgaatttgtgtcaaaaattgcagatgttttgggtcagctccttacaagcgaggaaaatgttgagcgtgatgctgttcataaagcgctcatgtcccttatacggcaagatgttaaaaattcattacaacctttatttaagcatgtggagcaaggatcagagattcgtgagaagattatttgttttcttcgagacaagtctttcctcttaaagcagagctgctgaaacctcaagcagaaatggagagatttataacggatttgataaagaaaaatgtgcaagatgtaactgttcagaattcgaactatcatggggttcttgcg

SEQ ID NO: 13376 - DNA, 453 bp, Zea mays
  Clone ID: LIB3279-213-Q6-K6-C8
cccacgcgtccgcggacgcgtgggcggacgcgtgggcgccaagcaggcagaggagatgaaggtgaagaagcgggcagaggcatactcgaaggagcgagaaaagaaaaccaactcgctcaggtccgtcggagaagaagtactaccagtcctactcgatggtcggccttggccttcctggcagcggcgggcacggtggcattgacagccacgcgtacgacgcccgtgatcctcttgcggagaagaaaaccgagatcgcccagtgccgtcggaaggtggaggacgagatggcgaggcacgctaaggccatggaggtcacgcggtcaatgacgctgaacaacatccagacaggcctgtcgggtatattccaagagataactgcttactcagggacagtggctgaagctcttgacgtggagtgccgcgcaagctgggacagagcggtaggacctgttg

SEQ ID NO: 13377 - DNA, 612 bp, Zea mays
  Clone ID: LIB3279-213-Q6-K6-C9
gctgacagcctcagaagtatggtggtgtggttggtgtgaggcaatcatcagaaatggagcatgtgcggggcgccgatgggcatggcggcagccggttagggcagctgccagggacgcagcagcgggtacgtccgccggcatctcctcctggatgtccatggacgacgctcgcctgaactcctcgacgaggcggagcacctcgttgacggagcggaggcggtcgccgagctaggcggcacgggcccgggagcacggagttctcctgctcgacgcgggtgtactgggacgcgatgtcggcaggcacgggccgccacgcgcgcgttgtcggcctgcaggcgcaccacctactgcaccagctagtccaggtgctgctgcttccggagccgggaccaacgcgccgactcgcggttcgacagccgacgtttctcgcgcctgtgcgtgtccgccgccgagtcgccgttcgacccgtacgtcctccccgccgtcggagacagcgacgaccacgacatcaagacaggttccttttcttttctttttcccgcagggaaccggacagcctaacttacctagaaaagatcctctacctgtgccgctagtgctgttatttggcga

SEQ ID NO: 13378 - DNA, 529 bp, Zea mays
  unsure (1)..(529): unsure at all n locations; Clone ID: LIB3279-213-Q6-K6-D1
ctcaaaataaaaanaataccctggtttcagggggtgtgagagggacactcccatggatggctccagaattactcaatggaagcagcaataaggtgtcagagaaggttgatgtattttcttttggtattgttatgtgggaaatcctcactggcgaagaaccatatgccaatatgcactatggcgcaattatagggggcatcgtaaacaacacactgaggccacatgtgccagcttcatgtgatccggagtggagaaggctcatggagcagtgctgggctccagatccggcacagcgcccagcgttcacagagatcgctggacggcttcgctccatgtgagttgcagcaaattaggcgaaggcaaccaaataagatacaggtggagtactgcctttcaacccccaatccgttgggggttctgttgtgctttgtttccttttgactggagagtaatacatatacatgcatgttatagagtgctgtgaaaaatagtgcatcaatttatttataaccatgttatgagctggatt

SEQ ID NO: 13379 - DNA, 626 bp, Zea mays
  unsure (1)..(626): unsure at all n locations; Clone ID: LIB3279-213-Q6-K6-D10
gccacccacgacacgactcgattcccagacccaaatccatccatcaatccatccgcagcgggcaggcacacacacaggcttttgcgttggcagggatggacgcgttctactcgaccaccgcctcctcctccacgtcgtcggcgccgtacggcggctacggcggcggcggcgaaggctggggctacgactcgatgaagaacttccgccagatcagccccgccgtccagacccacctcaagctcgtttacctcaccctatgcgtggcgctggcctcgtcggcggtgggcgcgtacctgcacgtcgtctggaacatcggcgggatgctgaccatgctcggctgcgtcggcagcatcgcctggctcttctcggtgcccgtctacgaggagaggaagaggtactggctgctgatggcggctgccctcctggaaggggcgtcggttggacccctcatcaagctcgccgtggaatttgacccaagcatcctggtgacagcgttcgtggggactgccattgcgttcgcgtgcttctcttgcgcggccatggtggccaagcgcagggagtacctctacctgngcgggctgctctcttctggcctctccatcctgctctggctgcagttcgccgcc

SEQ ID NO: 13380 - DNA, 355 bp, Zea mays
  Clone ID: LIB3279-213-Q6-K6-D11
cacaactcttgttccactgcattgttgccctttcatgacttgttgaatgtttgaaggtgggttcgaccttcgcttatggtcatggaagaggcgacgatgccaaaactcttgcagagctcggattccaaatcggtgattacttgagcgttgcaatcatgtagatggtgcccgcaccgtatgtaattgatgtaatgtcaaaagggctctagttgcaacaataaggcatgattctctgttagcactagaaactggaaccagaattggtctgtaatactggtagtttcaaatttacctagacacttcaaaccagaattggtctgtaatgtcaaaagggctcgggttcctatgaagtcaa

SEQ ID NO: 13381 - DNA, 157 bp, Zea mays
  Clone ID: LIB3279-213-Q6-K6-D2
cggacgcgtgggcggacgcgtgggatcgcgagcggccgctcgcgatctagaactagggcaaagaggatcgacacgatcaagaagctccagttgggtgccccaagtgcctgaaaccgagcgtgtcttcccttgaaaacggtcgtggaacagacctgta

SEQ ID NO: 13382 - DNA, 472 bp, Zea mays
  Clone ID: LIB3279-213-Q6-K6-D3
cgatcccagcatccgagagagctccacaggccaggtccccatcgccgcggcgcttgccccacctctcccccgcccggtagtagcctcgccgccgttgccgagatggggttcgtgtccttcgtcgggaggagtgctcttcgtcgccgctttcctcctctccgcctaccaggagtttaatgaattcggtgctgatggtggaccagcagctaaggcccttcggcccaaattcaacgtgtttgtcaaaaatgtatctgctcatctgggagtagctgtgccacacattgagttgaagcatgtgattgctgctacaattggtcttaagggtcttggaagcctcctttttattttgagcagctctctcggtgcttatctactgctgctggaccttgctttgatcacttctatgatccatgacttctacaactactatatggagaaggcaaaatttgcatgcctcttttgctaattcacc

SEQ ID NO: 13383 - DNA, 475 bp, Zea mays
  Clone ID: LIB3279-213-Q6-K6-D4
ttccacgccccccttgtccaactacccctcccactattactatttcatttcatccccccgatccaagaaaccggccaccgggccggagcgaacccttagaagcgaccttggcccgtgaggaagccaatcagccagagacagaacaatccatccaccatgaacagcctgttctcgagctcatggaagcgcgacggcggggacatcgagtccggcggcgtggagatgtctgcgccgccgggcgccgcggcgggcgcgagcctggacaggttcttcgaggacgtggagtccatcaaggacgagctccgcgacctggagcgcatccagcggtcgctccacgacgccaacgaggggggaaagtcgatgcacgacgcggtggccgtgcgcggcctccgtgcgcggatggacgcggacgtggccgcggcgatcaagaatgccaaggtggtgaagctgagcctcaagtcgctggaccgggcca

SEQ ID NO: 13384 - DNA, 494 bp, Zea mays
  Clone ID: LIB3279-213-Q6-K6-D5
caaaatggatggtcacgcaaaagcggtggtgcccttagcgcggtcgcagcaacaaaaagtcctgttatattcattggaactggcgagcacattgacgagtttgaagtttttgatgtgaagccatttgttagtcgcctgttgggtatgggagattgggcaggctttatggacaagattcatgaagtggtacctacggatcaacagcctgagcttctgcagaaactgtctgaaggaagctttactctcaggcttatgtatgagcagttccaaaacattctgaaaatgggtcctattggccaggtcttctctatgttgcctgggtttagcgccaaactaatgccaaaaggacatgagaaggaaaagcaggctaagattaagcgctacatgacaatgatggattccatgactgatgcaaagcttgacagcacaaatcctaagctgatgactgaataacggatcattcggattgcacgggggtttggttgttctgttag

SEQ ID NO: 13385 - DNA, 616 bp, Zea mays
  Clone ID: LIB3279-213-Q6-K6-D6
tttttctcctctcgagtagcgtggcgggcgtggacgcggcggcgatgctgcggtcggcgctgcggcggggaggggcgtccgcgaggcaggtcgcgttggcgggagaagcctcgccgagagacctcctccggatgcgcgtggcggagcgggagcgcgcgaggcggcggcgtcgcgacccgggccgcgacgagttcttcgtgcccacgccagagtcgctggcgtggctcgactcggtctccctccccatggtgctcaccgccgccgccgtggccctcttcaccaagctcctcatgatggaacatgaagctacagatcaagaaaggagagagcgcaagataaagaatagccaccctgatcaaggaacagtaaggatgctatctcgtgaagaatgggaggaggtccaagaagtcaggccaaggaccccttttgaatcaaagttagctcgtccacatgcccggataagaacgggggagccagtgcgactggaggatgtcaaggattgggctactgatgtaatcgcagattcttttaccagagcagaagaagctaccaagaaaaaatgatttagaagaatctaaaacacccggtgtatctgctttatcgtttctctgaatct

SEQ ID NO: 13386 - DNA, 613 bp, Zea mays
  Clone ID: LIB3279-213-Q6-K6-D7
aatctccccagcaatccctagcagaagccttccatcctcactcgctcgatggcccgcacgaagcagacggcgaggaagtccaccggcggcaaggcgccgaggaagcagttggcgactaaggcggcccgcaagtctgcccctgcgaccggcggagttaagaagccccaccgcttccgccccggtaccgtcgcgctccgggagatccgcaagtaccagaagagcacggagctgctgatccgcaagctgccgttccagcgcctggtgcgggagatcgcgcaggacttcaagaccgacctacgcttccagagctccgctgtctccgcgctgcaggaggcggctgaggcctaccttgtcggtctcttcgaggacaccaacctctgcgccatccacgccaagcgcgtcaccatcatgcccaaggacatccagcttgcccgccgcatccgtggggagagggcctaagcatcgtatattctgtcatcagtgcccgatcagaagatgtagagatgtgctgggttctgtagtttgggttactgtcgaatcatcgagtagttggttgttcactgctgtaacttattatcatgatgcatatgaaatggcaatgaactatgttatc

SEQ ID NO: 13387 - DNA, 473 bp, Zea mays
  unsure (1)..(473): unsure at all n locations; Clone ID: LIB3279-213-Q6-K6-D8
gcccttgcgagccattagnatcatcaaatgtcacatctatcgctatttcaacaagaccggtggtttntgttgaaaacacaatatccatgcgcatttgatgcataaccaagcaagaaaccctcgtccactctaggagcacacttcgagctcttgactttcttgttaagaatgaagcatttacaaccaaagactctaaagtaatcaaccttaggtttgttaccaatgagaagctcgtaagcagtcttcttataaatcttatgaagatataaacggttgattgcatgacaagcggtgttgaccgcctcggcccagaagttgtcacgtgtcttgtattcatctaacatggttcttgcgacttcaattagtgttcgatttttcctttccgctacaccattttgttgtggagtgtaggggaccgagaactcatgtttgactccttcttcgcctaagaattcttcaacacttgtattctt

SEQ ID NO: 13388 - DNA, 607 bp, Zea mays
  Clone ID: LIB3279-213-Q6-K6-D9
ctcggagggatgatcgtcgtgccgatagggatcgtgaaaaactcgtgaaagggtacgcggaaagagaccgtgaggagaggacccgtgaacgttcgcatgaccggactcgtgatagagatctacgagatgagaagcatcaccatagagaccgtgagaggactcgggatagggagagaggaaaggaccgtgaaagagaccacggccgtgaccgggagcgtgatcgtcgtgacagggacaaggatcgtggtcgggactatgatagagaaagggaccgtggtcgctctcatgatcgccatcgtgagagaggcagggaccgtggtgaaagagattatgagcgcaccagccatgaacgtgaccgtggtcacatgcatgagagggatgcagactatggcaatggtgggacaaagcatgacaaaaatctgtctagttatggtcaggattatggctatggtcagtatgagcaacacaaaggtcatgatgcatatggttacagtcaagatgtacgtggacatgaaactgaacactcaaagcggcatgagcacgaatattatcgtgttgactcgtatggtaaaatggaagctaactatcagatgccgccaaacatgct

SEQ ID NO: 13389 - DNA, 633 bp, Zea mays
  Clone ID: LIB3279-213-Q6-K6-E10
ggtggccgcggtggctcctccttcggcggcggctttggcgctgctggctctgacgtccgccctggtgactggtactgctcctgcggcgcgcacaacttcgccagccgctccagctgcttcaagtgctccgcctacaaggaggaggccgctgtgaacagtggcgctggcggctttgacggcgacatgtcacgctcacggggctacggcttcggcagcggtgctgctggtgctggtgctggcgctgcccgtactaccaaccgccccggttggaagtccggagactggatctgcaccagatccggatgcaacgagcacaacttcgccagcaggatggagtgcttcaggtgcaacgcaccgcgggactctggtagcgctgccatgacctacgaaaactacttgcactgaggtgtaggatcgagcaagttaaaaagtctgcagcgccgaagaaagcgacgacaagaggagtcctcatcacgtcgtaacgtaagagagagagtagtggatttgcaacaaaaaaaaaaaaaaagacggccgcgatgctctgttactagctagctagttttggtcaaccacccatgccgtctcttctcttttattagatttggtttggttctcatagcccctttaatacca

SEQ ID NO: 13390 - DNA, 634 bp, Zea mays
  Clone ID: LIB3279-213-Q6-K6-E11
gcgaggtcggcgcggcgtcgtccctggcgcccaagatcggcccgctcgggctctccccgaagaagatcggcgaggacatcgccaaggagacggccaaggactggaagggcctgcgcgtcaccgtcaagctcaccgtccagaaccgccaggccaaggtctccgtcgtcccctccgccgccgcgctcgtcatcaaggcgctcaaggagcccgagagggaccggaagaaggtcaagaacatcaagcacagcggcaacatcggcctcgacgacgtcgtcgagatcgccaggaccatgaggaacaggtccatggccaaggagttggccggcaccgtcaaggagatcctcggcacctaggtcagcgtcgggtgcaccgtcgacggcaaggaccccaaggacctgcagcaggagattgatgacggagaggtcgagatcccgtccgcttgaagactagccatccaaggggacttccattggtgctgctgaagtgttgttgttctgcatgctatcgatgtacctttttcaagcaacgcgagccatctattttttttgtctagctatgttagtgatatcttgtgagagacctcaatgttaccaccgtatctttgtctttgttggatggagagatttagcacctc

SEQ ID NO: 13391 - DNA, 595 bp, Zea mays
  Clone ID: LIB3279-213-Q6-K6-E2
gttgtgagcttttgggcaggagttggctctccacgcccagcgaccagacgtatctcagctatgtaactgtcagaacgggaaagttatgctgattggggaaggccaacatggttcagttgggatgacaaaaatccaggcacacaggtgcttttgtccagactaaatttcttcgggtccaaacagatatctaatgccgaaaatgaggggttgaaaatgtatagagatactgcagaagctgtcatttgtggtctgattccagattcgcctcaagccactgccagcagaactggaggaggcttggtgtggataagcgggtggaattctctccagcatgccaccaacgctgcgttcctatctgttgtgtacagcgactacatgctctcgacgcggacagcggcagtgcagtgcagcgggaagtactacagccctaccgatatacgcaactttgctgcatcacaggctaactatatcctgggagacaacccgatgaagcttagctaccttgtgggatatgggagcagctacccaaagcaagtacaccacagaggggcgtcgatccccgcggatgcgaaaacaggctgcaaagggttcgagt

SEQ ID NO: 13392 - DNA, 542 bp, Zea mays
  Clone ID: LIB3279-213-Q6-K6-E3
cccacgcgtccgcattaccatagctcttctgttcaatgcatagaggcactcggagagaggatctgggtgggctatgcaagtggtactattcaagttatggatgttgaaggtaaccttcaggcaggatggattggtcatagctgcccagtcataagcatggcagtcggcgattcttacattttttctttggcacatcatggtggcattcgaggatggtctctaagttcccctagccctcttgatgatattctacgctatgaattggctagcagggagctgtcatacacaaggctagagaaccttaaaatactggttgggacttggaatgttgcacaagagaaagcttgtcctgaagcgctaaagtcatggttgggtggcgcatttttcgatatttgggttggtggtggttggtttgcaagaggtcgagatgggtgctggagttcttgccatggcagcagccaaagaaagtgtaggacttgagggcagtaccaatgggcaatggtggatagacagtattggcaaaacacttgatgaggggatat

SEQ ID NO: 13393 - DNA, 500 bp, Zea mays
  Clone ID: LIB3279-213-Q6-K6-E4
gcgggccgcatcccgcccgcgccgcccaccggcggccacagccgcctacataaaccactattcgaccactcgccgaaccaagccacccacccaccacccaaacccaatggcgtccaacctcctctccgccccgtcccgaaccctagctccgtcgccggcgccggcccccgcgggcctccgcgggcgcgtgccggtgcaggcgcacctcccgcgcggcggcctcggcctcggcctcgccccccgccgcagcagccgcgcgctccgcgtgcgcgcgtcggtggcgatcgagaaggagacgccggagagcgagccgcccccgacgttcctccgcgaggacgggcacgggtccgggtccgtgcgggcgcggttcgaggccatgatccggcgggtacagggggaggtctgcgccgcgctcgaggaggccgacggcggcggcgcgcgcttcgtcgaggacgtctggtcgcgccccggcgggggcggtggcatcagccgcgttctgc

SEQ ID NO: 13394 - DNA, 642 bp, Zea mays
  Clone ID: LIB3279-213-Q6-K6-E5
gcccgcgcccgctgctgcttgcctgcttcccacgcacgcgagctctgttccgtactgcagcaaccgcaaccgcatccgcatccgaatccgcacacgatccccgcgccacttgccccgtcaccccccacgcggcccgcgcctccgcccgctcgtcggccaatgcccggcgcaggccagctcggcgagatgagatgacgccgccgcgcggcggtgcccggcctcccgtcgctcacgcgcgccagcaccagcaccacccggccccatcgggattcttcatcccgtcctccacctagcgcggtagcgccgcatttattccctccccagcacaacggtcacgtttccatcgccccgtcttctctccctcgtcgcatccggcgctccgcctcgtctcctatttaaagcgcgccgggctgggagccagcgatcatgctattctctaggaggcctctcgccgccgctttccacctcgcgcccctttcgcctccgctgctcctcttcttcgcatccgcgtcctcgtcctgctcgcccgccgactacggcgacgacgagtcggtctccggctccagaggttgcactgctgcaaggatggacagcggtgcggtggagacagcgttcactggggcagtatggtcatcaccttcg

SEQ ID NO: 13395 - DNA, 512 bp, Zea mays
  Clone ID: LIB3279-213-Q6-K6-E6
cggtcgcgtgggcggacgcgtgggcggacgcgtgggcggacgcgtgggcggacgcgtgggttttcgcgccgccgccgccgccgcttcgtcgtctccgccgcatcgtcgtctccgccgcagccttgccgtcgcacaagaccttccggatcaagaagaagctggcgaagaagatgcgccagaaccgccccatcccctactggatccggatgcgcacggacaacaccatcaggtacaacgccaagcgcaggcactggcgctgcaccaagctcggcttctgagcgcgcggatcggccggctcctgcgtcggaattctagggtctctacctttcctttggttttatcgatgtctcttgtgtttctgtaagctagcaaacggttccagaaagcttttgttaagattttgatgacgctaagaggaggatgctactatgctgtgctcaggattccatgctggattgcgatgctaaattaaggaacctctggtaccttactttaagaaaaaaagaaagggc

SEQ ID NO: 13396 - DNA, 644 bp, Zea mays
  Clone ID: LIB3279-213-Q6-K6-E8
ccgcttccaagagtcgaagcgaggacgtggaggttctgctggtaacaagttccggatgtcactgggtctaccagtggcagccactgtgaactgtgctgataacactggagccaagaacctttacatcatttctgtgaagggaatcaaggggcgccttaacaggcttccttctgcctgtgttggtgacatggttatggcaactgtgaagaagggaaagcctgaccttaggaagaaggtgatgccagctgtcattgtgaggcagcgcaagccatggcgccgaaaggatggtgtctacatgtactttgaagacaatgctggagtgattgtgaacccaaagggagagatgaaaggctctgccatcactggacccatcggaaaggagtgtgctgatctgtggcctaggattgccagcgcggcaaatgcgattgtctagtggaatcagttgatcgaaatttacttcaaataacatttgtttgtgttgcgaattgggaagagagtttttagttagacgagcttttgatggccctaaagatgttttccccgatgatgtttgtgctgctggacccgttcctgttagcttagatggcatcctccccatatcgataaactgttgcttaacctgaccatcgggagagttagaagtt

SEQ ID NO: 13397 - DNA, 633 bp, Zea mays
  Clone ID: LIB3279-213-Q6-K6-E9
cggacgcgtgggcggacgcgtgggcttatcgaaacacaagctgactcaagttctacagagctctttaggcggacaagcaaagacactgatgtttgttcaaattaatccggatactgaatcatattcagaaacaataagcactttgaagtttgctgaaagggtttctggagttgagttaggtgctgcaagaagtaacaaagaggctaaagatataaaagagctgctagaacaggtttcatatctgaaagacacaatatcacggaaagatatggaaatcgatcaactcctgaaggacaaagccaagtctccaagttcatcaacagatataaatgacagtagccaacagatccgacgactatcaggggctgctggatcaggcgaggccgaatgcaaagataacatgtctgatgatggctgctcagtggcaggaaccgagtgttctgtaggtggtgcttcagaggcgacagcagaacgaataaggccccatcaaggatagccaggctttttctcacaaagaatgggcagcctgcaaactcgaagccaaaaccaagggagtctgccctgaaaccgtcaggtcgcacgacatctacaggaagccaggcgacaggaggaggatcttcagtgaaacccccg

SEQ ID NO: 13398 - DNA, 496 bp, Zea mays
  unsure (1)..(496): unsure at all n locations; Clone ID: LIB3279-213-Q6-K6-F1
taagaacaacttcgacccccaaaaanagtcaacgctgtcagccttgcatatgtctatgagtttcccgagatgtgaatctggcaatacttccatggcgacaagaaatcttggtaccacaatcgctgctaggattagcgagttggaacatgcaaatgcaaccaagcctgcagaaaaaaacactaagcctcatgatttgaggctaccaagaaagaaattttccagcgctttaccagaaattgctccaaggacatctcaagtcgatgaagaaagatcatcacatatgatgaaaatcaaagaaaagctatttggttcaacatttccaacactgcatcagaaatatggtgtaaccaaagaaaaagagagaaagatcaacagtgaacatgggtttaaagaattacaacataatttgtgcttcaaagccacgctgtaggcaaatggctatgtaagcaatgtacaaccgaaggatgcaagttatggtgtctctcaagaaattcta

SEQ ID NO: 13399 - DNA, 606 bp, Zea mays
  unsure (1)..(606): unsure at all n locations; Clone ID: LIB3279-213-Q6-K6-F10
ctctcccctctctcccccaaggccccaacccacttgagcgagccctagagaaggcaaaagccatggcgtccttggttgttcgtgccgccggcgccgccgccgccgccgcccgtcttccctccctccgtcctcgccgcaacggcagcggggtgctctccggcttgagggtcggaacagggcactacggcgcgcggctcgcgcttgcttcgtccacagcttctcacaaagagttcaagatcgcctgccttactgtcgatgacagcagtttgggcccgggggatgaatatgagtctgacccccgcatgccaggcgaggatgagttcgaccatttctaccgtgttctcgccaagaagactgacaacctgctcagctgctacattccaatgccgcttgcactttctgaagaggagaaggccgtgcagaaggagttcaagctgatcgcgagcggatgcatcgacctcctggttggtgcgatgcgccgcacccccgcagagaaaaggcgcccactgttcttggtgtttggtgagctgtacccggtatttgagtttgtgaggtggactgccgaggcggngtgtgccaagtggtggatggcgctgcagatcatcg

SEQ ID NO: 13400 - DNA, 404 bp, Zea mays
  Clone ID: LIB3279-213-Q6-K6-F11
cgtgaatcgtgtcccttcccttggctgcaggacccaagcaacacggaaggagggaggtgagcaccatgtcggcgctgttcaacttcaactccttcctgaccgtggtgttgctggtgatctgcacctgcagcctacatcaagatgcagttcccggcaatcctcaacgaccgcaccggattccgtggtttcttttggaaagctgccaggataggtgagcgattgagcccttgggtatcagtcgggtgcttggctatgggaatatccactattttcttctaaggccgaagtgttaatctccacaaatttagtctaggacgcagcaccttgtttcacttgtagagaaaaaaaaactattgtaagcattttgcttcagtttttaatggaatgggcactgtaagatctgt

SEQ ID NO: 13401 - DNA, 395 bp, Zea mays
  Clone ID: LIB3279-213-Q6-K6-F2
tgctcattgtcgttgatactgaaacaaagctgaatgcttcaatctagcttgcatgattgcattatatataagcaataagtgttgtgattcttcggttgttccatgatttgttggtagagttcaagaagacatgtttctgcttcgtatttagtttcttgaggaaaaggcagctcggatcaaattatcggatttgaaaagtaaatttgtagtcaaatcaccatgtagctagtatataatgcaaagtataaattaattaataaaaatactttgcattcaaaaaaaataaaaaaataaaaaaaaaaaaaaaaagaaaaaaaaaaaaaaaacaaaaaaaaaaaaaaaaaagaaaaataaaaaaaaaagaaaaaaaaaaaaaaaaaaaggggggcccgttt

SEQ ID NO: 13402 - DNA, 571 bp, Zea mays
  Clone ID: LIB3279-213-Q6-K6-F3
ctagttctagatcgcgagcggccgcccgcgatctagactcgtccctctcccctctctcccccaaggccccaacccacttgagcgagccctagagaaggcaaaagccatggcgtccttggttgttcgtgccgccggcgccgccgccgccgccgcccgtcttccctccctccgtcctcgccgcaacggcagcggggtgctctccggcttgagggtcggaacagggcactacggcgcgcggctcgcgcttgcttcgtccacagcttctcacaaagagttcaagatcgcctgccttactgtcgatgacagcagtttgggcccgggggatgaatattttggcctctatactcctaagctgcttgcagatactgaagatgattatgagtctgacccccgcatgccaggcgaggatgagttcgaccatttctaccgtgttctcgccaagaagactgacaacctgctcagctgctacattccaatgccgcttgcactttctgaaaaagaggaagccgttcagtaagaattcaagctgatcgcgagcggatgcatcgacctcctggatggtgcgatgcgc

SEQ ID NO: 13403 - DNA, 538 bp, Zea mays
  Clone ID: LIB3279-213-Q6-K6-F4
cccacgcgtccgcccagcgtccgcggacgcgtgggttagcatcggtccccaatggcgtcctcagccgccgccgccgccgccaccgtcatgctcggcggcaagggctccgccctgtccccggccgccgtttacgcgttctccctcggcctcgccgccccgggcatcgacccttccgcgcacaagtcgctctctacccgcgcgccctcgccgcaggagacccccgcgcggctcgccgccgccctcgcggcgctggcgccggccgagtcccgcgccgccgcggcggtgctgcttaacaagctggtcctcacgtcgtccgactccgcctccgcgctcgtcaccgccgccacggtcgcccgcctcgcggactcgctcgacctcgccgccgcgctgccgctggcctcccgcgacgaggccgcggtggccgcggcgaccgcgcccgtcgccgtcgcgctagcggcgctgatcgattgctgcgccgagccgctggctcgcgtagccgacaccgtcgccgcgctgtcgtgcgaagcctcgcgcgggg

SEQ ID NO: 13404 - DNA, 522 bp, Zea mays
  Clone ID: LIB3279-213-Q6-K6-F6
taggaaatcaaattgtaccgtgaagcagctttcttgtgtttacacaaagtattcttcttcaaatctcatttactttcattttcactagcagatgctgtaatgttatgttttgttggccagcattttctttactggaccaaaattttccttaataaaacgaattgcaactgctgcagaaatgtaccttttagcatcatgctaaagatttattagttttttcttgagggtgatcaacttattttgccattatctgagtgcacaggtttgtaatgatatagccttttataaacgttacagaattttagaattggttccatttacctacggttttttttttcttcataacttttcaggtgattacggtattgagagatccaggatttctaatagctggtttccaatgctgctctaggtttctaaccaatctcccatctcgaacacaaagggctctgctgaactaaatgaaagtgaacgtgcttactgttgctctggataaagagctcaattgtgcaacatttatca

SEQ ID NO: 13405 - DNA, 566 bp, Zea mays
  Clone ID: LIB3279-213-Q6-K6-F7
gccgctccgctccgctccgctcgtgctctgctcctgctctctctctctctcggcgtcgattgggcgaccgccgccgcctcccccaggtcttcgctgggcccgtcgccggcgacgagcacccaccagggcaagttttacttgataatgtggacatcaagacgttgcaattaaagcgacttagagaccagatcggattggtgaatcaggaacctactctttttgcaactacaattcttgagaatattctttttggcaaacctgaggcgacaaaggcagaggttgggtctacgactacttccgcaggcgctgaaccgcgctggtggcaaggctggaaacaagggtgctgaagctgctcttacatcccacaactgtcacggcgtgtgctggggcagtggggctgtcgccaaggacatgcagcttgtgaagcagtgctggagccgtccccatcgccgagcagctcgtgagggtaattcaagcacgctaatgcagtctggtcctacaatagcgatccttgggcttcacctacatcttcacctaccgaacattagacctctccagctaccttg

SEQ ID NO: 13406 - DNA, 450 bp, Zea mays
  Clone ID: LIB3279-213-Q6-K6-G1
cgctggctggctccaagtactggactccctcctgagtcctcatctgaggatcgggaggaagcaatggcggctgagaggcagcggcagcagcagcagcacgagggcgcggtggcagcggcggagccgagcgtggcgcggcggctgtggcgcgtggtgcgcgccgtgctgtacatgctgcggcggggcctgccgtcgggccgcaagctcggcatggacctgcagctcctcctccaccgcggcaaggtcgcgggcggccggttcctcgcctcggcccagcacggacgacacgccgcgaccttatcgtaccacgctggcgccggcgccggcgcggggggttcgttctcgtgcggagcgctggacccgagcgtggcggtgcacgagcccttgtgcaggcggtgcgaggtttattttagatgaagtaacacgccagtaatacgtctttgggcgtgg

SEQ ID NO: 13407 - DNA, 583 bp, Zea mays
  Clone ID: LIB3279-213-Q6-K6-G10
ctgctaccgccgatgtgttccttccatccgggaagttatcgctaatggcattagcgtcaacgtcacgcttattttctctattgcgacatacgaggctgtgattgatgcttaccttgatgggctagaggcttcgggcttgagcgacttatctcgagttaccagtgtcgcatccttctttgtcagccgagtcgacacccttatcgacaaaatgcttgaaaagattggaacacctgaggcacttgccttgagagggaaggctgccgtcgcacaggccaaactagcaaatcggctctaccagaagaaattctctggcccgaggtgggaggcgttggccaagaaaggtgccaagaaacagaggttgttgtgggcatccaccggtgtcaagaacccagcttatcccgacactctttacatcgacagtctcattggacctgacacggtcaacacgatgcccgaccaagctttgcacgcattcatagaccacggcactgtctcgaggacagttgatgcgaatgtgtccgaggcggaaggtgtatacagcgccttggagaacttggcattgactggggcgaggtcggaaagc

SEQ ID NO: 13408 - DNA, 119 bp, Zea mays
  Clone ID: LIB3279-213-Q6-K6-G11
gtctcctcccggcctcccctcaagcccccgccgctgcccccacgccacccaccccaccccgcccccgcccctaccgcgcgagtgcccggggacccaggagccagacccctttcttcacc

SEQ ID NO: 13409 - DNA, 468 bp, Zea mays
  unsure (1)..(468): unsure at all n locations; Clone ID: LIB3279-213-Q6-K6-G12
ggggggggggngggggggggggggggggggggggggggggaggggggggaggggggngggggggggggggggggggggggggggggggggggggggggggggggggggggagggggggagggggggggggggggggagggggggggggggggggggggggggggggggggggggggggggngggggggggggggggggggggagaggggggggggggggggggggggagggggggggggggggggaggggggggggggggagggggggggagggagggggnnggggggngngggnagggaggggggagggagggggngaggagnnnggngggggggggaaggaggggggggggggggggggggggaggggaggggggggggnggnagaggaaggggggggggggagggggatggggggcggggggggggggggggggggggggggggggggggggggcgggggggggg

SEQ ID NO: 13410 - DNA, 660 bp, Zea mays
  unsure (1)..(660): unsure at all n locations; Clone ID: LIB3279-213-Q6-K6-G2
cggacgcgtgggcggacgcgtggggtgcagcagtgngaaaagagcagattttagcagagcagcgagggtcggagaagcctccccaagcttcgaatcgctatgcagcccgtcaaggtgtacgccgaccggcggtcgcaaccctcccgagctgtcatcatcttctgcagggtgaaccagatcgatttcgaggaggtcacggtggatctgttcaagtctcagcacctcacacccgaattcaaaaaaataaacccaatgggacaggtacctgcaattgttgatggaagattcaaactatttgaaagtcatgcgattttgaggtatcttgcatcggttttccctggagtagctgaccactggtatccttctgacttgttcaccagagccaaaattgagtcaatcttggattggcatcactcaaatttgcggcgtggtgcagcaacccttgtaatgcacactgcattggctcccttccttggtcttacgacaagtcatgaggctgtgaaacaagcagagaagcttgtgatgcagtcactgggggtgatcgaatccgtatggctgaaaggcgatgccaagttcttgctaggtagcccccagccatcgattgcagatctgagccttgtctgtgagataatgcagttgngagaccttggcgatgaggtc

SEQ ID NO: 13411 - DNA, 413 bp, Zea mays
  Clone ID: LIB3279-213-Q6-K6-G3
cccagcgtccgcccagcgtccgcggacgcgtgggtcacttgtctatgtttcaatcgttctgggatggtgaggtagtcgtatctatgttcacgtttatgggcaagccatgcatgtttatgcatgcatgtgtgtgtagtgcaaagataaataaggacgtcgagctaaatctatacaaccctcgacgtggtgtgattgtattttgtatttgaatcttgtgaagcatgtgtgtgtgtcatgtactcagaggtcttcgcgagtcacaagtggcggtctaatacaaggattgacgcggtttagtgtttgtaatcttttattacatatcatgttttaagttgaagtttgtttgatccacatagaagaaatatggaaggttatgaaataaaaaaagatattttgtttgaaattttaataat

SEQ ID NO: 13412 - DNA, 618 bp, Zea mays
  unsure (1)..(618): unsure at all n locations; Clone ID: LIB3279-213-Q6-K6-G4
cccggnaaacaatttccggccatggcgaccgcagctcaggttgccgccaccttcctctcgttcctttcctcctccactcaccaccccgccccttcctccatctccctcgggacaacctctgttctacccgtctcccttcgggccgctggcacaggtggcccacggctcgcctaccgcctccggggccgccgcgtcggtgccgccgtcgcccagctccccaccacgcatccagaggtagtttctggggagaagaagatcagatggtcatcaagggctgtgcggtcttttgcgatggcagagctggaggcccggaagatgaggtaccctacgacaggcactgaggggctcctcatgggcattcttgttgaaggaactagtggtgcagcaaaacttttgcgggctaatggaatcacacttctcaaagtgcgtgaggaggcagcgaatgtgcttgggaaatcagaaatgttttactttagtcccatgcatccaccattgacagaagctgcacagcgagcccttgattgggctgacaatgaaaaattgaaatcaggtgaggatggagaaattaatgccaatcaattgctactggggatatggtcaaatgacgagtcagctggt

SEQ ID NO: 13413 - DNA, 622 bp, Zea mays
  Clone ID: LIB3279-213-Q6-K6-G5
tcttcatgtctttgatgatataatgaggatgactgagaacttgagtgagaaatacatcattggatacggggcatcaagtacagtttataaatgtgttctaaagaattgcaaaccagtggcaataaaaaagctgtatgcccactaccctcagagccttaaggaatttgaaactgagctcgagactgttggtagcatcaaacaccggaatctagtcagccttcaagggtactcgttgtcacctgttgggaacctcctcttttatgattatatggagagtggcagcttatgggatgttttacatgaaggctcatccaagaagaacaaacttgactgggtgactcgcctacggatcgctcttggtgcagctcaaggcctcgcttaccttcaccatgactgcatcccacgaataattcaccgggacgtaaaatcaaagaatatactcctcgacaaagattatgaggcccatcttacagacttcggcatcgctaagagcttatgtgtctcgaagactcacacgtcaacctacgtcatgggcactattggttacattgatcccgagtacgcccgcacctcccgccttaacgaaaagtctgatgtctacagctacggcatcgtttctgct

SEQ ID NO: 13414 - DNA, 619 bp, Zea mays
  Clone ID: LIB3279-213-Q6-K6-G6
ccccgcgtccgcccacgcgtccgcccacgcgtccgcggacgcgtggggcggcagcttccctccctgcctccttccaggatttcttgggttcccagtcgttttcgtaaatttccacttgttcaaggccattgttcgcagtcctgcatcttccgttgtcttgggaatctgtggagggagccttccttagaccgctgccctataaggcattatttctggtctgggaattggccattgggagctgcatagctaaattgtggcccaagacttcctagtcatattgtggaatcttataggttctcgaagatggtttcctctgagataacctctgttacagcagcgcgtgcacagggccccaagctttttagagggaagatacttctgccagggggccccccagatgttgtgccttctgaaaatgttgagttcgacttttctgatgtttttgggcctagtgcagtccagactcacacagaagtgagtattctcactcctgacagtccagcacctgtggctgagtccaacgatgaggtttacaatgaccctgatgtcattgtcaaacgatctcattctcttgttggtccatcatctcttgttagccagtctttgccatttagcaagc

SEQ ID NO: 13415 - DNA, 600 bp, Zea mays
  Clone ID: LIB3279-213-Q6-K6-G7
cggacgcgtgggctccggcctccagcttttcctttgcgccccaggccggaagagcccacacaccaccaccaccactagatagccagcgacgatcgagccgcgcgccggtggacgcgcacatacacgcggtagcttccttctcaagcctagctagccccatcctgcgcgcaggcggcggcagcgagaattgacgtgcgacgacgagcttgtgcttgctagctagagagcgaggatgtcgagccggaggccgtcgtcgcgtggcaacatctccgaggacgagatcaacgagctcatctccaagctgcaggccctgctccccagctcccgccgccgcggctccggccaggcgtcgacgacgaagctgctcaaggagacctgcagctacatcaagagcctgcaccgggaggtggacgacctgagcgaccggctgtccgacctcatggccaccatggaccacaacagccccggcgcggagatcatccgcagcatcctccgctcctgatcgcccacgcgcctcctactgcggcggcgccggccggcgcgcgagagagcgaggtcggcgacgacctcgatcgccgacaacgacgaccgcgcgcgccc

SEQ ID NO: 13416 - DNA, 647 bp, Zea mays
  unsure (1)..(647): unsure at all n locations; Clone ID: LIB3279-213-Q6-K6-G8
cgtgaaccgcgtcgtggcctccatgttcaacaccgtcgccggcaagaagatcgccgtcctcggcttcgccttcaagaaagacaccggtgacaccagggagaccccggccattgacgtctgcaagggcctgctgggcgacaaggcccagatcagcatctacgaccctcaggtgacggaggaccagatccagcgggacctggccatgaacaagttcgactgggaccacccgatgcacctgcagccgacgagccccacggccattaagcaggtgagctgcgtgtgggacgcgtacgaggccaccaagggcgcccacggggtgtgcatcctgaccgaatgggacgagttcaagaccctggactaccagaagatcttcgacaacatgcagaagcccgccttcgtcttcgacggccgcaacatcgtcgacccggagaagctgagggagatcggcttcatcgtctactccatcggcaagccgctcgacgcctggcttaaggacatgcccgcggtcgcttaattcgtctgaggtgctccattggattggatccggngaaggaagagaacttgttgaccgttcttcattacagtttgtttttttgcaggattcttaaaagttggacggcgctgctagtattcccatgtttctgttt

SEQ ID NO: 13417 - DNA, 575 bp, Zea mays
  unsure (1)..(575): unsure at all n locations; Clone ID: LIB3279-213-Q6-K6-G9
gccgccgtcatgtcngaacgaggtaggggaggttcggctgggaacaagttccgcatgtcactgggtctaccggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaagggaaagcccgacctcaggaagaaagtgatgcccgccgtcatcgtccgccagcgcaagccgtggcgtcgcaaggacggtgtctacatgtacttcgaagataatgctggagtgattgtgaatcccaagggtgagatgaaaggttctgcaatcactggacctatcggcaaggagtgtgctgacctttggcctaggatcgccagtgcagcaaatgccatcgtttgagagcttgttggaatgtgtttagacttgagtatgatcatctcaattgtgtgttgcaggtgttgtaagggtgctattggacttgatggctccttttatgtttggtcactcaattctgtagtgaacagaaatttctggttgcctca

SEQ ID NO: 13418 - DNA, 499 bp, Zea mays
  Clone ID: LIB3279-213-Q6-K6-H1
gttccccccttcccttccctcctctcgcgcgccggctccacgcagatccaggagatatgcctcgctatgatgaccgctatggaggcacgcgcttgtatgttggcagattggccactcgtactcgttcccgcgatttagaacatctgtttggcagatatggaagaatacgagaagtggagttgaagcgtgactatgcatttattgagttcagtgattatcgcgatgctgatgaggctcgataccagctagatggcagggatgttgatgggagtcgtattgttgttgagtttgctaaaggggtcccacgtggttcaggtggctcacgtgaatatatggggagaggccctccaccaggtacaggtcgttgtttcaactgtggagttgatggtcactgggcaagagactgtaaagctggtgactggaaaaacaaatgctaccgttgtggagaaaggggccatatagaaagaaattgccagaacagtcctaggagtctcaggcg

SEQ ID NO: 13419 - DNA, 602 bp, Zea mays
  Clone ID: LIB3279-213-Q6-K6-H10
caggcttctccaggatcagttcgagattatgaataaagagttttcttcagggatcccttctatgtctcttcctaatggctctaattccaacctgttgaagcaagattcatgctttttgccagagactgctcctggaaatgcaatgccagatggtataatgcacaatggaagttcaagtggtataataaacgacacaccatctggcgatcagttacttaatgctagtaaagacctgcatggccttcataatcaaatagatgcttcaactagtctacaatcagaccagaatgcaactgctgtgctgtatggtgtagacaacgagacaagcgcaacaataaagaccgagtcttgctactcgagtaatgctgattttgccttctgtgggaacactttcctggaatcatgtcagtcgataggtgatgcatctggtggtggatccttcagcagctcagagttgaatgggcaaccactaaacgattcaattttggatatggagtcatcatcaattagcttcttgaaccaaatgccccaaagcttcatgttttcagacctggcagatgatttcaaccaaaatgcagaaataacaccatttctcactcctg

SEQ ID NO: 13420 - DNA, 632 bp, Zea mays
  Clone ID: LIB3279-213-Q6-K6-H11
cggacgcgtgggagggggagccaagggaagctctcttctttcttcctcctcctcgtcctctcgaattccgtctcttgtctctgtcctcctcgctcggcttccccggttcttgagaggggaaagaggaggcggaggagagggatggggagggacgagaggttcccagtgtgggaggccgcgctcggcgctggggtcgccgccgccttcgccgctgggctcgtcggggtttacctttccatgccggactccgactacagcttcctcaagctgccactggccatcttgagaactatactagcgactacaccctacaggtgttggtaggctactgcgccgtgtacatcttcatgcagaccttcatgatcccagggacaatattcatgtcactgcttgctggtgctctgtttgggcagctccggggcgttgccctggtagtcttcgccgccactgctggcgcttcttcgtgctatttcctgtcgaagatgattgggaagccactggtgttcacgctgtggccagataaactcagcttcttccagagacaggttgctaaaagaagagagaagctcttgaattacatgcttttcctcagggtgaccccaacattgccaaataccttcatcaacttggct

SEQ ID NO: 13421 - DNA, 615 bp, Zea mays
  Clone ID: LIB3279-213-Q6-K6-H2
cgggcccgtaccgcgccaacttcctgctcgattcggtcgccgacctgcgccggagcctccgcgcccgcggtggggacctggtggtgcgcgtgggtaggcccgaagtggtcattcccgagctcgcgcgggcggcgggcgcggaggccgtgtacgctcacggggaggtatcgcgggacgaggtccgcgccgaggagagggtgcaaaaggctgtggagaaggagggtatcaacgtgaagtacttctggggtagcacgctataccacgtggaagaccttcccttccgcctcgaggacatgccgtccaactatggcggcttcagggaggccgtgaaggggttggaggtcagaaaggtgctggaggctcccgaggaggtcaagtgcgtgcccatgaagaatgtgctcgagcccggtgacatccccacgcttgctgagctcgggctcactgcgccaccagccatgtcacaggactcaaaacctgctgttggctctactctcattggtggggagacagaagctctggagaggttgaaaaattttgctgtagaatgctctatgcagccaacaaagtggacaaaacatacccaagaagcatatatggtgctaattgcttttgcaa

SEQ ID NO: 13422 - DNA, 556 bp, Zea mays
  Clone ID: LIB3279-213-Q6-K6-H3
tggtcctcccgtcgtcgtcgactcgtcgtcgtcggtgttgctccgatgggcaaggactcgaagccgaaggacgccaaggggaagggcaagcaggcggccggctcctctggcggcgacgacggcggcggcaagggaggcaagggcaagggcaagggcaagggcggcaagtccgctgacggactcggcacttgcacctacgtcaaagctaggcacgtattgtgtgagaagcaggggaagatcaatgaagcttataagaagttgcaggatggatggctgaataatggggacaaagttcctcctgctgagtttgctaaggtagcacaagagtattctgaatgcccatcagggaagaaaggtggagatcttggttggttcccgcgtggcaagatggctggtcctttccaggaggttgctttcaacacacctgagggaactgttagcgcaccattcaagtccacgcacgggtataactttatcctctgcgaaggaaggaagaactgatctggaaatgtcggttggggagactgcatcatcaggttgtatgagacgcaatgca

SEQ ID NO: 13423 - DNA, 153 bp, Zea mays
  Clone ID: LIB3279-213-Q6-K6-H4
gtgtccgttttctcctgtattttttctctctcagttcgctcagccattagctatacaaaaaaaatccagttgaaccgttggggataaacctggatgatctaattctttgttgagagcatagcatcatatatatggtatagctcactttttttt

SEQ ID NO: 13424 - DNA, 500 bp, Zea mays
  Clone ID: LIB3279-213-Q6-K6-H5
cccacgcgtccgcggtcgcgtgggtccggctacaactttcgcgacgtctgcgacatcagaaaactgagctcgccccctcttgccttccctcctccgccggaccgctgctgtccgcctccaaccctccagttcgacgcaggcggcgacggcggcgcgccgagatgaaggtctccgtgaagacgctcaagggatctagcttccagatcgaagtggagcccaccgacaaggtactcatcggttgcgctcccgatctgtcgctatgtttctagttgctgatgtattggcggggctgcttcgctagatttggctgctttttaggtttgtttggggtctaggatttggttggttccgctgtggaggagatgagagtattgaaagccgcgggcgaagctgccgtgaatccaatctgaaggttgctgatttggttccggtggtgcgtgtggaacacgcggaacggagagctgttgcaaacttcgactgtggattttctgggttcaatt

SEQ ID NO: 13425 - DNA, 569 bp, Zea mays
  unsure (1)..(569): unsure at all n locations; Clone ID: LIB3279-213-Q6-K6-H6
cggacgcgtgggcggacgcgtggggtgcagcagtgngaaaagagcagattttagcagagcagcgagggtcggagaagcctccccaagcttcgaatcgctatgcagcccgtcaaggtgtacgccgaccggcggtcgcaaccctcccgagctgtcatcatcttctgcagggtgaaccagatcgatttcgaggaggtcacggtggatctgttcaagtctcagcacctcacacccgaattcaaaaaaataaacccaatgggacaggtacctgcaattgttgatggaagattcaaactatttgaaagtcatgcgattttgaggtatcttgcatcggttttccctggagtagctgaatcactggtatccttctgacttgttcaccagagccaaaattgagtcaatcttggattggcatcactcaaatttgcggcgtggtgcagcatcccttgtaatgcacactgcattggctcccttccttggtcttacgacaagtcatgaggctgtgaaacaagcagagaagcttgtgatgcagtcactgggggtgatcgaatccgtatggctgaaaggcgatg

SEQ ID NO: 13426 - DNA, 492 bp, Zea mays
  Clone ID: LIB3279-213-Q6-K6-H7
tccagtccttcgaaaaccctgaaccttggtgaagccgagacgagcaatcatccaagcagctagtgcttagcatctatggcgacctccgttcgtggtttcagtagcgccctcagggatgtgccgggcagctacggccttccgctggtgggcgccgtccgcgaccgcctcgacttgtactacttccagggccaggacaagtacttcgagtcccgcgtcgagcgctacggctccaccgtggtgcgcatgaacgtcccgccgggccccttcatggcgcgcgacccgcgggtgagggcggtcctggacgccaagagcttccccgtcctcttcgacatggacaaggtggagaagagggacctgttcacgggcacctacatgccctccacctccctcaccggcggtcaccgcgtttgcgcctacctcgacccctgcgagcccacccacgccaaagtgaagcagatgctcttctccctcctgctctcccgcaagtacgac

SEQ ID NO: 13427 - DNA, 638 bp, Zea mays
  Clone ID: LIB3279-213-Q6-K6-H8
tgaacctgaaaggaacagctgcggtatgttggtaggctctttgtaaaggcttcaggaagaccacaggacattctgctgaagttaaggatgttggcaggtttttcacaggatgatgatattgaactttatgaggaaattaagttcgagcccaatgtgatgtgtgaatacattgacaacaggcttctgtttcgatcttgccagcttgaagacggggatataatttgttttcaaaagccttcaaaaccagatagtgcagaccgatatcgatttcctgacgtcccatcctttttgacgtatatacgtaaccggcaggtggtgcacttccgttcattggagaagcccaaagacgacaaattttgccttgagatgtcaaagattttcacatatgatcaagtcgtggagaaagtagctgaaaaacttggcgtggatgacccatcgaaaattcgtcttacatcacataattgttattcgcagcagcctaagcctcaaccaataaagtacagaggcgttgaacgtctactggatatgctgattcattataaccagacttctgatattctgtactatgaagtattggacataccacttccagaattacaagcgctgaagacattaaaagttacctaccatcatgccac

SEQ ID NO: 13428 - DNA, 598 bp, Zea mays
  unsure (1)..(598): unsure at all n locations; Clone ID: LIB3279-213-Q6-K6-H9
gtggatgttaacgagttccagaccaacctggtaccctacccgaggatccacttcatgctttcttcgtacgctccagtcatctctgctgagaaggcctaccacgagcagctctctgtggctgagatcaccaacagtgccttcgagccatcttccatgatggccaagtgcgacccacgccatggcaagtacatggcctgctgcctcatgtaccgtggtgatgtggtccccaaggatgtgaatgctgctgtggccaccatcaagaccaaacgcaccatccagttcgtggattggtgcccgactggcttcaagtgcggcatcaactaccagcctcctagcgttgtgcctggtggcgacctggccaaggtgcagcgtgccgtgtgcatgatctccaactccaccagtgttgtggaggtgttctcccgcatataccacaagttcgacctcatgtacgccaagcgtgccttcgtgcactggtacgtcggtgagggtatggaggaaggtgagagctctgaggcccgtgaggacctggcggcgctcngaaaagactacgaggaggtcggtgctgagttcgatgagggcgatgatggcgacaagggtg

SEQ ID NO: 13429 - DNA, 578 bp, Zea mays
  Clone ID: LIB3279-213-Q6-N6-A1
caaagataaagttttcagattcacggtaatggatcaaagataaccgaacaaaggccggagcaacccaaagcaaaagattcacaaaccatggatgcattggaataggagcaagatcccataaactggttcgatacataaaccctggatgcattggaaggagcaaaatcccatgagctggttcgatacataatactttgacatgtctattaggttctacatgtatggaaaatcagacactggaacataatctctggcaggctccatgaacttgaaatgctctctatttcttcttgtcagtgtgcgtaccagccgacctcatcttcctgaggacgcccgccatctcctctctcttcttctttgccctcttgtgagttccaagctttctcttagcaagcttcagggcacgcttgtccttgccaaccttcagaagctcagtgatacgcttctcataaggagcaaacccagcaacctctctgatcaggcccctgaccatagacaccctcttcgttgatttccccttgcggtggcacgggcggggaggcagctcgcgcttggtgacgacatgacccttgttgatg

SEQ ID NO: 13430 - DNA, 596 bp, Zea mays
  Clone ID: LIB3279-213-Q6-N6-A11
gggcaagaaaacttttcgcgttgtggattacaagctagtacattgtgctcatggtagtgtactacaacatctcacgatagccgagccttacatagaggaacacctagatgagcttcgtaaagaaaatcagaaccgcacagaggactggatcatgagggagcacaaacatcgtttcagcgaatggttaatggacaaaaacatcccattcggagactctttggaagagaaaacaatgaagaatttggcttctgggccatcgtgttttgtgacatcatggcaagcatatgacatcaatgggtacacattctatactaaatcaaaagacatgaaaagtgttgcacaaaatagcggtgttcgtatcgatgcttttgacctacatggacagaagaccacatattttggattcatagaggaaatatgggaacttgattatggcccaagcatgaaaatacccttatttaagtgccaatgggtacaacatcccgtgggggtgatagtggataactacggactcgcactggtagacttaaagaaagtaggatataaagatgacccgtgggttctcgccgaatgtttgcacaagtgttatatgtact

SEQ ID NO: 13431 - DNA, 500 bp, Zea mays
  unsure (1)..(500): unsure at all n locations; Clone ID: LIB3279-213-Q6-N6-A12
taagctggtccctanacggccgcccccctcccnnctcccccccgncccccccccgggccccacaccccccccccccgcgccccccgcccccccccccccccggccccgccccccaccccccccccccccccccccccccccgccccccccncccccccccccgccgcctccccccccccncacccccccacccggctcccncccncccnccccccccgcgccggcccccccctcccccccccncccccgcccgccccccacccaccaccccccccccccccccccncnccccccccccccggccccgacccccggcccccccccccccccccccccccccaaccccccccccctccccctccccccccccctcaccccacgccccctaccccaccccccccccctaccacccccgcccgccgcccccccccttaaaaccccccncaaccccctccccccaccccgccgccccccccncttcccccccttctttccccccc

SEQ ID NO: 13432 - DNA, 609 bp, Zea mays
  Clone ID: LIB3279-213-Q6-N6-A2
ccgacataacatattcatataaccaaaataaccaattcaaggcaattaaatccaccccctagttcagctaattatagagcagcacctaaaattccaataaagtaaacaaagtaattgcattctagagataggtatcaagcaaaaattgccagcaatttctgaatcatcagaaacattcagctggagaggacgccatcattcagtgatagattagccagctgctgctcggtggaggcattgctctgctggagatgctgggctgagcggagaacctccatggcttcagcaaccttagccttgagagcatctggcgactccagcaggtgaagaacctccgtctggtccatctccaaaagcatgccagtgaccttggcagcctgctcacgctccagctgttcaacaagaggatacaggttctcaccaagcatcagtctttgctgatctggtgaggcgttagcaagcgcagtggctagtgccccaattggaacaggttgtgagacaccagcatctctcattgccatccctcccatctcatatggagatggcatcacagcaccaacattatgcatgccaggatcaggcattccacgtccagtagcatagcggtag

SEQ ID NO: 13433 - DNA, 629 bp, Zea mays
  Clone ID: LIB3279-213-Q6-N6-A3
atcacaaggaaattgctcactccatactttacaaatctatatggtatcatatatatgttccttgtaagtgaagagcttaaatggaacaatccaattacagatacataatcacaccatacatgacaactagccaagaagagttacacgatagggtgctcattacagaagcacaataggatgctgtccaaactctttgagatcatgtcctcattttctcaaagtatgcagcaagaacatttctgttgcaccttattctcctccctacgggcggtagatggttgcctagcagaagaggtaggtgacaacctatcgtcccttaccctgttgaagataccagtgtacttttcacctgatgctgcatttgcatcatcccattcaccaaagggtggtacagccacttcttcaggctcataactaccgggcttcatcctactccttccaggtgtatgctggctatgcccctctgaagaatgccttctctctggagcctgcatcgcagtcgatctatgattcggctttgattggttgtttgactgcattggcgaagcagacccagcagctgtccctgtagggcttcttggtgccacagcattactcccttgttctctctgaggatttgcatgtcttcg

SEQ ID NO: 13434 - DNA, 616 bp, Zea mays
  Clone ID: LIB3279-213-Q6-N6-A4
agagctcaatcgcttttagaaaagagtgtactaatcaggtctgaaaacatggcataacgctctgaacttgagacgactaaccaaaaaagtgtactcatcaggacacacatttcggtgcaagacaatccatgagaatgctctaagctacagcgctcttgcccttcttcctctgtagcttcttcatgtagaactcaagctctttaccctcaaggatgtacccatcagctcggccacactgtccagggcgggaagaaatgcatgccagcaaccgtccactgccaaattgctcctcaatgtgtgggtcaagggtacgtccctccttgcgcttctcaagcttcctcgtgacatggttgctctttttcgtttcctcagctgctgcctcaacctcttgtccctcagcattatccttctttgcagcaggggttttcttcttcctaccaatgtcaactccatagtgagtgaggtaccactgcttgaatggggcagcatcaacttgcacaatggcactcttcacaagggtttgtgtcctcacaagctcattgtttgatgcattgtagaccacgtcgaggatacgggtcttgcgggtaacagcttcacttccccatgagtagttacc

SEQ ID NO: 13435 - DNA, 627 bp, Zea mays
  Clone ID: LIB3279-213-Q6-N6-A5
gagacgacgaatttttaaaatttccactgaccatcgttcagcccccaaacggagcccaaaaaattccaaacatggtgggtgtccaagcaaaagtaacaaacaaacgaacaaccgtatccgaatatccgatgaaccaaagacagccgtgattttgtacagagtggcaccgccgagcagagagtcgcaagacccacgccatggacacaaagatcaatcttgtcgcggaccggtttatattggtgcctgaaccatccttcagctgcttcacaccttcagcgccagcttcttggcggcaagagcctccgcctcgagggatggctgccagaggatcgtggtctcggccagtagccccgtcacaatgtacgggtccatgtttgatgccggccgacggtcttccaggtaacctttcccttttgcctcggtatctcgccccacacggatagagcagccgcggtttgccacaccccatgagaacgttccgatgctcgcagtctcatgtttcccagtcagtcttctttcatttccttctccgtatgcactaatatgcagatcatggcgcagagaaagttcaggattgctctcttgatctcttcaaacccgccgtcttcgcgcatagtctttgtgctg

SEQ ID NO: 13436 - DNA, 581 bp, Zea mays
  unsure (1)..(581): unsure at all n locations; Clone ID: LIB3279-213-Q6-N6-A6
ctgtccacaacatagctttttgcagagattcagtacataaggattcttcaaattaaccataccacaccataacatgggacatttgcgaaactacgggtacaggtatcaaaatgcaacgagttcaatactaaaatataagcgtagtgcaatctaatcttcttcctcgccctcgttctcagcaatgttgaagtagcggagctcatagacgtttcggtccttgttggcagcaaccacgcgtagccaatcccgcacgttgtgcttcttcaagtacttcttggtcaagtacttcaggtacctcttggagaagggtccgtcagaggtgacggtgaccttggtcttctcgcgagagatggtgacggagtcgccgaggttgccagccttgccgccggcgaccttgatgcgctcctgcaggaacttctcgagcgaggcgacctccatgatcttgtcctccactggcttggtgcagtcgatcgtgaaggaaaccgaccccttcttcttgcccgtgaccgcgccgcccttcgccgacaccacgccgngcgccatcgntcctcaccttccctcggcttggtgctcgagtggat

SEQ ID NO: 13437 - DNA, 577 bp, Zea mays
  unsure (1)..(577): unsure at all n locations; Clone ID: LIB3279-213-Q6-N6-A7
gccaatgagggatatcctgatattgataaatccacatacagattcgctcatccattagcattcagagcaatgtactggtacacatcacatatgcatccagctaaatgacacaaagcctgaaaccaatactatagcatctagacaccaacgtagcactgatccaattgaactcaataccaagatctgaaccacaggaagactacctattgcttgaaggtgtagggctggggcagcgacatggggccccggcggtccccatcgccgtcgagcaacctctgcacccgcttcttggcggagtactgccggtcgaagtgcttgacccaggtggggcggcagttgctgacgaagtcggcgcgggactttttgcagtcggcggggtagaggaggcccatggtggcgatctcggtgggctttttgtccgcgtgcttctcgatgcacgcgtagaaggcatcccgtgccttgtagcaggcctcccggcccttggcgaggacgtcgggcatgacgaatccgtcggagtggtggtagtcgtccgcggcggtggtcatcgtcggctgcggaggcgtgcggngggatttgt

SEQ ID NO: 13438 - DNA, 584 bp, Zea mays
  Clone ID: LIB3279-213-Q6-N6-A8
gcgatctagaactagggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacagcggtggcaaccgtggcggcggctacggcaactccgacgggaactggatgaactgagcggtgggtgcccgcgc

SEQ ID NO: 13439 - DNA, 595 bp, Zea mays
  Clone ID: LIB3279-213-Q6-N6-A9
acatggcagattcttgacttcaaaagggcatcattatgtatgtgtcaaaaaatcacaaccatggcaacaggtctgaagacacgcattacgcataaatgtattctggagcaaagtaatctcccgaattgctattgatttctgtcactccaacaatggcagtgtctgtcagaaaaaagaatggtaaagggtggggcatctacaaatggcacgcggaacaggatacaatctgcagagggcttttcgtcagaactcatgattctagtgtagtggccttgcaaagaaaatatgcaagacctttcctttggaaaagaaaaacaagatatccgattcagtaatcagtatgaactggctcgtacaagcctcctccaaaggactacacaagatggcagaagaaaacaaaactttcccaataccgattcgatccaacaggcacggggtttgcaaaactcttcctcattaagcattgttgctcgttatagcgctgaacataacgcacctgagggccacgatgaacagcacagttttgcttcatttacatgattcacggcaaggccaatcatccacgatccaacactaacatcatcatgggcatatg

SEQ ID NO: 13440 - DNA, 536 bp, Zea mays
  Clone ID: LIB3279-213-Q6-N6-B1
ggacacaaatatgcttactacacactcgaaacacatactagttggtacagtacagagtacacatatatttaaacgacacaggagctctacggcccagccccaccgatgtgctgtaaaggcaggccacatcagcaccgacagtgggcccactaacccgacacgggatcggcacacagacacattatttattcgaccacaacacaaaacgacgctcctacgctcctttactaggcggggcccgccgcgccacgtaggacacgacgtgaacccgaacacaaaagcaggtttttcctagcgacctatgccggcgccatgccgtgctgttgccgtggcagtggcaccagagcggcgcacgccaggtgacaggctgacgcagcgagctagatcggccgccgtccggcgctggactcactcgacggacttctcgacggcagcgacggcggcctcgggagcagggaccgccgcttcctcctcggtcgctgcgacctcaggagtggcagcaaccgcaggcgatgcctccccctcctcctcgttag

SEQ ID NO: 13441 - DNA, 397 bp, Zea mays
  unsure (1)..(397): unsure at all n locations; Clone ID: LIB3279-213-Q6-N6-B10
aaaaaaaaaggggtttttttttccccccccccgtttttaaaggcgggttgaatccacgggggggggaaaaaattatgggtggggcgggccaaatgataaaaaacgccccccaagaaaaggggggagccccggttaaacgggggggggggtaattggggaaaaaaaaggaaggggctttttaaaaaaaaaaaaaaaaaaaaaaaaagggttttgggggggggaaaacaataaacccaaaaatttttttggggggggaagatgccccaacgggtcccccaaagggtccgccaannnntnnggggacccggggggggccccggggggccccccggggatcccggcccgggcccgggggggggcccagcttcccctttnnggggggcccttaagcccgggg

SEQ ID NO: 13442 - DNA, 616 bp, Zea mays
  Clone ID: LIB3279-213-Q6-N6-B11
gaaattaacaacagagactagtagttaatatacgaatataaagataaccatcatccacataggaagcatgtttttttcatgtccgaatataaaagctctaacaagcaaacaacactcagcaacctactcgcaggcaggagttccaaaacaacgggatcgcaaagagaagcaactcagtacttgtagtccttgacgtgaaggctctcggtgtcggcggcagcatcacccttgtaggtgccgagggtagcctcggagttggccttgcacctggcgaggaaggccgctctagccttctccacgttctccaccttgccagcccaggccttgagggtgctcgcctggagggcacggccgaaggagaaggacagggcccatggcttcttggtgctgagcttgttcatggcattgagattcagggtggcctcctcctcgctctgtccaccggagaggaagacaacagcaggcacagcagcagggacggtcctctggagggtacggacggtgtactgggcgatcacctcaggtgtcaccttcttagagtcggagccaggagtcaccatgttgggcttcaggagggtaccctccagaaggacatggtgctcgttgagagccttgt

SEQ ID NO: 13443 - DNA, 617 bp, Zea mays
  unsure (1)..(617): unsure at all n locations; Clone ID: LIB3279-213-Q6-N6-B12
ccccccccccccccccccccccccccccccccccccnccccccnccccnccccnncccccnccccccccccccccnnnnccccnnnncnnnnccccccccccccccccccccccccccccccccccccccccccccccccccccccgggggggccccccccccccccccccccccccccccccccccccccccccccncccccccccccccccccccccccccccccccccccccccccccccccccccccccccccccccccccccccccccccccccccccccccccccccccccccccccccccccccccccccccccccccccccccccccccccccccccaccccccccccccccccccccccccccccccccccccccccccccccccccccnncccccccccccccccccccccccccccccccncnccaccccccccnccccccccccccccnnncccccccccccccccccccnccccccccccccccccccccccccccccccccccccccccccacnccccccccccccccccccccccccncacccccaaaaccnnnccgcccnccccccccccccccccccccccacccccccccaaccaaaaa

SEQ ID NO: 13444 - DNA, 457 bp, Zea mays
  Clone ID: LIB3279-213-Q6-N6-B2
agtactagatagacaaagttccatacataagctgcaaccgatgatcataacaccacgagattacactactgactcttctcgactggccgtgccgtgagaaaaaaaaacaaccggcagctcaaccaggagagactagcacgcatgtacttgacgctgcttcacaacactggacgacgacgagtcgacgacgatgtactagctagctagttactcattgctacttgcagccgccatggccgacgtctaaaatgccatcgggccaccgcagccgcaaaacccagacagtagaaaattaaattacacggagctattattgctcatgacaggatggaatcccagtcgatctcccaggacgggtacttgcgcaggtggaaggcctccgtctcgtcccacggcgcctccgtgaagtccagcttcgccatctccggcaccggcacgggcggcgccagcgtcgggg

SEQ ID NO: 13445 - DNA, 558 bp, Zea mays
  Clone ID: LIB3279-213-Q6-N6-B3
cacaaaaggatgggtttaaaagctgcaaatccatgactggcaacacagaattcaaatcaattgcatgtagaccttcactcagtcgctagttgagcataacaaaactttggtggccaagttatagacaagaaacaaaacgcttataacttaagtatcaccaaaagcaccagtgcaaagacgataaaaaagggcattctgcactttccgcgccagcgattcgaacacatcaatcgtaactggcattcagaaacttcaacagttcgttccgcttgctctctgctgccttgtcttcctttgtcttctcaagcttcatcattatctttttaccagagattgcactccgttgagtaccttcttccttttctttgtcccgtccaagaaacttggaaagctggacagggccatcagcatgctcactctctttcttctgtataaagctcccccatttataatagaacacaaccaacccaccaacagaacaagcagcaggccaatccaccatgttgtcacccgttcaccaatcccagctccaatgtcaaagagccaacccagaaacag

SEQ ID NO: 13446 - DNA, 494 bp, Zea mays
  Clone ID: LIB3279-213-Q6-N6-B4
gctccaacacatgtgtacatatatattatactatatccaaggaacaggcgtacaaatctacgttgtttgacaacgtcgcaccatgccatgaatcaccaaattattcatgaatcatgggttaatgaaccaggcagagcattaacaggtaacaacccatgcaaaatttcatgtacacaaacatcagccagggattagcatgtgtttaatcgtacccttttatttgctagcaaactgggcccaatgcaaaaacacaaaaaatgagggacactaatccaggacatgttctaagccaggaacgcacatgtgctttattaacacctttcatggaattcccgaggtgttaggctcgaatctaacaatacacacgtgcttttggcgggaatgactctacttgatcagccaatgtgttcatgtgcaccggcctgtatgccaatagaaccttctagtactcccagaattccagtgagcggtgcatccacttctagttatctttg

SEQ ID NO: 13447 - DNA, 587 bp, Zea mays
  Clone ID: LIB3279-213-Q6-N6-B5
aaagaagctcgaaaggcatttgctgtcctcttattagcagaaaattaaatatgcaaagcaaagcagaagcctagagagtagagatacatacagtccactgcccaaaccatcacgtcgcagtagcacatattttacacgtttgtactcactttctgtcttggcttggcactctgacacgggcgcaccacacgtcgactactcgactgagaccaactaatgagcatgtcctaggtaggaaaaactgtcgccggctgccggcgccggccacggtgggcatcacgccaagccgacgagcttctcgctgatctcccagagcttcttggccttgtcggcgtcgctggcctcctcagagagctggttctcgaaggacgcggagttcttgttccagctccagtacacgccggacttggtcaggctggggtcgctcaccacctgcgccagccgcttcccggcctcctcctcggagacgtaccccttggtgatgtacttctggaacggcgggaagagcaggcggaacagcgggatgtgctcgcggaacatgcccgtggtggcgatgcagcccgggtagagcgacgcgaagtcacgcc

SEQ ID NO: 13448 - DNA, 542 bp, Zea mays
  Clone ID: LIB3279-213-Q6-N6-B6
atcaaaatatctcggttaacgatctagacaacaaatgctggtgcaacagtttcttgctgccggacaatctcgtgtttcttacatgcacatgtatcagcaatatcacggctttaggataaggatctaggcagggaattagcaaaactaatggaagcatgcgcctatctcccctgccatatgacacaaaacggagggagaactatgccgtattctgtaccaaatgcatacatgcgaatgagtttcgaattaccaatagaactttactatgtattgcgaacgagtttacaatcaccaccagaactttgcgtgttcccttttctggttcataatccgtcatgggtactccatggagagctttaagaatggacaggcattccttcagaatcgcctttgcttgttcgcttttttcatactcgcagagctctgagagttcatcctcgaacttggcctctgttctgttctacagcgggaagtctctgtacaatttgctcaaatcaagaaggcactccgatgcaggaacgtggacctgagcaatctttact

SEQ ID NO: 13449 - DNA, 501 bp, Zea mays
  Clone ID: LIB3279-213-Q6-N6-B8
aagctggtgcagaacataaacttccaacccaaattttgtacatctgggagaattacatgatataacactctaaaacacttgctgcctaccaacgatagatgggcatttaccggggggaacataatccctcgggacataaaaagaaaaagttacactctttgctcccagtaaggaaacatcagtagctccaattacaacatgtttagcaaggtatgttaagctgtgaggggtggggaggattctaatgtcaattagtgtggaacactttaaaccatagaaagaaaccatgaatatcaatgacaccacggaaagaacgttcttgtcccagcttggaatcaaattcttaacatctaatcatttctctggagcaccaacataatctcataaccaacaggttaggaagcacaagagagtcctattttcagttaccaatcatatgatcggagagtatatggttccttttcatgggcataagtgatttaggatgaacagcaccctgac

SEQ ID NO: 13450 - DNA, 574 bp, Zea mays
  Clone ID: LIB3279-213-Q6-N6-B9
caaacatcaaacttcacaaggattcaagccatactgctgcaaaagagttttgggtccaacacagaggacacaacaggtccattaaaccaacgaagccacaaccacgattcatgacacacaaaccacagatgtttattagacgacgacgacgcatatacccaggtacagcagcagcttaaatgaaccatggcttactgaccaccacggaggcggagcaccaggtggagagtgctctccttctggatgttgtagtctgctagggtgcgaccatcctccagctgcttgccagcgaaaatcaaaccctgctggtctggggggatgccctctttgtcctggatctttgccttcacgttgtcgatggtgtcggagctctcaacctccagggttatggtcttgccagtcaaggtcttcacaaagatctgcataccacctcgcaagcggagcaccaggtggagggtgctctccttctggatgttgtagtcggcgagggtacggccatcctccagctgcttgccagcaaagatcaggcgctgctggtccggtggaatgccctccttgtcctggatcttggctt

SEQ ID NO: 13451 - DNA, 156 bp, Zea mays
  Clone ID: LIB3279-213-Q6-N6-C1
caagcaaaaaatgtactatgatcatagaatcccgaatggtctgattcttctactcgggtagagacaattcatacaacaatgcaccttaacagcaacagattactctgattacaccaccgtaatgttcaaccgcttaaaacatctcgtattattacg

SEQ ID NO: 13452 - DNA, 583 bp, Zea mays
  Clone ID: LIB3279-213-Q6-N6-C10
gcagcttaactaggtcagccatcatggtatcaagtttccctaatacgttcgtatacagcaaggcaaaaggacaagaaaccctgagacaaaatggtttctgtgccttttggccaatccaatcaatgactcaatgagaaatcaaattgccttcctctctctgggttctaatagaactacctgccacacaacacaggattcctctgtgacattctaccacgaagaataaccgaagcttcccctgctcatcaggcaccaccaaaactaacttctcaatctcctactttgtcgatttgacatcagtaagtgattctggctttgctccagggcttaattcatggctgaagcaacccttggtagtaccccctattcgaccaggatgccaataccgaaaaattgatctccccaatatgttttttgctggaagagggccccacacatgtgaatcgtagctgttgtttcggttatctcccatcacaaaaacagagctttctggtacttgctgcatcaagatggttaagaaaacaaagagcaaaacatgaaaattaacattctttttttacaaagatttgaaaaatacatttac

SEQ ID NO: 13453 - DNA, 568 bp, Zea mays
  Clone ID: LIB3279-213-Q6-N6-C11
gagaacgcactcctctgccacaacagtcaacatcaaatgagtgtccaggcacaggcgggggcagcttaccatagccagccgtggacgtcggtgtcctgccgcaggttgggctgtcgcgggtggagtctgtacctatgcatctgcggtgatagccccagcgccgtcatcgacgactccgcggcgtcccggccgtgcagcagctgctggctctggctgccactgccactggctcccacgtcccaccacaggaacggcctcgggttaattcccaccatctcgccagcctgctggtgttgcccgctagcagtagccgcagccaggttcatgaggcacaggtagccgccctgctctgctggcatgtgcatctccttcgaaagtttaggacgaaacagaactcttgtgtgtcacaacaactcgggccttttgaaagagagatgtgtacaggctaccaagcgacggatcggaggttggaatgttgtgtaccctttggcggatctcgagcagctgctggtcgagtagctcttacttcctgaggcaaactttgtacaacgagaactcgatctgctgc

SEQ ID NO: 13454 - DNA, 515 bp, Zea mays
  unsure (1)..(515): unsure at all n locations; Clone ID: LIB3279-213-Q6-N6-C12
cccccccccccnccccccccccccccccccccccccccccggggccccnccccccccccccccccccccccccccccccccccncccccccccccccccccccccccccccccccccnccnccccccccccccccccccccccccccccccccccccccccccccccccccccccccccncccccccccccccccccccccnnccccccncccncccccccccccccccccnccccccccncccnnccccccccccccccccnccccccccccccccccccccccccccccccccccccccccncncccccccccccccccccnccccccccccccgcccccccccccccccccccccccncccccccccccccccccccccccccccccccccccccccccccgcccccccccccnnccccccccccccccgcccnnccgcccccccgccccccnccccccccnccccccccccccccgcgggcccccccgcccccccccccccccgccgcccc

SEQ ID NO: 13455 - DNA, 619 bp, Zea mays
  Clone ID: LIB3279-213-Q6-N6-C2
tcgcgatctagagttctagatcgcgagcggcccccttttttttttttttttgacatgtaccaacaaaacagtgaacatccaggtaacttgaggtaacaaattcatagtgggatagaaaaactctggttcaccagtaaaccccaaccagcacagcaacctacgcctagaattaccacaggaaaagtctttcaagtactttccaacataaaacaaagttaaagtccaaacatgactaagatttttatcccctctgcttccgcgactcaaaaacaatattcttgactattgcacaagcttagtcgaagaggctgaagcccatgtcgtcatcactttcttccttctcctccaccttctcttctttcttcgcctcagctgcaggagcgccgccagcagcaggggcagctgccgcgacagccacaccgccaccgccacatgggactgaagcaaacttctccctgccggcggcaatgagctcggtaatgtccttaccgctcagttgggacagaaggagttccatcttttcattgtcaacttcacagccaactgactccagaatggctgtcaagtcctcggcagaggggctggagttcccagcgaggacagcaagcaggtaggcagc

SEQ ID NO: 13456 - DNA, 124 bp, Zea mays
  Clone ID: LIB3279-213-Q6-N6-C3
catcacatgaattttgatttgttattctatatatgcttgtagctagtaccatgcgtacatgcttgcagcatcctatacaaaaagacgttctttaaaataaaaataaaaaaaacccacgcgtccg

SEQ ID NO: 13457 - DNA, 608 bp, Zea mays
  Clone ID: LIB3279-213-Q6-N6-C4
agaaccaagagtgcttaaagcgacagacttcaattacaaatgcaaatactagagcagttcagcaagtgatgatggaaggaaacacccaaacattacccaggacacaaacaaaggtttttcaacaccacaacctggctcgacagccaaacagattcatgcaagcagatcagtattcctcctcctcgtcgccgtcatcactgccgccctctgcggcgacctcctcgtagtccttctccagggcggccaggtcctcgcgtgcctcggagaactccccctcctccatgccctcgccgacgtaccagtgcacgaacgcgcgcttggcgtacatgaggtcgaacttgctgttgatgcgggagaacacctcgacgacgctggtggagttggagatcatgcacacggcacgctgcaccttggcgaggtcggcacccggcaccactgttggcgcctggtagttgatgccgcacttgaaccccgtcgggcaccagtccacgaactggatggtgcgcttcgtcttgatggtggccaccgcggcgttcacgtccttgggcaccacgtcgccgcggtacatcaggcagcaagccatgtacttgccgtgccgtgggtcgcac

SEQ ID NO: 13458 - DNA, 582 bp, Zea mays
  Clone ID: LIB3279-213-Q6-N6-C5
ccaggtaagcaagttcaaataccaatggcgtaaaaatcttcctaaatccccagcaggggtgacaaatacaaaatcattttattgcccaattcgctccatacagcgatctggaaacaatgctaccagttccggcaaattttggtgggtgtagctttacatggcgtccttggaaagccagttgtgggtcgagattccccgagcattggtgagctcatcaacgccgtctccccgctcgaacacagcagcggcacccatcccagaacctatgcacatagaaatcactccgaaccggcaatccttgccgcggcgcttcatctcattgagaagagtactgacgcaccgtgcacctgtagcacccaaaggatgtccaagagccattgcaccgccattaacattgactttagcaggatcaagttccaacttcttgcagcagtagacatactgagatgcaaaagcctcgttgatttcgaaaagatcaatatcatccatctgaaggccagcagctttcactgctgcagggattgcaacggcaggaccaatacccatgacagctggatcaactccaacagcggcaaaggtcct

SEQ ID NO: 13459 - DNA, 254 bp, Zea mays
  Clone ID: LIB3279-213-Q6-N6-C6
ggctcatggcacgattcaaaggatcgtaccaaaatattaacttaagtattatatagggacagcgactccgcgttttgcacgtagtctactataataagcatataacgaagcaaagtactcaatatgcgtcacaacacaggactgctaatttaactgtataagtcatcatcgtcagctgctgctgcagcggatgcgaagggatcggccccaacaacagctgccgtcggttggtcggggaaccggaactcgctgcc

SEQ ID NO: 13460 - DNA, 620 bp, Zea mays
  Clone ID: LIB3279-213-Q6-N6-C7
agcttattaaatgcttaacttatattacagctaatcaatcgttacataaaagttaaacatcactaatacatctgtgtcagtacaaggacgaaacataaaacgaactcaaacaaagtcagcacaagcttggtcgtctcttcaaacactgtaaaataaaataaagaacaaagatatcgaactgcccagttcatcaaacagccagccaacgcaggtgacacgacggttagggtggcaaagaacacgatgagatggtaaatggataagaaagatgcacaaacttgcagatatttcttagcatcctttctctgtgtacgcatttctgctgttgtgtgccttgatccatttcaacgcgttgcagtaatgcacaccaataaaacatcgaccttggagtttactctctggtggaagcagaaagctcatcccttgtcaggtttgaacataatttccaggtcatctcagtggtacccactccatcctcttcctcttcctcggccacccctgccccgacctcttccactgcctcttccaacatgagacagtccttcaaaagctctgttcactagctggttttgcattcctcctctccccttcttgtttgcagggtcattcccatttgtact

SEQ ID NO: 13461 - DNA, 532 bp, Zea mays
  Clone ID: LIB3279-213-Q6-N6-C8
attccatcactctactttgagctatatattatattatattttgcagtttccctatataagtaaactactgaatcacccagagagagaaaggatggtctcttggtaattctggtggggcaagaggtcctaccgcactgacccagctcggcggcacaccacgtcaagagcttcaaccactgtccctgagaaaccagctatggcttggaatatacccggcaggcctgtctggatgttgttcagcgtcattgaccgcgtgacctcgatggccttagcgtgcctcgccatctcgtcctccaccttccgacggcactgggcgatctcggttttcttctccgcaagaggatcacgggcgtcgtacgcgtggctgtcaatgccaccgtgcccgccgctgccaggaaggccaaggccgaccatcgagtaggactggtagtacttcttctcgacggacctgagcgagttggttttcttttctagctccttcgagtatgcctctgcccgcttcttcaccttcatctcctctgcctgcttggcg

SEQ ID NO: 13462 - DNA, 484 bp, Zea mays
  Clone ID: LIB3279-213-Q6-N6-C9
aaaactccccttgttaatgctaattgtaaaaaaacgggggaagcgtttttttaatacttgtcgttgtgcaacatgtacaatacacgggagggggaggggtttaaaacaccccccccggcgagaatagcctaacctggacgtcccaatcggttatttgctcacctcaccagggcccccccaacatttctaggccgattgttggcccaacagaaacaccccaccgagccccacacgggccattgccggccacccatgaccagactggtaaagattcccttcacctttctcccatcattattcccgtcacgcaaccaattctattttctgaaacacccccccccaccccacgacagggaaaattaccataacccccctttgggccattttaccaaaacgacctcggcccgggtttaaataagccctccaggcttacctgggcccctgccccttccctttgttccccctccgatggaggggataacct

SEQ ID NO: 13463 - DNA, 463 bp, Zea mays
  Clone ID: LIB3279-213-Q6-N6-D1
aaaaaaaatcccaactaatcctttaacacataaccaaccttaaaacggggcccaaaattttcaggggtccaacccagctaaaaacaggggtaaaaaaaaaggggggccctaattttaacagccctttaaaacaggcagggtttggtttacccccccagccaaagggaaaaaagggggaagagaccccccaccggttggggggtgaaaaggcaacccccccccggttttttattggggggcctcccccggattggcggcaccggacagggagcaaacccccccagcaatctttggaaaccctgggccctggcccggatctggaccccaaaactgttccatgagccttttccactccggataaaaaaaagcgggcacagggggcccaagggggtggttaacaaccccccctataatggccccaaagggcaaatgggcaaagggttcttccccaggggggtttccc

SEQ ID NO: 13464 - DNA, 556 bp, Zea mays
  Clone ID: LIB3279-213-Q6-N6-D10
gtcatattcattcacaggacaggacaaaactatcaacaggctcactgatgacagatcaagagaaaacaaaggaacgacacttgcacaggtcagttccaccccaaagtaactcctcgctcctatatatgtatacacctagttatgtgggagcttcatttcagacgcaccagtgccttccttcccttcccttgagtgctgtgttcgcacacagattttcaccacctcctcctcttcctcctcttgtcctccgacttgtcagccgcgttcttgagcatgatgacaaggatgcggacaaggacagccacgaagtcggtgaagagggtgagggcgtgcttgatgtattccatgtcgccgtggtgcgccctctcgatgacctcctgcgtgtcgtacaccatgtagcccatgaagatgagcagcccaaagtagacctcaaacatgaagctgctagtggattggtggccgaagatggaggcggcgaactgcagccagagcaggatggagaggccagaatagacatcccgcccaggtagaggtactccctgcgcttggccaccat

SEQ ID NO: 13465 - DNA, 362 bp, Zea mays
  Clone ID: LIB3279-213-Q6-N6-D11
gccttcataggaaccccaccccttttgacattacaaaccaattcggggtggaaggggctagggaaatttgaaacccccagttttacaaaccaattcggggcccagtttctagggccaacaaaaaaacatgccttattggggcaactaaagcccttttgacattacataaattacatacggggggggccccatttacatgattgcaacccccaaaaaatcacccatttggaaacccacccctgcaaaaattttggaattggccccttttccatgaccataagcgaagggggaaccccccttcaaacattcaaaaagtcatgaaagggcaacaatgcaggggaacaaaaattgggcggcacccc

SEQ ID NO: 13466 - DNA, 647 bp, Zea mays
  Clone ID: LIB3279-213-Q6-N6-D2
tcgcgatctagacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggaccgtccttcgaccaaggtccacgctgctcctggcggtggctcttccctgggatacctgtttggtggcaactgatgccgctcaccaagctatcaccccccactgtcgccgcatgctttttctgaatcgtgaacagccgttgtcatttcatgtgtacccaaacctcccgtcccgcgtgggcccgtaagctgcgcctagatttcagggctaatcgtgtgcctgaaccctcatcataagtcgtctctgtacccagcttctcgtttcgtttgcacccgtgatggtatgggttggtt

SEQ ID NO: 13467 - DNA, 607 bp, Zea mays
  Clone ID: LIB3279-213-Q6-N6-D3
aaaatcaaatggagaagattaaccgtcggcaacccagttcaacaaacaaatctcaagtacataatcgtgcaatctagtcgcctaacccaccccggtcacacctttgttcgggccgcaaaatggaatctgatgataaacatgtgaaagcgcagctcgatggcattcgctgcatcgcgctgagcctgcttcgaaatagacctgtctcctgatacaccccacctgaggcgtgcagctatctaagcagccctagttcgtcttcgccttgggggccttcttcttgccgccctgccgcttcgggatggagttcttcatgcccagaaagaagagcagagctccgatcagcgccaaatcctgggtgaacttcgcaaagaggcctgcaaattctgccttctccatatcgtagttgtagaagtcatggatgataggagtgatcaaagcaaggtacagcagcaggagataagcaccgagagagctgctcaaaataaaaaggaggcttccaagacccttaagaccaattgtagcagcaatcacatgcttcaactcaatgtgtggcacagcttctcccagatgagcagatacactttttgacaaacacgttgaatttggg

SEQ ID NO: 13468 - DNA, 601 bp, Zea mays
  Clone ID: LIB3279-213-Q6-N6-D4
agaacgaattacgcaggccaggcggcctagttcttattgacgcccttgagcacgatggggaggacgatgacgaggatgatgacgaggaggatgatgatggcgatgaaggtccacttgcgggtgctcttctggtgcttccgcgccacctgcagctgctcgcgtccgcggtcgacgaaggacctggcgcggccgacgttgccctcgatgtcgtccagctgctccccctgcgcggccaccagcacggccatgtcgttgaacacctgctgcagctccagcaggctgcgctccagccccgccacggcgccgtgccgctcctggatctccgccaccacgcccagcacctccccgcgcccctggccctgctccgcgatggcgcgctgcaggaaccgctctccttccccggactccgccagcgcgtccagggtcgcctcgtcgggctgcgcccccgtgaccgtgaagtaccgccgcgccaccgtgtcccggtactcggccgcgacgcgggaccgcagcgacgagaaggactccatcgagtcccggagcttcttgcgcagcccggccacgacggacgtccgggtgcggtcggtggaggagcccggcccgc

SEQ ID NO: 13469 - DNA, 613 bp, Zea mays
  Clone ID: LIB3279-213-Q6-N6-D5
acataagcatattccatttgtcaaatattatatcttatacatttttcgaggacaaatgtactgttcataatcatataaattaaattttcaggcatggggagctacagtaagcctgttccataacatggcgcaggctgatcttcatggaaacctatgacgatgatcagaccgcagcactaaaccctctcaatttagcatcacaagttcacagcgacgatccaccaaaaacaggacgtaaaattaccgctcgccacccatgcctccaaacattccgctcatctccttcgatcccatctgtttcatcagagactgcagaccgcccatgccaccaatctgtttaagcatctgcggaggaaggaccttgctcatgtgctgaacattcatgttgcgggacagtgcactcatctcccctttctttgggatcttgagacccttcatcttgccccagattttagcaagccgcttatactcttccagcatgtcgatgacatccctgacaggacgaccagacccccgtgcaatccgaatgatccgtgattcagtcatcagcttaggatttgtgctgtcaagctctgcatcagtcatggaatccatcattgtcatgtagcgctta

SEQ ID NO: 13470 - DNA, 610 bp, Zea mays
  Clone ID: LIB3279-213-Q6-N6-D6
aagagaaatttcaccgtgtcaattcacctagtattctttattatatcgctctttctccaagaggcccgggtgaagcagttgtttaccatggtgcaccgaaacatagaccaagggactcagggcttcactctcagaataccatagtggccgtaatacccatatggtcatggatctgtaaaagaactcggttacaactgggtgttttagattcagagaaacgataaagcagatacaccgggtgttttagattcttctaaatcattttttcttggtagcttcttctgctctggtaaaagaatctgcgattacatcagtagcccaatccttgacatcctccagtcgcactggctcccccgttcttatccgggcatgtggacgagctaactttgattcaaaaggggtccttggcctgacttcttggacctcctcccattcttcacgagatagcatccttactgttccttgatcagggtggctattctttatcttgcgctctctcctttcttgatctgtagcttcatgttccatcatgaggagcttggtgaagagggccacggcggcggcggtgagcaccatggggagggagaccgagtcgagccacgccagcgac

SEQ ID NO: 13471 - DNA, 608 bp, Zea mays
  Clone ID: LIB3279-213-Q6-N6-D7
gataacatagttcattgccatttcatatgcatcatgataataagttacagcagtgaacaaccaactactcgatgattcgacagtaacccaaactacagaacccagcacatctctacatcttctgatcgggcactgatgacagaatatacgatgcttaggccctctccccacggatgcggcgggcaagctggatgtccttgggcatgatggtgacgcgcttggcgtggatggcgcagaggttggtgtcctcgaagagaccgacaaggtaggcctcagccgcctcctgcagcgcggagacagcggagctctggaagcgtaggtcggtcttgaagtcctgcgcgatctcccgcaccaggcgctggaacggcagcttgcggatcagcagctccgtgctcttctggtacttgcggatctcccggagcgcgacggtaccggggcggaagcggtggggcttcttaactccgccggtcgcaggggcagacttgcgggccgccttagtcgccaactgcttcctcggcgccttgccgccggtggacttcctcgccgtctgcttcgtgcgggccatcgagcgagtgaggatggaaggcttctgctagggattgctgggg

SEQ ID NO: 13472 - DNA, 472 bp, Zea mays
  Clone ID: LIB3279-213-Q6-N6-D8
aagaatacaagtgttgaagaattcttaggcgaagaaggagtcaaacatgagttctcggtcccctacactccacaacaaaatggtgtagcggaaaggaaaaatcgaacactaattgaagtcgcaagaaccatgttagatgaatacaagacacgtgacaacttctgggccgaggcggtcaacaccgcttgtcatgcaatcaaccgtttatatcttcataagatttataagaagactgcttacgagcttctcattggtaacaaacctaaggttgattactttagagtctttggttgtaaatgcttcattcttaacaagaaagtcaagagctcgaagtgtgctcctagagtggacgagggtttcttgcttggttatgcatcaaatgcgcatggatattgtgttttcaacaaaaccaccggtcttgttgaaatagcgatagatgtgacatttgatgaatctaatggctcgcaagggc

SEQ ID NO: 13473 - DNA, 593 bp, Zea mays
  Clone ID: LIB3279-213-Q6-N6-D9
ctgcaaaatgttggaacaaataatttgaaggaactgtcatacaaaacttcttaacagaagagtagatggataacggcagatcatatggatctccacaaccagattacacaaatatcttattccacaagatattggcagccataggcttcaaattcaaaaatccacgcagttgggcaagattttgcttccttttgagaattccccaacatggaagaacacaactgacaggcactatgcagctgaaactaattcatacaaagaaccaacattgaaaccatcgttgtgtatcagtataaagctgcaggcaaatctcatcgctgcaatcaagcttccttcatgtgttcaccagaccggtgatactggtagtcgccttcctcatatgcctcaccttcctcagggccttctggctcagcattgtttggcggcatctgatagttagcttccattttaccatacgagtcaacacgataatattcgtgctcatgccgctttgagtgttcagtttcatgtccacgtacatcttgactgtaaccatatgcatcatgacctttgtgttgctcatactgaccatagccataatcctgcccataact

SEQ ID NO: 13474 - DNA, 471 bp, Zea mays
  Clone ID: LIB3279-213-Q6-N6-E10
aacgcccccggggattttaagaagcaacagtcctagttaagcaagcgtttttggggggggtacatcacaagactcggtccaagggcaaacatgggggggggacgaacgggaaacagaacagcaaacatagggcccaaaggggaattaaagggctttgggaaccaaaccaaatctaataaaaaaaaaaagacgggatgggggggtgaacaaaactagctagctagtaacaaagcattggggccggctttttttttttttttgggggaaaaccactacttttttttttacgttacgacgggaagaggactccttttgggggcgcttttttgggggctggaaactttttaacttggtcgatcctacaccttagggcaaggagttttcggggggcatgggagcgctaccaaagtcccggggggggttgcccccgaagcactccatcctgctgggaaagttgggctcgttgcatcc

SEQ ID NO: 13475 - DNA, 576 bp, Zea mays
  Clone ID: LIB3279-213-Q6-N6-E11
gaggtgcttaaatctctccatccaacaaagacaaagatacggtggtaacattgaggtctctcacaagatatcactaacatagctagacaaaaaaaaagatggctcgcgttgcttgaaaaagtacatcgatagcatgcagaacaacaacacttcagcagcaccaatggaagtccccttggatggctagtcttcaagcggacgggatctcgacctctccgtcatcaatctcctgctgcaggtccttggggtccttgccgtcgacggtgcacccgacgctgacgcaggtgccgaggatctccttgacggtgccggccaactccttggccatggacctgttcctcatggtcctggcgatctcgacgacgtcgtcgaggccgatgttgccgctgtgcttgatgttcttgaccttcttccggtccctctcgggctccttgagcgccttgatgacaagcgcggcggcggaggggacgacggagaccttggcctggcggttctggacggtgagcttgacggtgacgcgcatgcccttccagtccttggccgtctccttggcgatgtcctcgccgatcttcttcg

SEQ ID NO: 13476 - DNA, 565 bp, Zea mays
  unsure (1)..(565): unsure at all n locations; Clone ID: LIB3279-213-Q6-N6-E12
cccccccccccccccccccccccccccaaccccccccccccccccccccccncccccccccccccccccccaccccccncncccccccccccccccccccccnccacccccccccccccccccncccccncccccnncnacccccnccccnccncccncccnncccccccccccccaccccccccccccccncccccccccccccccccccccccccccccccccccccccccccccccccccncccccccccccccccccccccccccccccccccccccccccncccccccccccccccccccacacccccccccccccccccccccccaccccccccccccccccccccccccccccccccccccccccccccccccaccccccccccccccccnccccccccccccccncncccccccccccccacaccccccccccccccccccaacaaacccccccccacccccccaaccccccccnccccccccccccccccccccccccccccgncccccccncnccccncnncaaccccccccccccccaccaccacccccaaacc

SEQ ID NO: 13477 - DNA, 594 bp, Zea mays
  Clone ID: LIB3279-213-Q6-N6-E2
ggagcacgcggtgaaaaactatagctgcactgcaggagcagcaccgtcattgtacacacacaacagaagaaacgcgtgggcactactaaactactgctgcatcctgcatatgccatccgtctgaactgaacggttggcaaccaagctttctctctcacagtcacagatcgcgcatcaccatcagccacgccaagcaaaaaaactgcaatcgtactcgtacacgcatcgctccaggccagaacataggaggagccctctaggtgaacgactgtaccacggaggaagtggtgacgaggccggagaggagaccgaccagggtgccactgttgtaggtgctggactccgtctgcacggcgttgtcacgggagtccacgaaggtgtcgttctggaacggcccacccaccagggcgcccgtagccacgtttgggttcgggctgggtgagtggagatactcgaaccctttgcagcctgttttcgcatccgcggggatcgacgcccctctgtggtgtacttgctttgggtagctgctcccatatcccacaaggtagctaagcttcatcgggttgtctcccagatatagttagcctgtgatgc

SEQ ID NO: 13478 - DNA, 465 bp, Zea mays
  Clone ID: LIB3279-213-Q6-N6-E3
ggaaaaaaaagaaggggtaccttttaattttaacgggggggaatgggaacaccgggcccccccccccccccccccttttttttccttttttttccccttttgggccgggcccccaagggggggggggccgggggggggcggggccccttttgtcccgaacaggggggaggggggggccctttttttttccccccccccggtttggggaaaaaatccaggggccccccccgggtaaaccctggggcggaaaacaaaaaaccccccgccccgggcaaaaaaaaacggggctttgtttttacggggtccgtttccgccccccgaaaaagggggccccccccgagctgccaaattttgggaagccaaacccccccaggggtttccccggggtgttttggggccccggcaaaacctccttgggggagccggaaagggggccccgggggttaaccgccgggggggctgggg

SEQ ID NO: 13479 - DNA, 593 bp, Zea mays
  unsure (1)..(593): unsure at all n locations; Clone ID: LIB3279-213-Q6-N6-E4
gacagctacagcattactacatcatatttattcacgattctacagatgcaaaatatataatgaaactgcacgtggtcttagccctacagaagggaaaactctaacaaaagacctcaagaataacggctaatcagatccaatccttcgggtttatgcaggcttccagaagtttccattcctcggttccttcttccggtttatgatcatactgccatcgtgctgtaagcggaagggacacaagtatgctctcaatccttcctccagtctttaggccaaatgttgtaccacggtcgtagacaaggttgaactccacataacgacctctccgcaattgctgccatgccctgtgctcctcattgaacggagtgttcttccgccgttctatgatcggtatgtacgcaggaagtacagagtccgcacattctgtagcaaagttgagaagcatttcttgatcgtaatcattaaggtcatcaaaaaatattccacctagcccacgccgctcattacggtgcttaatatagaaataatcatcacaccattttttgaatcttgggtgaaaacttgnatcaaatttatcacatgcttgcttttga

SEQ ID NO: 13480 - DNA, 601 bp, Zea mays
  Clone ID: LIB3279-213-Q6-N6-E5
acttaacgcgtgctcacaaataacacgcatcatatatcagttatgtacatatttatatacaggtaaacttactgataagtagaaatgtatctactgtagttataaaccttctctccttcacaatgggtgaagcttcctgttatataatacggcaactacgatgtcaccctcctatcctgctatggatcaattacaacgaggaactccgaccagcagtaggggctgctcctacagcccaagcacatcaaactcgtggggcatgtaatcttcgctcggacgatagtatttgtcaggggaatacaaaccgaagtttgtaacctggctgctgtacaagcatgcaaatctctcaacctgatgagcaaatctggaattttggtacccagtcttcatgagctgtccccacaccttatgaaacttctgatgatgttgcctctgagcttcttgatgaagaccacgaacatgccctctctgtttcagcagattgtcatgttcagagaacaatttctccttctggttttctgagatatcatcaagcttaagagaccattcaagatgatggattttgtcttcaattgaatcacgctccattctaagatgtcta

SEQ ID NO: 13481 - DNA, 495 bp, Zea mays
  unsure (1)..(495): unsure at all n locations; Clone ID: LIB3279-213-Q6-N6-E6
aaagtaaggtagcagaggttctttaatttagcatcgcaatgcagcatggaatcctgagtacagcatagtagcatcaatcctcttagcgtcatcaaaatcttaacaaaagctttctggaaccgtttgctagcttacagaaacacaagagacatcgataaaaccaaaggaaaggtagagaccctagaattccgacgcaggagccggccgatccgcgcgctcagaagccgagcttggtgcggcgccagtgcctgcgcttggcgttgtacctgatggtgttgtccgtgcgcatgcggatccagtaggggatggggcggttctggcgcatcttcttcgccagcttcttcttgatccggaaggtcttgtgcgacggcatcgctgcggcggagacgacgatgcggcggagacgacgaatcggcggcggcggcggcgcgaaaacccacgcgtncgcccacgcgtgcgcccacgcgtncgcccacgcgtncgcccacgcgtncg

SEQ ID NO: 13482 - DNA, 619 bp, Zea mays
  Clone ID: LIB3279-213-Q6-N6-E8
atcaaatctttaacatttaaactcttccgattgtcaggctaagcaacagtttatcgatatggggaggatgccatcgaagctaacaggaaacggtccagcagcacaaacatcatccgggaaaacatctttagggccatcaaaagctcgtctaactaaaaactctcttcccaattcgcaacacaaacaaatgttatttgaagtaaatttcgatcaactgattccactagacaatcgcatttgccgcgctggcaatcctaggccacagatcagcacactcctttccgatgggtccagtgatggcagagcctttcatctctccctttgggttcacaatcactccagcattgtcttcaaagtacatgtagacaccatcctttcggcgccatggcttgcgctgcctcacaatgacagctggcatcaccttcttcctaaggtcaggctttcccttcttcacagttgccataaccatgtcaccaacacaggcagaaggaagcctgttaaggcgccccttgattcccttcacagaaatgatgtaaaggttcttggctccagtgttatcagcacagttcacagtggctgccactggtagacccagtgacatccggaacttgttaccagc

SEQ ID NO: 13483 - DNA, 579 bp, Zea mays
  unsure (1)..(579): unsure at all n locations; Clone ID: LIB3279-213-Q6-N6-E9
cccaccaaaagccggctgctcaccatcatactcaacagaccgtttacaagtgaaaccgttacagtgacatacccttgcatcgcaccaacccgttgaccgtagtgtttcagcagcgcaatctccgagtcggtttacaaacgcccacgcattgcatcagccatcaacatggcaaaccccagatgctctttatttctctaccgcctcttcgggggtttcactgaagatcctcctcctgtcgcctggcttcctgtagatgtcgtgcgacctgacggtttcagggcagactcccttggttttggcttcgagtttgcaggctgcccattctttgtgagaaaaagcctggctatccttgatggggccttattcgttctgctgtcgcctctgaagcaccacctacagaacactcggttcctgccactgagcagccatcatcagacatgttatctttgcattcggcctcgcctgatccagcagcccctgatagtcgncggatctgttggctactgtcatttatatctgttgatgaacttggagacttggctttgtccttcaggagttgatcgatttccatatctttcc

SEQ ID NO: 13484 - DNA, 440 bp, Zea mays
  Clone ID: LIB3279-213-Q6-N6-F1
gggggggaaaggggtccccccaaagggggtaaaaaaaaaacccccgcccaaattggggggcccaaaagggggcccggaattaaaaaaaaaaaaaggggctaatttttaggggaaccccaaaaaaaaaagggccaaacccccttttgggggggggaaaaaaaaatttggggggggaaaaaaaccattttacccggggggggcattttcccccgggggggggggggaaaaaaaaccccggggagaggggcccacctcaaaaaaaaaaaaaatttttgggggacccgaaaaaccggacccctgggggggttaatggcccaaaaaaaaaatgggaaaaaggggggtttaaaaaaaaaaactttggggggtttttaaaaacccagggcaaggggggacctttccttttttttttgggggaaacccaaatttgggggggggggggg

SEQ ID NO: 13485 - DNA, 609 bp, Zea mays
  Clone ID: LIB3279-213-Q6-N6-F10
gaaggaatgaaagactaatatcagaaatcttatgatatgactgatccaacacaatggagtatactgctggctaatttcagaaatcatataatgtgactgatccaacacagtgaagttgctactgggtagaagtgtagaacagaaacgtagtactttggacaccaggtatcacatgcatgatcacatcaagactagagctaatcacatgcatgatccaatcacttgaggctagtgactgcaaatctcgatcctgtatgtagacacgtacgtagcttggtgacgatggctaacaaggagtggaagcagagaccatgtcatagatgtccgacttgacgttgccgaagacgttgtcgatcagggcgaagatcaccactgataagtcgttgctcccgacgacgccgttgccgccgggcgccgcctgaacgctgacaccggagagggccaccatcctgtcgaacaccttgtcaatgtcaagaggggtgccgccgcatgcgctcgacaccatcctgcgcacggtttggagcccctcgatgatctgcggcgccatccaccacttggcacaccctctctcggcataccaccttacccgcacaaatacaaggaacacat

SEQ ID NO: 13486 - DNA, 403 bp, Zea mays
  Clone ID: LIB3279-213-Q6-N6-F11
acagatcttacagtgcccattccattaaaaactgaagcaaaatgcttacaatagtttttttttctctacaagtgaaacaaggtgctgcgtcctagactaaatttgtggagattaacacttcggccttagaagaaaatagtggatattcccatagccaagcacccgactgatacccaagggctcaatcgctcacctatcctggcagctttccaaaagaaaccacggaatccggtgcggtcgttgaggattgccgggaactgcatcttgatgtaggagcaggtgcagatcaccagcaacaccacggtcaggaaggagttgaagttgaacagcgccgacatggtgctcacctccctccttccgtgttgcttgggtcctgcagccaagggaagggacacgattcacg

SEQ ID NO: 13487 - DNA, 271 bp, Zea mays
  unsure (1)..(271): unsure at all n locations; Clone ID: LIB3279-213-Q6-N6-F12
cccnccccccccccccccccccccccccccccccccccccccccccccccccccccccccccccccccccccccccccccaccccccccccccccccnccccccccccccccccccccccccccccccccccncccccccccccccccccccccccacccccccccccccccccccccccccncccnccccccccccnccccccccnccccccccccccccccccccccccccacgcccccccccccccccccaccccacccccnccccgc

SEQ ID NO: 13488 - DNA, 292 bp, Zea mays
  Clone ID: LIB3279-213-Q6-N6-F2
ggaagggaaaggtttttttttaaaaaaattattctttggattttttaccagccccaggggggtttggccccaaatttacttttaaaaaccggaaattgggcccggggggcctttttcctcaagaaactaaatccgaagcaaaaacatggttttttggaccttcccaaaaaattaggggacaaccgaaaaatcaaaaccctttttggttttttttaagggaaccatgccagctaaatggaaacattcaactttgtttcagtttcaacgacaaagaacccgggcccggggggcc

SEQ ID NO: 13489 - DNA, 607 bp, Zea mays
  Clone ID: LIB3279-213-Q6-N6-F3
ctgacaaaaccactggtttcaaactctgcatttttttacctacgactacgattctattagtactcgtctagtacgtttaggcccatcagtattcagcacgtggtcccaagtcccaatcccaacaagcttctgtccttgaatttcatggatgctactaggtttccatcccaattttcgcaggccaaagcacaacagaaatttacagtggaatcagttcttcagctccagctgtacacgatccatatgccataccataaacaatgtgccgcacagtatgggagcaaccgcaggaatccagcataaatggttaggcctccagctatacaaaaaaagcttcatctcgagagcgctttacgatgattcagtgattcacacaacaatttcgaagctactatacagcagctcactgttcgatcttcatggagccagagttgttggtgccgctatcagctgccacaccagggttgaagttcatctgaggtatgctctgaagtccttcccacatggaaggtatctggttcattgttgacacgtcatgaatagttccgtgcaaaacatcggcaggattagaaatgttgcacatcattgctggctgcacgattccttg

SEQ ID NO: 13490 - DNA, 578 bp, Zea mays
  Clone ID: LIB3279-213-Q6-N6-F4
gaggacaaaaacttttcattcctcaagggagtacaaaaagaatataattcacaatatgtctgcagcctgattcatcagcataatgcattgggactcaggggattcgaatgaccttatgaacataacaaggggccctatgccaaccggactgaaacattcacgtcagtttaaattataatgatgtaatgtcattctccccctaattgagtttgcgtcaaatgggtgtcaaaagatgatatcaacccctaaaattttcctcttaggatttactcaatctcttcttcaactctcgaacaaaatccttcctatcaacctcttcttcctggttggcttcaacgtccttcaactttacagttcctttctgcagctcaaactcgccgactagcaccatccacggaatgcttgattgcaaggcatacttgatgtggttcgccaccctggtagtgagcttgaactctgcctttatcccagcattccacagctcgctcacaagctcggcagctagggtaaggtcctttcccagaattgacaccagcacctctgtctctgtaggccggatcttctcatttctttcttta

SEQ ID NO: 13491 - DNA, 562 bp, Zea mays
  Clone ID: LIB3279-213-Q6-N6-F5
gcacggaattcttgcaggtttacaaaagagcgatatgtcatgaggcttgaaacgaggacattccattgattacagcagcgagatattacagcacatggactagaaactagaacgatgcagtacaaccaccacagaaaacagcaccgataaagacaacacagactaactagaccaagaacacaacacgaccgccaccgccaccacgtaattcgccaccgggagaggggcgacctaaccgccgaaaccgtagagggtgcggccctggcgcttgagagcgtagacaacgtccatggcggtcacagtcttgcggcgggcgtgctcggtgtaggtgacggcgtcgcggatgacgttctcgaggaagatcttgagcacgccgcgggtctcctcgtagatgagcccggagatgcgcttgacgccgcccctcctcgccaacctgcggatcgccggcttggtgatgccctggatgttgtcacgcagcaccttgcggtggcgcttggcgccgcccttgcccagacccttcccgcccttgccgcggccagacatcgccgagagtttcgccgct

SEQ ID NO: 13492 - DNA, 572 bp, Zea mays
  Clone ID: LIB3279-213-Q6-N6-F6
agcaaattgtatgtatatatataatagtatatgtttattctccgtgcacagcacagcaattcgaagacagaaagggcgcatcgaagcgccctatccatcctagtagtacattgacttcacagcaggtaggctcttgttattccttgatatctccatcacctggaacaatatcatcgctactacacagcaccaaggttacgtataacatggattgctccatcaggcaccattcatctgagcgcctcccagaaccagctccttgaaccgagctatgcatcccatcgcacgctcgaattcccccctctccagagcaaagctgaaccggcagtagccagggatccccgtccaggagctgctgtttatgcacagcccagtggccctcaggatggcttcccggatgttgctcgcgtccagctcgccgtcgaagccagcagctttgaaggccttccccatgtacgcggtgggcttcgccagcatcgagatgccaccgcaaccgatggcagcttcccagccacagctctccagtgtctgtatcaactggttggcgcgattcttcagctcctccttctgct

SEQ ID NO: 13493 - DNA, 606 bp, Zea mays
  Clone ID: LIB3279-213-Q6-N6-F7
cacataaaacatctcacacacaatcacataacaatatttaaatccatagtctcatcaattacatcacaaaagtctcatccatagtcataataagacacatctcatccagtactaataagagacaatatctaatacataggcataataaaagtctcaagtatcacaacccataacatggaagctcacgatcgccgatcgccatcggggtacagtgacgagtgatggtcgatacctccactagcgaagagggtttcgacaaagtctaactcgtcttctcgttcatgcgtcggcaaggtagctggagaggtctgatgttcggtaggtgaagatgtaggtgaagaccaaggatcgctattgtaggaccagactgcattagcgtgcttgaattaccctcacgagctgctcggcgatggggacggctccagcactgcttcacaagctgcatgtccttggcgacagccccactgccccagcacacgccgtgacagttgtgggaagtaagagcagcttcagcacccttgtttccagccttgccaccagcgcggttcagcgcctgcggaagtagtcgtagacccaacctctgcctttgtcgcctcaggtttgcca

SEQ ID NO: 13494 - DNA, 604 bp, Zea mays
  Clone ID: LIB3279-213-Q6-N6-F8
ggcaacacgaatcatcagtcttttaccaagatcgcttcgggacgaagcggtacacgaactaccacacaaaatagacttgtaaagccgtttttacactacttcgccacgccgtctaaaagcgaacaaacagcataaagttacaaattgcactcctccatccctccgccgccactggggccgggcgcgagatacgcctacgcgcgctcgccgcggatgcggcgggcgagctggatgtctttgggcatgatggtgacgcgcttggcgtggatggcgcagaggttggtgtcctcgaacagaccgacgaggtaggcctcggcggcttcctggagggccaggacggcgtggctctggaaccgcagatccgtcttgaagtcctgagcgatctcacggaccaggcgctggaagggcaacttccggatgagcagctccgtgctcttctggtacttgcggatctcgcgcagcgccacggtgccgggcctgtacctgtggggcttcttcacgccgccggtcgtcggcgccgacttcctcgccgccttggtggcgagctgcttgcgcggggccttgcctccggtggacttgcgggcggtctgcttcgtacgagcca

SEQ ID NO: 13495 - DNA, 188 bp, Zea mays
  Clone ID: LIB3279-213-Q6-N6-F9
gaaaatcttgttattactcatgtaaaaatatagctcgggaccatgccagtgttttttaaagcaattacatgcagaacatcatctattttctgtcatcccataatctacacacaaattcttcacgaaaccgttgctagcaatggttgaccatgatatgtttgcatatggaacaaactcatgccgaatgc

SEQ ID NO: 13496 - DNA, 611 bp, Zea mays
  unsure (1)..(611): unsure at all n locations; Clone ID: LIB3279-213-Q6-N6-G1
accaggcgcagcagctgcgcctgcgcgggggacggcgtcgcggaggaggcgcccggcaccggcactcgcacggcgtcgccgccgaagagccggccgcggtcatcgacgtcgaccacgtcctcgtcctcgtcctcgtcctcgtcgctgagcatctcgaacacccgcgccacctcggccgcgtcgtagctgtagtactgcatcaggtacccgctgccgccggccgccggctccggctcgtcgcgctgctgctgctgctgctgccgccggcgtcggcggcggcgtctggcggcgccgaggaggccgaggccccccacgcccgaggcggacgacggcgtgttgctgcagctgaactcgacctcgcgccgcctgcgcgagggctcgtgcaccgccacgctcgggtccagcgcgccgcacgagaacgaaccccccgcgccggcgccggcgccagcgtgggacgagaaggtcgcggcgtggcggccgtgctgggccgaggcgaggaaccggccgcccgcgaccttgccgcggtggaggaggagctgcaggtccatgccgagcttgcggcccgacngcaggccccgccgcagcatgtacagcacggcgcgcaccacgcg

SEQ ID NO: 13497 - DNA, 468 bp, Zea mays
  unsure (1)..(468): unsure at all n locations; Clone ID: LIB3279-213-Q6-N6-G12
ccccccccnnccccncccgcccccccccccccccnccccccggccggcccgcnggggcccccccccccccccccccccccccccccccccccccccnccccccccccccccccccccccccccccccgccncccccccccccccccccccccccccccgcccccccccccccccccccccccccncccnnccccccccnncccccccccncccccccccccccccccgcccccccccccccgcccccccgccgcccccccccccccccgcccccccccnccccccccccccccccccccccccccgcccncccccccccccgcgcnccggcgcccccccgccccccccccccccccttcttcccctcgcccccccggccncccggcnngcctgccnccnncccccccgcccccccccccccccnncccccccccctccccccctgcccccccccccgccccccccccc

SEQ ID NO: 13498 - DNA, 610 bp, Zea mays
  unsure (1)..(610): unsure at all n locations; Clone ID: LIB3279-213-Q6-N6-G2
ggaataagtaagtgcaacgaagcacttgtggccttctggaataagtgtaattaataccaacagtaattaataatagttcccgtttattatattatatcacaagatggatctgtctgtcgcttattctgcctttggtcgtcagagctttgatgctgttttgagctttgtgctcgactcaaaagccttgctgctgctgccttgcaccatgcgtgccttcttcacttggaaaaggagctcgtgggcttcctcaaaatgagggctcgtggctttcttcaccttgtccatccagacaaggatcctctcatgagctcccaggaatcggtcacggacctcatcgccaaggatctccaactgcattatctcacagacaaggctcagatctgcaatcgatggctgggggctacctagcaagaacttggcatcgcctttcagccatacggattcgatcacccccagtgactgcatcacaagcttctctgcttgtttcacagcctcatgacttgtcgtaagaccaaggaagggagccaatgcagtgtgcattacaagggttgctgcaccacgccgcanatttgagtgatgccaatccaagattgactcaattttggctctg

SEQ ID NO: 13499 - DNA, 362 bp, Zea mays
  Clone ID: LIB3279-213-Q6-N6-G3
gggggtcaaacaaacttcaacttaaaacatggtttgtaataaaagattacaaaccctaaaccccgtcaatccttggtttaaacccccccttgggacccgcgaagacccctgggtacatgacacacacccctgcttcacaaggttcaaatcccaaatccaatccccccccctcggggggtggttaaatttaacccgacctccttatttatttttgccctacacacacatgcctgcataaacatgcctgggttgcccataaaccggaacataaataccactacctcaccctcccaaaacgattgaaacataaacaagtgacccacccctccccggacccctgggcggacccctgggccgacccc

SEQ ID NO: 13500 - DNA, 102 bp, Zea mays
  Clone ID: LIB3279-213-Q6-N6-G4
ctctctctctctctctctctctctctctctctctctctctctctctctctctctctctctctctctctctctctctctctctctctctctctctctctctct

SEQ ID NO: 13501 - DNA, 522 bp, Zea mays
  Clone ID: LIB3279-213-Q6-N6-G5
gaagaggaacgggagagatgatgatggatcaatacagcctcctagtaagttagaccaccaaaaaaaaaggagaggggggataaagaagatgaggaaaaagctccgctgctcttgcgttgcgtcacatgactttttacagctaacaacaccctagctactgagtcccatgttaatctcctgcgctgggtcccacaaaatgtcagtcaaactactccctgcaatcggcctcactcaaggggcctcaccgaacgtttacgttttcccctacaccatgttctgggagatggcctcgccgaacttgaggaacagctcggcgtccgaggtgctggacgagttggcgcaagaaagggcgccggtgccccgcaggctgacgtactcgtcgacgtaggccggcggcaacggctgcggcggcagctggtggtgcccgtgccccttctgctgctgctgctgcggctgcggcggcggctccgggttcaccaggcagtcaaggacgcgcaccaccttgtgcattgtcggccggtc

SEQ ID NO: 13502 - DNA, 601 bp, Zea mays
  Clone ID: LIB3279-213-Q6-N6-G6
acatcatcaaactcatcatcgctaagggacccttggttgatttgttttcctttggaagggcactctgaaagttccaatgaactctctgtcttgtgtaatgtaagcttgctaaatggcaaagactggctaacaagagatgatggaccaacaagagaatgagatcgtttgacaatgacatcagggtcattgtaaacctcatcgttggactcagccacaggtgctggactgtcaggagtgagaatactcacttctgtgtgagtctggactgcactaggcccaaaaacatcagaaaagtcgaactcaacattttcagaaggcacaacatctggggggccccctggcagaagtatcttccctctaaaaagcttggggccctgtgcacgcgctgctgtaacagaggttatctcagaggaaaccatcttcgagaacctataagattccacaatatgactaggaagtcttgggccacaatttagctatgcagctcccaatggccaattcccagaccagaaataatgccttatagggcagcggtctaaggaaggctccctccacagattcccaagacaacggaagatgcaggactgcgaacatggccttg

SEQ ID NO: 13503 - DNA, 585 bp, Zea mays
  Clone ID: LIB3279-213-Q6-N6-G7
ttttttttttttttttctttttttttttttttttttttttttttttttttttttttttttttttttttttttttctttttttttttttttttttttttttttttttttttttttttttttttttttttaaaaaaaaagggggttaaaaaaggggggggggggccccccccggggaaaaaaaaaattggccttgggaaaggggggggggggggggggtttttggccgggggggggggggggccaatttgccccgggcccccggctaattttccggggaaaaaaaaaaaatttttaaaaaaaaaagaaaaacgggcccccccaaaaggaaaagcggccaaggggaagccccccctatggggggggggggggggggggcccacaaaaaccaccccaaaaaacccaaaagggggggggggacccaaggggtttcggaggggggggaaaaacttagttggttaaaccccctggggcctcttgcccccccccccccagggaaatttgggtttaaaaaaaaaacaaaagggggccggggggctggaaattttgggttggggaaaccccccccattttcccattttggggggg

SEQ ID NO: 13504 - DNA, 550 bp, Zea mays
  Clone ID: LIB3279-213-Q6-N6-G9
gaggcaaccagaaatttctgttcactacagaattgagtgaccaaacataaaaggagccatcaagtccaatagcacccttacaacacctgcaacacacaattgagatgatcatgcggaaggctaaacacattccaacaagctctcaaacgatggcatttgctgcactggcgatcctaggccaaaggtcagcacactccttgccgataggtccagtgattgcagaacctttcatctcacccttgggattcacaatcactccagcattatcttcgaagtacatgtagacaccgtccttgcgaccccacggcttgcgctggcggacgatgacggcgggcatcactttcttcctgaggtcgggctttcccttttttacgggggccatgaccatgtcgccgacacaggcggacgggaggcggttgaggcggcccttgatgcccttgacggaaatgatgtagaggttcttggcgcccgtgttgtccgcgcagttcaccgtggccgccaccggtagacccagtgacatgcggaacttgttcccagccgaacctcccct

SEQ ID NO: 13505 - DNA, 610 bp, Zea mays
  Clone ID: LIB3279-213-Q6-N6-H1
ggcatcatatcatatatatattatccatgagagggtaagagtcatatctcaaagcaagcaaaataaagtcattgtttcagagaagaaaatgatgtagctattgtgtctttgatatggtagcaaaaaatagcaatacgattgcccattgcattgagaagcaccaccacaatctgggaccgccagcgctcagggtgacttgcttccagtgggggagccaccgcgggcagcagcatcagcatcgacatcagcagcagcatcattgttaccattgccattggggcttgggctacggtcacctccaggactcgggctccgctcacctccaggactcgggctccgctcacctccaggactccggctacgtccattggccgcagggctgcggttactaccagatggactgcggctgcggctcctgctgttctccctccctctggggctgccgccacggtctgagccattgccttcgccattatcctttggtggtgggctcatcacctgatcctgggggctccgactccttgggctcctgcttccatcaggtgcggggctgcgctccttttcctttactggtggcgaggcagatcgcatggggctcctgctgtagcta

SEQ ID NO: 13506 - DNA, 585 bp, Zea mays
  Clone ID: LIB3279-213-Q6-N6-H10
agagcagtacaactcatggtagtcagtactgataaaatttgttgtacaagccaagcggggaaattagccaaattaacgctgaaaacatactggaagaccaatacccattacgcgttctgatgggcttgacaacccaccagacccgaagccccaaactaccacaatatcaagacgcaaaaactagagaaataaacaagctagatcaaaaggtcctcaagttcttcaccaatgcagattcgactgcccatgagcctatgtacaaatggttggtacgctgtgcatgacccgctcaacctgtatggtctccccctgttgaatcggagaaatttgtctcaggagtgagaaatggtgttatttctgcattttggttgaaatcatctgccaggtctgaaaacatgaagctttggggcatttggttcaagaagctaaatgatgatgactccatatccaaaattgaatcgtttagtggttgcccattcaactctgagctgctgaaggatccaccaccagatgcatcacctatcgactgacatgattccaggaaagtgttcccacagaaggcaaaatcagcattactcgattagc

SEQ ID NO: 13507 - DNA, 534 bp, Zea mays
  Clone ID: LIB3279-213-Q6-N6-H11
gaaccactgaatatggattgaatgaatctggtcaatataaacagggattagactaaacgccagacctatccgaacagcactactcgtttacacatcagagcagcttgtggaacgggcattctgcttcccagattcattcaatcgttcatgatgtgctgaatgatctatccaagctgtgtagtagccatgcgaaccgtttttgtcttccagccacacgggcccgtcgatctgaactaatgaagccactgcatggctgcatgttgatatgtacaggtgctcggtgcttcggtgatcacgacgcgcctacagccatttctgatggtttttcttgtgcctcgtccttgcccaacaatgctggtgtgactgaaacaacaccgatcaggaatagcagcgctatcgactgggtgtcgtaaaggtcgcttagcgaagttaattctccaagagcgattccagccctgacagtcacataagaagctgggataaggccaatgagagttcccagtaagaatatgtggtaggggacatctactatcg

SEQ ID NO: 13508 - DNA, 648 bp, Zea mays
  Clone ID: LIB3279-213-Q6-N6-H2
cacagtatcatttgcattcaacagtcatttggagggatgtcgacaacattaaatacatcgaccaaaccaaaacgcaggaatgcgcattcggcgtcgttcactttgactaccaacattattggcggcaaaaaaaaagactccattgaaaatgcacataagtttatcaccccaaaaaagcagctggcaatcagcttgtctaagtatgttcatgcaagcgctggggtgggagtgcagccagtggcaacttcagatgtcttctgtacagagctgtacttctttgtgatgaacctgaagaaatctctccacagcaactcaaacattaaccaatttgtcccagcatcagatgtgccatcattattcttgggtgttgacccaaaaggaattgctttagtagcatgcttcttcaactcctcatacatgaaccgtggagagaggcaacctgtagcaagccatggagaaattttgcaagagaaattagcaccatatatgctatcttgggtattgcttttgtctactttgtttggctgcatagagcattctgcagcaaacttcttcaacctctccagagcttctgtctcaccaccaatgagagtagagccaacagcaggttttgagtcctgtgacatggctggtggcgcagtgagccca

SEQ ID NO: 13509 - DNA, 548 bp, Zea mays
  Clone ID: LIB3279-213-Q6-N6-H3
aacccacctgttaactgacccagataggtttgccatatcagattatcagtacaatatgttaattacagcgaatcacacattcttttgttttggcaacttgtttggaacagaatgcgaatagcccaacacaaagtacacatgtccagcgcttattaaagaaggggagtagtttgcattgcgtctcatacaacctggtgatgcagtctccccaaccgacatttccagatcagttcttccttccttcgcagaggataaagggatacccgggcgtggacttgaatggggcgctaacagttccctcaggtgtgttgaaagcaacctcctggaaaggaccagccattttgccacgcgggaaccaaccaaaatctccaccttttttccctgatgggcattcaaaatactcttgtgctaccttagcaaactcagcaggaggaactttgtccccattatttagccatccatcctgcaactttttataagctttattgatcttcccctgcttctcaacaatacgtgcctagctttgacgtaggtgcaagtgccgagtc

SEQ ID NO: 13510 - DNA, 152 bp, Zea mays
  Clone ID: LIB3279-213-Q6-N6-H4
aaaaaaagggggctttcccatttttttgatgctttgctctcaacaaagaattagatcatccaggtttatccccaacgggtcaacggggattttttttggttagctaatggctgggcgaactgggagggaaaaaatccaggggaaagcgggcc

SEQ ID NO: 13511 - DNA, 547 bp, Zea mays
  unsure (1)..(547): unsure at all n locations; Clone ID: LIB3279-213-Q6-N6-H5
tnttttttttttttttntttttttttnttttttttttttttttttttttttttttttttttttttttttaatgaagtttcgggttgccttacttttttttcaattaaacacacaacctgaagagatgttggacagcgaccattgattggctggaacctttgctttttttaccaactacaatgcctggtaacttcaccttggcatttggttcatgtttccaagaaaaaacccaatttggaacccgaaaatccacaggggaagtttggaacagctttccgttccgcctgttccacacgccccaccggaaccaaattagcaacctacagattggatccacgggagcttcgcccgggggttccaatacttttattttctccacaggggaaccaaccaaattcttgaccccaaacaaacctaaaaaggagccaaatttagcgaagcagccccgccaatacattatcaactagaaacatagcgacagatcgggagcgcaacccatgatttccttgtcggggggctccacttcgatctggaagctagatccctt

SEQ ID NO: 13512 - DNA, 585 bp, Zea mays
  Clone ID: LIB3279-213-Q6-N6-H6
ggaataagtaagtgcaacgaagcacttgtggccttctggaataagtgtaattaataccaacagtaattaataatagttcccgtttattatattatatcacaagatggatctgtctgtcgcttattctgcctttggtcgtcagagctttgatgctgttttgagctttgtgctcgactcaaaagccttgctgctgctgccttgcaccatgcgtgccttcttcacttggaaaaggagctcgtgggcttcctcaaaatgagggctcgtggctttcttcaccttgtccatccagacaaggatcctctcatgagctcccaggaatcggtcacggacctcatcgccaaggatctccaactgcattatctcacagacaaggctcagatctgcaatcgatggctgggggctacctagcaagaacttggcatcgcctttcagccatacggattcgatcacccccagtgactgcatcacaagcttctctgcttgtttcacagcctcatgacttgtcgtaagaccaaggaagggagccaatgcagtgtgcattacaagggttgctgcaccacgccgcatatttgagtgatgccaatc

SEQ ID NO: 13513 - DNA, 582 bp, Zea mays
  Clone ID: LIB3279-213-Q6-N6-H8
aaccagcaagtaagaaatgtatcattggaattacaaacatccgccgcgtcaataatatacagaaagagtcgaaagacaagcaccctcaacagctcaaggccacctagcaccaccaccaactgcagaacagagtgatcgactaaaacgtcggccactcgactggaaaaagttatcttatctactgaagacaattgtctgggggggtcatctctgtacaactttatatatccggggcagcaaaacaaacagagtcgcccgatcagtctcctctgaactagttccacagctccatcgaaaaacctgagcaacatgctctctatttcaagccagcaacttcagccctggcttggtattgagcggcagctcatcgctcaatttctaacatgcctagttataaatttttacaggtctctcaaatgaatgccggttctgattagccgtgtgtgccttcctaggagccgtgtccggatgttccagtccaagatactgctcccaagctccatacatgtttctctggaattttagtgctacagtatctgaatcttcaaaatagtcaggacgaccgagtgaaatgttgcaaac

SEQ ID NO: 13514 - DNA, 609 bp, Zea mays
  Clone ID: LIB3279-213-Q6-N6-H9
gaagcaacaacgtaaacagccataattattctcaataacccggtagcaatgcaggggaattaacaactcttacaacatcaggtgttgtaaaccacacaatacttcagaacagacacacataacacgatagcaggagcaactctcggcagatcacgggataagggcagcacactggcctgatgctgcgtcatcagcaaacttctctagtactcgtcaccctcgtcgccatcctcgccctcatcgaactcagcaccgacctcctcgtagtccttctcgagcgccgccaggtcctcacgggcctcagagaactcaccttcctccataccctcaccgacgtaccagtgcacgaaggcacgcttggcgtacatgaggtcgaacttgtggtcgatgcgggagaacacctccacaacactggtggagttggagatcatgcacacggcacgctgcaccttggccaggtcgccaccaggcacaacgctaggaggctggtagttgatgccgcacttgaagccagtcgggcaccaatccacgaactggatggtgcgtttggtcttgatggtggccacagcagcattcacatccttggggaccacatcaccacggtacatg

SEQ ID NO: 13515 - DNA, 414 bp, Zea mays
  unsure (1)..(414): unsure at all n locations; Clone ID: LIB3279-214-Q6-K6-A10
gctgatgtcggggnagtttaccaggactgtgccgttcttgatttctgatagcttatcttctagtacacctcgtgttgttctcttcgtcacggcgccggtgcgcgtgcgctgaagctgcctgccattgccattgcctttgccgctgtttttaattaagcacacactctagatgttatgcccgcatgctatgtttcgattctcaagttgataaatgatggctggatgctggttttcgtgctccaagcctgctgcttcttccnagggaaaaaaagacctgcccttgttgcagcgttgttgtttagaatgacctatatttgactggtattctgttacggtggctttgcaaagctgtttgtttggtttaatgtctcggaataatatgaattggctgcattggacgtgtgtgtttctttt

SEQ ID NO: 13516 - DNA, 629 bp, Zea mays
  unsure (1)..(629): unsure at all n locations; Clone ID: LIB3279-214-Q6-K6-A11
ggnaaacgcccagcccgcagctctagccgccgtcaatctcgtctcgtatcggagtcgaaggaagtaagaggcgggatggcatgaagcgacctaccaagaatgagaggctgggcaacccccggcacaagtaggaggaagaacccgagcaaccgagccacagggaggaggaggagatgggcaactgcggcacacgggaggagaatgccgtcgtcgctgcgcacgcgcaagttcagcaactccacttgttacaacagccttccaagaacgccaatgcagataggaagcacacctgcatgtcatcagatataagtgacccttccacacctaggaaagttgaagatgccaagaacatttccatatacaacgatgtgattgccttcacattgtttgagctagagacaatcacaaagagcttccgtgttgattatgttcttggcgaaggaggatttgggaccgtttacaagggttacatagatgaaaatgtcagggttgggctgaagtcactgcctgttgcagtcaaggtgctcaacaaagatggacatcaagggcacagagaatggcttaccgaggttaaactgcctgggcagttgaggcatccaaatttggtgaagttgatcggatattgctgc

SEQ ID NO: 13517 - DNA, 635 bp, Zea mays
  unsure (1)..(635): unsure at all n locations; Clone ID: LIB3279-214-Q6-K6-A2
cccggatccgccattcccccgtgccctctctccgtcccctcaaccttctccctcctttcttgcttccctcaacaatcgccaaataacagcactagcggcagcggtagaggatcttttcgaggtaagctaggccggccggttccctgcggngaaaaagaaaagaaaaggaacctgtcttgatgtcgtcgtcgtcgctgtctccgacggcggggaggacgtccgggtcggacggcgactcggcggcggacacgcacaggcgcgagaaacgccggctgtcgaaccgcgagtcggcgcggcggtcccggctccggaagcagcagcacctggacgagctggtgcaggaggtggcgcgcctgcaggccgacaacgcgcgcgtggcggcccgcgccgccgacatcgcgtcccagtacacccgcgtcgagcaggagaacaccgtgctccgggcccgcgccgccgagctcggcgaccgcctccgctccgtcaacgaggtgctccgcctcgtcgaggagttcagcggcgtcgccatggacatccaggaggagatgccggcggacgacccgctgctgcgtccctggcagctgccctacccggctgccgccatgcccaatcgcgccccgcacatgctccactactga

SEQ ID NO: 13518 - DNA, 581 bp, Zea mays
  unsure (1)..(581): unsure at all n locations; Clone ID: LIB3279-214-Q6-K6-A3
ggnagaagttgacgaatctggtccgggcatagtccacatgaaatgcttctgaatttctggagcagtatatctgttgcttgcattttcagttagttgggatgcaagtttgtcccgtggtctcgctagcattcttcgttctttctggatattgaagagctgttggccatggagcattgtgcaaggtggtaaagtcgattgatggtactacatgaagaaacatgtgcagtacttcagcagtatagatcgtcaggtcagtttagttttttttttcaacaacagtgccatattaggatgttcctgatgtgcgcagttggtctgggtttttacacaacgcaagggtgtcggctgtcgcccgtgcagtttgcgtctttgtgagatctgggtccgtttctgcactccagtacgtggaacaggtttcgcatttggtggccagtgccccagcgtggcgtgagtgttgatgatttgtacttggagctgtttgttctattcctttcatgaaacagatattatcgtttgtacagggataaataataaattgtttatccttcaaaaaaaaaaaaaanaaaaaaaaaaaaacaaaa

SEQ ID NO: 13519 - DNA, 487 bp, Zea mays
  Clone ID: LIB3279-214-Q6-K6-A4
acaaccttttttttattatttttccgagcttatgcctcttgcatatgttgtagattctcgccgagaagggagtagtagtattacctgatatctatgctaattcaggtggtgtggtcgttagctactttaattgagtgggttcagaacattcaaggtttcatgtgggccgaggagaaagtggacgacgaactagaaaaggacatgagcagtgcttttcaacacatgaaggccatgtgcgaatctttggtgctgccgaagtgtgccgtgacattggaattgcgggtctagaaaaacaagctcattagatttctgaaaaaacattaggagttattagattggtagcatttttttaagatttaaaattttatagaagtcatcattttcgtttattggaagaaatatttttggaagttaaaaagatgctctaacatccaaccacgcaaactatcttacaaccattctaacacgatttcggtaatatgttttt

SEQ ID NO: 13520 - DNA, 373 bp, Zea mays
  Clone ID: LIB3279-214-Q6-K6-A5
ccccgcgtccgccccgcgtccgggatctcgcgcgcccctgattcctacttctgctccagcgcgcgcgttcttccctgtcgcgtctggccgtcgtcaagctccatggtgtctggccccgcttggatctcgtccgtgccgtgcagctccctctgccgatttcgctgtgcgccgaggtcgcgtgcagctcgtccagctcataagggtgaatcacagtttgagattgaaaaaggagcttagaaggtgtagataatgaagccctagattgacgtttgccgttgtcgtttgtgcgaacatcgaatcaaattgtgatgcggtaagctaattcattgtttttgctactgtttcgatgattggattaagtaaattgataggt

SEQ ID NO: 13521 - DNA, 623 bp, Zea mays
  Clone ID: LIB3279-214-Q6-K6-A6
cggccgcgtggggcaagtttcaccggattgattccccaccgcacccgaccacaaatcccaccaagcaaaccctaatccgtcggccatgtcgtcctcccccgcggcgctgcgcttctactgccaccagtgcgaccgcaccgtctccctcgcccctcccgcatccccggacgccgacgtcttctgcccccgctgcggcggcggattcgtcgaggagcttcctcccaaccctagccccgcgcctccggccgccgccttctttgccccgccctccttcgacatccgccaccccagcgacctctccgctttcttcggccccgcctcccccgagccgctcgccccaggcctcttcgatccctccaacttccttcacgaccacttcggcggcctcctctccggcggcgccaccatccagatcgtcctcgagggtgggcccccgcccccaggcctcaactttgccgactacttcgtcggctcctccggcctcgagcagctcatccagcagctcgccgagaacgaccccaaccgctacggcaccccgcccgccgccaaggccgccgtcgcctcgctccctgacgtcgctgtctcggccgacatgatgcaggccgacggcggcgctcagtgtg

SEQ ID NO: 13522 - DNA, 652 bp, Zea mays
  Clone ID: LIB3279-214-Q6-K6-A7
gccaggaaaatcgatactctttccttataacttttagattttttagtgagtgttattgtcatcatgtatacaatttgttttcttactctatatgagtgtaattaataaggtatacatacgtataaacctgcaaattttattagatgttgttgatgatctacacaagaagtgtagcggtgtttgactcatttaggaatggagtgattccatttatttagttttctggggtagtatctgaacaaggttcattttgtaaaaaccaatatgaatggaatgctcctttgcgtatagtatatgacttgctagtaaatagtgtcctttttgggcactatttaactaagaagaagccaaagtcaaaaaaatctgaaaggaaagaaaaaaggtagacaaggatgatgttgagcactttgtcggcatgactaggcgagaaggaatatataaatctaagaggccaaaagactataaacacattagccacaagttatttgagaagagaagaaaagtaaaattatttcgtatctctggtaacaagaaaaataattatttcacccactagttgccttttccaaataggctcgggatgttgtctagatgatgatggagactagtctcactcctgctctcaactcttattgtgctttccgaagagctc

SEQ ID NO: 13523 - DNA, 636 bp, Zea mays
  unsure (1)..(636): unsure at all n locations; Clone ID: LIB3279-214-Q6-K6-A8
cgtccaaaatccanaccgctggtaggagtatctcgtagacattgaacaacggctgcatggcgagcgcctgcgccacctccatccccctcgtctcggcgccctctgcatgcccgtccaagaagaccaccgtcgccaggttccggcgccgcacggcgacgtgcagggccagcagcggcggtggcggtggccggggcggcgaaaatgatggcctcctttggctgccccggcgggacgtgatgctcaacggcctgtccagtgtcgccgccgggctcgcctggtacccgggcgtcgcgtccggcgcggatgcggtgtgcaccagggccgacaaggtgaacgagaagaccgtgcagtgcacggacccggccgggcagcttccgtgccctctggtgtcgccgacggaccccgtggacttcaagccggaaagcaaggtgacgcgcatccggcagccggtgcatctcctgagccgggagtaccaggagaagtacaaggaggccgtcgcgaagatgaaggcgctaccggaagagaacccgctgagcttcgcggcccaagcggccatccaccaggcctactgcgacgcctactacaagtatgacccgacggccaaggacgcgccgttcgacgtgcacttctcgtgga

SEQ ID NO: 13524 - DNA, 510 bp, Zea mays
  Clone ID: LIB3279-214-Q6-K6-A9
gccatgcagtccggacgtccagaaaccacaaccagctcactcaagaacaaagaacccaacccatggcttttcccaagccggtcctcctgctcgtcacctggttcctgagctgcggcctcctggtggccgccgactacgccccaatgaccctgaccggggtgaacaactggccctacccggtgtggccgggcatccaggccaactccgggcacgacgtcctggagggcggtggcttcttccttccgacgttcttccacaagtccttcccggcgccggcccacccctggtccggccgcatctgggcgcgcacgggctgcgcggacgcccgctcgcagatccactgctccacgggcgactgccgggggcggctccagtgcggcgggctccgcggcgcggtgcccgaggacgctggtgcacgtgaacctccaccacagcaacgaccagaccttctacggtgtgagcttgatggacggcttcaacgtgggcctgtacgagaccccggacgagggc

SEQ ID NO: 13525 - DNA, 617 bp, Zea mays
  Clone ID: LIB3279-214-Q6-K6-B1
ctcgaagttccagcgagcgactgtgtcgagcaggagagagcgcgatggggaagatgcggcagctgatctgcctcgtggccgccgtcgccgccgcggccatcctcctgacagcgtcggccaagaagtccggcgacgtcaccgagcttcagatcggcgtcaagtacaagcctgagtcatgtacgctgcaagcacacaaaggagacaaaattaaggttcactatcgtgggacactgactgatggatcagttttcgattctagctatgacagaggtgacccgtttgaattcacccttggaaatggccaagtgataaaaggttgggaccaaggattgctcggtatgtgcgtgggtgaaaagaggaagctaaagatacctgcaaagatgggttatggtgagcgaggctccccaccaaagattccaggtggagcaactctgatcttccacacggagcttatcgccgtcaacgggaagacatccggcggtgcaaaggcagagagtgatagtgagctctgatacaatgcattggagagttccaaagctcgagaggagtagtagcagcgtcgcatagttcattaggtgaaagggttgctgtttcctccacatagcagtttatgctac

SEQ ID NO: 13526 - DNA, 638 bp, Zea mays
  Clone ID: LIB3279-214-Q6-K6-B10
atgaagagctgaaggaaagctaattacccgtgaagaatggtgaagaaaagataattgtagttggagagaaagtcttttggaggccttgaagaagcttcattactgtccatcattatggtacaggccttctgttgaagcagtgtctagtgattctgtaatggcagcaccaggaaaattatccttggataaggcaggtggagttttttcattaactcttagtgttaaccatgttgattcacatgcaccaaatggtgtgtctgaacaatccacagttcttagcaccaaaggatgtgaaacccttgcagcggatatggtgcccaatggtcaagattgtccggcaccaagtggtgtgccagaaacatctagttctgctgttgccatgcgtggggcttctacaagtgtggaacccaagcgcagagatcctcctgtacagattgtgccacctggaagctctgcaaccccatgtgccaaaaatcaagattcttttgtaggaagagtgacacctatagctcgtgatgggcttttgaggacaatttgtggaagctcttcatctcctggcggttatgcttctctagcgcaagctaatacctcccaaaccaatggagtttcttgccccagtgtcactcctaggggctatg

SEQ ID NO: 13527 - DNA, 632 bp, Zea mays
  Clone ID: LIB3279-214-Q6-K6-B11
cacaccacacgccctcacaactcgcatccatcgggcctcttccactccacatcgggagccgcaagcagaagcagaaccaatgacgacgacgaccacggcgaagcagctccggcgcgtgcgcacgctcggccgcggcgcgtcgggcgccgtggtgtggctggcctccgacgaggcctcgggcgagctggtggcggtcaagtcggcgcgcgccgccggggccgcggcgcagctgcagcgcgagggccgcgtcctccggggcctctcgtcgccgcacatcgtgccctgcctcggctcccgcgccgcggcgggcggcgagtaccagctcctgctggagttcgcgccgggcgggtcgctggccgacgaggccgccaggagcggcgggggccgcctcgcggagcgcgccatcggcgcctacgccggggacgtggcgcgcgggctggcgtacctccacggccggtcgctcgtgcacggggacgtcaaggcccggaacgtggtcatcggcggcgacgggcgcgccaggctgaccgacttcgggtgcgcgaggccggccggcgggtcgacgcgccccgtcgggggcaccccggcgttcatggcgcccgaggtggcgcgcggccaggagcagggccccgccg

SEQ ID NO: 13528 - DNA, 637 bp, Zea mays
  Clone ID: LIB3279-214-Q6-K6-B2
cggccgcgtgggcgcgtttagaacctctaaaatttcccccactcgccagtcgcagcagcacctgtagccatggacgccagcggagccggtagcaagggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtagggacttcatttgcactgtgtgctgtagcatgctcgtgtctagatctgtggatgggatgtgtcctgctctagtttcgtccttgtgtc

SEQ ID NO: 13529 - DNA, 518 bp, Zea mays
  Clone ID: LIB3279-214-Q6-K6-B3
ccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccg

SEQ ID NO: 13530 - DNA, 565 bp, Zea mays
  unsure (1)..(565): unsure at all n locations; Clone ID: LIB3279-214-Q6-K6-B4
caaaacgaanatagctttttatgatcaatagcggaatttgatactctacatatcaagctaatacacggagcagaactgacgtgcatgactatgtctatgtgtgattgggtcgaacaaaaatagcaggagcatacttagttgagtagcatatggcagagcatatctgtataccgtaggacaaaaatcataagggttcgaatcagttgttcccatgggggatgaggatgatgatagccaggcagcatgtatatatttctaggcttccttaagaacttagtggggctccagatgaaaagcagtgtgttgttggaattttatagaccctacctcgtgttaggttaattttaataaacccgaccgtttgtccgctaagtcggctattattctcttgttgtaattgacgcgttgcaccagttgccccactggctggttgcaccagtgggaaattgacgcgtaccatatataatgttgacatggctgattaaaaaaaaaaaaaaaaaaaanaaaaaaannaaaanaaanaaaannnnaaaaaaaaaaaaaaaaaaaaaaagggcgccgctcg

SEQ ID NO: 13531 - DNA, 629 bp, Zea mays
  Clone ID: LIB3279-214-Q6-K6-B5
cttttccccgggcaccaccaccaccccccccagccgcacagctcactccagccgaaagcacaagcacgccatggcagaggagaagaagaggcacaagcacaagcacaaggagaaggacaagcaggcgggcggcggcacggagcaggcggcgcacttcaagccgtgcggcgacgtgaagggcatccggttcgggggccagttcatcgtgaagtcgttcacggtgcggcgggcgtcgcccctggagctgctgcggctgctgggcatcccgccgtcgtacctgagcgagtgccagagcctgccgttcccgtccaccaccgcctacatgcccacgggcttcaccatcctggcgcaccaggcgtggcacacgctgacgctgggcctgggcaccaacaagtccaaggcggcgctcttcgtgttcgagtccgaggccatgaaggcggccgtggaccgcctgtggcccgccgtcaccccgctcggggacgtcaacaggaggctcatccgcggcctcacgggcagcgagatggcgcgcttcaagttccgcaagggctgcctcaccatctacgtctacgccgtgcgccggctcggcgccgccgggttcatgcgcaccgacgacctcaggcgggtgctgc

SEQ ID NO: 13532 - DNA, 649 bp, Zea mays
  Clone ID: LIB3279-214-Q6-K6-B6
tgagaggtggatttcatgcatgtatatggctcttccgatcttcatgagaggagcatcagcaagcaagttcctcaattacttcgttaaacaaattgttccagcatttgagaagattcctgaagaaaagaaactggatttgctaaagactattgcttcaagttcaccatatgctgcagcacaagattcacgtcagctgcttccatctgttgttcagttactcaagaagtatatgcctgggaagaaggtggaagatatcaaccataattatgttgagtgcttgctatacacttttcatcatttggctcacaagactccaaacacaacgaacagtctatgtggttacaagattgttactgggcaaccatcagatagacttggagaggacttctcagagcattacaaagatttcacagagaggttaactggaacagaagagacggtacgagcagcctcaaagcgactaactcaggggatggcagatttcaacaaggcaatatcttcagcaaaaactgacgaggaaaagactaaaattaaaggcgatcagcaaacttcaacaaggacaatgaggtcatataacaatatattggcaatgacacagtcattgcattcaaaatcccctttatttatcggtgataagaaaatcactctg

SEQ ID NO: 13533 - DNA, 654 bp, Zea mays
  Clone ID: LIB3279-214-Q6-K6-B7
ggccgccgcctctcctactgcatctccctcgctctcgtcgcctcgttcgcttcgcctcctccccgccccgccccgagccgagcagagcgcagccctatccggagctgggatggcggacgcgaagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccaattgggtgagggctccgctggtcaggtcacaaggaacatgcttgcaaatgagggtgtccgttctttctacaagggtttgtctgccggattgctgaggcaagcgacgtacacgactgctcgtcttggatcctttagggttctaactaacaaagcagttgaaaagaatgaagggaagccattgcctctaattcagaaagcttttattggtctgactgctggagcaattggtgcttgttttggtagtcctgctgatctggcactcattagaatgcaagccgactcgaccctgccagctgcacaacgacgcaactataagaatgctttccatgcactaccgtatcagtgctgatgagggagtccttgcgctttggaagggtgcaggtccaa

SEQ ID NO: 13534 - DNA, 644 bp, Zea mays
  unsure (1)..(644): unsure at all n locations; Clone ID: LIB3279-214-Q6-K6-B8
cggccgcgtgggcangacagccgcatcgaactctacctgcctttctctcgtccctggcggcggcggcaggatggcggcttctactgcgaggacggtgaaggatgtgaacccccacgagtttgtcaaggcctactccgcccatctcaaacgctccggcaagatggagcttcctgagtgggttgacattgtgaagactgcgaggttcaaggagctccctccttatgaccctgactggtactacatcagggctgcatctgtagcaaggaagatctacttgagacaaggcattggtgttggtggcttccagaagatttatggtggccgccagaggaatggctcacgcccacctcacttctgcaagagcagtggtgccatttcacgcaacatcctccagcagctgcaggagatgggcatcattgatgtcgatcccaagggtggacggcgcatcacctcccagggaaggcgtgatctggaccaggtggctggaagggttgctgttgaagcttgagcaatctcatatttggtttctatgatgtcatgtttgattgttgagatggctacactttatttgcactttggattaggatttttgtgttaagagaactcaaggcattctagctatggttcacactgtattntccctg

SEQ ID NO: 13535 - DNA, 654 bp, Zea mays
  unsure (1)..(654): unsure at all n locations; Clone ID: LIB3279-214-Q6-K6-B9
gnttaccctggcgttggacctgagcacagtttcttgaaggacatcggacgcgctgaatatgacagcgtgactgatcaggaggcactggatggtatgtgcctcactccctttccatcttttgtatcgattgaactaatttttaacaagttgttgctgttagcgttggtgtcagctttcagtgccttgacatctgtatcaatcactaacttttataaataacacacggacattctgtttttttcttgatctgaaagagtcactagtgaacgcgtgtccaaatctccacagtgtgcttataccagtacaactgcactgttttgtcatttgtgccagaatttattttaatacacctatgtgaattatctcaaacgtggcgaatcagcaagatgttatcttaaatgattaattgtcatgtatttggttgatgtagccgttcaggatattgcaatgccaataatatagtcgtagcctcctaggttctgctcagtagatacgccaaatgtttaatatatgccttattattgagctgatgctgattttttcaataaccaaacttaatgttaattcttgagcactctgtgctatagatcggagattagaattagcttacaaatcaatagtcctcagatgtgacactaaatacattgcggactg

SEQ ID NO: 13536 - DNA, 625 bp, Zea mays
  Clone ID: LIB3279-214-Q6-K6-C10
gctttgactgccctcgcttggtgctcagttcttccccctgctcctccgcctcttctcgcacctcggcgccttcttcggcaactgcgagcgagatggaggcgcaagacgactgcaagtggcggcagatcccggcgttcggcgactggaacgtgtgggacggcgacacgcccgtcacccagtacttccaggcaggggccttcttcttcgcggcgccggcggagaagggcgacgcggatctcttcaaggtgccccagttgcctgccaagccctacggctacaagaagtgcgttgttcgagtgaagggggagaaagaaaccgctgtgccggcggcggcgaggaagggacgcaggaggcgctgcgtgagcgagcagcacaagtggaagcccaagggagctgtggacgaggacctgtacaagatctccccgcagcttctctgcaaggtgaagaagaagaagctgctgaggaatttgcttggagggtgcctgggcttgggctgcattgcctgagagtgagagatgcagagcttaataagtttcttgaaagttcgcttgcttgatgctctggagagagttgtatagttgtctacgctaatatgagattaatggaaacttactactgcttctgc

SEQ ID NO: 13537 - DNA, 645 bp, Zea mays
  Clone ID: LIB3279-214-Q6-K6-C11
caattttccactgggatgtacctcaagcactagaagagaagtcggcggcttcctagataagagtcataagagcattgtagaagattacacatactttgctaaggtgtgctttgataacttcggcgacaaggtgaagaattggttgacctttaatgagccccagacatttacttccttttcctacggaactggggtctttgccccaggtcggtgctcacctggactagactgtgcctacccaactgggaattcactcgtcgagccttacactgctggccataacattctcctagcccacgctgaggctgttgatctttacaacaagcattacaagcgcgacgacacccgcatagggcttgcgtttgacgtaatgggtcgtgtgccatacggaacatcgtttctggataaacaggccgaagaaaggtcctgggacatcaacctaggatggttcttagagccagtggttcgtggtgactaccccttctccatgagatcattggctagggaacgactacccttcttcaaggacgagcagaaggagaagctcgccggttcctataacatgttggggttaaactactacacctcacggttctccaaaaacatcgatatctcaccaaactactcacctgtgctcaacactga

SEQ ID NO: 13538 - DNA, 639 bp, Zea mays
  Clone ID: LIB3279-214-Q6-K6-C2
gccaaatcggcctatagatcaaacgctgcactgtagggagcgtgaagccagcggcgaatggaatccctagccgccacctccgtgttcgcgccctcccgcgtcgccgtcccggcggcgcgggccctggttagggcggggacggtggtaccaaccaggcggacgagcagccggagcggaaccagcggggtgaaatgctctgctgccgtgacgccgcaggcgagcccagtgattagcaggagcgctgcggcggcgaaggcggcggaggaggacaagaggcggttcttcgaggcggcggcgcgggggagcgggaaggggaacctggtgcccatgtgggagtgcatcgtgtcggaccatctcacccccgtgctcgcctaccgctgcctcgtccccgaggacaacgtcgacgcccccagcttcctcttcgagtccgtcgagcaggggccccagggcaccaccaacgtcggccgctacagcatggtgggagcccacccagtgatggagattgtggccaaagaccacaaggttacgatcatggaccacgagaagagccaagtgacagagcaggtagtggacgacccgatgcagatcccgaggaccatgatggagggatggcacccacagcagatcgacgagctccct

SEQ ID NO: 13539 - DNA, 656 bp, Zea mays
  unsure (1)..(656): unsure at all n locations; Clone ID: LIB3279-214-Q6-K6-C3
ngatacttatgtaatgtgggcacaataatggtaagaaaatttgattttaccaatattgactcatctgttggtcggtcacctggagtaccctgatttatggacaacaatatcgaattagtaaagtggatttaagaatatgaatgtacacaaatttttgagtcaccttttgtttcatgcaccataacctataactaatacatattagtaatgaaaacaattcgatatacttagcaagaaagttgattttcactgtcacctttgatgtggtagcacacttggttttatcaaaggtagttgcagattgcatatctttcctttttacctgtcattacatcacaatgagtattcaatattttaatatttttggatgattacgaaatagttaattttgtacatactattaacttcaatttagttatgcaacaccctagtgtactgccaattaaaatgcatctccattcaagaatgagtagtatgtgagatactactacttactaatgaacaatgaatacaatacatgggtcatgtgtagaagtacctggttcttagatgcttcttcatttaaggaagtagaagttggttccttgggcatactctgtatgtgcgagacatcaatgtaaagataagcaatcatgattatgtatgttgaataaatt

SEQ ID NO: 13540 - DNA, 636 bp, Zea mays
  unsure (1)..(636): unsure at all n locations; Clone ID: LIB3279-214-Q6-K6-C4
gtcngacgctttcggcggcgcccctgttgacagaagcatggtgttcgccaggaaggtggacctcaccggtgtcgacggcgaggcgctcgccggccacggcctcgggagcaacttatcagtggtgatcttcgtgctgatggacagcgtcttcagcaacgtcaagtcggacatcgatgccatggtgtctgacccttgccgcatggcagacgaggatgtgcaggagttcgaccattactaccgtcatctggccaagagggctgccaagctgcatgccatctacccgcctgaactaccaaagccgctttcagaatctgaagatgagaaggccgtgcaggagaggttcaaggagatggcgaacgagagcatcgacctcgcggctggtgcgatgcgccgcatccccgcggagaaatggcgcccactgatctcggtgtttgcttatgtgttccttgtatttgtgcgggtgaggtggtatgccgagagagggtgtgccaagtggtggatggcgccgcagatcatcgaggggctccaaaccgtgcgcaggatggtgtcgagcgcatgcggcggcacccctcttgacattgacnaggtgttcgacaggatggtggccctctccggtgtcagcgttcaggcggcgcc

SEQ ID NO: 13541 - DNA, 626 bp, Zea mays
  Clone ID: LIB3279-214-Q6-K6-C5
atatcatttgccacaccatggtgtgacacagagtaatacacaatttgaagtgtcgaccctcttaatcatgcttgttggggagaagacttcatcaaatgtcattaaattaacaaattatgttgttttcaacctgttttaggaacgctaaccatagtagacggtgtcgagatactcaatatgaaacaacaacgtagctattagttcgacaacagagagctaatcaagtctagctccgtgatgaagttaccacaatgtaggggtagttcgacaatagggagccgatcaagtatacctctgtgacaaagtcggcacaatgtacaggtagttcatcaatagggagccgatcaagtctagccgatcaagtccaactccatgatgatgttggctgctatcacctgtcgcagttgtattatgggggtaggacaggcctgtgggtacggcggcggagcccgaacaagcaccccaaatggggcatggtcggtgcgcgcgtacgagaacatggttgtggtttgtcttgtattgataagctcaactgcagtggagtgtcatgtcgatgagcattgtaagatctaagatttcataactttattgtgggtatttatactgaaaaaaaaaaaaaagggcgg

SEQ ID NO: 13542 - DNA, 626 bp, Zea mays
  unsure (1)..(626): unsure at all n locations; Clone ID: LIB3279-214-Q6-K6-C6
cggccgcgtgggcggacgcgtgggcangagctggtccactctcgaggcacgggtcgagaaagttgcatattagctgaccctttggacccgagtttgctcgagaagatttcggattacgaagaagatggaattaagtttgggaaaaggcggcccaaacagaggctccttttcgacgccgtaaacgaagcgctcatcgagcttgcttcgatggcggaactggctgcgtacccctggggtagatcatgctcttcggagcacggggattgcaagaacggttccagcagtaattctgcggctgaggaaatctggcgggtcattaggaactggtcgatacttgagaagtaccctcccggtgaagctattgaaagaaatctcttgctggagatgatactaaagagggaggtggcggaggcagccagcgctgacacgactcggttagagacgtttgatctcaacaccacggtctgcgccatggtcttggatggcctggttgaagagacagttgtagatctgactaactactgctagtgaggtacctctgccctctaactaataatctcgcgctctgctccctagtgttggtgtttggtgtgatacttgctgccgtaacactgctccatgctatt

SEQ ID NO: 13543 - DNA, 652 bp, Zea mays
  Clone ID: LIB3279-214-Q6-K6-C7
gttggcctgttgcctgcctcgcctccgtccccctcgtcgcctccacctcctcggtcacagagagagagatagagagagagagggagggagagagggaacccggagaccgccaccaagcgtgaggcagaggaggagcatggcggcgccgccgtcgaggtcccggggcgactacgaccacctgattaagctcctgctcatcggcgacagcggagttggaaagagttgcttgctgctgcgcttctctgatgacacattcacaacaagcttcatcaccaccattggcattgatttcaaggttaggacggttgagcttgatggaaagcgtgtaaagttacaaatttgggacacggctggtcaagaacgtttccgaacaattactactgcctactacagaggagccatgggcattctgcttgtatacgatgtcacggacgagtcatccttcaacaacattagaaactggatccgcaacatagagcagcacgcgtctgacaacgtcaacaagatcctggtgggcaacaaggtcgacatggacgcgaagcgggtggtgtccatggctcaaggccagaagcttgcagacgagtacgggatcaagtttttcgagacgagcgcgaaaacaaaccagaatgtggagcaggtcttcttcgccatg

SEQ ID NO: 13544 - DNA, 226 bp, Zea mays
  Clone ID: LIB3279-214-Q6-K6-C8
gtaattccaaactttgctttttctcaaacatcaccggtgcatcatcttatactaggtctatgtcccgtgcgttgccacgagaaaacatgaaatcgttatatatgtggtactacaaatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgggccgttttaaa

SEQ ID NO: 13545 - DNA, 508 bp, Zea mays
  Clone ID: LIB3279-214-Q6-K6-C9
ctggaaaggcttcacagatcaatttaacatcattcagggggttagtgacgtacctgtttcaggcaaaataagaaacaccctagataatggcttcttaggtgaagttcgaactgggcagccatctgtgctcacagctgctgcgaatggagcaagacatgacaaaggtacaaataatgtcatacagggttatggtggaaagcaacaagggaggtcaactgggatggcttacctttccagaagatgaagtagttttcactcgacgcaattggttttgagggtggtgaagctgttggaaaccatacaagtggcattgttttggcctccaaacggccgatgctgaagatgacctggattaaagttattctagatttattttttttgttgcaccattgctattcacagcgcctgtatgagggccttgttgtggcgaagcctgctgaaattttgcgactatgtaactcgtctgtgcttgtattgtggtgcacttggaatgatgtgaatgttatag

SEQ ID NO: 13546 - DNA, 646 bp, Zea mays
  unsure (1)..(646): unsure at all n locations; Clone ID: LIB3279-214-Q6-K6-D1
ccccgcgtccgcaaaccttgcgccgccactgcctcacaggtaaggccgccatggtctccggttcgggcgtgtgcgcgaagcgcatcgtggtggacgcgcgccaccacatgctgggccgtctctcctcgatcatagccaaggagctgctcaatgggcagaaggtggtcgtcgtccgctgcgaggagatctgcatgtcgggcggcctcgtccgtcagaagatgaagtacctccgcttcctccgcaagcggatgaacaccaagccgtcccacgggcccatccacttccgcgcccccgccaagatcctgtggcgcaccatccgcgggatgattccgcacaagaccaagaggggggaggcggctctggcgaggctcaagacgtacgagggcgtcccgccgccgtacgacaagaccaagcgtatggtcatccctgacgctcttaaggttctgaggctacagcctggacacaagtactgcctcctcggcgagctctctaaggaggtcgggtggaactaccatgacaccatcagggaacttgaggagaagaggaaggagaaggccaaggttgcctacgagaggaagaagcaattggccaagctgcgtgtcaaggccgagaaggcagnccgagagaagttggggtctcagttggc

SEQ ID NO: 13547 - DNA, 497 bp, Zea mays
  Clone ID: LIB3279-214-Q6-K6-D10
caaccgcttgcgtcacacgcacactgacggagagtgatcactgatttctggtcatggcaaccgtaactgaggaagttgctccggtcgtcaccgtctccgaggagccggcgccggaggcggcgaaggaggtggcggagaagccggaggaggggaagaagcccgacgaggagggtggcgaggggaagaaggccgcccccgccgccgagaaggagaagaaggcgaggaagccgcggagcaggaagcccaagtccgccgggccgcaccacccgccctacttcgagatgatcaaggaggcgatcctgtcgcaggacggcgggaaggtcggggcgagcccgtacgcgatcgccaagcacatgggggagaagcaccgggacgtgctcccgcccaattaccgcaaggtgctggcagtgcagctgcgcggcttcgccgccaagggccgcctcgtcaaggtcaaggcttccttcaagctcgccgccgccgaggagaggaagccctcc

SEQ ID NO: 13548 - DNA, 648 bp, Zea mays
  unsure (1)..(648): unsure at all n locations; Clone ID: LIB3279-214-Q6-K6-D2
gcatggcgtcggctcctgcgttctgcgtcgcgctgctgctgctgctggcttccgccgctgccgtccaagcggtgccgccccaggccggcacgtcgtccacctgcagcactgacctcctccgcctcctcccctgcctgcccttcatcgagggcaccgccaccgtgccggcggacacctgttgcgccaacctgggcagcatggtgcacgacgagccgcagtgcctctgccaggctctcagcaaccccagcacggcccccgtcgccgtcaacatgacgcgcgtgatggccatgcctcggctctgccgcctcgacctcccgcccgccaccggcgcctgcgcagttgccggtcttcttccccatggaccatcaccgccgctgccaccgccgccgccgccaccggcggtcactccacacgcaagcgccaactccagtgctccagcgaccctcaccacgccagcgacgccaacgccgacgacaccacgtatgataccgtcaccatcggtgagcagtcagacgccgccgcgatacagccgggggtccaagatgatagctgacggcttctctgtcactcttggtttcgtggcatttgtgtcagtcctagctntctgaagaaattggcggcattcgtcaggcagttagaattatggct

SEQ ID NO: 13549 - DNA, 625 bp, Zea mays
  unsure (1)..(625): unsure at all n locations; Clone ID: LIB3279-214-Q6-K6-D3
gtacacataaaataaattagctgcaacaattcagtttaaattcatcgtagatgtccangaaacaaaatagacaagcagccaacctggcactgttcatcatgtgctgacagcgatacttctgcttttttaatatcaacatcggagatgaatttcaaactgaattattgctgttgcacttaggtgtgttgcatacatatttttttgtgatgattttttagaacattacaacatgatgttttagggtctgtttggttcacaactatagatttatgaaaatatgaatccaactgtgagctgtgaaaaatctgcttcgagctgagggttgtgagaaagttaaaatatatttgattaaaacaactatcaatggtagattctacaagagtatgatagctgtaacatgaataatgtaatctggaaaatttggggtagatagtgattttgaattgaactagagaaatctatagatttttaaaaatctattctggtgttgtaccgtttgggtgagattttagatttttggcagcgaattggttcagaaaactgaaccaaacacacctggttaaagagggtgtcggcctacttgcgcaccatataattttctgttcttgtgtttctgctgacattt

SEQ ID NO: 13550 - DNA, 624 bp, Zea mays
  Clone ID: LIB3279-214-Q6-K6-D4
ccccttcccctcagtctctcacacgcacgctcctcccctacgcagcaaaaccctaaccctagctgcggacgccgtcgccgcctccgcgcccaaccgatgtctgattctgaggcgtccccaccgcccactccggccgccgcaacgcccgcagcgctggtggagacctccccgtcctcggcgaggaaggaagaactgctgcctgtggaggaaaagatctcggaattaagtgaatcacaatcagagcttctagggaggctccgtgggcttaaggaggatttgctgagttggaggagtaatttagactcccaagtgacgaaatacaaagtggaactctctgacatcaagagtgcactcaataatgaaatagagcagcttcgctcagatttccaagagctgaggaccacccttaagaagcagcaggaagatgtgtcacttagcttgaagaatttggggcttcaagatgctaccgaaaatgatgggaacaaaggaaatggagacggcacaaatgaggtcttgtcagctaacttggggaacttgaaactggatggttcttctgaaaactatgatgaaagcagagagtcaaaggaggacaagggtggaaaacaccgacactgctggtgatgg

SEQ ID NO: 13551 - DNA, 644 bp, Zea mays
  Clone ID: LIB3279-214-Q6-K6-D5
accctcgacagccgtcgaacccgtcctcccagaggtggtcgcctggatcaagcgcatcctccgcgtcgagaagaccggtcacagcggcacgctcgaccccaagtgaccggcaacctcatcgtctgcatcgaccgcgcaacgcgccttgtcaagtcgcagcagggcgctggcaaggagtacgtctgcgtcgcccgcttccacgccgccgtgccggacaccgcgcgagtggcccgcgcgcttgaggcgctcactggcgcggtgttccagcgcccgccgcttatctccgcagtcaagcgccagctcagggtgcggacaatctacgagagcaagctgctggagcacgatcccgagcgccaccttgccgtgttctggatctcatgcgaggcaggtacctatgtccggactctgtgtgtgcaccttgggctgctccttggtgttggtgcgcatatgcaggaactgcgccgtgtcaggtcggggatcctaggggagcaggacaacatggtcaccatgcacgatgtgatggacgcgatgtggtctctcgacaactacaaggatgagtcatacttgaggcgtgtcgtgatgccactagaggtactgcttactagctacaagaggcttgttgtgaaggactccgctgtaaatgc

SEQ ID NO: 13552 - DNA, 622 bp, Zea mays
  Clone ID: LIB3279-214-Q6-K6-D6
gcgccggcagtcgccgtcatcgatcgatcgccggaaactaacccctacgatgtctggagccggcgaggaggacaagaagcccgcggagggcggcgcccacatcaaccttaaggtcaagggacaggatggcaatgaggtgttctttcgcataaagaggtccacccagctgaagaagctgatgaacgcttattgtgaccgccagtctgtggacatgaatgccattgcgttcctgtttgatggccgcaggcttcgcggcgagcagacccctgatgagctggagatggaggacggcgacgagatcgacgccatgcttcaccagaccggaggcagcgttcctagcaccacctaaaagcctcgttttgctctccgtcctgcgtagtagtaaacaaaagggaaaaagtctttttaaggaacttgtgatgctctggctccttgtgccattgctgagggacatccttagcctttgtttagtagtatggtttggtactttgttctgtcatcactcgtttatctatccctaatacatgccgccatgattgtactcccaatgacgcgcagatcatttgctttgttttgtctgctcgaacctcgaagtcgtctatgcttttcagattattttggg

SEQ ID NO: 13553 - DNA, 439 bp, Zea mays
  unsure (1)..(439): unsure at all n locations; Clone ID: LIB3279-214-Q6-K6-D7
cagaagacacggagctgctcnatccggagttgcccttccagcgcctggtccgtgagatcgctcaggacttcaagacggatctgcggttccagagccacgccgtcctggccctccaggaagccgccgaggcctacctcgtcggtctgttcgaggacaccaacctctgcgccatccacgccaagcgcgtcaccatcatgcccaaagacatccagctcgcccgccgcatccgcggcgagcgcgcgtaggcgtatctcgcgcccggccccagtggcggcggagggatggaggagtgcaatttgtaactttatgctgtttgttcgcttttagacggcgtggcgaagtagtgtaaaaacggctttacaagtctattttgtgtggtagttcgtgtaccgcttcgtcccgaagcgatcttggtaaaagactgatgattcgtgttgcc

SEQ ID NO: 13554 - DNA, 556 bp, Zea mays
  Clone ID: LIB3279-214-Q6-K6-D8
tttggccacatgaataaatcaaaagacatatcaatgaaggtgccctatgggagcttgttcggatctcaagggactgttctcgagaagattaaggaatttggcataccggacattgacatccagccccactcttgaagcagagatgaggagattaggaataaaaatgtgataacagaacagagtgcagctggggctcacactatgaagttccatttctcgtgcacatacagaggtgtccgttgctatgggcgctggtaatcaagcacatcttcccttgatctacctgatttttggcaggcatacacgggcaccgcactgactaatcagaagaggcaatggccttcgcaccaactttctcctcgagagttcatttttctttggtttgagggggcagttgaaaatctcgacagcactagcaattcgtttattttgtaaaataatgctagcatagcagatgttacctaccccccaatgcagggtttgtaaattttttgctgtaaaaatatcaaggccaaaaggagtgcttttgcagtttgaagcataactgtattccctg

SEQ ID NO: 13555 - DNA, 628 bp, Zea mays
  Clone ID: LIB3279-214-Q6-K6-D9
gtctcgttcctgccctcggccctcccctcgctcgctccccaactccagcaggcagatcagatacatccattcgcggaccggaaggaaaggaaggggcgttgaactatgagcgccgtggcggtttcgtcgtcgctgaacccggacgcgccgctcttcatcccggcggcgctactacaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcagggccccgtcgccgccgcccttaagacagattcggtgctcaaggcgctgaacatgacctccccgaagggcggcggcgacgccccgcgggggttccgggagaaacccaggaacgccgagaagccgaccaagtacgccggcagccccaagagcagcgccccccgcgtgatccaccagcctcgctaggttcgctgggggaactcatcaggaaggctgctgcccctcttgcagccttgctcctggctgccgccgctgtcgtggactcgtggtctgctctttcaagtcg

SEQ ID NO: 13556 - DNA, 617 bp, Zea mays
  Clone ID: LIB3279-214-Q6-K6-E10
ctccggttcgcgtagcgccggcggcgaaatgaagtctccgtgaagacgctcaagggatccagcttccatatcgaagtggatcctaccgacaaggttgccgacgtgaaaaagttatagagagtatacaagagcaggcttcctatcctgctgaccaacaagtgcttatacaccaggggaaggtgctcaaggacgacacaacattggaggaaaaccaagtagttgaaaataattttcttgttataatgctcagacagaacaagggatcatcaagtgcagcaccagctaaggtaaccgcgaatcaggcaccctctactcagacagtgcctgctactccacctcaaacgtcagcagccccagatgcaccggcacctattgtacctgtcagtgcaccggctgcaactgctacagcctcagcagctcctgctgttgctgtctccactgaggcggatagttatggtcaggctacctcaaacctagttgctggcagcaacttggaaggaacaattaaatccattcttgaaatgggtggcgggacatgggatagagacactgtactacgtgctctgcgggctgcgtacaacaatccagagcgtgctgttgagtacttatattctgta

SEQ ID NO: 13557 - DNA, 616 bp, Zea mays
  Clone ID: LIB3279-214-Q6-K6-E11
gattgactggctgattgaggttcactacaagtttgaactgatggacgagacgctatttcttacggtaaacgtaatagatagattcttggaaaaggaagtggttccaaggaagaagctacaactggttggaatcacagctctgcttcttgcttgcaaatatgaggaggtctcagttccagttgttgaggaccttgtgctcatttctgaccgtgcctacacaaaagggcaaattctagaaatggaaaagttgattctgaacacgctgcaattcaacatgtctgttccaacaccttatgtcttcatgaagaggtttctgaaagcagcagatgcagataaacagcttgagctagtgtcatttttcatgctggagctctgcttggtagagtaccaaatgctgaattataggccttcacatctggctgctgctgcggtttatactgcaaaatgtgctattaaccgttgccagcagtggacaaaggtttgcgagtcacacagcagatacactggcgaccaactcctggagtgctcgaggatgatggtagactttcaccagaaggctggaaccggcaagctcactggcgtgcacaggaagtacagtacctacaagttccggttg

SEQ ID NO: 13558 - DNA, 651 bp, Zea mays
  Clone ID: LIB3279-214-Q6-K6-E2
gcggggccggcctacaaccgttttcgtgctcacacacccaaaccttagtcgcgatcaggccccaaggactcgagatgaagtcgagggcacggtccaccgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgaggtgaacgacgaggacgaggagggtgacgagtgatgtatgacggatgaaactctgtccaagtgtttgcagtcagggaaaaaatctcgtcgttgtcggcctaaccgggttttctcgaaggactttctagatgcagtagattagtgccgtcttctgagtagtttccttgcaagtgtcgtcccgtccctggagtgaggcagtttagtttgtagtttcttcgcttcatcggcac

SEQ ID NO: 13559 - DNA, 289 bp, Zea mays
  Clone ID: LIB3279-214-Q6-K6-E3
attccaaacacactgcccttgcttctaccgttccccagtgcgctccctctctcgccatccatctcgtgcacgactgggcaaccgttgccgctgtcgaggtgcccaggtcttcatcggtccctcgtcagttcttctccggcccttcgccgccgacaagctcccccagtacttatgttaccaaagcaaggctagtaaatcataccggaaagaatggtgatggcgtcttggtcttgggtctgctagatgcatgcctactgccttatcgcaaagctagcttacctgctactgg

SEQ ID NO: 13560 - DNA, 630 bp, Zea mays
  Clone ID: LIB3279-214-Q6-K6-E4
atgccgcactgctcctccccatccgcctccgccgtcccggtcttccaccccaagaactcctcctcctcccgcctcgtgggctgccgcaacccctcctgccagtgggtccactctgccgcgaacctcgccaccaagtgccgccgcgccccctgctcccccggcgccgccaactgccccgccgccgccagcaacgtctgcccgccctacgccgtggtctacggctccggctccacagccggtctgctcatcgccgacaccctgcgcgcgccgggccgcgccgtccccggcttcgtcctcggatgcagcctcgtgtccgtgcaccagccgccgtcgggcctcgcgggcttcggccgcggcgcgccgtccgtgcccgcgcagctcggcctcccgaagttctcctactgcctcctgtcccgccgcttcgacgacaacgccgccgtgagcggctcgctagtcctcggtggcaccggaggcggcgagggcatgcagtacgtgcccttggtgaagagcgcggcgggcgacaagctgccgtacggcgtgtactactacctggcgctgaggggcgtgacggtgggcgggaaggcggtgcggctcccggcgcgggcgttcgcgggcaacgcggcggggtcc

SEQ ID NO: 13561 - DNA, 635 bp, Zea mays
  Clone ID: LIB3279-214-Q6-K6-E5
cccagcgtccggttattatatatattataaaaagaaacattatcgaatttggtggtgaagtcacaattacattttttgttttgtatcagtaccgaagttttggctttgtattttcaaaacaaacacatacctattatacctactaacattagttgctacctattagtgtttctctattaaataagttcgatcactaagtttggtcaatcggttgtataaatttctttattaatataacaccagacaatgaaaggagcctatctaggagtgattctcctgataggtcaccaaaacacacaagtcgtagacgtgattttactccgggatactcatttgcaagataatatcattcaccttttattgatcgcttgcattatggtggaagaaatcaccgtgacaggtacatggtttaccagggttcccgatatcgatcaccgtcggagccccgccagagacagtatcaacaccaatgaaaataaattattattatttaaatgctatagttaaatattttttgtatggttatcaacatttattatttctgataacacgccatcgagccaattctgaataggcagtcatttttgtttgttacttactccctccgttccaaattataattcttttgacttttt

SEQ ID NO: 13562 - DNA, 630 bp, Zea mays
  Clone ID: LIB3279-214-Q6-K6-E6
gccgccgccgccgccgccgcccaaaaccctacctaccctcttctccccctcactctcctttcatctccattctaatggcggcccaacccgtccggcgaagctgctagtgcttgtatctactatcttcatcaggtacttcgcgatcctactgaagtattccccgccgccgctgccatggccaccctcaaccctttcgaactcctcggcgccgacgacaacgacgacccgtcgctgttgattgcggcggcggcggctgctgctcagaaagccgaggcgaagaagtccgccgtggcgcctgctgggaaggctgcccagcctgcggcgaccaccaagttcccgaccaagcccgctcctccctcgcagacggttcgggatgcacgcggcggtggctcatcagctcgtggaggctttggccgtggtgaacgtggccgtggcagaggtggacggggatatggccagaaccgtggcttcagtggtgacaatggcaatgagttccagggaggttatggtggcggaggctatggggatggtgctgtaactggtggatctgaaggagaaagggagagagacactcgtcccccgtaccgtggcggaggcagacgtggtggttacaggaatgttgagtttggc

SEQ ID NO: 13563 - DNA, 648 bp, Zea mays
  Clone ID: LIB3279-214-Q6-K6-E7
aaacttgattcaacatgctttttgcccacaatatcagcctgtcactagaaaaactacaaaatctgatttgattgcaatatacaaaaataaacttgctgctcttaaagagtcatttaaaaggttcagttctcatttgctttaacatcggacatttggacatcatcacaccaaaaaacctgttatgtttctgttgttgcccactacttggacgattcatatgctttaaacaagcgagtcatcggttttagaatgatggatgagtcacacactggagatgcaattgccaaccatatacttgaggtagttcatgattttgagatagatggtaagattctctctataacccttgacaatgcttccgcaaacacaactgctattgatattctcaccccctcggttgcagtcatatatacaaggttatattatccaccataggtgtgtgcgccacattataaatttggttgttcaagctagtataacagttgcaaataagtacttgaataatatacgtgctgctattcatttcataacaagcacacctcaaatgatttctagatttgctgagtattgtaaagctcaagatatgagaccaagaaaatttggtcttgatatgaagattagatggaattcaacctaccatatgcttaa

SEQ ID NO: 13564 - DNA, 641 bp, Zea mays
  Clone ID: LIB3279-214-Q6-K6-E8
cacgagcggctggtggccgagaaccgcggcgccgtggccgacgccggcggcaaggtcaccctcgcggcggtggagaggatggagctggccaagtcggtggtgtgggagtcgctgcgcctggacccgcccgtcaagttccagtacgggcacgccaagaaggacctgctggtggagagccacgacgcggtgttccaggtgaggaagggcgagatgctgttcggctaccagccgtgcgccaccaaggacccccgcgtgttcggcgacaccgccggggacttcgtgcccgaccgcttcctcggcgaggagggcagcaagctgctgcagtacgtgtactggtccaacggccgtgagaccgagaaccccagcgtcgacaacaagcagtgccccgggaagaacttcgtggtgctggtcggcaggctcctcctcgtcgagctcttcctccgctacgacacattcaccgccgaggtcggcaaggagctgctcggcaccagcgtcatcttcaccggtgtcacgaaagctacctccggtccgggcagcgagtaaaccgcccggccggcgcgcgtcgttggatatatgatgagtggacgtgacagagtgtcccattatttcttaatttcgtcattttcctccttccttctaat

SEQ ID NO: 13565 - DNA, 658 bp, Zea mays
  Clone ID: LIB3279-214-Q6-K6-E9
gccgcagattagcaggccgcctgcgctccctcctcctttcccctcagcctcccctcctctccggtgtacgtctccgtcgagatggccgccccgctccggcggagcctcccctcccttggccgcgcgcttctcacgccgccgacgccggcgccggcgcggatgctctccgcggaggcctctgatgccctcgttgagatcaagcccggggagatcgggatggtctccggcatccctgaggagcatctccgccgtaaggttctaatttattcaccagctaggactgcatcccagcaaggttcaggcaaagtcgggaggtggaaaattaattttttgtcaacccaaaagtgggagaacccgttgatgggatggacatctactggggatccatatgctaatgtcggtgaagcaggacttacgtttgacagtgcagagtcagcaaaggcgtttgccgaaaaacatggatggaattatgtggttcggaaacgccatgcacctcttctgaggcctaaggcctacgctgagaacttcaagtggagaggtcctccgaaagcggagcaagcatgagctcgagacatctgtgatgctgacattggcacgatgtcgttttcctcctggctcgattttattttgctttcaccgtgcccattgttaaagtacg

SEQ ID NO: 13566 - DNA, 654 bp, Zea mays
  unsure (1)..(654): unsure at all n locations; Clone ID: LIB3279-214-Q6-K6-F1
gnaaatgcggcgcaggcagaagaagagaacccaagcgcggctccgtctccggcagtccggctccgctctgcatctcccgccgccttgtgcaatgcggtgccctcctccacctctttcgcatttgatttgattcgtccagaggacaatctctgcgccgcgcataaacaacgccagaagagtcgtcgcccctgaccgtcccgtctccttcctcccctcatccccaccctcccacccacccaccgcgccaccataaaccccgaggggatagagagaaaaaccccggccccccacacgcgcactccatggcggagccggccggcaaggcccgggagcggcgggtgtcgatcgaggaggtggcgaagaagctgtccctgtggcacacggccacgttccggcccatcctgacccacgccgagctggagcccatcctgtgtgcggcgggcttcgtggcgctgccgtcggcaccagcgacgcatcagaagcaggacgagcggcccggcgtggcgtggcgcgagtacgccttcctcggcggcggcaatgcgagccctgcggcggcggccccgcggcgctggctgggcccgcgcccccgcctcccgtacccgcgcgtcgacggcctccacctcaagacgtaccaggccttcctcggcgccgtcg

SEQ ID NO: 13567 - DNA, 660 bp, Zea mays
  Clone ID: LIB3279-214-Q6-K6-F10
gttctagatcgcgagcggccccctttttttttttttttatggataggatcacaaatggattccaaaatattttctcattacaatataacacacatatgtacataagttgtgtacataaattatcgtgttattatacggttccgttgtaacgcacgggcactcacctagtgcattaatatttgaacaagcgcgtagaaagcttttcaccaaacgcgaatttttttcccgtttcctgtaaaaattaaaatatttttatattattcttttgaaaaaaatccctgtgttccaaataaaaataaaaatgattcaattcaaatcatttgaactatatacgatttctatgtctgcagcaatcacgaaacaccagcaaatcagcaacacggagcagttacttaacactacaatattatttgaacacaccagtacaccactgcttatgtacatcattattgagcgaactcaaaacattatgtacgatgtaacggccacagattcgcagtatacgggggctcccggatattgaagccagttgtgataaattgttcaaacagatacaacagttcattggccatgagttttgccaatccagcaagcgctaattcacatcagctgggccgtggtagtttctcctcctcagctgcgattctggggcaggttgct

SEQ ID NO: 13568 - DNA, 553 bp, Zea mays
  Clone ID: LIB3279-214-Q6-K6-F11
gtccgaaaaaaatcccccattttcttcgaggcgaggagagcgtgaaagacaggcaccggcagcgacgatgtcggggcgcggcaagggcggcaaaggtctgggcaagggcggagcaaagcgccaccgtaaggtgctccgtgacaacatccagggcatcaccaagcccgcgatccgtaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcaagcgccagggccgaaccctctacggcttcggaggctaggctggatgcctcttctccttgctgtcgtggatgcctgtttgttgttagggttatttcgtttagttccttgtctgtgacgtgttggactattgttagtagtattcttgaagttgtttcgaatgtaatccaatcttatcgttcgataattgaaatgattcctgggcaacgttttgc

SEQ ID NO: 13569 - DNA, 643 bp, Zea mays
  unsure (1)..(643): unsure at all n locations; Clone ID: LIB3279-214-Q6-K6-F2
ggcttgaccaagcagcagcagcagcagcagcgatggcgcctctgaagctgtacgggatgccgctgtcccccaacgtggtgcgcgtggccaccgtgctcaacgagaagggcctcgacttcgagatcgtccccgtcgacctcaccaccggcgcccacaagcagcccgacttcctcaccctcaaccctttcggccagatcccggctctcgtcgacggagacgaagtcctcttcgagtcccgtgcgatcaaccggtacatcgccagcaagtacgcgtcggagggcacggacctgctccccgcgacggcgtcggcggcgaagctggaggtgtggctagaggtggagtcgcaccacttctacccgaacgcgtcgccgctggtgttccagctgctcgtgaggccgctcctgggcggcgcccccgacgcggcggtggtggacaagcacgcggagcagctcgccaaggtgctcgacgtgtacgaggcgcacctcgcccgcaacaagtacctcgccggggacgagttcacgctcgccgacgccaaccacgcgtnctacctgctctacctcagcaagacccccaaggccgggctcgtcgccgcccgcccccacgtcaaggcctggtgggaggccatcgtcgcccgccccgcgtt

SEQ ID NO: 13570 - DNA, 645 bp, Zea mays
  Clone ID: LIB3279-214-Q6-K6-F3
cttcctccccgccctccgaatccgaagccagaagcttccggaagccagcccaagccatgaacgccgccagcaccgccgccgcggcccccgcgcctgccgcgaccgtgcaggtgccgcgcgggcaggtggatctgatcgacttcatcgactggaccggcgtcgagtgcctcaaccaggactcgtcccacagcatcgtcaacgcgctcaagcagagtttgagagacgacgaggggctgtacctcgccagcgattcggacgagcagctgctgatctacatccccttcatgcaggtagtcaaactgcattccgcgctattcaaaggtcccgaggaagagggccccaaaacagtaaaactcttctccaacaaagagcatatgggtttcagcaatgtcaatgactatccaccaagtgacaccctcgagctatcatccgatcatttgatagagaataaacttttgccactaaagtatgtcaagtttcaaaatgttcgcagtctgactatatttattgaggacaaccaaagtggaagtgatgtctccaaaattcacaagattgctctttatggaacaactgtggacacgacaaatatgaaggatctgaagaagatagaagagcactgagacgattttaaggctgagcttattc

SEQ ID NO: 13571 - DNA, 535 bp, Zea mays
  Clone ID: LIB3279-214-Q6-K6-F4
cacaaatccgcatgccagtcagtctgcaaatcttctaacaccagctttctttgcaccaccaccaccctcttcaacatctgtgacaccacctgcttcatccatgatgcctacagcaccacctcttcatccgacttcaacagctgctcaacatccttcatatggcactcccttactccaaccttttcccgcaccgtctccacctccttccctgacccctgcacacaacgatggacttgttatttcaagggataaagttaaggacaccctccagagacttgttcagaatgacgagttcatcgatttgatatatcgtgagttacaaagtgtgcacatgtagactgctgctcactagtctgtacggagtttgtctaaaccaccgatagtcttatggagctgctcgtcgcgacaaagatcgcctccctgtttttcttcttgtgagttttgtatgatttatttcttataaacctgtgcatagtttgttttaatgtagagtgcttatagcagtgcttggtaagcatttatcctgctggtttcc

SEQ ID NO: 13572 - DNA, 591 bp, Zea mays
  Clone ID: LIB3279-214-Q6-K6-F5
ccgcagtacagctaccgcggcgtcgcctcgtgcgctgttgcatgtccaccgcacctgtcactttccacgcgcgccagaaagttccagagggtttgaagagaagcccatgggctcatcagaactgccaggcgaaaaagatgctcctgtcggcgagaagccagagccagtgaagacccatctccgcaacatgatcattgtccccgagatgattgggagcattgttggtgtctacaatggcaagaccttcaaccaggttgagatcaagcctgagatgattggccactatcttgcagagttctccatttcctacaagccggtcaagcacgggaggcccggtattggtgccactcactcctcgcggtttatccctctgaaatgagttgttacccagatctgtagcgtcccaagggtgtccagtggcattgccctttcagctttgctgcttgtttcgaacaagttacatacccaagacattttgttctgtttccagcactagatttcaaagctaagcattgcataactatgctgttttgttggaagtatgtgagtataatcttatctaatatgtgatgttacgttctttgttgtttc

SEQ ID NO: 13573 - DNA, 552 bp, Zea mays
  Clone ID: LIB3279-214-Q6-K6-F6
ggcgtgccttcgtcgtccgtgccggtgcgtggcgtggtggccgtgccgaccgtccgtccaccccctctcctcttcccggcgccggcgacagcgggagggactccctgggaggaatggccgtggtgagggctccgctcggcgcggtggcggtggccgctctcgtcgtcgccatcttcatgccggccgccgcagcggcgcaggcaccggcgcccgcgcccaccagcgacggcacatcaatcgacctggggatcgcgtacatccttatgctggtggccctggtgctcacctacctgatccacccgctggacgcgtcctccccctacaagctcttttaatctctgctccttttcgtttggtcatgcggttatgggtgctataggaattttaggtgcgcgagatgtttaggtgaggttgggaggtttagaatgatgatgattgcaatcatttgatcttggtatgtatccaaggctccaagccgttggtgttctgattggtttgtaattgtatcggattccattatctttgtgctcagtccctgatttgctcctgctg

SEQ ID NO: 13574 - DNA, 622 bp, Zea mays
  unsure (1)..(622): unsure at all n locations; Clone ID: LIB3279-214-Q6-K6-F7
gccggcgtctctccaaaacccaaccaaaccctanatccgccgcactcagttccggtgagaccctcctttccagcgaaaatgccgaacctcgagtgccggatgtatgagcagcggttcccggaggtggacgccgcggtgatgatccaggtgaagcacatcgctgacatgggcgcgtacgtctcgttgctcgagtacaacaacatcgagggcatgatcctcttctccgagctctcccgccgtcgtatccgctccatctcctccctcatcaaggttggccgccaggagcccgccatcgtgctccgtgtcgaccgcgacaagggctacatcgacctttcgaagcgtcgcgtctccgaggaggaggcgcacgcatgcgaggacaggtacaacaagtccaagctcgtgcactccatcatgcgccacgtcgccgagacgctcgagatcgacctcgagccgctctaccagcggattggctggccgctctaccgcaagtacggccacgccttcgaggccttcaagctcatagttgccgaccctgacgccatcctcgacgcactcacctatgaggagaaggaggtcggcccngatggccaggaggtgactaaggtggtgcctgctgtcaccc

SEQ ID NO: 13575 - DNA, 621 bp, Zea mays
  Clone ID: LIB3279-214-Q6-K6-G1
cggccgcgtggggccgccgcggtttcgtcgttgctgtgcgcaccgtgggtccgcgccgcggccagagaagggtgagttctgcatcgacgacatcgacctggacgagaagagcaacaaggtgaaggtgacggggcccttcgacccggacaagctcgccgacaagctgtgctgcaaggcgtgcaagatcatcaagcagatcgagatcgtggagccgccgccggagaagcccaagaaggaggaacccgccccgccgccgccgaagaagaaggaggagccggccccgccgccgccggcgaaggtcgagccgcagaagcctccgccaccgaaggagaagcccccgccaccagcaccgaaggaggagccaaagcccgccccggcgccggcgccgccgcccaaggtggtggaggtcccctacccgtggccgtacccgtgcccgtgcccgtgcccgtacccggcgtggccgtccgactgctgctgccaccacgggcacggcggctgccactgctgctcctgcggcaaggcccccgaggccccggcgccgcccccgatgccgcagtacgtgccccagccgtacccctgcaacccctgcggcggcggcggcggcggctaccggatcgtctg

SEQ ID NO: 13576 - DNA, 644 bp, Zea mays
  Clone ID: LIB3279-214-Q6-K6-G11
agcatctggtctcgtctctctccgatccctctcctctccctccccctagccactacccacttgagcgagccctaggccctagcaggcgaaagccatggcgtccttgggtgttcgtgccgccgccgccgctcgtcttccctccctccgtcctcgccgcgacggcagcagggtgctcaccggcttgagggtcgggacagggcactacggcgtgcggctcgcgctttcttcgtccacatcagcttctcccagagagttcaaggtcgctggccttcctgtcgatgacagcagtttgggcccgggggatgaatatgagtttggactctatactcctaagctgcttgcagttactggagatgattatgtgtctaacccccgcatgccagacgaggatgagttcgaccatttctaccgtgttgtcgccaagaagactgacatgctgctcagctgccaccttccaaagccgcttgcagtttctgaagaggagaaggccgtgcaggagaagttcaaggagatggcgaacgaatgcatcgacctcctggttgatgcgatgcgccgcatcccagcggagaaaaggcgcccactgttctcggtgtttggtgagctgtacccggtatttgagtcagtgaggtggactgccgaggggg

SEQ ID NO: 13577 - DNA, 432 bp, Zea mays
  Clone ID: LIB3279-214-Q6-K6-G2
cggacgcgtgggcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcgtccgttcctttggatctgaataagatggtggtgatctgagtggtggtcttagtttatcatgtatcgctcgcagtttaatttagcggtttaggtgtggatctgtgaaccccatggcgcctctgcttgattcgtgtttcacctgttatgttctgagattcatgataatgctatgagaactgaaattcccgttt

SEQ ID NO: 13578 - DNA, 466 bp, Zea mays
  Clone ID: LIB3279-214-Q6-K6-G3
ctagtccttgatttatactcttctagagatgaaaaagtgttgccgctgccggagtactttaacctggtagatacggagacgacgctcaagacgatcgaacgttcccgatgaggagtcaaggcacctggatgagcgcctcatcgatgtcattgttggtcactcattcctcctctaacacggtgactgcacggagagcttcaaggagtttgacaacgacaatatttgtggcactgtctacgttctcatgtagatgttcgtcgtgctcaccttcggcacccaaatgcccatggatcgtgatcaagtaatcccattgtgaaacccaattttacaaaaaatgtataaattaattaataaaaatgcattgcatttatgttgaaaaaaaaaaaaaaaaaaaaaaaaaaaaaaaaaaaaaaaaaaaaaaaaaaaaaaaaaaaaaaaaaaaaaaaaaaaaaaaaaaaagggggcg

SEQ ID NO: 13579 - DNA, 623 bp, Zea mays
  unsure (1)..(623): unsure at all n locations; Clone ID: LIB3279-214-Q6-K6-G4
cccagcgtccggnacgtgcatgtcaggaggtgataggatatgctgataccgatgttgctgagtttgtatacaaaaataacccctcggtcgatcagcttatgaaatttctctgcaaagatctttcngaaagcatgtgccaaggacccaccgccagttccaaaagatcgtgtccctggggaaccatttgcaaggaagccatcaaaggatgctgagatggaaaagatattgagatcaatggagggtatgccgggagccccaagcatgaaaatgtactccagggacgatctgatgaaaaataactttggtactgaagacgacgacgaggaggatgacgaagatgaggatgacaacttcccaaagaacttggggaaagctctgaaaaacaagggctctcaaaagaaagatttgaaacagcaagtcgtgcagcagttcaaggataccagcaagaagttgaaagggcatgtaaacaaggtgtccggtatggtaaagaaatggtggaaaggggcaaagaagcctgccaaatccagcaaaagcaaaattgagctctgaagcattgttgaatcacgtcagtaaatctcatccgtcttccacttctcctggagcaaagttttagatggttatcg

SEQ ID NO: 13580 - DNA, 628 bp, Zea mays
  unsure (1)..(628): unsure at all n locations; Clone ID: LIB3279-214-Q6-K6-G5
cgcccgcccgcgccananaccatgtggcgccgcgccggagccgggccgctcctccaccacctcgctgcagccgcctccgccgccgccgccggccgctgcattaatggacggccgctacctcctatgcccaccgcctcttggtcccccctgttccagcacaatcttggaatctcgtggggttccgcttctgtcggggctcccttccggagcctgtcgaaccagtcaagcggcggcggcgcgtgctggagctgcggtgcgacgggcgcgttcctctcctgcgggtcctgcgggagcgtgcagcctgtcgaccccgccgtcgactacttccaaatatttggcctaaaaagagagtataatataacggataataacttggaagggaagtacaaggactggcagaagaagttacatcctgacctagttcactcgaaatctgagaaagagaggggctatgctgcggagcagtcagcacttgtgatcgatgcataccgcacactcagcaaacctttatcaagggcattgtacttgttgaaactcgagggtatacatgtggatgaagaaaagactatcaatgatccagaacttcttatggagatgatggagatacgggaagctgtcagtgatgcca

SEQ ID NO: 13581 - DNA, 617 bp, Zea mays
  Clone ID: LIB3279-214-Q6-K6-G6
cccagcgtccgagcataatgggtatgcaagtgatcaaccatattttgatgtgcaatgaagtgtgaacctctggcaaacaaggataacaaggaacataacgtaccagtattgtgagttctatggcatatttttgcagatattgtagtggctgagataaaagcttcacttacatctgattggccacctcataatgtctattagctagttattgttggaaattatgcacactaatcaagttcacagaactctttctacagttttgcaatggcaaaagcaatataagctttgattttccttttagttgctgtcagtaacttaaatcttatataacagctagtatcagatagtgtgaagatgaaacaagcttgtagttcccttctctctgacaagcttatgctagagaagcaactccagcaagttaacacttcactggagtcatctaaactgaaaattgcccgtggcgaagagcaggtattgtcttacttctgttttgatacttcttttatatggtatcatttggtggcaagttacggtcactgaatttttttgtgtgccaacagagtcctaaaaaaagcagacatcaactttctaaaatatatttattttagtgcttacac

SEQ ID NO: 13582 - DNA, 536 bp, Zea mays
  Clone ID: LIB3279-214-Q6-K6-G7
tgctctgcgcagagaagaccacgggtcgttcgacttcgtcttcgtggacgccgacaaggacaactacctcaactaccacgagcggctgctgaagctggtgaagctgggcggcctcatcggctacgacaacacgctgtggaacggctccgtcgtgctccccgacgacgcgcccatgcgcaagtacatccgcttctaccgcgacttcgtgctcgtcctcaacaaggcgctcgccgccgacgaccgcgtcgagatctgccagctccccgtcggcgacggcgtcaccctctgccgccgcgtcaagtgaaaacatgccctggcctggcctgccccaccaccgccaccgacggcgccgccggccgcatcctcattccaatcataatagacgacccgcagcattaattatccaccggcttttttttttggctctttcttgcccctgttatctttctcctcctcttcttcttgggaattgtcgctgccgtttcgatacgtaaatcacgagatcggtaatacagtaatgctcctcaattttacaa

SEQ ID NO: 13583 - DNA, 342 bp, Zea mays
  Clone ID: LIB3279-214-Q6-K6-G8
tcgttttgttggagagctctaattgatatttaaatacccagactaagatttagtcggtaaaaaccaaacaccgaatatggattagaggattggaatattgttcacaagacaaaataaacaaaaaaattgtctgtgcctccctccctcatcaagttgctgctcaagtgctcatactatacgcttccgctcgctgctgagaggacatggctcgaggccgttctcgttgctcgcggtgcacggtacgcggtcggtggccgttactccgtcgccggcggcgttttggttcctttgtctgccgtcgttcctgtcgttctcctcttacgcctcgccgttctttcacct

SEQ ID NO: 13584 - DNA, 545 bp, Zea mays
  unsure (1)..(545): unsure at all n locations; Clone ID: LIB3279-214-Q6-K6-G9
cccagcgtccgccccgcgtccgggnaggcctaatcggggtgnactggaaatctgcttcttcaagggagcaaaggctggactgtggtgacagaagggattctacaagagtgaaaccaacagatcatgatgggagcaatgggggatcgggaaggtctttcaggcatggtcgttcaatgtctccagaagagcacaggcatcggggcaggcatgaatctcatccatcatcgagagtgtccagaagtgcagcacatatcgaggatattaactcgagaggaggtgaagcatcccggaatggagatcctgatgctttggcaacaatgaacgcaactgcagaagctcttgaagcaaaagaaaagcaaaagccatcgtttgaattgtctggaaagcttgctgaggagaccaacagagttgcaggtgtaaatctattatattcagaacccccagaggctcgaaagtcagagattagatggaggctctatgtatttaaagatggtgaaccactgaatgaaccactgtatgttcatcggatgacctgctaccttttt

SEQ ID NO: 13585 - DNA, 640 bp, Zea mays
  Clone ID: LIB3279-214-Q6-K6-H1
ccccgcgtccgccccgcgtccgttcagccctcccttccttggcttgggccacgtcgccccttctcctccccacacatccatactgaagcctcaaaatcctccgcttcactcccatcccatgccctcctctcaaccctagtccctccccatcccttactcatggcgctctcttcccacgccaccacagctgctgcggcggcggccgtcggcacctttccccaatccactcgctcctcttcccggcgattccccgcgtcgtctgtctccccccgtcctccgccgcccccgcgctccctacgcctcgaccatgccgtggcgccgtccctctcccccgccaccatgcccgcgcccgacggtctcctcgctgcagccatcgaacacctggagcgcgagccagcatccgtcgcagccgacgaggctccgctcgcggcgctgtccccgcgggagctgcagctggtgctcgtctacttcgcgcaggaggggcgcgacacctactgcgcgctcgaggtctttgactggctccggcgcgccaaccgcgtcgacggggagaccatggagctcatggccgccatcgcctgcggctggatcgagcgcctcgtggggggccggcggggacgtcgccgacgttgctgcgctgctc

SEQ ID NO: 13586 - DNA, 564 bp, Zea mays
  Clone ID: LIB3279-214-Q6-K6-H10
cccaaacatctttagctaactctgaaccaaggttgtagaaaactgccgctatcagtagccgccactgcaaaatcaagcggagtactcctacatggattagagtaagatacttagcttggccaaggagggaactccgagctaaaacttgggcaattgaatttgagaaatggatggaaccaaatttgattgagaaagaaaaggcaatacttggtttcctccaattttctcatgttcggttgatcggatgtgtaggtggcagtgcagcaagatgagacctgtctgaagaatttggaagctgaaggtgagcgttggcggaaaccaagtctccaactgcacgcaaagcacaagatttagttccctccaatgtctcatcttcaaatgtctcaaatcaatgcaaatctcgaggcgttagtaggatcattattatcctccaaatacggtgttcctagttaagcaaagtaatgggctctttgtttgcaccaatttggcgtttcgtgttagacaatttcatatcgggtgaacatttccaaattcactactgacaatgtcatatatttgtggttt

SEQ ID NO: 13587 - DNA, 648 bp, Zea mays
  Clone ID: LIB3279-214-Q6-K6-H11
gcaaaccgttccgattgtggaagcgacgtcgtcgtcgcaaatggattcgcagcgccgtgacaagacttccatccgcgcaaggcggtgtttgcccaacgcccatgctgctactggtagccggcagccgcattgatcgatcgatcgatcgattcccccctctcccacctgcctggattgaagccggcacccactcgcgtccattgcgcggcacggctcgccactcgcgtcccacctggcagtggctcagcagccagcacgacgcctcgacggtcgtgcagtgcacaagggttgggatttccgcccgccaccggcgaccacatcccccaacggccccgtcattatttcggctcatcaaacccgacctgccaagtgccaaccccgctgtccccttcgtcaaggcccagccaagatgcgcatcaaatccacagttattacagcagagctggaggagatgcgcccggtgcaccgtggactcgtgttgcctctgatctgcatctgctccggcctctggatgccatgccagtcaaccctatacccgcgtttggttctccgccgccgctgtcgcctccgcagctcgccggttcatctgccacgcgaataggctgatgacttggcaggtgagcctaccaaacacgtcaacggttacgt

SEQ ID NO: 13588 - DNA, 646 bp, Zea mays
  unsure (1)..(646): unsure at all n locations; Clone ID: LIB3279-214-Q6-K6-H2
cagaacggtggngagagaatgttggaccaactctggcgcttccgttcaacactcaagttgtcccggagaagattaattgggaagaccacattagaaagaattctgtagaatggggttggcaaatggctgtttgcaaattgtttgatgagcgccctgtgtggccaaggcaatcactttatgagcggttccttgatgataatgtgcatgtctctcaaaaccaattcaaaaggcttctgtttagagctggatactacttctctactggaccctttggaaaattttggatcagaagaggatatgaccctcgtaaagactctgagtcacaaatatatcagagaattgattttcgcatgcctcccgagctacgatatcttctaaggctgaagaattctgagtctcgaaagtgggcagatatgtgcaagcttgaaacaatgccatcacagagtttcatctacctgcaattatatgaactgaaggatgattttattcaagcagaaattcgaaaaccttcttatcaatcagtttgttcacgttctacaggatggttttctaagccaatgatcaaaaccctgaggttgcaagtgagcataaggctcctctctttattgcataatgaagaggctaaaaacttgttgaggaatgccca

SEQ ID NO: 13589 - DNA, 270 bp, Zea mays
  Clone ID: LIB3279-214-Q6-K6-H3
caccatctccacgcatcagctgaccgatgacggctggcagctagtgctaccgcgagagcgaccagcgatgggcttcttcttcttgaccttagtgacgcccccttcgggcggcgacgacccgaactgcgccttggtggccgtgcactccaaggccacctacgactagctgcgggcggcccacaggagcagcggctcgctgctggtgatcgacttctcggtgtgctggtgcgggccctgccgcttcatctagccggccttggtggagctggt

SEQ ID NO: 13590 - DNA, 597 bp, Zea mays
  Clone ID: LIB3279-214-Q6-K6-H4
gcgagcgacccacgtccacacgacacgaaccaccaccaccaaccagcagccgcaccacgcacccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgccgacggacgccgcgccgtcatgctcgcggctgctgcggcggccgtggcagccatcggcggcgccggcgccgccatggcgggccccaagaacgggacccccgaggcgaagaagaagtacgcggccatctgcgtcaccatgcccaccgccaaggtctgccacaactgagcacgcccgcgttgcatgcagctgccgggccggggggtggtatataattaatgtacgtgccacggtgttgttgtccctattgttggttcgagctttagatgcatgcctgacgtgaggccgcttaattgctttctgacggcctcggagctgtaagaatatcaagtgcactgcaaaactgaattcggttgaaaccgttcttattttatc

SEQ ID NO: 13591 - DNA, 650 bp, Zea mays
  unsure (1)..(650): unsure at all n locations; Clone ID: LIB3279-214-Q6-K6-H5
agnaaatcactttagttacatcatgatcaacatgtcgcgttaggatatcttttatctttgaaagtataatgtgttacctaactacaaggtgatcttcgtctctattagctttatgataaaaaactaatgttataattagagtcaaatgttatcattaaatgcatatagataggactgtacttgtgttggactctaggcttaacctatgtatatatatgctagcattaggatctcatattataataagtattattttaggatgaccatctgattggtgtggctacgtcgagcgcccgctacatgactgcaacattctagtggccgatgttgttgactttagtcaaatcacgattggagtagtttcccaatcggagcttgggacgatagggctcaaaaccctcacgcgcgaggtgatgggcatgctcatcgacacacccaagcatgtgacgcttggcaggtgggcaagacgtctgttagcctccacaagtctggtatgccgtcgttgatgtctatgggttatacaaggttggttgtctgttgttcacgatggagcgcacacaccgccgatagaaggatgttgtcatctattttcctgcggttgttgttagagcatctcaaatagaagtcctaaacagagttgtattttgaaa

SEQ ID NO: 13592 - DNA, 615 bp, Zea mays
  Clone ID: LIB3279-214-Q6-K6-H6
cggacgcgtgggttttgtagcttgcgcaaaccaaggttgagtgatttgtcaaggcagaaatcagtataatgataggtgtgcttgagcttttaatagctggtttatttgaacttttatctttttatgatcatgatatattgagacataaatatattacatgtacctttgcagtttttcagttggagaaaacatttaagacaacattttcatcgtttgttctccatatggggcttgtttcacgccacttgaaggaagaagggaatggtggtgttaagttcggacaatacatctacacatcttggagcatcggcatcaatgttctcaatcttctcaaatttcaaattatactggtcattactttgaccattagaataaaatccctataaaacgtggccatgcaatcactggttgtaaactgatgggcagaatgttgtaggatggattggctcaagaactaatatagcttacttatgacaatgtagtaattcatgaagttattgttccttatgttcatggagtttgttctgctaggtttttatgcttttaatttctatttccttaacgaaacctcaggcaccttaaagacagcttggatgattggtttcatgaacagct

SEQ ID NO: 13593 - DNA, 566 bp, Zea mays
  Clone ID: LIB3279-214-Q6-K6-H7
atgaagcttctgagagtttgatctgcacaacgttgtcatatctatacctctgccagcacttcgggaggctccgagtgttagacagatcgatggagagtggaagttcgactcaagaaactctgtgttggaatggtctattctccttatcgatcagtcgaatcgcagtggttccatggaatttgttgttcccccagctgacccatcatcgtttttccccatctccgttggattttctgcatcgagtactttcagtgatctgaaggttactggaattcttcctctgaaggaaggcaaccctcccaagttttctcagcgggctcgtttgctcactgctaactaccaagttgtttaacgcttgtaccgcgagtgttggtccacttgaatgctccaatagcagatgttattgccgtggacttatgcaagccatggcacgggagattattttgtgtttggaaaatttctttactatgcgcttctcattgttatagcatattgcacaaatgttgttctaatgtattgccaccagagaaataagtaatgttcttgcattttgttggcatgcccca

SEQ ID NO: 13594 - DNA, 652 bp, Zea mays
  Clone ID: LIB3279-214-Q6-K6-H8
gctatgtaaaccttgatatgtgttaattcttgttgtttttcctcttgttgtatttggtatacattcatctgaacaatttcccgtttctcctactcgctgccctcttccttgtttattcctctaatgtgttgctgccttgctgggtaacaagtgagtgcggccccatgtattttctcaccaatttgatgaattcgtacagaacttactttagtacagtaatctgttggaagggagttcctgtcttccatcaaatattctgctttttaccagggtacctggtttcatgtacccatggatgttttgtttctttcaaactttaatagcttcatataattcccaaaaaacaagttttctagcggtatctattaaataacatttctttgtgaggcgtattgctgcatgcttgtttattaagtttgctactcatgttcaaaaaggtcattcgcgaactcagtggactcattcttacacgagggcccaaactctgcaattttgttgagtggagaggttacaaggtcgtataccggaggtatgctagcctgtatttctgcatgtgcattgatgccgaggacaatgagcttgaagtccttgagatcatccatcatttcgtcgagatactggaccgctattttggcagtgtatgtgagttgga

SEQ ID NO: 13595 - DNA, 654 bp, Zea mays
  Clone ID: LIB3279-214-Q6-K6-H9
ggaccagcgcccaggacaaggggctccgcgcggccaacaactccgcaacgcccatagctaaggtagagagggttgatcgaagtgacatattgacattggatagcatcagacaagttttgattagactagaagacagcatcatatttggccttttggagagagcacagttttgttacaatgctgatacatatgatagcaatgctttccacatggatggttttggaggatctttggttgaatatatagttagagaaactgaaaagctccatgcacaggttgggagatacaagagcccagatgagcaccctttcttttccaaggatctgcctgagccccggttgccacctatgcaatacccaagggttttgcatcccattgctgattctatcaatatcaacaaagagatttggaaaatgtattttgatgaacttcttccaagattggtgaaagaaggaagtgatggtaatgctggatccagtgctctttgtgacacaacctgcttgcaggcactctccagaaggatccactatgggaagtttgtggcagaggccaagtttcaagagtcccctgaagcttacacgccagccataatagcccaagaccgtgatcaactcatgaaccttctcacatatgaaacggtggagcgtgctatcg

SEQ ID NO: 13596 - DNA, 534 bp, Zea mays
  Clone ID: LIB3279-214-Q6-N6-A1
cagccaagatatcggagccttcgacaccgacttaaccactgcaagtatcatggctggggcaaccaaccacatgagtgtcatacaagacgcaattggtgaaaagggaattgattttcctcgtccggcctcctcataacatgtcacttgcaagagtcactaactaaccaaagagaagaagtacccccaaaaaaacaaaaaaaaactgctcgatgataacagagatcttaaaagtttggcttatcctccagatgggtcacttcatgtcaaacttctccacgttcttaggtgctatcattgttgccttcgcgtgctgttgggagggcggcctgctctccctgctagttgggcctatgctcctcatggttggagcatcttactcgaaggcgatgatcagcatgtccctcgcaagaacatctttcgtgtctgaagcgaccgctatcgtagaacaggtaccggctcatcagttgtaccgcccgccttcccctccgctcctgtttggtgccttcttcatacgcgcccctcggactgttgcgc

SEQ ID NO: 13597 - DNA, 415 bp, Zea mays
  Clone ID: LIB3279-214-Q6-N6-A10
aaaaaaaacacacacgtccaatgcagccaattcatattattccgagacattaaaccaaacaaacagctttgcaaagccaccgtaacagaataccagtcaaatataggtcattctaaacaacaacgctgcaacaagggcaggtctttttttccctggaagaagcagcaggcttggagcacgaaaaccagcatccagccatcatttatcaacttgagaatcgaaacatagcatgcgggcataacatctagagggtgtgcttaattaaaaacagcggcaaaggcaatggcaatggcaggcagcttcagcgcacgcgcaccggcgccgtgacgaagagaacaacacgaggtgtactagaagataagctatcagaaatcaagaacggcacagtcctggtaaactccccgacatcagccga

SEQ ID NO: 13598 - DNA, 441 bp, Zea mays
  Clone ID: LIB3279-214-Q6-N6-A11
gagcctgggcttttatggaaaataaaatggggccaagcccacattaatccaacgggggggtcaaaaaaacgcccccccccccaggggcacaggacaaaccggaacctatcccagggggttaaaccgaaggggagaaacataaccggactttggaaggcgggaaaaaaggggggcacttggggggggggaaggccccaaaagggacaaacctgttgccgggaaacctgggggggcctttgcaataaaaaagggcggaggacccctttttgccccccccccccccctgttgaaaagggggggggggtttaaaaaccccgttaaaaaacggcccggccttgggggtttggctcaaggcataaaacccgaggcttcaagacttggaaaggggtttggcccagaactgcccccccaaccccggggtgaaaaattgggagaaccccc

SEQ ID NO: 13599 - DNA, 537 bp, Zea mays
  Clone ID: LIB3279-214-Q6-N6-A2
ggagcttacataacacttattattcatataactgataacattacaagacagaaagtacaactagacacatgattaagccttacataacataagatgagcatcatctcatacacactgacagacagaacataagagaagagtacagaacagcgacaattattggagaaaccaggaggtagatttaacacagcagcagatagtagaggccctgtaattctcaaagcagccaggtaggtagtagatgtgaatgttgttgagaggcagccaattcttcttgtcttgttgccaaccagccccagctgacagcctcagatgtatggtggtgtggttggtggaggcaatcatcagtagtggagcatgtgcggggcgccgatgggcatggcggcagccgggtagggcagctgccagggacgcagcagcgggtcgtccgccggcatctcctcctggatgtccatggcgacgccgctgaactcctcgacgaggcggagcacctcgttgacggagcggaggcggtcgccgagctcggcggcgcgggcc

SEQ ID NO: 13600 - DNA, 183 bp, Zea mays
  Clone ID: LIB3279-214-Q6-N6-A3
aattatatatttttttaattaggaagggtaaacaatatatttttaatccctaggcaaacgataatatctgataaatagaaggaatagaacaaacgtttagataacaaatgataaacaataaaaacaaactggggcgagggccaccaaatgccaaaccttaaccacaaactggaaaaaaataaa

SEQ ID NO: 13601 - DNA, 474 bp, Zea mays
  Clone ID: LIB3279-214-Q6-N6-A4
tttttttttttaaaaacatattaccgaaatcgtgttagaatggttgtaagatagtttgcgtggttggatgttagagcatctttttaacttccaaaaattttcttccaataaacgaaaatgatgacttctataaaattttaaatcttaaaaaaatgctaccaatctaataactcctaatgttttttcagaaatctaatgagcttgtttttctagacccgcaattccaatgtcacggcacacttcggcaataccaaagattcgcacatggccttcatgtgttgaaaagcactgctcatgtccttttctagttcgtcgtccactttctcctcggcccacatgaaaccttgaatgttctgaacccactcaattaaagtagctaacgaccacaccacctgaattagcatagatatcaggtaatactactactcccttctcggcgagaatctacaacatatgcaagaggcataagctcgg

SEQ ID NO: 13602 - DNA, 375 bp, Zea mays
  Clone ID: LIB3279-214-Q6-N6-A5
acctatcaatttacttaatccaatcatcgaaacagtagcaaaaacaatgaattagcttaccgcatcacaatttgattcgatgttcgcacaaacgacaacggcaaacgtcaatctagggcttcattatctacaccttgtaagctcctttttcaatctcaaactgtgattcacccttatgagctggacgagctgcacgcgacctcggcgcacagcgaaatcggcagagggagctgcacggcacggacgagatccaagcggggccagacaccatggagcttgacgacggccagacgcgacagggaagaacgcgcgcgctggagcagaagtaggaatcaggggcgcgcgagatcccggacgcgtgggcggacgcgtggg

SEQ ID NO: 13603 - DNA, 488 bp, Zea mays
  Clone ID: LIB3279-214-Q6-N6-A6
ggaacaggaaaaaaacctgccgcaattgcaaaagggacaacttttcctgactcagtttttccaccgattcctcccccaaccatttgtgaatacaaattttaaattaacaggcccatttcccttcaaaaacaatgcactgacagggtcaacaaaccaacccttttccattaacagtcagcaaaggttcctaaaggactccatacttttgatgcccatttattaatttggtccacgacgggatcatctttcatttttgggggatagcctatttgtttccaaaaaccgcttttggggccttagtccaaatcattatttacagtctgaaactgagggccaccaactttattttttccaaaccggggcaccttataattggggggattggtttttttttccttagcaacgccaaaagcgggccttaaaggcccgggcagggaaatcctaaaccttcttttggccaccctgggggaggaaaccccccgcaccgg

SEQ ID NO: 13604 - DNA, 447 bp, Zea mays
  Clone ID: LIB3279-214-Q6-N6-A7
atcaaataatcaagcctgataataatgagccatttccggaaagcacaataagtgttgagcaagagtgagactagtctccattatcatccacacaacattttgagccttttcggaaagcccaataagagttgagagccggagtgaaactagtctccatcattatctaaacaacatcccgagcctttttggaaaaggcaactagggggggaaataattattttttttgttacccgagataccaaaaaattttacttttcttcttttctcaaataacttggggctaaagggtttataggcttttggccccttaaattatatatttcttttcgcctagtcatgccgacaaagtgctcaacaacatccttggctaccttttttctttcctttcagatttttttgactttggcttcttcttagttaaatagggcccaaaaaaggcactttttt

SEQ ID NO: 13605 - DNA, 497 bp, Zea mays
  Clone ID: LIB3279-214-Q6-N6-A8
caatcataacaatgttattatatttattccgtagaatctaccattggcgcggctcgatcctaatccatgcgaaataaaacacacaataatgcaacactggccgtcccgcactgtgcgtgacagcatataaacgatgatggtcgatgaatgaccacgcgatcgagtacatacgtacgtacgtacagtgtgcttgatgagcactagtagcagctagctcctagttccgattcttgatggtggggcgagcgttgagcgtgatcttagcatttgtgcgcggcacgataacgacgtcgacggttttatcgccgtcagcgtcgatatcgaacagcacttcggtgatgcacagggagagcttcactttccgcgtcttcccggcgccggagcccggcacgacggcgaagcttccggcgtactccttgtactgtgggcctacctgcaacgctttgtccgcgggcaggttgatggcgacgtcgaacttattgttcgcctgggggtcg

SEQ ID NO: 13606 - DNA, 541 bp, Zea mays
  Clone ID: LIB3279-214-Q6-N6-A9
gctcatcaaacaagtttttatttcagactgcaaactgtagtaagcagcaacagcatgacatcagtcttgcggccagaacgcatacatccaacaacccagtatactacagacagcctacacaggccacagacacgacgggaacacagccacagctattccagcacacactagacaacacacgcaccgcaaatcctactacctcagactagcgacacttgttgacggcggcggcgccctccgagctccgagctctagtggcagaagatgaccttgagctcgcgcggcagggcgcactcgtgggtgagcgaggggctgtcgtgcgcgtaggtgaaggcctgcgggcactctcgcttgaagaactccgagtacttggaggcgcggcaagtgtgcgggctgttgtacatgttgcggcagcacagctcgtcggtgcggaaggccttccagcctgtcttgcacgccaggacgctgccggccggggagcgcaacttgagctcgccggggcaggtctcggtgaggtttttgcgggcagccgaggacgggg

SEQ ID NO: 13607 - DNA, 384 bp, Zea mays
  Clone ID: LIB3279-214-Q6-N6-B1
aaaaacaaaatcgggttttcatgaaatgtaaaggaaaccgttctgggggtacctaggccggcgggggtgcatagactggtaaaccattgggcaaaacccggcttggttttggaacaactttggagcaaaaaccggtttgggggggaaacaaaaaccctttcacctaaagaactatgcgacgctggtactacccctttcgagctttggaaccctccaaagcattggatcaaagctcactataactttttgcctttgcacccccggatgttttccccttgacggggaaaagctccggggggaaaaacaaattgctccacctggaaactttgggggggaggcttgcttaccataacccatttttggagggttttttaacttcctttt

SEQ ID NO: 13608 - DNA, 460 bp, Zea mays
  Clone ID: LIB3279-214-Q6-N6-B10
aaaaagaaaaatttttgcccccataataatgccgggttcccccagataatttacctgtggagaacataacaggggggaattttccttttttaaaaactaatttttaaccaaaacatttgccgcccagccacatttggggggcgggcccccaacagcaaccgtcccccctggggatcaaagtccccgggggtgatccctgtccataaaaacctgtcccggaaaaaaaaagggtctgatccaacgggaaccaccctggtggtggtggtgctcctttaacccccccccttttcccccaaagttgatagggcgacaagggccctccctgccccggtaacatggctgttagcgtcaaaacttggtacaaataatttactctgggagccaattactagggctgcccgctttttcttggcccccccactttctgatgctggaccctcatgggtatggccctttgggg

SEQ ID NO: 13609 - DNA, 515 bp, Zea mays
  Clone ID: LIB3279-214-Q6-N6-B11
aacgaaattcgtttcattgttaccttttctgtttctctgttacaaacgcggtgggatccctgccccttttctaacccgtcgccatgatgatccaacaacgggcgtggaatctcgtttccgcggacgcctagatgcataggcgggtaataataataactgccctgcaggttaacggcggtggcgcctgctaatgccactcctgcaacgtgcgggagacctgcggcggcggcgacggcgacgaatggttccagctctgcgtctgacggctccgcccagctgatgaagtagtccgcgacgggcgccggcggtgcgtcggcagttccggccgagtggtcgtcctggaggtcgatccagccttcctcggtgtcccagtcaggcagcgcggaggcggcgcacgccaatgccccgatcctctcggccgccgcgcccgtcgacatctcgtccgcttcgtcctcggcgtccgagtcccagaacgcgtcgtgcagcgtgctcttgggtgacgggaccacctcctg

SEQ ID NO: 13610 - DNA, 329 bp, Zea mays
  Clone ID: LIB3279-214-Q6-N6-B2
acacaacgagctctgattgctgaaaatcttctcggggaagaccaacatccaataagacacaggggccaaactggggcaggacacatcccatccacagatctagacacgggcttgctacagcacacagggcaaatgaagtccctactttttaagcctttttgggggactgggcgccctttttgggggactgcggctccttgctgccggggctggccgccttttccgccgcctttttgggcaggagcccggaggggatgttggggaggaccccccccggcgcaaaggggacccctgccaacagtttcccgagctcctaaaaattgcggatc

SEQ ID NO: 13611 - DNA, 427 bp, Zea mays
  Clone ID: LIB3279-214-Q6-N6-B3
aggatagcaaaatactattatagcttagcttgttcatagagactggaggagcatgacggctgatcacacgcgatcaactatcccaagtttttacaggcacagaactaccaccgacactcatgctggagctaccgacgaatctagagctactgacaatattacgattggatcaaaatccatgaaagaggggaatctataggcggaattgagggggggatctcgccagcgacaaggcaggcagactacttcttggccttcctggccacccccttagtggccggggcggcagcagcagcagccttctttggggttgccacctttttaggagccgccggtgcctttcccttcttggcaggagcagccgcctttttggctgccttggcgggggaggcctttggaggagatttggggaacttgggagggcgcc

SEQ ID NO: 13612 - DNA, 272 bp, Zea mays
  Clone ID: LIB3279-214-Q6-N6-B4
tcgcgatctagaactagttctagatcgcgagcggcgcccttttttttttttttttttttttagttttttttttttttttttttttttttttttttttttttttttttttaaaaaaggagggggaaaattgtatggggggcgcgggaatttcggggggggggaaacaaacagggggggaaggggggcaacgggggaattacaagaagagaaggaaaggggatagggggacaaaggggggggagtgtagagaagaggtgagagggggggggggg

SEQ ID NO: 13613 - DNA, 588 bp, Zea mays
  Clone ID: LIB3279-214-Q6-N6-B7
gaaggtaaaaatctgtataaaatatggtccaattccattcaatggcataactaggtagtatccccctctcctcatggctacatcccagccaacaaatgcatgtccacccacccaccccccaaaaaaaaatcccccagcaacaattaattcgattattgcgacacaataattggaaagctaaggtaaaaaaattgtaacagacttgtctctaccaaaaccaactaccatggtgcgaaagcagctggaatgttattacagagtccagcagtaatagcatagaacggtcaaccctgtatccgtccgatgggaatcctatatgccgatcttcttctcaaacttctggatctgattcaagaatatccaggtcatcatgacatggggtgcaatcctgacgcagtacaccgggaaaccagtgtagaacttgaatgggccaccgctcttgaaggtcttcacagcacagtccaaagaccctgtgtatgggtacttgccattagcatcaagttgcatcttctgaatctgtgtcttcacatagtcaaagggcacactgcatgctgaggccaagaatccagaaacagggctggctccaac

SEQ ID NO: 13614 - DNA, 500 bp, Zea mays
  Clone ID: LIB3279-214-Q6-N6-B8
acgaataggttttgataaataggtactcaggggaaaatacagtgtgaaccatagctagaatgccttgagttctcttaacacaaaaatcctaatccaaagtgcaaataaagtgtagccatctcaacaatcaaacatgacatcatagaaaccaaatatgagattgctcaagcttcaacagcaacccttccagccacctggtccagatcacgccttccctgggaggtgatgcgccgtccacccttgggatcgacatcaatgatgcccatctcctgcagctgctggaggatgttgcgtgaaatggcaccactgctcttgcagaagtgaggtgggcgtgagccattcctctggcggagaccataaatcttctggaagccaccaacaccaatgccttgtctcaagtagatcttccttgctacagatgcagccctgatgtagtaccagtcagggtcataaggagggagctccttgaacctcgcagtcttcacaatgtcaacccactc

SEQ ID NO: 13615 - DNA, 545 bp, Zea mays
  Clone ID: LIB3279-214-Q6-N6-C1
gaaaacatagccatacgagttaaggtagcaaataccacatagttgatattcggacgtgacactggaacctggtcgctaaactgaaaaaccaaatgcaaagggcatttgtgatgcaatcttgctactataaacaactttggaccaatcaagcgccgaacccctccacaaccacaaatgcggaaaatctcacacgaaggcagacttgatgtagagaactgaaacttgctagaccagttcccagtccccatcaatgaaggagacgccatcgtctgcgcggtccggcctaaacatgtccacgacaatgtcatccagaccaccactaagtcccctttgcagcctacctgtccccatgagttcgttgttgtagtttagatgactgctgacagcttggtgatcaatcctgccatcttgcagaggggggacaacacaaccacctgaattgctaccacccagtgtctgccctggaacaacagaaccgtctatgcgaaggttcggcaatgtagagttgacgcctgaattactaagcgcaaggttgttattcagca

SEQ ID NO: 13616 - DNA, 551 bp, Zea mays
  Clone ID: LIB3279-214-Q6-N6-C10
gcagaagcagtagtaagtttccattaatctcatattagcgtagacaactatacaactctctccagagcatcaagcaagcgaactttcaagaaacttattaagctctgcatctctcactctcaggcaatgcagcccaagcccaggcaccctccaagcaaattcctcagcagcttcttcttcttcaccttgcagagaagctgcggggagatcttgtacaggtcctcgtccacagctcccttgggcttccacttgtgctgctcgctcacgcagcgcctcctgcgtcccttcctcgccgccgccggcacagcggtttctttctcccccttcactcgaacaacgcacttcttgtagccgtagggcttggcaggcaactggggcaccttgaagagatccgcgtcgcccttctccgccggcgccgcgaagaagaaggcccctgcctggaagtactgggtgacgggcgtgtcgccgtcccacacgttccagtcgccgaacgccgggatctgccgccacttgcagtcgtcttgcgcctccatctcgctcgcagttgccga

SEQ ID NO: 13617 - DNA, 568 bp, Zea mays
  Clone ID: LIB3279-214-Q6-N6-C11
gaaacaggggaaacccatcactttatttattgcatgcatgacaaggccagactgaattggaacaatgcgttattagccacggtgctggagagtatgcctccagaacctctcgtggcggaaaaaaacagaaaattttcggttccaaaccacacaccagttttttatgggctgcacccacatcatgaggcccccgatttctaagctggcgtaagaatcttcttgctgggcttcttcgcggcgttgaactgtttcaaccacttggcagactccttcatgtagcgcgtgcagttattgttgcggtcgacgtagacaatgccataacgttcggtgaagccggcgaaccattcaaagttgtccagcagagaccaagcgaagtagccttgcacatttgatcccaagtctattgattccttaagagtagcgatgtggcgctggatgtaatctagccttttgtagtcatttaaggcatcctccatgggtagaggtgtctccttggtatcaacatccccgattccgttctccgtgatgtagataggtgggtttccgtatttggtcttcatgatcataa

SEQ ID NO: 13618 - DNA, 437 bp, Zea mays
  Clone ID: LIB3279-214-Q6-N6-C2
ggaaatctagtttcatactgaacaaacgacagtcataagccataacctcaatttccatatttcttcggttctttagagaacaggcttattgcttttctccacccactaatgacatctttttttaacggaaagggggtaaaagaaacatgaacaagaactaaacgataaccatagcacacttttctttgtctacaaaagctgactctgcaagatcgatggcccgagctagtgcagcagccttattctcgcattcacgttgttcgtcatctgggctactgtcggcaacaatgcctgcaccagcctgaaaatgagcgacccactcccgacgcctatctgcgtttttgtatgagtacatcgtgttggggctcggcgctgttgaaaataccatggtgcggaaagaaagtgcaatttgcatgtcaccatcaaacgatattcct

SEQ ID NO: 13619 - DNA, 412 bp, Zea mays
  Clone ID: LIB3279-214-Q6-N6-C3
gaaggtgggaatgcaataaatttattcaacatacataatcatgattgcttatctttacattgatgtctcgcacatacagagtatgcccaaggaaccaacttctacttccttaaatgaagaagcatctaagaaccaggtacttctacacatgacccatgtattgtattcattgttcattagtaagtagtagtatctcacatactactcattcttgaatggagatgcattttaattggcagtacactagggtgttgcataactaaattgaagttaatagtgtgtacaaaattaactattgggtaatgatgcaaaaatattaaaatattgaatactcattgggatgtaatgacaggtgaaaaggaaagatatggaatgtgagactacctggggtgaaaccaagtgtggtaccaca

SEQ ID NO: 13620 - DNA, 600 bp, Zea mays
  Clone ID: LIB3279-214-Q6-N6-C4
gaaagataatatcagaaatcttatgatatgactgatccaacacaatggagtatactgctggctaatttcagaaatcatataatgtgactgatccaacacagtgaagttgctactgggtagaagtgtagaacagaaacgtagtactttggacaccaggtatcacatgcatgatcacatcaagactagagctaatcacatgcatgatccaatcacttgaggctagtgactgcaaatctcgatcctgtatgtagacacgtacgtagcttggtgacgatggctaacaaggagtggaagcagagaccatgtcatagatgtccgacttgacgttgccgaagacgttgtcgatcagggcgaagatcaccactgataagtcgttgctcccgacgacgccgttgccgccgggcgccgcctgaacgctgacaccggagagggccaccatcctgtcgaacaccttgtcaatgtcaaaaggggtgccgccgcatgcgctcgacaccatcctgcgcacggtttggagcccctcgatgatctgcggcgccatccaccacttggcacaccctctctcggcataccacctcacccgcacaaatacaagggacacat

SEQ ID NO: 13621 - DNA, 535 bp, Zea mays
  Clone ID: LIB3279-214-Q6-N6-C5
cagtataaatacccacaataaagttatgaaatcttagatcttacaatgctcatcgacatgacactccactgcagttgagcttatcaatacaagacaaaccacaaccatgttctcgtacgcgcgcaccgaccatgccccatttggggtgcttgttcgggctccgccgccgtacccacaggcctgtcctacccccataatacaactgcgacaggtgatagcagccaacatcatcatggagttggacttgatcggctagacttgatcggctccctattgatgaactacctgtacattgtgccgactttgtcacagaggtatacttgatcggctccctattgtcgaactacccctacattgtggtaactgcatcacggagctagacttgattagctctctggtggcgaactaatagctacgttgttgttccatattgagtatctcagcaccggctactatggttagcgttgctaaaacaggttgagaacaacctaatttgttaatttaatgacattttgatgaagttttttccccacca

SEQ ID NO: 13622 - DNA, 553 bp, Zea mays
  Clone ID: LIB3279-214-Q6-N6-C7
gtgccctgcgcagtgcacatggggagcaacagctggatatacgatgcactaataatgtacaagcatgtcatgttccgacacaatcagacactaccgtctctcaagggttttgtttacacgacagaagcaagcaaacccagcacagcagcctagctatctgcctacactacacgtttgctccggcaaatctttggagcgaaatttaaatcttggcttggcaccggaggaagtaaacacacacacacacaccacgcggtaagcagtaacctatagcagccagagccagccacacacacggcggcagatcaggtgctacagcaggatgatgaccacctcgtcgacgaggctgcgccggcctggcccgagtccggcctgctgatctggatagccggaggctcggccgcggcggcaacggtctcggtgagccttcgcttcacgtccctcgccatggcgaagaagacctgctccacattctggtttgttttcgcgctcgtctcgaaaaacttgatcccgtactcgtctgcaagcttctggccttgagccatggacacca

SEQ ID NO: 13623 - DNA, 134 bp, Zea mays
  Clone ID: LIB3279-214-Q6-N6-C8
gggggggggggcccccatttttaacgatttcatgggttttttgggggaacgcccggggcatagaccttgtttaagaggatgccccggggatgctttgggaaaaacaaagtttggaattaccgggcgcggggggg

SEQ ID NO: 13624 - DNA, 475 bp, Zea mays
  Clone ID: LIB3279-214-Q6-N6-C9
agtggggttaacattcacatttttccagggggcccccaattcaagccccggcgggtttcattgggggaaaatttgaggggggtttgccccaacaggggccttataccggggctgggaatagcaagggggcccccaaaaaaaaaatttggaataactttaatccagggcatttttagcatcgggcggtgggggggcaaaacaatgccccttgggtgggttccaacaggttcaccccccttaaaaccaattggggggggggaaaactactttattttttggaaaggggagccctcccaggtgaccccccttgggggtttccaccataaccctgggagacattatttggacctttggcatgggttggtccattcgcagcagctgggaacacaaatggggggcccgttcgaactttccctaaaaaagccttatttgggggggttttttttttggctggaaaggggcggtactaaccccc

SEQ ID NO: 13625 - DNA, 602 bp, Zea mays
  Clone ID: LIB3279-214-Q6-N6-D1
caccagctagaaaaatgtgttcaaataggagtggcagaaaaataacacggtttaccagattatactgtcacaaactgttaccgaacacttaaaacaaagactagatgttccccaaaactgatgacaaagcacagctcctcagtacttgataggggcaagaatctccaactgagaccccaacttctcctcggctgccttctcggccttgacacgcagcttggccaattgcttcttcctctcgtaggcaaccttggccttctccttcctcttctcctcaagttccctgatggtgtcatggtagttccacccgacctccttagagagctcgccgaggaggcagtacttgtgtccaggctgtagcctcagaaccttaagagcgtcagggatgaccatacgcttggtcttgtcgtacggcggcgggacgccctcgtacgttttgagcctcgccagagccgcctcccccctcttggtcttgtgcggaatcatcccgcggatggtgcgccacaggatcttggcgggggcgcggaagtggatgggcccgtgggaccgctttgtgttcatccgtttgcggaggaagcggaggtactttatcttttgacgga

SEQ ID NO: 13626 - DNA, 497 bp, Zea mays
  Clone ID: LIB3279-214-Q6-N6-D10
ggagggcttcctctcctcggcggcggcgagcttgaaggaagccttgaccttgacgaggcggcccttggcggcgaagccgcgcagctgcactgccagcaccttgcggtaattgggcgggagcacgtcccggtgcttctcccccatgtgcttggcgatcgcgtacgggctcgccccgaccttcccgccgtcctgcgacaggatcgcctccttgatcatctcgaagtagggcgggtggtgcggcccggcggacttgggcttcctgctccgcggcttcctcgccttcttctccttctcggcggcgggggcggccttcttcccctcgccaccctcctcgtcgggcttcttcccctcctccggcttctccgccacctccttcgccgcctccggcgccggctcctcggagacggtgacgaccggagcaacttcctcagttacggttgccatgaccagaaatcagtgatcactctccgtcagtgtgcgtgtgacgcaagcggttg

SEQ ID NO: 13627 - DNA, 400 bp, Zea mays
  Clone ID: LIB3279-214-Q6-N6-D2
gcaactgaaaacacaaatcttgtagccgaacaagaacaaccgggatggacatacagtattttttcctgggcgggttgtctctttaggaaacaagcgcccatcggaaaagcaactaagtttctctaagccataatagctaactgcctgacgaatgccgcccaattcttcagaaagctaggactgacacaaatgccacgaaaccaagagtgacagaaaagccgtcagctatcatcttggacccccggctgtatcgcgggggcgtctgactgctcaccgatggtgacggtatcatacgtggtgtcatcggcgttggcgtctctggcgtggtgagggtcgctggaacactggagttggcgcttgcgtgtggagtgaccgccggtggcggcggcagcgatggcaa

SEQ ID NO: 13628 - DNA, 390 bp, Zea mays
  Clone ID: LIB3279-214-Q6-N6-D3
aagagcaactatttctggtgtttcaatagaaagaatggggatatgtgtttatctctctcctacatgttacacaatgtgctacagaatgacacctttaggtcgctgctacaactacagagaataaattatggattatgggtgccctgctaagttagctacatgtaaaatctggggcgattgaccccctaatgcttcatcttggagatctcactgaaatacaccttccgcacaaggcgagccttgataaagctcgtgatcttcgtgtcctgatcttcagtgcaaacagctgcaaaagaaatgattgtgccggtcaacaagagtggaaaatgtcagcagaaacacaagaacataaaatttttggtgcgcaagtaggccgacaccctttttaac

SEQ ID NO: 13629 - DNA, 545 bp, Zea mays
  Clone ID: LIB3279-214-Q6-N6-D4
ccatgataccatatcgtaactttcaattggtacacaattctagaggagatttggatcctcacgactcacaggtcccaatagagttccataaccaacccgactgagccatagcaaagcatggactcgctctcttacaggaactcatgtatcgatgttcctagaatttctacagctgagacacgaacagtgtagttcagtttcctgtgttagaattgttcatcagttgagctcgtctccttagtagctttgtcgacgatgccatcaccagcagtgtcggtgttttccaccttgtcctcctttgactctctgctttcatcatagttttcagaagaaccatccagtttcaagttccccaagttagctgacaagacctcatttgtgccgtctccatttcctttgttcccatcattttcggtagcatcttgaagccccaaattcttcaagctaagtgacacatcttcctgctgcttcttaagggtggtcctcagctcttggaaatctgagcgaagctgctctatttcattattgagtgcactcttgatgtc

SEQ ID NO: 13630 - DNA, 519 bp, Zea mays
  Clone ID: LIB3279-214-Q6-N6-D5
cttcttctcactcttctccccttccactgcttcagtggcttcctcaactttgatcttcttcgcaggaacagaagcatcagtatcctcagcatcatccttctgcctcttttttttcttctccttgacctcttcagtcacagctgtgtccggctccaccttcaccttctctggctcaggagcagctgcaatgctggcaattgaaacatcaccaccagtgggaagcaccacattccgaagccactcagttggtgtcttctcatttggcttcccatgcttgtcaagtagaccctcagcaaccagttttttcttcttgagtgccaccgggccaagtccccatttccttgggtatgtatctctgtccatcactaccctcttgatctttgaaactgcaccatggtcacaggtcgccatcacagcagtagtcatttcagctataccaatcgcgatagcctcccctttcgtcgtcatgagaaccacttcctccccggtctcaatatcattctcaaatcggagtaaccc

SEQ ID NO: 13631 - DNA, 527 bp, Zea mays
  Clone ID: LIB3279-214-Q6-N6-D6
gcccaaaataatctgaaaagcatagacgacttcgaggttcgagcagacaaaacaaagcaaatgatctgcgcgtcattgggagtacaatcatggcggcatgtattagggatagataaacgagtgatgacagaacaaagtaccaaaccatactactaaacaaaggctaaggatgtccctcagcaatggcacaaggagccagagcatcacaagttccttaaaaagactttttcccttttgtttactactacgcaggacggagagcaaaacgaggcttttaggtggtgctaggaacgctgcctccggtctggtgaagcatggcgtcgatctcgtcgccgtcctccatctccagctcatcaggggtctgctcgccgcgaagcctgcggccatcaaacaggaacgcaatggcattcatgtccacagactggcggtcacaataagcgttcatcagcttcttcagctgggtggacctctttatgcgaaaaaacacctcattgccatcctgtcccttgaccttaaggttgatgtgg

SEQ ID NO: 13632 - DNA, 440 bp, Zea mays
  Clone ID: LIB3279-214-Q6-N6-D7
ggcaacacgaatcatcagtcttttaccaagatcgcttcgggacgaagcggtgcacgaactaccacacaaaatagacttgtaaagccgtttttacactacttcgccacgccgtctaaaagcgaacaaacagcataaagttacaaattggactcctccatccctccgccgccactggggccgggcgcgagatacgcctacccgcgctcgccggggatgcggggggcgaactggatgtttttgggcatgatggtgacccccttggcgtggatggcccaaaggttggtgtcctcgaacaaaccgacgaggtaggcctcgggggcttcctggagggccaggacggggtggctctggaaccgcaaatccgtcttgaagtcctgagcgatctcacggaccaggcgctggaagggcaacttccggatgagcagctccgtgctcttctg

SEQ ID NO: 13633 - DNA, 560 bp, Zea mays
  Clone ID: LIB3279-214-Q6-N6-D8
cagggaatacagttatgcttcaaactgcaaaagcactccttttggccttgatatttttacagcaaaaaatttacaaaccctgcattggggggtaggtaacatctgctatgctagcattattttacaaaataaacgaattgctagtgctgtcgagattttcaactgccccctcaaaccaaagaaaaatgaactctcgaggagaaagttggtgcgaaggccattgcctcttctgattagtcagtgcggtgcccgtgtatgcctgccaaaaatcaggtagatcaagggaagatgtgcttgattaccagcgcccatagcaacggacacctctgtatgtgcacgagaaatggaacttcatagtgtgagccccagctgcactctgttctgttatcacatttttattcctaatctcctcatctctgcttcaagagtggggctggatgtcaatgtccggtatgccaaattccttatatcttctcgagaacagtcccttgagatccgaacaagctcccatagggcaccttcattgataatgtcttttgaatttacttcatgttgtgcca

SEQ ID NO: 13634 - DNA, 571 bp, Zea mays
  Clone ID: LIB3279-214-Q6-N6-D9
acttgcttgctatacaaaaggaacttctacagttgagccacactatccactagctcgaaccaccgttacttcgacttgaaagagcagaccacgagtccacgacagcggcggcagccaggagcaaggctgcaagaggggcagcagccttcctgatgagttcccccagcgaacctagcgaggctggtggatcacgcggggggcgctgctcttggggctgccggcgtacttggtcggcttctcggcgttcctgggtttctcccggaacccccgcggggcgtcgccgccgcccttcggggaggtcatgttcagcgccttgagcaccgaatctgtcttaagggcggcggcgacggggccctgctcgagctggtcgtcgtagaagaggtcctcgtcgtcggggaggaggccggccgcgtcgatctgctcggccatctcgtccaggtgggcgcgctcgcgggaccagtggtcgcggaaccaggcagtggtggtgatgaggtcccaccactgcggcgagaagtcctccacctgtagtagcgccgccgggatgaagagcggggcgtccgggttcagcgac

SEQ ID NO: 13635 - DNA, 593 bp, Zea mays
  Clone ID: LIB3279-214-Q6-N6-E1
catgagcttgctattgctaggacacatccccgatcatcacatagcatagcatgtgaactccaggccacctaatggtagattacttgttactagcaaatattccgaactgtatgcagcagtacgtctatcactctatcctaactcctacacatggtacatgtagaaatcttttacagaacttagctcttgcaagacacatatatggccctcgttaagggtcagaaataggcttttttatttgatacaggcaaaataagaggctcctaaaccagttctgtctgaatcttcaagctttttcatgcatcatctattgcagatacagcattgcgaaatgcttcccaggctttttcatttgacacgggcataagaagaggctcttaaaaccagttcagtctgaatcttcaagctttttgatggcatcctctattgcaggtacagcattgcaaaatgcttcccactgctccaaagtcatactgatacttttgcagatcagctagcctgttgaaatgatttcctcagatttttctttaaatcaatccaaatttcggtaggcaggggtgctgattcaaaggggtatactgaacgtaatgctt

SEQ ID NO: 13636 - DNA, 578 bp, Zea mays
  Clone ID: LIB3279-214-Q6-N6-E10
gtcaggttgaacccgtgaataactgcatgctggcccaatgcggccagaacagcaataagtagcacaaaacatatgatccagaaaagagtaaactttgtcttttctgtaaatctagaattatgtactaaacagcaaagaaatgtagggggagcggagcggacagacgagacaaatcccaaaacgttttcctattttctgtccacagccttcgcatcgcatcacaatggaggccctccgagcccgtcatcgttgtcgaactcgtgcatgtgatccaagaggtagttggcggccagctgctcgttcttgttgcaggcgaagaacacttccaggacgagtgcccggtcaaagcccatcccttcaagacgaagtatagcttcattctcctctggagtgactgcaatggtctcagttgcatctgccatctgatccagcatcatttcattctcttcgtctccctctagtggctcactaatcaaccgcataaactctgcttggttttcctggattagctgcataacccggggattttgtttcctcaatttttgaagcaatggctgccaaatttgagggttagcctg

SEQ ID NO: 13637 - DNA, 538 bp, Zea mays
  Clone ID: LIB3279-214-Q6-N6-E11
ggacaaaggatccatttgaccatttgattcagaacttgtttttctttacaaggttccaacaacattcatgaacaggacagttcgttattagccgcagtataacaaaacagtccgtcactcgtcattcagtacacagatagaaaaaaaacagttaatcataattctccaagaaaattcgatgcacttttgggcaacatcaacacgatgttttctgcatcttgttcacggagagtatgctaaaaccttaaaaaaaccccccacccagttaaaacagggcgattcaattagattgcacctgaaggaggcggtgctgtccctcctgactccagcatgaactgcgcaggcaaaatcttggccgcgcacccgaacttgtaggtactgtacttcctgtgcacgccagtgagcttgccggttccagccttctggtgaaagtctaccatcatcctcgagcactccaggagttggtcgccagtgtatctgctgtgtgactcgcaaacctttgtccactgctggcaacggttaatagcacattttgcag

SEQ ID NO: 13638 - DNA, 560 bp, Zea mays
  Clone ID: LIB3279-214-Q6-N6-E2
aaaacaaacgtctattgtgatctgagatttaaaacaggcaccatagatgcttggggcaagtacagactgcaggctaaacatcccaatccaacaacggtcgagtgccgatgaagcgaagaaactacaaactaaactgcctcactccagggacgggacgacacttgcaaggaaactactcagaagacggcactaatctactgcatctagaaagtccttcgagaaaacccggttaggccgacaacgacgagattttttccctgactgcaaacacttggacagagtttcatccgtcatacatcactcgtcaccctcctcgtcctcgtcgttcacctcggacttggacttgtcggaatcaccagacgccgtggggtctccagactgcttgttgttgtaagcgtcgatcttcttggtgtactcagccttgagcttctctgccttagacacgtagggagccttctcggcatcagacagggacttccacttgtcaccaccagccttgccaatcagggagacttgcttcacattggggtgcttctccttgtagtccttcctgaactcct

SEQ ID NO: 13639 - DNA, 289 bp, Zea mays
  Clone ID: LIB3279-214-Q6-N6-E3
ggttgcaataatacgaatattgacacaagcatgacagtaaaacgacagcaagcaaccttaattcagggatcagacattcacaatccttgggcgttcgtttcattggtgactcgcctaggataaaactaacacaggaagtttatctcccacactattccattcatctagaacccctgcttaatcctggcctcgaacctgtacttctcatcctaaaaagcttgtttaagggactcaagctctttatctaaatcattgaatgcctgggtgatagcctgcaaacgggaggact

SEQ ID NO: 13640 - DNA, 513 bp, Zea mays
  Clone ID: LIB3279-214-Q6-N6-E4
gacagtaaatttagttttttattagcagtacacgagcactaacaaaagatcaagcagccagcttttggaattggaatttggagtgttacgtggactggactctggagtaattactggcctccactccgatccccgccatgccgacgtcgtgagacctcacgacggcgacgacgtgcatgactgccggcggaaccccagcctctccttctccaggtcgtactccaccaggtagttctgctgctggaagctgccgaggatgatggccgggccgctgccctcgttcccagccccggagcctccgccgaagtcggtgacgacggcgaggcagatggccttcacggcgccgcgccccgcgaccacgaagtagttctcgaccgggagctgcatcaccgccccgccctcgaagtggaacgacagctccggcagcgccatggacctggcgccctgcggcagcgcgaagcaggggtgcaaccccagcccgtcctccgcgttcttggaccgcttgtaccgccc

SEQ ID NO: 13641 - DNA, 289 bp, Zea mays
  Clone ID: LIB3279-214-Q6-N6-E5
aacaaaaaaaaagggggttttaacttttattaaaaaattttgggtttgttttagcaaaaacccttttttttaaaacaaaaaaaaatgggtggcccaaaaatcaaaaaaaatttttttttgggagggggggggggaataaaaaaaaaaaaaggggcgccttttaaaaaaggggtcgggggggggttttcaaaaaaaaaaaagggtggctcccccccaaaaaatttaaaatgggagttaaaacaaaaaaatttttttttatttgggggggaaacgtttttggggggggtcc

SEQ ID NO: 13642 - DNA, 578 bp, Zea mays
  Clone ID: LIB3279-214-Q6-N6-E6
aaccaaagatagccacatgcaacaccattatttgttccgtttaaaccgtggcacaaaaatgtaacgtcggacaaaatttaaatatgacaacagcagacaacacaacgctcggtgacagcagcagctgggcgcccttcacttcccaccaaggcttgggaactgagcttgatcttcaatggatggagcagcagcagctgggccacgactgtatccccctccgtatccgcctttaaaaccaccacgatccccacggcccccccttccacggccacggccgccgtagtacctttctccttcagcaggtttcaggaactcgttgatgctcaccgacttcttggcacgctcatcacgctcagcattttccttcttcttatccttgtcagaacccagcttaatgaaaacttcatcattttctttcttgtttgaaagtggcatcagagaacgcagatccttgtcaacttcaactttcctctcctcagccttcaacgcaaggagggctttcctcttctcctctcttattttctcaaattcctccagaagtatctccttggcctcttccttttcttcctcctcatttg

SEQ ID NO: 13643 - DNA, 570 bp, Zea mays
  Clone ID: LIB3279-214-Q6-N6-E7
gagggaaacaaaaaatattcctcggtctgtctcattaaaaaccttataccccattacagggcccctctataaggaaaagagtacagaccagcaatgtccaaataaagtctaaatattacaaccacataaagttcatagtagcaaattctatctgcagtagcaactaaacattattgtctaatcaatgtccaaatctgcagcagcaaattcaatctcaagatcctcaagttgatgttacttccgctcttcggctctgttccaatctttaaggcaagtgattgcctccaccgtcttaggtgctagagaagacattcgttcctcaattattctcccaactatgctaaaggttgcttcagaggaaacagttgagacaggaataacaagtatatctctagcaaactgagacaagacaggaaaactatacttctggtccctccaccactcaagtaactttaccttctcaccccttagtgcgcgatcagtacctacaaagttagtggacagatagtgatttaattcagcattaggattccacctttgagatgaggcggcattttctttccccttcgc

SEQ ID NO: 13644 - DNA, 588 bp, Zea mays
  Clone ID: LIB3279-214-Q6-N6-E8
atgcaacatgccatcctgcattataattattacaaaagcgacaaacacctccaatcacacgtgaaggtggggccgagggtgagagagaagtcttattagaaggaaggaggaaaatgacgaaattaagaaataatgggacactctgtcacgtccactcatcatatatccaacgacgcgcgccggccgggcggtttactcgctgcccggaccggaggtagctttcgtgacaccggtgaagatgacgctggtgccgagcagctccttgccgacctcggcggtgaatgtgtcgtagcggaggaagagctcgacgaggaggagcctgccgaccagcaccacgaagttcttcccggggcactgcttgttgtcgacgctggggttctcggtctcacggccgttggaccagtacacgtactgcagcactttgctgccctcctcgccgaggaagcggtcgggcacgaagtccccggcggtgtcgccagaaacgcgggggtccttggtggcgcacggctggtagccgaacagcaattcgccctttctcacctgaaacaccgcgtcggggctctccaccaacaggtccttcttggcgtg

SEQ ID NO: 13645 - DNA, 446 bp, Zea mays
  Clone ID: LIB3279-214-Q6-N6-E9
gcaaaagcaatgtcatccacgaattaacgttttggaggtacaagtacaccattttgtttgattgcacatcatgcttattacaagtttgatagatgcatactctagttcgtactttaacaatgggcacggttgaaagcaaaataaaatcgagccaggaggaaaacgacatcgtgccaatgtcagcatcacagatgtcttgagctcatgcttgctccgctttcggaggacctttccacttgaagttcttagcgtaggccttaagcctcaaaaaaggtgcatggcgtttcccaaccacataattccatccatgtttttcggcaaacgcctttgctgactctgcactgtcaaacgtaagtcctgcttcaccgacattagcatatggatccccagtagatgtccattccataaacgggttcttccacttttgggttgacaaaaaataattt

SEQ ID NO: 13646 - DNA, 444 bp, Zea mays
  Clone ID: LIB3279-214-Q6-N6-F1
gccgacaaaactcactcagcattgcatgatatacccaactcgcagacagattatacacttggtggggagggaaacaaaacaaaaaaaaactaaaaacaacggggggatcggaacagcctgctgacaggccaactaacacctatggggatgcattcctcgccactaattcgactgcagttctgcaaactctcatgcccatgcaaaatggggtgaagctaggctgcacggtttaatttcgtcgtttcaggcagctaatctcagtagtagctgggaaaaaaatccttgagctggacgacaaaaaagtcgtcgtcatggccgcgggcagtgccgcggcggcttttgcatccctcctcgaggcagttttcgtccaccttgcaaaagcagccgaggtcgctgcaactgatccctaggatgacgtggccgggcgcgccctctttcccgggg

SEQ ID NO: 13647 - DNA, 604 bp, Zea mays
  Clone ID: LIB3279-214-Q6-N6-F10
tcgcgatctagaactagatcaccgcgagacgcgagtcgtcctcctctctgtcttcgctcggcgatctatcaaggagggtgagggggagatggcggagaatccgcagctgtttgggaacgggatgccggtgccgttctacggcgagatgttcgtcctcgtccgcgacggcgtcgagttccacgtcgacaagatcccgtcagctcctggaggtcatgtgaaaacaaaaggcacaatttacctgtccaatataaggatggtgtttgttgccagcaagcctgttggcaacttctttgcttttgatatgccactgttgtttgtgcatggtgagaagttcaatcagcccatatttcactgcaacaacatctctggattcgttgaaccagtcgttccagacaatcagaacagggccctgtactcaactcacaccttcaagatcttgttcaaggaaggcggctgtggtactttcgttcctctcttccttaacctgactgcatctgtgcggcgctacaatgagtttgaagcccagtctgctgctaacatggcaccgcgtgtggatcctctgcaagccgcgcaaactcctgtcgatgatatgatgcgtcatgcg

SEQ ID NO: 13648 - DNA, 556 bp, Zea mays
  Clone ID: LIB3279-214-Q6-N6-F11
gcaaaacgttgcccaggaatcatttcaattatcgaacgataagattggattacattcgaaacaacttcaagaatactactaacaatagtccaacacgtcacagacaaggaactaaacgaaataaccctaacaacaaacaggcatacacgacagcaaggagaagaggcatccagcctagcctccgaagccgtagagggttcggccctggcgcttgagcgcgtagacgacgtccatggcggtaacagtcttgcggcgtgcgtgctcggtgtaggtgacggcgtcgcggatgacgttctcgaggaagatcttgaggacgccgcgggtctcctcgtagataagccccgaaatgcgcttcacgccgcccctccgagccagcctacggatcgcgggcttggtgatgccctggatgttgtcacggagcaccttacggtggcgctttgctccgcccttgcaccagacctttgccgcccttgccgcgccccgacatcgtcgctgccggggccctgtctttcacgctctcctcgccttgaaaaatatgggggatttttttcggacg

SEQ ID NO: 13649 - DNA, 524 bp, Zea mays
  Clone ID: LIB3279-214-Q6-N6-F2
gaccaaccaaaaggcaatgaacacacaccgaaagcaacagtgtttattacacaggctgttaacacatggcgcagcagcaaatgcaagacaggatgctgcctcttttattcgactcggggctccgacgcatccgcgacccaggcaacggcgcaacgcaaggcgaggtcaagccgaggaggagggcggcgggggcaaggggatggcggcgacggtcttctggaacgcggggcgggcgacgatggcctcccaccaggccttgacgtgggggcgggcggcgacgagcccggccttgggggtcttgctgaggtagagcaggtaggacgcgtggttggcgtcggcgagcgtgaactcgtccccggcgaggtacttgttgcgggcgaggtgcgcctcgtacacgtcgagcaccttggcgagctgctccgcgtgcttgagcaccaccgccgcgtcgggggcgccgcccaggagcggcctcacgagcagctggaacaccagcggggacgcgttcgggtagaaatggtgcgact

SEQ ID NO: 13650 - DNA, 299 bp, Zea mays
  Clone ID: LIB3279-214-Q6-N6-F3
gcatggagcaattttgattcattcatgaaatggatccgtatcgtctgactgtcactcccaagccacataaataaattgcaggattacaagataccaagaggtaatagcttcggcatcaccagactcgcactcttttaactcctcatgtataaaaatagggggggggggggggggggaagtttcttggtcaactataaattgctcaattcaacatttaaactgcttttagtttgccatgccccctctggactggaataagctcaaccttaaaagcgagtgagggcccttttatctatctc

SEQ ID NO: 13651 - DNA, 195 bp, Zea mays
  Clone ID: LIB3279-214-Q6-N6-F4
ttttttttttttttttttttttttttttttttttttttttttttttttttttttttttttttttttttttgatttatttgttaggttgaaatttggagtgctgggtattatgtaagtggtggtgttgtttaggcatcggttttagggaaacccagggggagaaagggcccccggggccgggggagagagcggggc

SEQ ID NO: 13652 - DNA, 366 bp, Zea mays
  Clone ID: LIB3279-214-Q6-N6-F6
acataaaagttaaacatcactaatacatctgtgtcagtacaagggcgaaacataaaacgaactcaaacaaagtcagcacaagcttggtcgtctcttcaaacactgtaaaataaaataaagaacaaagatttcgaactgcccagttcatcaaacagccagccaacgcaggtgacacgacggttagggtggcaaagaacacgatgagatgggaaatggataagaaagatgcacaaacttgcagagatttcttagcatcctttctctgggtacgcatttctggtggtgggggccttgatccatttcaacgcgttgcagttatgcccaccaataaaacatccaccttggcgttgactctatgggggaagc

SEQ ID NO: 13653 - DNA, 397 bp, Zea mays
  Clone ID: LIB3279-214-Q6-N6-F7
aggcagcacgaagccaaacttgcgtatatgaagtgaatataaacacttatagcaacgggctttgttttcagtcccaaaaaaaaattggggattctcgacagaagtaaacgctaccccaacaccggctgagcccaaaacattaacaacgcaggtaacgagtttcagcgaattcaccaaaacctaacagaaagaaactgcttccaaacagaacggcttaaaacttagctggtgctgtacagcaaagctcatccaaatcaaccagtgttgccttagtaagcagcgaccccagaatttgtaatgtcaacgacccccattcctgtgtcttcctcctcttcactgacagcataaccattgacctctgcgttatgctccattagggaatcaatctggacgaggg

SEQ ID NO: 13654 - DNA, 484 bp, Zea mays
  Clone ID: LIB3279-214-Q6-N6-G1
gcctaacatatatgatgaatcgcttatacatgagtgtgtgtatatgatgaatctgtactgcgattatacgggaggcacgggcatggcactgcacggcacggcatgatgagatgactgacactggtgggttgtgggcgcgtaacgggacaatgaatcacatgatggcgcaggcgtaggaggggtcttcctcgcagacgatccggtagccgccgccgccgccgccgcaggggttgcaggggtacggctggggcacgtactgcggcatcgggggcggcgccggggcctcgggggccttgccgcaggagcagcagtggcagccgccgtgcccgtggtggcagcagcagtcggacggccacgccgggtacgggcacgggcacgggcacgggtacggccacgggtaggggacctccaccaccttgggcggcggcgccggcgccggggcgggctttggctcctccttcggtgctggtggcgggggcttctc

SEQ ID NO: 13655 - DNA, 590 bp, Zea mays
  Clone ID: LIB3279-214-Q6-N6-G11
gaaggattgaagggcatcattattatcagaaatcatgtaatgtgactgatccaacacagtgaagtagccatctactgggtagaacagaaaccatagtactagcagaacccaatcacatgcatgatccaacataaccaaggtagatactagtagtagctagaacggacacatcaagatttgcgctagggcagtagtaagagcactgtagcagagatccaatcacttggagacttgaggctagtgactgcaaatctgtagacacgtaggtagctaggtgacgatggctaataaggagtggaagcagagaccatgccatcgatgtccgacttgacgttgctgaagacgttgtggagcagcacgaagatcaccactgataagttgctcccgaggccgtggccggcgagcgcctgaccgtcgacaccggtgaggtccaccttcctggcgaacaccgtgcctctgtcaagaggggtgccgccgcaagcgctcgacaccatcttgcgcacgatctccagcttctccatgatctgcagcgccatccaccacttggcacaccccccctcggcagtccacctcactgactcaaataccgg

SEQ ID NO: 13656 - DNA, 432 bp, Zea mays
  Clone ID: LIB3279-214-Q6-N6-G2
aaacgggaatttcagttctcatagcattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagccaaggggtcgcgacggtgcagatgaagaactgggcccacgcgtccg

SEQ ID NO: 13657 - DNA, 96 bp, Zea mays
  Clone ID: LIB3279-214-Q6-N6-G3
aaacttaaatgcagtgctttttttttaattacttaatccttttttggaaaaattgggtattaaaatgggatttctttttccctatccatggccttt

SEQ ID NO: 13658 - DNA, 480 bp, Zea mays
  Clone ID: LIB3279-214-Q6-N6-G4
aacctggaaaaaaacttcatcggggttcagttcttttactagggtacactgcaaataacagaagttaaaaacaaacaattgtacacgttttatgtagctaaactctttaacaaaagccctggatgcgttgctgtaacttttatcttccgataaccatctaaaactttgctccaggagaagtggaagacgggtgagatttactgacgtgattcaacaatgcttcaaagctcaattttgcttttgctggatttggcaggcttttttgcccctttccaccatttttttaccataccggacaccttgtttacatgccctttcaacttcttgctggtatccttgaactgctgcacgacttgctgtttcaaatctttcagttgagagcccttggttttcagagctttccccaagttctttgggaaggtggcatcctcatcttgagcatcctcctcgtggggcggttcagacccaaattatttttta

SEQ ID NO: 13659 - DNA, 565 bp, Zea mays
  Clone ID: LIB3279-214-Q6-N6-G5
attactggtgcaatgtagctacagtaacatattccaatgtagtcatataatacattgcaacgtataagtaaaaaaaagacctactctgtactatgttactgttgcaatgtagctgcgtgagcacagggggatctgcaaggaaccgtacgaaaagacacaagcctcaccacctttggcagctgtaacagaagatcagaggctcaaagcttcttcactgtttcttccactgcacgttcatagtacctcattctctgtgtggcttccaccgcacggtcaaaatccttcctgtcaaatgcctcctggaaggaatcggaccaggtttcgagctttgccttaatctgagattggatctttttcagggtttgagaataactggcatcactgacagcttcccgtatttccatcatctccataagaagttctggatcattgatagtcttttcttcatccacatgtatacccttcgagtttcaacaagtacaatgcccttgataaagtttgcttgatgtgcggtatgcattgaacacaagtgctgacttgttccggagataaccccttttttttt

SEQ ID NO: 13660 - DNA, 376 bp, Zea mays
  Clone ID: LIB3279-214-Q6-N6-G6
aaagagggggacaccatgtacatggaatagccttaataaaactggcatgcacccgctagcaggggggggctagaattcgagcattttgacacccagcagatacaccactcgttgccaagggtacttttcccaaagggtaatcatacatagcacacacgatagcaaataaattaggaacttcacttcttccagttcttatcctaattttaattccagtaataaagggagttagatctagatgttcgccaacataacagacgatattcacaagggagtttgttggtgttgttcacacccaagtcggttgtcactgtcactttggtgaggtttatattttcacctccctaacgttgtagtgtgcaaaaggggttccaaa

SEQ ID NO: 13661 - DNA, 169 bp, Zea mays
  Clone ID: LIB3279-214-Q6-N6-G7
aagtgatatgtttaggtggttagaaagtggaggtaagggatggtaggggtgaggggttgtctggggaaagcgggggggcgtggccggggaccccacccgggggaggacgggcgggaccgggggggccagcgcccaacaaaaggggggggggaaagccccgggggccaaa

SEQ ID NO: 13662 - DNA, 430 bp, Zea mays
  Clone ID: LIB3279-214-Q6-N6-G9
ggggcaactgctacaagcaggtaactctttttattacaaaaaccccacctgaggggtcacaaaaaattccttttgacctggacccccggaaaaaacacacaccccaagtttaagcccgcccatcccccgtctaaaaaatttaaaacatgccaaaccccctggttttgccggatttttcttctaccacaaaaaaaggggggtggttcaaacccccatccggtgaaatttcccaaaaaccattttttttaaatttcggggagcaaaaaaaaccccccggttctattgccaaaaatgattggggccctttcaaaaaacccaaaaaaatccccgggctcaaaggcaattccaatgaaaaaaagtccatttggtccctcaaaaacccccaaaaaaaggccttatttctttgtaaacaaaccaaccaattgccccc

SEQ ID NO: 13663 - DNA, 540 bp, Zea mays
  Clone ID: LIB3279-214-Q6-N6-H1
aaaacagagatgtatcgtgtaatctcggtacaactttagaagttcagtcccgacagagctgtacattatatcaacaaaagtttccatcttgcctatcccctacaggctgcagtaacgcacagatttcaacagcgactgcatatgaaaacagtaacacagagaatttacatgtacgatatggactctgttcaaagtactacaacagccctgtttacaacaaacaaccagttgatacctctacttcggtcaaaaatatacaaggaaccattattatgtaccaaccggttcaccgaaattgaagcttctatgtcttgttgttcatcagggacaagcgtttgagccacacacattttttagagatctccattttgtacctgccatgagtggatatatgacgcaagggttcatcagaactctaaagcatgtgtgccatccacaatttgaatttgcggacatatagatacacaatacatggtccaatcagatctgtctcagatagtcgcttgcaaagcttaaagtaggactctaggctggcggatg

SEQ ID NO: 13664 - DNA, 537 bp, Zea mays
  Clone ID: LIB3279-214-Q6-N6-H10
gaaaccacaaatatatgacattgtcagtagtgaatttggaaatgttcacccgatatgaaattgtctaacacgaaacgccaaattggtgcaaacaaagagcccattactttgcttaactaggaacaccgtatttggaggataataatgatcctactaacgcctcgagatttgcattgatttgagacatttgaagatgagacattggagggaactaaatcttgtgctttgcgtgcagttggagacttggtttccgccaacgctcaccttcagcttccaaattcttcaaacaggtctcatcttgctgcactgccacctacacatccgatcaaccgaacatgagaaaattggaggaaaccaagtattgccttttctttctcaatcaaatttggttccatccatttctcaaattcaattgcccaagttttagctcggagttccctccttggccaagctaagtatcttactctaatccatgtaggagtactccgcttgattttgcaggggcggctactgatagcggcagttttctacaaccct

SEQ ID NO: 13665 - DNA, 362 bp, Zea mays
  Clone ID: LIB3279-214-Q6-N6-H11
ttttttttttttttttttttttttttttttttttttttttttttttttttttttttttttttttttttttttttttttttttttttttttttttttttttttttttttttttttttttttttttttttttttttttttttttttttttttggggggaaaaaaaattttaacccaaagggccggggggggggggaaaaaaaaaaaaaaaggggggaacgcgaggaaaaattaaaaaaaaaaaagggggccaaactttggggggggggaaaaaaaacgaaggagacgggggagggggggggggggggaacccggaaaaagttaaagattttggggggaaaaaaaaaacgggaaagggggggggg

SEQ ID NO: 13666 - DNA, 507 bp, Zea mays
  Clone ID: LIB3279-214-Q6-N6-H2
ggaaaatcatatgcgagttttgcagcgagcaacagcagttacgggcacaagtccaatggcagcgtggctgtcctcatcggtgtggtggggctatgattttcaatagccaaagtgccactgatgggtttgaactactaagctcctcagtacccaaaataatttaacaaataagccatctatgcagttcttacatacatgtgaaccaatcctatgtgtttagaaaactgaagctaaggaagatcacagctcaaaaaaagatacaactagccatcagaatcttcatcatcactgggctgttcgtaaatttcaaactctccatcacttgcatcagcgttgataggagcatcacataatttcttttggccgtcttcctgcaatggcaagctgcgcagtacttcttcgaggtatccattcgagaagccttcatcaaatgcataggaatcacctaaggtgaactcatgaatatcatctgccataggtggagaatcataaccctccaattcctct

SEQ ID NO: 13667 - DNA, 360 bp, Zea mays
  Clone ID: LIB3279-214-Q6-N6-H4
gataaaataagaacggtttcaaccgaattcagttttgcagggcacttgattttcttacagctccgaggccgtcagaaagcaattaagcggcctcacgtcaggcatgcatttaaagctcgaaccaacaatagggacaacaacaccggggcacgtacattaattatataccaccccccggcccggcagctgcatgcaacgcgggcgtgctcagttgtggcaaaccttggcggggggcatggtgacccaaatggccgcgtacttttttttcgccttaggggtcccgttcttggggccccccatggcggcaccggctccgccgatggcttccacgggcgccgcagaaaccgcgagcatgacggg

SEQ ID NO: 13668 - DNA, 559 bp, Zea mays
  Clone ID: LIB3279-214-Q6-N6-H5
gttaaagtactatatttcaaaatacaactctgtttaggacttctatttgagatgctctaacaacaaccgcaggaaaatagatgacaacatccttctatcggcggtgtgtgcgctccatcgtgaacaacagacaaccaaccttgtataacccatagacatcaacgacggcataccagacttgtggaggctaacagacgtcttgcccacctgccaagcgtcacatgcttgggtgtgtcgatgagcatgcccatcacctcgcgcgtgagggttttgagccctatcgtcccaagctccgattgggaaactactccaatcgtgatttgactaaagtcaacaacatcggccactagaatgttgcagtcatgtagcgggcgctcgacgtagccacaccaatcagatggtcatcctaaaataatacttattataatatgagatcctaatgctagcatatatatacataggttaagcctaaagtccaacacaagtacagtcctatctatatgcatttaatgataacatttgactttaaatatcacattagttttttatcataaagcta

SEQ ID NO: 13669 - DNA, 291 bp, Zea mays
  Clone ID: LIB3279-214-Q6-N6-H7
gggggggccccccagggggggggccctttcttttttttggggggggggaccctttgaaccccccttggggcgtttgggtttcccccgggggggggcctggggaggaaattttcccccccccaatatttctcccgggcccggggtgggcttggtcccggggggtacccttgggtgtgggggccttcgggggggcccccccctggggggccgggggttaaccacggggggggtggggggggccccccccccccctgtgggaaacctgggggggggggcctcccttcggggggg

SEQ ID NO: 13670 - DNA, 545 bp, Zea mays
  Clone ID: LIB3279-214-Q6-N6-H8
gacaaaatatccacttataacattaggaatttacatgtatgcctgagcaatcctggaaatcatgattttacttgcaacgggaacacatgcaatgtagttacacatcacgctcattctaaataacctggagtcttgaaatccataaacatgagcagagcaaatgaactcgcagtccagtgcattacagttgcttgtacaacaataacaagatagagggaaggggggcaggcatgaagaacttcattttgtagcctgagcaataatgttacttatggagctggcttcctctttagcagcttcgaccaatgaatcctgtgcagcaataagtcttgcaacattcttcttgctagattcttgaagttcaccagcgatgagaatctcatccagtatgtagtacgccttatgaaaattgaatatcaaatccaactcacatacactgccaaaatagcggtccagtatctcgacgaaatgatggatgatctcaaggacttcaagctcattgtcctcggcatcaatgcacatgcagaaatacaggctaacatacc

SEQ ID NO: 13671 - DNA, 588 bp, Zea mays
  Clone ID: LIB3279-214-Q6-N6-H9
aagcgcaactccagatgatattatgcatgttgcttgccacacatggtatattttccatcctctccccaaaactgggtacttactgatgttctggtttaatgacaggagttcggatcatcctcttcacagaaatgggtacttaccgatgttatggtttaataccaggagttcggatctggcagttttacagctacgtaaacacactcaatccagcctcttaagcaagtacgcgacctcaacctccttggttagcggcatgattctatagctgtacagctcggcgaccaagctcggcctgattttgtagaccggtgggctgccgttgtccttagcaccaatgttcacctcttgcccgaagatcttggctttggcctccaccctgtgttcgatagcacgctccaccgtttcatatgtgagaaggttcatgagttgatcacggtcttgggctattatggctggcgtgtaagcttcaggggactcttgaaacttggcctctgccacaaacttcccatagtggatccttctggagagtgcctgcaagcaggttgtgtcacaaagagcactggatccagcattaccatcactttc

SEQ ID NO: 13672 - DNA, 653 bp, Zea mays
  unsure (1)..(653): unsure at all n locations; Clone ID: LIB3279-219-Q1-K6-A1
cccgggnncgnacccacgccgtccgcccacgccgtccgtaccaaatccgngcagnaagccaacatctctacgacatacatgcccttgttgtcatcagaagatttgccgaaggaataatcaagatcacaaaggttaactgtttcattaagggtgnttgaaaaaaaagacttgtctgaattagaacaatttcatatatgataaattgtaacaacctgacaggatttttcgtttggagccaagagttagcagctatcattttagcagccgttacggcgggacttgtggctgtcaccttgttcaaatgttgaatcacagattgagcactagttcaaatgttgaatcacagatttttggagatcgagctggattcggggccagacgccaaggaacattgcaccaacattatacatgaaagccaagaggaagaatatctcggtggcccttagaaacaatcgatggatgcacttctgctctccttacactcaagatagagaaataaaagaattcatctccctctggcagggtatcaataacacacatgaactcaatgatcttgatgatactattttatggaggtggacggctgatgggaaatacagcacaagtagcgcctacaaaattcagttcaccacggaacttttgtaaaatgaaaa

SEQ ID NO: 13673 - DNA, 620 bp, Zea mays
  Clone ID: LIB3279-219-Q1-K6-A10
ctttttgcttgattgttccaggtattcgcagtcgaccgtgtcctcggagcacgatgaaggttgttgctgcctacctgcttgctgtcctcgctgggaatgccagcccctccgctgaggatttgactggcattctggagtcagttggctgtgaagttgacaatgaaaggatggaactgctgctgtcccaactgagcggtaaggacatcaccgagctcattgccgcgggcagagagaagtttgcttcagtcccatgtggcggcggcggtgtggctgttgcggcaggtgcacctgctgctggcggagctgctcctgcagctgaggcaaagaaagaagagaaggtggaagagaaggaagaaagcgatgatgatatgggcttcagcctcttcgactaggttgcacagtcatcacagtattgtttcgggcagtgaaatcaaagggaaaccagagtcatgtttagattttaaccttattttatgttggaaagtactgcaaagactgctaattgtctctgtatttggtaattcagctgtagattgctatgatggttgggatttactcgtgaaccagagtttttctatcttatatcctgaattggttatcccaaagttttctggcttttt

SEQ ID NO: 13674 - DNA, 577 bp, Zea mays
  unsure (1)..(577): unsure at all n locations; Clone ID: LIB3279-219-Q1-K6-A11
cggacgcgtgggcgcgccgccgcgcagctcatcaagacgattgtcggggtggtgcaggggtgccactcgcttggcgtcatgcaccgggacctgaaaccggagaacttcctcttcgcgagcacccctgaggatgccccgctcaaggccactgattttgggctttccgtgttctacaagcccggtgataaattttctgacgttgttgggagcccctattatgttgcccctgaggtgcttcaaaaatgttatggcccanaatctgatgtatggagtgctggagtgattntgtacattttgctatgtggtgtacccccattttgggcagagagtgaagcanggatcttcaggcanattttgcnaggcaaacttgatttggaatctgaaccatggccaagtatctctgatagtgctaatgatttattccgtaagatgcttatccnctatcctacaaagaggttcactgctcatgagggtntatgtcatccatggatnngtgatgatgctgtcncacctgataagcctatttattctgctgntttgccaaggctgaaaaactttnctgcaatgaacaagctca

SEQ ID NO: 13675 - DNA, 590 bp, Zea mays
  unsure (1)..(590): unsure at all n locations; Clone ID: LIB3279-219-Q1-K6-A12
gtaactcaccgttttctggggtctcttatgatctcgcgaactgtgttgccgttttgtagttcgtaccatcttaaattttagggttatttggtttctttagacttagcttttaggacccgtttagtttgtgctactaaagagtagtcccttcgttttagtcccatttagcatataaattgccaaatgatatgactaaaatagcgactaaactgctttagactctggtctcattaagggtgactaaaagagactaaaggaaataattaggttttagcgatttagagactaaagtggagtaaaatagatggactaaaaaatagttactagaaaccaaacaccttatttgcctgccagacgcagttgtgtggaaattgttatgaaagataagcagttgctgactgctttccaaccggcgtcctccaagagatgtgcccctgcatgatccccatgtatggacgtggctttnggtctactccttttggtgtctcctctgcttgtttaaatatcaaaagtnataaagaatgtagngcccctttttcatttttcgcacaacagtttctatttctcacatgttatcaacacttgctttt

SEQ ID NO: 13676 - DNA, 358 bp, Zea mays
  unsure (1)..(358): unsure at all n locations; Clone ID: LIB3279-219-Q1-K6-A2
caagccagcgctgctggaaggaaattggntgggaacccagtggtcgctgtctgctatgcggaggacaagtttgccaatggggaatatgatggatgaaaatcttatccctcttgaactatagcagtagccggnctttgcctttggctctatgctacctgcttgtttaattgcaacaaagatgaacggtctctcatttaagctgaacctctacctgtattgatatccctggattttttctgagccaccacctgttgtgatttgtgaacgttgtaagaataggtttctttgcttgggttcgcttgttgctgtcgaaaatatgtaacgaatgttattaataaagaatttcttgtatgacttt

SEQ ID NO: 13677 - DNA, 550 bp, Zea mays
  unsure (1)..(550): unsure at all n locations; Clone ID: LIB3279-219-Q1-K6-A3
cccggtcgcccacctccgtccctncacaaaccccgcctccaggcagccagaaacacaatccacacagtctccgtgaggtctgagcgaggtaggactagctctgagcgagttcttccgtcttccaggtataatccttgcaactctcactatcctcttcgcatcgctcgtctctttttgagaccagttggatttctcttctttttccttggatcctactacctaatagaacagagctccggagccttttagtttctggtctctgatctactcattttcttttcttccccttttggtgacataggtaggtctagttaagatctgtcgtgccagttctttgattttagctaagaaccaggcgatttagtcttcttcttccttacaaaaaaaatccccagaaaaaaaagttgtgagtagtatattcttgtaccatttgatggccgctgctataaatctccccgggcccagcgaggatctgatgcgagcgatggagtccttcatgcaagacgacgccccatcccctcttgccatgccgccggcgccgtctttccca

SEQ ID NO: 13678 - DNA, 532 bp, Zea mays
  Clone ID: LIB3279-219-Q1-K6-A5
gttgtgagggaagacaactccttccttgtgaagcagttcggcaacggcaatgccaaggtgcagttcaccaaggagccgaacaacctctacaacatccactccttcaaacactcgggtttggcgaacaagaagactgtgacgatccagccagctgcaaaggactcggctgtggtcctctctactaccaagaccaagaagcagaacgcacctgcgaagctcagccacaagtctgtgatgcgcaaggagttccgcaagatggccaaggctgtgaaaaaccaggttagtgacaactactacaggcctgatctgaccaagccagctcttgctaggctaagctcggtgtaccgcagcctccaggttgccaagtccggtgtcaagaagaagaacaggcagtcctaagcgctaagtttgtgttctgtcagggggcatgttggtgctcgtagtcccagcttatatttatctatgttccaacagttgagacttgttagaactgagcaaaccatgttaagatgctgctgtgtgtcattcctta

SEQ ID NO: 13679 - DNA, 644 bp, Zea mays
  unsure (1)..(644): unsure at all n locations; Clone ID: LIB3279-219-Q1-K6-A6
ttttgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtagggacttcatttgcactgtgtgctgtagcatgctcgtgtctagatctgtggatgggatgtgtcctgctctagtttcgnccttgtgtcttattgtatgttcgtct

SEQ ID NO: 13680 - DNA, 494 bp, Zea mays
  Clone ID: LIB3279-219-Q1-K6-A7
ggctgctcaagcagcagttcgagaggaccgtctcggcgggagggatcatgttcaacgacaccggcatccacctgacaaacccgaacctgccgttcggaggagtcggggagagcggcatgggcgcctaccacggcgccttcagcttcgacgccttctcccacaggaaggccgtcctggaccgcagcttcctcggcgaggccagggccaggtacccgccgtacacgccggcgaagctcgccatcctcaggggcgtgctcaatggcagcccgcttgccacggttcaggcggctgcggggtgtacaggaggggcatcagctgactgactgactgaccccccttcatgcttattattaataataagcataaatattcaccgcatacacattgctgtgcttttattaaggttgttgtgagctcgaaaaatgtattgaccctttgcgtgtgcgcgtgcgtgtatagcaactattaataaaagaaaaaagtgatgttcattt

SEQ ID NO: 13681 - DNA, 654 bp, Zea mays
  Clone ID: LIB3279-219-Q1-K6-A8
gtttactgcagcaacctcaaggatctacaagacaagaaattcactgtccttactgtagagttaaaatgaattcaactctccccgagaagaacacaaaaatttctgatgtgagaaaagacagttctgcacagaaaggaagcaagcctgacaaagttgcactggtctgttttgacatggaaggaacataccaaccagatctcgaattaatttcttgccattgtggcccttgcaagggacagaaatttttgttcaatgaatgggagcggcatgctggctgtagaagtaaaaattggagatccagtattaagcttaagggctcgttgatgccatttgggaaatggatagatcgacatcagccaggcgtgtgccctactaatcctccaaaacgctcatctcagaaaatgaagaaacagaagttaattgatttactaaatgacccatatgatcctgtaaatgtaaaatggacgacagaaagatgtgcagtctgtagatgggttgaagattgggattacaacaaaattgtgatttgtaatagatgtcagatagcagttcatcaggaatgttatggtgtgaggggtaagcaagactttacttcatgggtttgtcgggcttgtgaaaaacctgagcaaaagaggagtgctgtctttgccctgt

SEQ ID NO: 13682 - DNA, 594 bp, Zea mays
  Clone ID: LIB3279-219-Q1-K6-A9
ttttcgcgtccgcggccgcgtgggttttgtcaccgctggagatgatgagaatgagctcatcttagcaagtgtactacatggtttttctgattctgttggtcttctactcaggggtgatgttgagaagcggactgcgcttgagaacttggatttgatacttctctgcattgatgaaattgtagatgggggaatcatcctggaaacagatgcaaacaccattgctggtaaggttgcaaccaatgctgttgatggttctgtgcccttttctgagcagacgatatctcaggcactagccacagctagggagcaccttgcaagatctttactgaaatgaacaaccagcaatatgtatgacatatatgtgtgttaaaggttgggctactgaatgttaagggtctttgtagtcgttattcatcccaaagtgctgctgtgacagagcctagttgaatatccgagggattggtcacatgctcgttatttttttttgaaccagtgagtttgtagctgccatatttcaggtaaaacataaaataaagagttgtaattgggtgtaatataattttcaccatacaaaaaaaaatcatctcaactatc

SEQ ID NO: 13683 - DNA, 470 bp, Zea mays
  unsure (1)..(470): unsure at all n locations; Clone ID: LIB3279-219-Q1-K6-B10
ctaattgctgctggtagaacatttgagagcagtcctgcatcagaaaggctgcagctttctgttatcaaaagagcttccttccggtggctggggagaaagctatttatcgtctcaagaccaggtttacaccaatctcaaaggcaaccgagctcatgcagcgaacactggttgggccatgctggcgctgattgatgcaggacaggcccagagagatcccgcgcctctacaccgagcagcaagggttttgataaacttgcagtcagaggacggagaatttccccagcaagagatcataggagtgttcaacaagaactgcatgatcagttactcccagtacaggaacaccttcccgatctgggctctgggagagtaccggtgccgagtcctgggggctgctggcaagcggtagtgacccggcctggccccgtcaacttgactgaaaggcgctttgttgtcttggcgtnctatct

SEQ ID NO: 13684 - DNA, 602 bp, Zea mays
  unsure (1)..(602): unsure at all n locations; Clone ID: LIB3279-219-Q1-K6-B11
gggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccattcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctaccgnggtggtggcggcggctacggcggtggcaaccgtggcggcggcttccgcaactccgacgggaactggaggaactgagcggtggggcccccgcgggccaagtatcctgttcgcttccgggtt

SEQ ID NO: 13685 - DNA, 634 bp, Zea mays
  Clone ID: LIB3279-219-Q1-K6-B12
gcaccgcagcagcgccatgaacgccgtcgaaccctccgccgccgccatcgccgaagaccccattactccggccgcctccgcagccccgtaccctggccgcctccgcgaagcacttaccgccctttccgaggcttgcgagtccggcaacttcaatgcttccgaaaccgcctccttcaccatctccgacattcttgacaccgcagccggcgtaagtggcgagctcgatgacgggagcgacgacagccaagacgcgtcgaggtcaggggcctccgaagtgctgcttcgcgaggtgctcgagttcctctctcgcccgtcatcgatctcgaaccagatggcccttgacgcgctctcgcttgtgcttcccaaacccgtggcgaagctaggggctcgaatggggagatgccgggatgttgccgcagctatcctaaagttcttcgtgacgaattgcaatccgagggacatgctctccatcctctgtgaggcattagatgcaccaatggagctaccaaatggcttatccagttttgttcttctactcgatgcacttgctaaagtgtttactttaattcagaggcgacatatcgagcaagtaaaggtggcactgcccgttgtacttaaagttatgcatgctact

SEQ ID NO: 13686 - DNA, 491 bp, Zea mays
  Clone ID: LIB3279-219-Q1-K6-B2
cttttatcgggttcttgattgggctcgtgcgtcttggagtgaacgtgaagaacttcccgtccttgccgggaccggccgcatttgcctcagttttccatgctggaataggagcagtcttgctgctctacgttctcttctggctcaagttggaccttttcacaactctgaagtaccttggcttcctcggcatcttcctcgtgtttgtgggccataggaccctgtcctacctttcctcggcgtcagcaaaacagaagacggcatgagtggacagtgcaagcagagctttcccgatcatcaattcgttttttgaggtggccattccaggtcactgggtgtctttgcttggtactctgaccgcaccctagtttttctttagctaacatgcattttgagggaggactcggtttatttcagttggctttgacgaatactgatactaggacaagtaacaggacctcacatcagtttctgaatagaatggatgtttaatc

SEQ ID NO: 13687 - DNA, 520 bp, Zea mays
  unsure (1)..(520): unsure at all n locations; Clone ID: LIB3279-219-Q1-K6-B3
gngggcctacttccgcctggccgcgccgagtccgctcccccgcttcctgatactcctgctcgccgtaacctcctccgcgtttgccgccgccgcggcaaccggggctccggtggtgggggaggactacgtccgtccgccgccggcgcggtgccaccgcaaggcactccttagcctcttcccttggagcaagaaggaggagtccgccgcctcctccgatccgcagcaggtgcacatttctctagctggagaaaagcacatgagaataacatgggttaccaatgataactctgtcccatctgtggtggactatggaactaaagaaagtacatacacaatgaaatctcaaggagaaagcacatcctacagctacttattgtatagttcaggaaaaattcatcatgttgtcatcggacctcttgaagataacactatttattactaccgatgtggagggcagggtccagaattccaatttaagaccccgccctcccaatttcctttgtcattggctgttgttggt

SEQ ID NO: 13688 - DNA, 500 bp, Zea mays
  unsure (1)..(500): unsure at all n locations; Clone ID: LIB3279-219-Q1-K6-B4
cggncgcgtggggatctttgtcgttaaggagcccgtagtcgcggcctcctgcctcatcgctggattcggtctctttcttccagcagttgtccggccaatcctggattcatggcagaccgcggaacaagttcctccacctcttctaaatgatccatgttcttgatgaaggtgatgaggagcacaggaaaccacagaacccagcaaccccctttggtttcccacgctcctcatcggcgtcagcaactattcgatcacatcccctatttcaaactttactcggtggttgcaggtgtcaccggccagaaaaagtagtgaacttgcattgttttctcatgccaatgttgccccacattttcttccccgtgttttttctggcgaccagattggaaggcttttcccaagagtcacggtcttgaactctagatggtntccgcggaataatcattgtacctgaatcattttctgcaatgtggcagttttgaaaatgtttccccttctac

SEQ ID NO: 13689 - DNA, 579 bp, Zea mays
  Clone ID: LIB3279-219-Q1-K6-B5
caccaagcaagcaggccgcaggcgtctcacaggctctccgccgtcccccaacgcgctttccccggcgccatggccaggctggcgctggtgctcctcctgctgctggccgtggcggcgtccgcgtgggccggcgccggcgcgagccacctcgatctgggcttgggcttcctctcctccggggaccgccggcgggagtgccgcggcacggtggccgagtgcctggacgagtcagagggcctggacctgggggcggggcccgcgtccgtggagtcccaccgccgcgcgctctacggcggcggcgggtacatcagctacggcgcgctgcggcgggacaacgtgccctgctcccgccgcggcgccagctactacaactgccgccccgggggccaggccaacccctaccaccgcggctgctcccgcatcacccgctgccgcggctgagcggatccggcattccacccgcccgccgagaataagttcttttgccctgttcaccccacccgagtgctaccgctaccgccgccgctgttcacaagtagttctagagctatggattttcattgttgtatgggggggttt

SEQ ID NO: 13690 - DNA, 628 bp, Zea mays
  Clone ID: LIB3279-219-Q1-K6-B6
tgtttatcgcgacctcggcgggtagattcgccgccgcccacagcccacccggtcgctggggcctccccgtcgtcgccggtcgctcgacattcgccgtgccggtccgcgcttccgatccccagcgcttccccgagtcgctgcgtgctcgcgtttccccgagccaagggtcgaaggtcgattcagcgccgtcctcaccggagcttgtccacgcccccttgtcccttcgcgcccgctccttcgccggagaccaccacgctgtccttgagcccgtcttctcgggaaacggcgcttgacgccctgcaagcgggacgaccccgtcccgcatctacggtgaatattcgcctgtgggacgagcccatcccacttctcctcacatccaaccaaacgccagcgagaagaggaccgtcccgtcccgttacggttcgtctctccacccctagttccccaaaccggggcatcgattcatcgaaccctgcccggagacgcgagcaatcatagacaggcatggcgatcgctcggaccggcgtgtacgtcgacgactacctcgagtactcgagcaccctggccggcgacctgcaaagtttctctccaccatgcgcgagctcgatgacagggcacatggcattat

SEQ ID NO: 13691 - DNA, 587 bp, Zea mays
  unsure (1)..(587): unsure at all n locations; Clone ID: LIB3279-219-Q1-K6-B8
cgcccagcgtccgttccgcgtccggggcgntcaccttcaccgccccctnanggggttcaccttcnnngnggtccgttcgccttcaccacccctnnaaaaggcttcaccccctcagaaagtgtcncctcctgctgaatcannctgcctctgcctcgcccatnnntcaagggctggggatgaggctcnctngnnngagatctccggaaaccccggcgacccggcgattgtggngctctcactggaccgannggnnaacccccctcgnggctctggatatatngaatncaagaagagagcngntgcngagaaggctcttcttcacatggntggnggtcancttgntggaaatattgttaagttgttatttattcttcatcctcgccaangggctgcttcacctgtttaagctccnccccctcctccaatattatattctcttttttttgnaaaaggtgttatccttgctttttttttttttttagcagcgtcctaaggaatcaatctcccnnnggggccccgctttncctcttctgtttttttctccaactcnataggctgtattccccatgcntccacctgtcccttcc

SEQ ID NO: 13692 - DNA, 604 bp, Zea mays
  unsure (1)..(604): unsure at all n locations; Clone ID: LIB3279-219-Q1-K6-B9
ctccgccgtcggagctagccggcggggttgttcgcccggctcgtgaggaaggcggcggtggggcgtttcggcgcgtcgtggctcgcggcggcggtggcctgtgctcgcgcgcacgccaacggcggtggcattgctgtgctccaacgcgtggccgaccggtttggtaagcatggcggtggtggtgacgaacaacagggcgagagcggagctggcgtggctgcagtggcgggagcaggtgccccggagttagctgatggcttgctcgcggcggcggtgtggctcacgcgcctgctcttccgtcgagatagtggcatccccggcaatcgctcttgaggctggctcgcggcgccgctcgcgtgttcgctgcgtgcgcggcaacacacgcggggaggagtgggctatgtgggctttggtcggcggcggatatggcattgncggcggatctaggccccatcggcctagatatggcccaccctcaactgatctacgccttggcgatggttgtcattgcggggtgcatgttggngcgcaacggatgcggtgcgcccggcgacagctggtttcgatgttccttgtgccagggccagtggcggtagctcaagct

SEQ ID NO: 13693 - DNA, 615 bp, Zea mays
  unsure (1)..(615): unsure at all n locations; Clone ID: LIB3279-219-Q1-K6-C1
gntttctgcaccatggccgattttcggttgcatctgtatatgctccaatttccttccctccacttcctctaatagttttgaagaacagagatggcgagcaacctgccattgctgctgtaggttcgttaaaaatgtggatccagaccggatcattctgaagaaaatggttctgaccgggtatccacagagagtctcgaaactgaaatcgatcgtgcggtatatgttccacaatcccgacgacgtaaaatggttcaagcctgttgagttgtggacaaaacatggtcgtcgtggccgcatcaaggagactgttggtactcatggtgccatgaaatgcttattcaatagcagcattcagcagcatgatactgtgtgcatgagcttgtacaagcgcgcgtatccgaaatggcctgaacagctctaccacgtataagattgcttgacgtttggctggatatgtaccagcaggcagaagcagaacgacgggaatgaaacagccttggagcttgcgtgccgtttagcttaaactaaatattttaggattagngaaaagttttgttggtcgcctgagctaggaggccgaattttgtattggtccttcatatacttttgaacatt

SEQ ID NO: 13694 - DNA, 645 bp, Zea mays
  unsure (1)..(645): unsure at all n locations; Clone ID: LIB3279-219-Q1-K6-C10
tccacgcgtccgtgttaataatgcatatttttaaaactagatgagtctgattatgcatagaagagataagacttattttatcgtggttgttagacgagacatggtggacaaatatatctgtacgtgacgcacgacacacgaagcttgagctgagctgagactcaaataagatcattaacctctccgtgctattatcgaccccaaacatcttgtttgacttggatcccgaaggaattcgtactgttatcaccaccaaacatcttgtttgacttcgctttgttgctgaagcgtccccaatcctctgggactcaaatgtgatacaattactagtctcaggaggctagtaaacacatttatacatcagatgatttcagatctgcttaaacgagacaaacctataaaggtggcgatcaactttaagagttggtccacaactcgggacatatcatcagagtggggctgaagcagctcgatatacgcagcgaagcaaatcagcggtccaacagccacaggcaaggttgggaacagtcgtaactcttactcgatctccttttttctgaaaacaacaaataagcaagggtgagtacaaacgtactcagcagcccaccttcacccacggnaatggggaaatcagatataatgcat

SEQ ID NO: 13695 - DNA, 598 bp, Zea mays
  unsure (1)..(598): unsure at all n locations; Clone ID: LIB3279-219-Q1-K6-C11
ggcgaaaaggggaaaagaagccagcgagagagacggaaaggggaagatgagccggagcctggggatcccggtgaagttgctccatgaggcagcgggtcacgtggtgacggtggagctcaagaccggcgaagtgtaccgggggtcattggtcgagtgcgaggataactggaattgccagctcgagaacataaccttcactgccaaggatgggaaggtttcgcagctggagcacgtcttcatcagaggaagcagagtgagatttatgattatacctgatatgctcaagaacgctcccatgttcaagcgcttggaagcgaggattaggggcaaaggatcagctattggagttggtcgtggacgtgctgttgcaatgcgtgctcgggctgctgctggtcgtggtggtggtcctgttggacgaggtagcgcgcctcctgtgaggaggtagattctaaatggcggcttttctcgtctggctgaggttgttgtctgatctcaggacgctgtctcgtagtaaaaactgtcctaatgtaaaattcaacggcttaaaggagtatgcaacctgtgattgaatgtaatgtattgactgtatttggtngct

SEQ ID NO: 13696 - DNA, 563 bp, Zea mays
  unsure (1)..(563): unsure at all n locations; Clone ID: LIB3279-219-Q1-K6-C12
ccccgcgtccgggaggagaaccggcgggctctccgtgagctcctgttctgctgccctggtgccctccagtacatcagcggtgtgatcctcttcgaggagaccctctaccagaagaccaaggatggcaagccttttgtcgatgtcctcaaggagggaggcgtcctccctggcatcaaggtcgacaagggcaccattgaggttgttggcaccgacaaggagaccaccacccatggccacgatgacctcggcaagcgctgcgctaagtactacgaggccggtgcccgctttgccaagtggcgtgctgttctcaagattggccccaacgagccgncacagcttgccattgacctgaatgctcagggtctggctcgctacgccatcatctgccatgataacggnctggtgccaattgttgagcctgagatccttgttgatggccctcatgacattgatcgctgcgcttacgtcactgagacaggccttgctgcctgctacaaggctctcaacgagcaccatgtcctcctggatggtaccctncttgaagcccaacatggggacttctg

SEQ ID NO: 13697 - DNA, 642 bp, Zea mays
  unsure (1)..(642): unsure at all n locations; Clone ID: LIB3279-219-Q1-K6-C2
cgcgtgctgggnagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtggaggaacgggctctgggcttggttctctcctcctggagcgcctgtctgttgactatggcaagaagtccaagctcggtttcaccgtgtacccatccccccaggtgtccacatccgtggttgagccatacaacagtgtcctgtccacccactctctcctcgagcacactgatgttgctgtcctgctcgacaatgaggccatctatgacatctgccgccgctcccttgacattgagcgcccaacctacaccaacctcaacaggcttgtgt

SEQ ID NO: 13698 - DNA, 639 bp, Zea mays
  Clone ID: LIB3279-219-Q1-K6-C3
ccccgcgtccgccccgcgtccgacgctcatcacttcgctccaagccagtgctagcccggccccttgtgtacgtgagagacggcatcgtaccgtagagcagcacatccatggctcagggaagtggcagtgctcgtggcagcggcgccgccgccgcgcttgcgctggtcctcctctgcgtgctcctccacggcgagctggccgagtcggcggtgtacacggtcggcgaccgcggcgggtggagcttcaacagcgccaactggcccaagggcaagcggttccgcgccggcgacgtgctcgcgttcaggtacaacgccaaggcgcacaacgtggtgcccgtgagcgcggcggggtacaggtcgtgcagcgcgcccaagggcgtgagggcgctcaccaccgggaacgaccgcgtcacgctgaagcgcggcgccaactacttcatctgcagcttcccaggccactgccaggccggcatgaagatcgctgtcaccgccgcgtgaggcccccggccgatcagccgcgccggcgacgacgaccgccggacacacgggctcgatcggtggccagcttattattatttttatttccctctccaaagtaaaagcgtcgcgtccttaacctgcgtgttggtaggcggtgtta

SEQ ID NO: 13699 - DNA, 537 bp, Zea mays
  unsure (1)..(537): unsure at all n locations; Clone ID: LIB3279-219-Q1-K6-C4
ctttttnnnnnnnnnnnnnnnnnnncnnnnnnnttttttttttttttttttttagatgggaacagagacgaaacagtttttttcccccagaggggaaacttgtcgcccaacataagagggtccaagtcaaattaaaacattgcagtcgcagcaacatattgatgcctacctagggtggtttgacctgtcaaagctgacgtgcattttttttcctattataacacttattaacaccttttcctttcctaacagaaattaacacgaattgacccaacgaactacttgatgggtactgaaaaaagagaaccttttgggcgcacgaccctttttttctgccagtcgggagttataccgcgccaagctttgaaagggtggaaccgggctggtactttggcttggatcctttggcgaccaggcttgggaaccctttcctgggttttttgggctttttgggaagtactctgaaactctggtcttgcttttcccgaagaaaattcagtccaagggcaagtcgtactcgatcgggttgggctggga

SEQ ID NO: 13700 - DNA, 616 bp, Zea mays
  Clone ID: LIB3279-219-Q1-K6-C5
cggccgcgtggggcacgccccagttctgtcccccccgacatcctcgcccatcgagccgcgcacgccccatgtcgcgcttccccaccacgcccgccgcacacgccgcaaaccgtcgatggaaggtgagcggggcgtggccgcccctggcatggcgctatcaaaataggccctccgcgcacgcctcgctccatcaatggaaggctccatcaatggaagttttacagattgtcttgtcctactgcctactatctgccttgaggaagtaccaaggggtttccgttctgtcttcagtggtgcaaacaaaattggtgatggtggttttggttctgtcttcagtgacgcaaataacgactttgtgctactatgctgaggaacaagctttgtgacttattttggatttgagcagcacggtcataacattgctgttctatttcattcatatgttcgggtgaatcttttctctagcaagatgccaagaaagatgatcctctatgttcactacatcttgcactatgtcctgcgtgttaccggccaaacaaaacaccttggagtgcagcgacgacaggaactacctctacaggaaccggtttaacgagtaatttgacgacgcgtgggt

SEQ ID NO: 13701 - DNA, 642 bp, Zea mays
  unsure (1)..(642): unsure at all n locations; Clone ID: LIB3279-219-Q1-K6-C6
ccccggngtcgnacccacgccgtccggtggnccgagnaaagtctgtggagctactttattttctcgcccaaggttatgaagatgcagagtcaacgtcttctgtcctcacaccttatctatctaatacgattgctgctcttctttctgccgcagaccgtgctgagaccacccatttcaggcttcgtgcttctgcttatgaagcactgaatgagatcgtgagggtcagcaacatacctgaaacttcaggcatcatagcacaattattgcaggagatcatgagaagattaaaccttacatttgatctccatatactttcttctggtgataaggagaaacaaagcgatctgcaggctttgctatgtggtgttctacaggtcatcatccagaaactgagcagcacagatgcaaagtctataatttctcagaccactgatcagctgatggtgctttttctgcgtgtctttgcctgccacaattctactgttcatgaagaagcaatgctagcaattggtgctcttgcatatgctactggtccagattttgtgaaatacatgcctaacttctttacctacctggaggctggtttgcagaattatgaagagtaccaagtgtgttccatctctgttggagtggttggtgata

SEQ ID NO: 13702 - DNA, 630 bp, Zea mays
  unsure (1)..(630): unsure at all n locations; Clone ID: LIB3279-219-Q1-K6-C9
gttcctttctagccttcacttctcagcacggcagccttcgatcccccgactgcagccgccagccgcgccatggagcaagcagccatgccgcaggttccccgcgtcaagctcggcatccaggggcttgaggtgtcgaagctggggttcgggtgcatggggctcacgggcacctacaacgcgccgctcggcgacgaggccgtggccgccgtcgtcgcgcacgccttccgccgcgggatcaccttcttcgacacctccgatgcctacgggccccgcaccaacgagaccctcctggggaaggcgctcaagcagctgccgagggagcaggtgcaggtggccaccaagttcgggataggtcagggcgccgctggcatgaccgtgtgcggcacgcccgagtacgtacgcgcctgctgcgaggccagcctgcgccgcctcgacgccggctacatcgacctctactaccagcaccgcgtcgacaccaccgtccccatcgaggatacgattggtgagctcaagaagttggtggaggaggggaaggtcaagtacatcggcttgtcagaggccagcccagacacaatccgtcgtgcgcacgccgtgcatcccatcaccgncgtgcagatggagtggtcgctc

SEQ ID NO: 13703 - DNA, 303 bp, Zea mays
  unsure (1)..(303): unsure at all n locations; Clone ID: LIB3279-219-Q1-K6-D10
gtcgatanatgaaacgaggcctctctccgggtatattgaaggaaggagaaggcttttgcgcgcgctatgctgaggctgctaatctagcacccgcctagacgtttcccttttctctggtggattacggactggatcggaccaaagatcgatccagctcctagtactaataatatagttgtacttgagaaaatgaataattgtaatttattgtttttttgggacctttgatattattgtactcgcgcgcgccggccttgcgtcgaaattgaagttcgcaataaggccggccgccggcttttattc

SEQ ID NO: 13704 - DNA, 667 bp, Zea mays
  Clone ID: LIB3279-219-Q1-K6-D11
gcttcatctacataccacttgacctatagcaacaaggatgatgatgaggtttgcagaaatggcgacgtcaccgagatatgatcctcaagaacgtcaacctatagcacgcgtgatatggtgtcggccggtagctatgatgttcccgaaaacatttttcagttcgattaagcttttaaattaaagcgcttctgaaccaccacgatcttcaatcttgctatgctcaaacaatttgcaatattgcattccaatatcagaatgatatggctcggtgatctgaaccatcgagtgtcagtgggctatgaagatacatgaacgttactatagaagaatgattgggacgttcttgtgaagaaaatattgcaaatattccgatcatctttggatactgatgtctctctataaattggccagaatttcaccaacaatttttgcatctcataattgagagagaaacagggagaacgttcagagacatggcatggaaggtgggcattgggtgattgcgagcactcgggatgacaacgtgtgagatccacagatggagttgctggacgacggctcggctatgataccatcgctatcgaatgtcgtacaccttgccaccctagcacgacgcccattgcagtctcacgcatgcatgaagggcaagggattgagcatgggatct

SEQ ID NO: 13705 - DNA, 640 bp, Zea mays
  unsure (1)..(640): unsure at all n locations; Clone ID: LIB3279-219-Q1-K6-D12
ggggggattctcacacccatagnaaactgaacctactacactgtcatatcacacaagaagagagcttcagcgtgtgagcaagagcaactctcagaaaagaaacactagtcaagagtcaagactgcctgcggcctgcctgccctccaaggctccaactctccgaggctccaaagtccaagctacttcggcgtccctgactgggcttgtggtctcagtctcagcccttcgttgccgcagagaaccctcagtagttccgctgcaggttgctaattaattaatcgacgagaagtaggagggagcgctgatcgtgtgtgtgcggcatcgcaggatgggggatactagtagttctagccattcaaggcaggatccttctcttcttggctatggcttccatggcgccatcgccaactccactcctcctgcaaacttctttgaccaaggaggaggaggcacctatttcggagagctggaagaagcgttcatgcatcaggtcgcctcgctcagaagaactcaacaggctgcaaccgtctctgcacctcatcatggagacaccaagccctttcccactgctgctggtgctacagctgcaacggctaccgctacggctaggccacctcctacactggacatcttcccagct

SEQ ID NO: 13706 - DNA, 617 bp, Zea mays
  unsure (1)..(617): unsure at all n locations; Clone ID: LIB3279-219-Q1-K6-D2
gtcgacccagcgtccgggcgcctnnngctccccgatctcagttcccgccccctctaactcccaagcgacgctgcggcggcgggacaagcggaaggacaagaggcggacttgtctccctgcccccaccccctccctcgcttcgcgcgtacccccttcagttcagccgggcggtaccgtcgacggcgccggcattgtacttctgctgcgcagctatcactgctctgagaaaatggttgcagcagcctttactgttgatttggacaagcctctagtattccaggttggccatctagaggagcagtatcaggagtgggttcaccagccgattgtttgcaaggaagggccacggttttttgaaaatgatatattggagttcttaacacgcacgaaatggtgggcagttcctcttatctggttgcctgttgtatgttggtgcctgagtacttctatcaagatgggcaatactatcacagatgtagctatgatgattgggtttggaatatttctgtggacactgatcgaatatgtgttacaccgattcttgttccacataaaaaccaaaagttactggnggaaacacagcacattatcttcttcatggatgtcatcacaagcat

SEQ ID NO: 13707 - DNA, 639 bp, Zea mays
  unsure (1)..(639): unsure at all n locations; Clone ID: LIB3279-219-Q1-K6-D3
ccccgcgtccggccgacgcaatggactacgcgctggagatgccgngaggggagaaggtgttgagacatgagaagcaccacagatacgtgagcacgcacgacgtcgggtactgggcgaacagcttcttgcaagatcttgagcggatttgcctcgaccataacaggaggcgttgctggggcataggatttgggctgaagttcagggttgtggccctcgacccaaacttcaagaagcttgcggtggagcacttggtctcggcctaccggaggacgaagaagcgcgtcattctcttagactacgatgggacgctgatgccgcagacttcgctcggtaagagtcctacctcaaggacgatagacatgttgaacagcctttgccgcgacaggaacaacatggtcttccttgtgagcgcaaagagccggatgactctgaacgaatggttcttaccatgtgagagccttggactagcagctgaacacggctgcttcctcaggtaaaataataacttcctgctgtctcccaagcagttcgtgatctgctactgctggagagcgcacacactaatcgctgatgctgtcgacggttgtgtaggctgagaagaatgcagagtgggaagaatgcgttccggtgatagactgc

SEQ ID NO: 13708 - DNA, 629 bp, Zea mays
  Clone ID: LIB3279-219-Q1-K6-D4
gttcagctggcgggaggtggtgctgccgcacctcgtccccgtggtccccggcgcgcaaccggagctcgagcgggagaccggggagcggcgccgcggcagggacctcctcgtcgccgtcgacttcggcccgaactccaagcacgcctttgactgggcgctcgggcacatcgcgcgcatggccgacacggtccacctcgtccacgccgtctccagtgtgcaaaatgagattgtgtatgacaaaagtcgggagctcatggaggatttagctgtcgaggcattcaagacgttactggtccggaccaaggccagaattgttgaaggagacgctggaaaagttatttgccgagaagcagatcgactgaagcctgccgctgtcattcttggtacacgtggtagaggccttattcaaagtgtgttgcagggaagtgtcagtgagtattgcttccacaactgtaaagcagccccaattatcattgtgcctgggaaagaagctggtgaacagtctgtgctttgaaggaagatgagtaggagagttgttcctgttcgttgtactgtcagtttaggtgataaagtgttgtatattggtgctggtttgttgtgggaacatgttcttaagtgctttgctttgc

SEQ ID NO: 13709 - DNA, 615 bp, Zea mays
  Clone ID: LIB3279-219-Q1-K6-D5
ctattggtgtctgccacagtaatattaagccacaaaaccttctggtgaacccacacacccaccagcttaaactatgtgactttggcagtgcaaaagttctggtcaagggggaaccaaacatatcgtacatctgctcccgatactatagggctccagagctcatatttggtgccactgagtataccacagcgattgacatttggtctgctggatgtgttcttgctgagcttatgctagggcagcctttgtttccgggtgaaagtggtgtggaccaacttgtcgaaatcatcaaggtcctcggtacgccaacaagggaagaaattaaatgcatgaacccaaattacacagagtttaagttcccacaaatcaaagcacacccatggcacaaggtattccacaaaaggatgccgccagaagctgttgatctggtctctcggctactccagtactccccaaatctgagatgcactgctatggaggcacttgttcacccattctttgatgagcttcgagatcctaatactcgccttccaaatggtcgctttttgccaccactattcaatttcaagcctcacgaacttaaaggagtcccatcagacattgtcgcgaaattga

SEQ ID NO: 13710 - DNA, 531 bp, Zea mays
  unsure (1)..(531): unsure at all n locations; Clone ID: LIB3279-219-Q1-K6-D6
ggctgggttgctggtcagaatttcgacaggctatacctgatgaaggccttgcatgaggattagaagactgggctgtgatgaatgctgttagaattagcttgtgatactgctcaaaatcgtaattttgtgatgtacctttacatgggcgtgcctgtcctctacttaatgtttccatggaccagatggttagctcgtgatacttaatgtacttgcatatgtatgcgttgccgtataaaccaattttctccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccnnnnnagggacccaagntnncnnccccngccttgccacgncannccccttttttgggggcccctaatttaaattaactggccctctttttaaacccccgggcctgggaaacccctggtgttcccaaattaaatggctttgcgggccttccccttttccccggctgggttttt

SEQ ID NO: 13711 - DNA, 477 bp, Zea mays
  unsure (1)..(477): unsure at all n locations; Clone ID: LIB3279-219-Q1-K6-D7
ngaaaccctaccgcctgtcttgctgaagctgaactgctgatccgtcttccaagctgtggtgtcatcccctgagttctgatccaagatgtatctccagtattacatcaatgagaagggggacaaggtctacaccaccaagaaggagtcacctcttggggtgccgacgcagtctgctcacccagctcgcttctcaccagatgacaagtactctcgccagcggtacctgttgaagaagagatttggacttctgccaacgcagaagccagcactgaagtactgaagcttcaactttccaaccatggatgtgcagtttgtgtcactgcttgatgcttgttggttggaatgtagaataggtatctgaggaaacatatcaaacactgctaggcactactatgacatctcagcgcattcaggcactatatgtaatgctatgtgtttgacaggtcttgttcttattatgtacttggtgtgtgggcc

SEQ ID NO: 13712 - DNA, 667 bp, Zea mays
  unsure (1)..(667): unsure at all n locations; Clone ID: LIB3279-219-Q1-K6-D8
cggtacgcgtggggngcaatgctattaggttntctgaagagcaggatagcaaagctaccacatgcattgtcagagtctgaagccaaaactagtcttcagtctgatattgatcgttttataaatgagaagatagttcttgcagacaaagttattgtcagccatgccatcacaaaggtcagagacaacgatgtcttactgacatatggatcatcaacagttgttgaaatgattttggattatgctcatgaacttgggaggaactttcgagttgtagtggtagattctcgcccaaagcttgagggacagggattgctgcggagattagtggcaaagggcattaattgcacatatacacacataaatgccatctcatacatcatgcatgaagtaactcgagttttgttgggtgcctcatcaatattatcaaatgggacagtttattctcgagttgggacagcatctgtggctatggttgcgcatgcatttggagttccagttctggtttgttgtgaggcatacaagtttcatgagagagtgcaacttgattctatatgtgctaatgagcttggcgatccagatgtcattttgaaaattcctgggaaggcagaggaccatcttaagaactgggcagacagtgcaaatctncaattgctaaatttaacgtacg

SEQ ID NO: 13713 - DNA, 614 bp, Zea mays
  unsure (1)..(614): unsure at all n locations; Clone ID: LIB3279-219-Q1-K6-D9
atcatgtaagattgtaaggcatgtcaccacattatagcgaaaataacaacatatgtttttcggccttctgctaagctgtaaaactctctatttctataaagtagtccacgccttattcctctgcctcccttccccttcctcatgtggctgcaccttctacttcctgatcccttcctctcaatcagtcgctcgcagcggacatccagaagaaccaaagtccaacgacgtcagtaacaatcgctcatgtcctctgtcggtgtttggagcccgaccgcacacccggggttacccctcgcggtgcttttgggtagaatggtgcttttgattgtaactcaatggttcgtacaagatgcatgagagacgacaggtgattttctacatgttcgggccacttggagaggcgtaataccctacttcctggtaaggatctttatgtggtgggttacaagaggaatctacggaatggggagaaactagtgaggtgggttggtgattgacttggaaatgatggggtaccccctaggccttatatattcgactgtggggcactacatgcatatgtgatgatgatatgttcctaaacaatagtnaaccgactgaactgatctttcctt

SEQ ID NO: 13714 - DNA, 671 bp, Zea mays
  Clone ID: LIB3279-219-Q1-K6-E1
ccccgcgtccggtcccctcgactcctcctccatccccgacgcggcggcgccagcctgcagattagcttattaccaccatgggtaaaagaaagcggtcgtcatgtcaacgagataaccataatgattctctagccagcaaaataatgagaactagaatcccagatcttcctgaggacatttggtctcatgtacattccctaatgccaatgcgtgatgctggccgtgctgcttgcctatctcgtgcctttttacgttcctggagacgtcatcctaatcttatctttaataaggatacgattggcatgaaaaaaaatcatatggagagaatttccaccacaaaattagccgcattctcaggaatcactctggcattagtttgaaaacattcaagcttgactacagtggcatgtgtgggttcgatggaactagttatcttgacagttggcttcaggctgctcttaatccagggattgaagaagtcaccctctggttgttccatacaaggagaatatatgaattcccatgctcacttttatctgatggggttcgaaattacttcggtaccttaaacttcgttgttgtgctctccgtcccacagttgaacttgcccccatgagaagcctaacaagttacatttgtcctttgtgagcattaaatggaatggttaaagc

SEQ ID NO: 13715 - DNA, 639 bp, Zea mays
  unsure (1)..(639): unsure at all n locations; Clone ID: LIB3279-219-Q1-K6-E10
cggattctggaagcaaaagaagggctngagctatttgaaagagctaacggtgaatcttcacacgtcctccgaatattcgacgacgaagcccaagcaaagcaatcagcccgtaactcctcacgaatgctcgaagaagcttatgagacaggagtgggtatccttcacaagtacgctgaccagagggatcggctgaagagtgctcaaaggaaagctttggatgtcctgaacactgtcggtctgtcaaactccgttctgaagcttatcgagaggcggcaccgcgtggacaggtggatcgcgtatgctggtatggtcatcaccgtggtggtgatgattgcgttttggcggttaacgcattagtgctgggttgtgtttgttacatatttctatccaagatatcaatgtgcaaacgagggagacggggcagattcagatggtacagttttttttccgctggtcgtggagcagttcaagtttgcctcgccggtccgtcgcccgcatagttgatgccggacccccaaagtgggttaaatgttcaaattccattgtatgcaatgctgctgtgtagtctattgttacgacttccgtgtaagtacacaagctnttgcgtgacacagaagagtaaatgcgctgtattatttc

SEQ ID NO: 13716 - DNA, 639 bp, Zea mays
  Clone ID: LIB3279-219-Q1-K6-E11
gccaacatatctcctcgcattttccttgcaaccgattgcctatccccctcccaaccaaagaccgatggcgcccaaggccgagaagaagcccgcggcgaagaagccggtggaggaggagcccgcggccgagaagacgaccgccgggaagaagcccaaggcggagaagcgggtccccgctggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacatcttcgagaagctggccggcgaggccgccaagctcgcgcgctacaacaagaagcccaccatcacctcccgcgagatccagacctccgtgcgcctcgtgctccccggcgagctcgccaagcacgccgtctctgagggcaccaaggccgtcaccaagttcacctcctcctaggcttgcacgctcgccctttgtaggcttctcttgtgttgatgttcgccttgtgttgtagttagatgttgctggtttctctgtcggcgctgctctgcttctgtaggaactgcgtcatgtaaccc

SEQ ID NO: 13717 - DNA, 527 bp, Zea mays
  Clone ID: LIB3279-219-Q1-K6-E2
cggtgaggatccgtcgccatgtcttccagcgaggtcgcctgcacccttgccgccctcatcctccacgatgactggatccccatcacttccgagaagatcgcgacggtggtgaaggctgccggaatcaaggttgaggcctactggcccgcgctcttcgccaagctcctggagaagaggagcgtcgatgacctcatcctttccgtcggatctggtggaggtggtgctccagctgctgctgctgctgccccggctgctggtggtgctgctgccgctgaagagaagaaggaagaaaagaaagaagaggccaaggaagagagcgatgatgacatgggcttcagcttgttcgactaagctgttcaattccagttctcctgtgggttcttctatgcgaaagacttgtcttatgtgcttttaggtcgaattttgaagatttattatgttatgctgtttgagactaagtatctgtgcaatgagtactgcaaaacctccttgggatggtcttgttagaatgaaaatggttctacatt

SEQ ID NO: 13718 - DNA, 597 bp, Zea mays
  Clone ID: LIB3279-219-Q1-K6-E3
ggttggtattatgtgaagaaaggaggcctggaagggatggaaagaggcaggtctggttcctgttctgtatgtgagttcatgataacagccatgtgtatcgtttcccacacttgtggaagctgtttggagttcatgggcttaacaaaaaggcacactggaatgctcccgagagatcttcgcataaactcgtgcccgtcgtataggcacgtggccttgtggaagcaggtcatatccagtcatcttggggttcgtatgatgctgcagtgctgttcctgggaaagatttacgtgttgatttgtctggacccacaccacgagtcattcaattgattgttttttgttgctaaggtggagactcttcagaggttaaccgttcatctgtgccattttgctgccgtctgtgttcaagaaggcaatttcgtcgtctccagttcgtgttgtgcgatatatattttagtcaaattgtagaggcatcatttccccgcgatatattattttggtcatgtatggtgtgattctggtggtaaaatagcgtcattaatcttgtgtatatttgtttccgggtggattatggagtatacaacacaacagtggattc

SEQ ID NO: 13719 - DNA, 560 bp, Zea mays
  unsure (1)..(560): unsure at all n locations; Clone ID: LIB3279-219-Q1-K6-E4
cggnttacctcccgcccatcctcaccacatagagtgcacactgcaggcagcgccatggctgctctcctctctggcctcaccttggtgtccctgtgtttgtgtttgagacgctggaggttcagaatgcagtgttgatattttacccctccggccacatgatttaggccccgtttcaatctcacgggataaactttagcttcctgctaaactttagctatatgaattgaagtgataaagtttagtttcaattaccaccattagctctcatgtttagattataaatggctaaaagtagctaaaaaataactgctaaagtttatctcgcgagattggaacagggccttagtcgttttggacggggggagtagacgttattgagtcataataaaatgcaatgtgcatggtgggagactgggaggataggaattatagttgtttattacgactgcttactgcatccagattgtgttgtcccttgtctggtgtagcttctgttgcttgctgcgttgcagtgccggaagtgactccagatttcagaacttaaacatgattgcttgttc

SEQ ID NO: 13720 - DNA, 408 bp, Zea mays
  Clone ID: LIB3279-219-Q1-K6-E5
ccccgcgtccgccccgcgtccgcgacatcttcgagaagctggccggcgaggccgccaagctcgcgcgctacaacaagaagcccaccatcacctcccgcgagatccagacctccgtgcgcctcgtgctccccggcgagctcgccaagcacgccgtctctgagggcaccaaggccgtcaccaagttcacctcctcctaggcttgcacgctcgccctttgtaggcttctcttgtgttgatgttcgccttgtgttgtagttagatgttgctggtttctctgtcggcgctgctctgcttctgtaggaactgcgtcatgtaacccagcaaggacttgtttatttgtgaatcatcaacactttgttgttgatcacttatgttccaaattctgagtttgacgctggagcatgcctc

SEQ ID NO: 13721 - DNA, 639 bp, Zea mays
  Clone ID: LIB3279-219-Q1-K6-E7
ctcggcggccggcctcctcttctcttcacccacacgctggtcatagagatgtcggctgcagaggcgaaggcggcggcggtcccggagtctgtgctgcggaagcgcaagcgggaggagcaatgggcagcggacaagaaggagaaggcgctcgcggacaggaagaaggcgctcgagagccgcaagatcatcttcgcccgcgccaagcagtacgccgaggagtaccacgcccaggagaaggagcttgtgcagctcaagcgtgaggcccggttgaagggtgggttctatgtgagcccagaggccaagcttctgtttgtggttcgcatccgtggtatcaatgccatgcaccccaagacccgcaagatcttgcagctcctgcgattgaggcagatcttcaacggtgtcttcctcaaggttaacaaggcaaccattaacatgctgcgcagggtggagccatatgttgcgtacggataccccaacctgaagagcgttagggagttgatctacaagagaggttacgggaagctgaacaagcagaggattccacttagcaacaacagtgtcatcgaggagggcctcgggaagcacaatatcatctgcattgaggaccttgtccacgagatcatgacggtgggcccgcac

SEQ ID NO: 13722 - DNA, 662 bp, Zea mays
  unsure (1)..(662): unsure at all n locations; Clone ID: LIB3279-219-Q1-K6-E8
cggtcgcgtgggctacgcacgccggatttttgcatcgagcacggagatctacaacaaaaacatggagctacgacgcgattcccaaggtacaatcgtaattatgttcaaacaatttttaagtcgtcctgcgctccttctattacgagcaacgttttatattctgtgcttgcataataaatcgaagaaatcctgacaccaatcgaactgaagatcctgaaacgcacgttaataccgttgacgtccgcttcacccagctcgattttcagtcttgtaataataattgagaactccaatgaactgagagttactaatcgctccatgagtctgaagcgtgcaaaaatttaggtcgcagctacacaaatttacacgctgttctatattctatattctatattatatttaggtcgcagctacccgtgaatctcctattttgaaaaggtcactgcttttttatttcattctatattctatattatatttttgtaatattcagtctcgtttaattgctttcagacttaatgttagataattgtttacattttctacaattcagtctggactaattgctttgggactaatgttggagatatccatatgtatctgcgtctaagcatttttcatttgtatttatcatgtnttgtcaatagggatacttgtttctt

SEQ ID NO: 13723 - DNA, 338 bp, Zea mays
  Clone ID: LIB3279-219-Q1-K6-E9
cgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaagggggacagcgttcgggaggggggaaaaaccactggagtgacccagggggaagggcactggcattaaataaacgcgtagcgaaatgttggtaaaatgaggcgaagagggcaaaaaccggatcgccgtgacaaaaagtgagggcataccagaatggaagaatgggacgcaacctgtatctttt

SEQ ID NO: 13724 - DNA, 637 bp, Zea mays
  unsure (1)..(637): unsure at all n locations; Clone ID: LIB3279-219-Q1-K6-F1
caactacttcctccccttccttcccttccggccgccccttgtcctcctcacctcccaaattgaaatcctcctccctccccgcctagggttccgcttcctcccccgtccgagcaccactcaggcagcggcggcagcggtggcagcctggaagcagtcccatctcgtcgccctagacttccctgccgccgcacgtctcagtttcttgttcggccgctctcctgccggtccgcccatcgcctgaggttcttacggtgccacggagttggcaactgcaaggagtgatattgtggtacaacactagttctaattgaagtaataaggcggggttgaaactgtctgctaccattgcttccatggcaactaatgagaacctcccgccaaatgtcatcaagcaattggctaaagaactgaagaaccttgatgagtcacctccagaagggattaatgtgattgtcaatgatgatgacttcactactatttttgctgacattgaaggccctgctggaactccatatgagaacggagtattcaggatgaagctattattgtcacgcgatttccctcaatctcccccaaaggnnttctcttgactaaaattttccatcctaacatagctactagtggtgagatatgtgta

SEQ ID NO: 13725 - DNA, 644 bp, Zea mays
  Clone ID: LIB3279-219-Q1-K6-F10
gctctgtatgcttgcgatgtctctctgtttcaaacatgcaacttttctatgtttagctgattgtattcattctggaactcagttattgggtcgatcactgttttgtcttggactcctccttcggtatggttatcaattgatgcaaacatctgaaaatcagcttgattttcccaagattatcaacttgctccagagaaaatatcttctcagggatgattttagcttgaaggttcgagctttgcagactttgggatacatacttattgcgaagcctgaatttatgctacaaaaggatatgttgaaactcatagagacagcactatcttctgaggttgattatagattaaaggtacttcacaactccttttggtttttttgtttgaaaagttaagtaaattaatccacctgttcagattcaaggacttcaaaacctctatgagtatctcagagatgctgaaagccaacttactgccgagagcactgtgaaacctcctgtccggtgtgaaataaatggcagaagtaaagtgcctgttgctgctggtgctggagacaccaacatatgtggtggtattattcaattgtattggagttctattcttgaaaggtgcttggatacaaatgatcaagttcgccagagtgcactt

SEQ ID NO: 13726 - DNA, 660 bp, Zea mays
  unsure (1)..(660): unsure at all n locations; Clone ID: LIB3279-219-Q1-K6-F11
gcaaaagtcactttcgatggtttagttacggaagccctacccaacggaatgttccgcgttcgcctagagaatgacacgatcatcctgggctatatttcaggaaagatccggtctagttctatacgaatactgatgggggatagggtcaaaattgaaataagtcgttatgattccagcaaaggtcgtataatttatagacttccccataaggattcgaagcgtaccgaagactcgaaggatactgaagatttgaaggataccaaagattcaaaggattaggtttttctggggtaataacttccaagtttcaaaatttaagtgaagagacttattttttccaaaagaatagattcatagtttaagaaaggaatacccatatatgaaaataagagcttccgttcgtaaaatttgtacaaaatgtcgactgattcgcaggcgtgggcgaattagagtcatttgttccaatccgaagcataaacaaagacaggggtaatctttcgaaaaagaagcttttctttctaatagcttttctttctaattaaagtaaaaagtaccccacggaaatgcccaaattgcaaataaaaaaaatgaaagtaaaggatatattntaacctgaaacggatatctttggatcttttttctttttgttatttctaactc

SEQ ID NO: 13727 - DNA, 629 bp, Zea mays
  Clone ID: LIB3279-219-Q1-K6-F12
gttctgggtgacaaattgagaagtggtggtgtctgatcgcgttgtggactcaccgtgctgccttgtgactggcgagtatggctggaccgccaacatggagaggatcatgaaggcacaggccctgagggactcgagcatggcgggctacatgtcgagcaaaaagacaatggagatcaacccagagaaccctatcatggatgagctccgcaagcgtgccgaggctgacaagaatgacaagtcagtcaaggatctcgtgatgctgctgttcgagactgctctcctgacctccggcttcagcctggatgaccccaacaccttcggcaaccggatccaccgcatgctcaaactcggtctgagcatcgatgaggacgagcctgttgaggcagaggctgagatgcctcagcttgaggacgacgctggtgaaagcaagatggaggaggtcgactaattgtcgcatcgcatgcttgccgtttatcttatccctagctaagctacctgtgatagcttaattttcactattgttcgaggtttttggcacgttatcggttgtcctgctggccaggctataagtctggtttatctgttatgtttaccctttttaacagtttgtcgttattattcgtgatggt

SEQ ID NO: 13728 - DNA, 457 bp, Zea mays
  unsure (1)..(457): unsure at all n locations; Clone ID: LIB3279-219-Q1-K6-F2
cccggngtcgacccacgccgtccggcggnccgccctnnnnnnnnnnnnnntnttnttttttttttttntttttttaaaaaaaaaagagctcgtttcacagatgttttaagttgcacttgcacggggaattttacagagttcatcaccaaccggtacgagaatagagttctttttcccactgggacacatcgttctgagggtgacatgagagcacggttctaaataatcgaccaactgcaagcttatgctccttccgcaagaaaagggttggcgatctcatcagttccatcagtcggtgagaccagcatgactgccgtgcctttgcacacaatgaggccaagctgtctggttttccctgatagcttcaatgggtcatcttgctctctttcatattcaactgcttcatctagcactaggttgagtagctggtcatatccctttaaagttcctgtcactt

SEQ ID NO: 13729 - DNA, 481 bp, Zea mays
  unsure (1)..(481): unsure at all n locations; Clone ID: LIB3279-219-Q1-K6-F3
tgttaaaccaagtccttacaaggtgtcttttcgctggactgtgtttccatgcataccaacaggtgtcttacatgattttggcgatggtgtctcctgtcactcattctgtgggcaactgtgttaaacgtgttgtggtcattgtaacatcagtgctgttcttcaggacacctgtttctcctatcaactctctcggtactgcgattgcacttgccggagttttcctgtactcacagctcaagcgacttaagcccaagccgaagacggcttaaatagggattgtattttccatctctttgtgttaatggagttaaacacttctatgtttcaggtgactgcattttaaaagatttgtgcttattacanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaggggggcccgttttaaagaaacca

SEQ ID NO: 13730 - DNA, 631 bp, Zea mays
  Clone ID: LIB3279-219-Q1-K6-F4
gttcaagtggacaactcttctgatcccccccaccctgtgcttgtgattaacctggttggtatagtggctggagtgtcgtatgctatcaacagtggctaccaatcatggggtccactattcgggaagctgttctttgcaatctgggtgatcctccacctctaccctttcctgaagggtctcatggggaagcagaaccgcacaccgaccatcgtcatcgtttggtccgtccttcttgcttccatattctcgctgctgtgggtgaagatcgaccccttcatatcccctacccagaaggctctttcccgtgggcagtgtggtgtaaactgctgaaatgatccgaactgcctgctgaataacattgctccggcacaatcatgatctaccccttcgtgtaaataccagaggttaggcaagacttttcttggtaggtggcgaagatgtgtcgtttaagttcactctactgcatgttaactgtcgtgactacctgttcaccgtgggctcatggactgtcatgatgtaatctgtatgttggaacttccaagtactgattgagctgtttggtcaatgacattaagggtttctctctcttgaaatttaaaaaaaattaaaaaaaaaaaaaaaggcggccgct

SEQ ID NO: 13731 - DNA, 422 bp, Zea mays
  unsure (1)..(422): unsure at all n locations; Clone ID: LIB3279-219-Q1-K6-F5
ccaggnaccccataccctctaaacaatgaatttaaagtggtaagctagactacctcgaactactattcattggccggatcaaattgattttccttggttggtgttgggtgtgacatgaagtcctgaggacccccccttaaatgttgctctaccccttcctgttatagcctgagggagaggttgagtttacatgtatacattatttgcaagccctacctatcatcgagccaactgcctccgtcctggcataaccttgtgcaatggtagtttcatttccttgtaatcatacaataaaagctggtgtgttttagtgtaatcgtacctaaaaggaacgataacacctaagagggaggtaaattagtgtaacaccctgaatttgggggtataaatttcttttctaatatccaccaaattctagtgtt

SEQ ID NO: 13732 - DNA, 680 bp, Zea mays
  unsure (1)..(680): unsure at all n locations; Clone ID: LIB3279-219-Q1-K6-F6
ccggtcgaccccgcgtccgccccgcgtccgcctgcttccaaagccggcaaagctcagctctcccccccagcaaagaagggcagaattcctcagctaaaagaaggtcaatgcggcattctgcaaaggagaataactcacctcctagtgcaggcagtaacaagctaagaacaacttcgacccccaaaaagaggtcaacgctgtcagccttgcatatgtctatgagtttcccgagatgtgaatctggcaatacttccatggcgtcaagaaatcttggtaccacaatcgctgctaggattagcgagttggaacatgcaaatgcaaccaagcctgcagaaaaaaacactaagcctcatgatttgaggctaccaagaaagaaattttccagcgctttaccagaaattgctccaaggacatctcaagtcgatgaagaaagatcatcacatataatgaaaatcaaagaaaagctatttggttcaacatttccaacactgcatcagaaatatggtataaccaaagaaaaagagagaaagatcaacaatgaacatgggtttaaagaatcacgacatagcttttgcttcaaagccacgctgttgccaaatttctatcgaagcaataaacaaccaaagnatacaagtcatcaggctactcaagaaacctaagttcttcgaagtctggccatc

SEQ ID NO: 13733 - DNA, 652 bp, Zea mays
  Clone ID: LIB3279-219-Q1-K6-F7
gagcttgaaattctgattcccaatttgacattggtacatgtcatgacacaacttatggtcttattggtttgggatctcaactccagcagctatatggtccagatatgcaggatgctttagatcatctgcagtctaggtggaatagtgttcagcaagcaaacaagcaaaatatggctgctgatgcatcagacaagtctgagagcagtttggagattttggtcgattctggggattaccagtcagatggacttcttgatgatattattgagaatgcttttaacacagaggattgcatggacaacaatttttgggagaacaattaccatcacttatttagtagcagtgagacggatgatggatttgagctgaatgcggccacttcacatgtatttcctatatctactccagaaggcaatgttactcaaatatcactagaacagaacgtctgtcctgatcaaatcattgattcatattgtgtgcctgaatttcatcaatcattatcaactctatgtgatgaagagcataaatgtacatctggtgacaattctcatagaaccctggaaagtgaggatgctggatggtataacaatgttcccttaacaatagttgagaatcatgttttgaaaaagaaaaagagcaagtacttcaacac

SEQ ID NO: 13734 - DNA, 658 bp, Zea mays
  Clone ID: LIB3279-219-Q1-K6-F8
cggccgcgtgggggggccaggggtttcttcaggggatgggtgcctactttgcttggttacagtgctcagggggcttgcaagtttggcttctatgagttctttaagaagtattactcggacattgcagggcctgagtatgcccaaaagtacaagactctaatctacctcgcaggatctgcatctgctgaggtaattgctgatgtggctctctgcccttttgaagctgtgaaggtacgtgtgcagacacaacctggatttgctcgtggattgagtgatgggctccccaaatttgtccgatctgagggtgttcttgggctctacaagggaattgttcctctctggggtcgtcagattccttataccatgatgaagtttgcttcctttgagaccatcgttgagcttatctacaagcatgctgtgcctgttccgaagtctgagtgcagcaagactacccagttgggtattagctttgctggtggttacattgccggtgtcttctgtgctattgtttctcacccggctgacaaccttgtgtctttcctgaacaatgccaagggagctacagtgggagatgctgttaagaagcttggtctctggggtctcttcactagaggacttcctcttcgtatcgtcatgattggtacccttactggtgctc

SEQ ID NO: 13735 - DNA, 654 bp, Zea mays
  Clone ID: LIB3279-219-Q1-K6-F9
ctgctccctccactaccagtccaccaccaccactgctaccgtcgcttccccaaaccctagccaagggacacggtggccagcgatggacggcgacagagaaggcgctgcggcggtgcaccaccacgcgcgctcccccgaggacgtcttccgcgatttccgcgcgcgccgcgccggcatcgtcaaggcactcaccacggatgtggagaagttctatcagcagtgcgatccagagaaagagaacttgtgcctttatggtttgccaaatgagacttgggaggttactcttccagctgaggaagtacctcctgagcttccagaaccagcactgggcataaactttgcccgtgatggaatggttgaaaaagactggttgtctctagttgcagttcatagtgatgcgtggctcctgtctgttgcattctactttggagctcgctttggatttgataaagatgcaaggagaaggctcttcaccatgattaataacctgcccactgtttatgaagttgtgaccggggttgctaagaagcaatcaaaagcccccaacggcagcagcaaaagcagcaaatctaactctaaaccatcaaaacagatcaattctaacagtaagcctgtgaagccagcccacccaaacgaagaggagatagcggccgt

SEQ ID NO: 13736 - DNA, 103 bp, Zea mays
  unsure (1)..(103): unsure at all n locations; Clone ID: LIB3279-219-Q1-K6-G1
ccggggnaatgtggagcaacgtagatgttcaggctaacacagacacatagtactctctccgttcttgttttaaaaatgagttagcgggcgacaaatattcgat

SEQ ID NO: 13737 - DNA, 657 bp, Zea mays
  unsure (1)..(657): unsure at all n locations; Clone ID: LIB3279-219-Q1-K6-G12
gccgggagcccctggccacaagtctccccggcgagtcctccaccacaagctcgcccagcagcggcagctcactgattgctccagttgcgtgctcgcgcgcgcaagctcgtcctccatcgcagtcagtggccttatcttgttcgtccttgcctccctcgttgttgcgacttgcgagacgacaggacaggatagcgagctgggcctgggagtatagactgcagacagagaggtggagcggccatgaagatccagtgcgacgcgtgcgagggcgcggctgccaccgtggtgtgctgcgccgacgaggccgcgctgtgcgcgcgctgcgacgtcgagatccacgccgccaacaagctcgccagcaagcaccagcgcctcccgctcgaggctctctccgccagcctcccgcgctgcgacgtctgccaggagaaagcggcgttcatcttctgcgtggaggaccgggcgctcttctgccgggactgcgacgagcccatccacgtcccatgcacgctctccgggaaccaccagcgctacctcgccaccggcatccgcgtcggcttcgcctccgcttcgtcagcgtgcagtgacgcctgcgacgcccacgaccaccacgccccgtccaaggccgtcgtctnctccgcggcgcatcatgtgccctcg

SEQ ID NO: 13738 - DNA, 633 bp, Zea mays
  Clone ID: LIB3279-219-Q1-K6-G2
gaaaaaagaaaaaatttatattattaccattattaacacatgagcgcagaagagttggcgttgccgttgcggcagaaaatccaagcggattgttacaaaatattgtcatgtgatcaaccctctcccctgacagttttctcccaagggacacaccccttgggagacactgtatccacatgtatataaaccagattctctgcaataaagatctacaactgtcatttgcactattctctcgaatcttgttttcactaagttacaacacgttatcagcactgctcacgagatcaaagaagaatttgtcgctcgcaagagaagaaggagcgatttgattgcccagaaacacacgttgctctccaacgaaggccataccaagcgcctgcggcctgcagtctgctcatcacggtcttcaccgacaacgaccacccatcagggaagaagagagacactagcctccaaggaatggaggtacgatgcctatcattttttttttcgtcgacacgctcacggcaggggccactccatgccatggagtgcacgccagttgctggcttgggccgcttgccccgttttgcgccgtggtagaggccgcgccggggctgcgcgctcgcgctggctttggccacacctggc

SEQ ID NO: 13739 - DNA, 634 bp, Zea mays
  unsure (1)..(634): unsure at all n locations; Clone ID: LIB3279-219-Q1-K6-G3
ggtnngaccagcgtncgccgngactggaggacgatcgacaagggagtgaggcggcatttccatgacgacatcagcgtcgtcgtggtcttccttgatcgccaccgtgagcgccgccacactagggtcgttgactcgagtagcaactgcatcagtgctcccgtcgacatatactcctccaacacacaccagtctgcggagcccttgcacggttaaaagagctgaactctggctagagtagaagactggggtttgccttgcgctctcctgctggtgaacggtggagttgtagagctgagggactgcagtgccatagccataggaagggaagaactcgagatgtacatagatagcgtgggtgtgtagcatcggaaaagatatttggtctggaactacgtagcgtaattggtcagtcagatcattttcttgtttctttttgtctgattatgcttacccagtggtaaatccgtccattgtatcggatttaatttaagaaatctgtaatacagaggtgtcgtgaaatagttgatgacgcaactggaggttagtggtgactggtgaccaaagaacatatgctctgcttatgatctagaagttaggttgtgacatgaagaaatatactatttatttgcaacgg

SEQ ID NO: 13740 - DNA, 598 bp, Zea mays
  Clone ID: LIB3279-219-Q1-K6-G4
cccacgcgtccgcaattatgttgttatctatttaattgttttcatgccccatgcagctcaaagttatgtgctatgagatgtcaactataactcaaactattgattacacatgttggctcttgagatgtcaaactggtgttctgtgctgatattgtctttgcagtggaccacgtgaggatgccacccgtattggttcagctggtgttgtgagaaggcaggctgtggatatctcacccctgagaagggtgaaccaggccatctacctcctcaccactggtgccagggagagcgctttcaggaacatcaaaaccattgctgagtgccttgcagatgagttgatcaacgctgccaagggctcttccaacagctacgccatcaagaagaaggacgagattgagcgtgttgccaaggccaaccgttgagtggagcttgtatcctggtgcacttgcactagaactacgtttctggcagtcgtatttttttcttgtgtttttacccatgtttagactttgagacctatatctaaggttttggttctcagtgaacaatgaaaattactgtgaaatgcagttgttttggtgcagaaatgcgcactgag

SEQ ID NO: 13741 - DNA, 627 bp, Zea mays
  unsure (1)..(627): unsure at all n locations; Clone ID: LIB3279-219-Q1-K6-G5
cgcccgcgnggatggcacggcgcgaggacaagggaggggaccttcccagttcctctcgattcttcccatttcttctcaaaaaattaaagattgtccacatgccacgctggagcaggggcagatttgggttccgggccacctgggccgtggcccgagtcgtggcccaaatatccacttatacttaggttttttcagcccaaccatttatccttcctctccacttgaagcctgggcgtatggcggctgcaaccctgatcgacctagcctcaaccttgccctggcggcgacttgaggtcgacggccagtcaccagtgctccctatgacaagctcgacggccgctgcgcgccctccatggatctagcaactagcgaaccgggcagtcggcgacctcctcacctccctgcggccctgcgccttgcttcctgcctccctccacggttcgtcgcgggcctgtgttttccgcccctcgccggtggctcggctcctccacggcagtcggcggcgtcaccaactccggcttccacaggtcagccacgctgacactggaacaggatgtgcgctgaagtttccacacagatgtcaggcaccacattcttgatgatgagattcgcacgacattgtaagca

SEQ ID NO: 13742 - DNA, 653 bp, Zea mays
  Clone ID: LIB3279-219-Q1-K6-G7
gtagtttttttccctcttgtcacagcaccccccacccacacacacccaaggccccaactgcagtgcccatccggcagtcaggtcgatggcggcggaagcagcggcagcggggaaggagaagatgcggacgctagtcagcagcgacttcaagaagttcgatgtggaggagtctgtggcgagggaatcgctgattatcctgaacctgatggcggactgcgacgacagtgacatcccggtcttcaacgtcaacgccaagatcctcgacaaggtcatcgcgtactgcaggaagcacgcctcggcgccgcgcgccgatggcggtgatgcggagccaagtgctgcgagtaacaaggcctcagcggacgatctcaagtcctttgatgctgagttcgtcgatgttgacctggtcaccctcttggagctcattaaggctgcagactacctggagatcaatgggctgctagacctgacctgccaggccgtcgcggacatgatcaaggggaagactccagaggagatacgcgagacattcgacatcgagaatgacttcacacctgaggaagaggctaaagtgaggagggagaatcagtgggcctttgaatgaacaagctgcaggctagctctaacaaaacatagcatatcatataaccaggcca

SEQ ID NO: 13743 - DNA, 668 bp, Zea mays
  unsure (1)..(668): unsure at all n locations; Clone ID: LIB3279-219-Q1-K6-G8
ggggcatcgacggctcgacgcatcggctaccgcaacagcctcaaagctgcgtcggtcgccaccccctctagcagggcacacggagctcgatttcaccttgccgtgtgcgtcatgctatcacgcgccgaagccgatgccggcagtcgtcgccggcctggcactcgcggccactgcgagggtctcacccccgccacgaggagatgaccgccgtgcaggtacggtcgctgcacctcctccccgagccgccaggagctccgcgcaagagggccacaacggccgctcaaagagccagctgaacgacatgttgctgcatctgccgatcggcgccagctcgcgccccggcgggcagcacggtgcagccaccgaccgtgcagcgcgaagaaggtaatggttgctacagttcgatgtgatgaaattgcaaacgagaagtttggatgcataacctcagacacagaatggttggatgtggagagtgctgtccaatctggtccagtacctggttttggaaaaaacttggcaatatcgtcgacgttcacttgcaagagtatgacaaagaagctgtctattttgatgaagctgtaaggaaaggaaaacgacagcnatttggagtccagaatactgaatcttgtccaacctgcattccagaaaatgttgactcatctgcgtgt

SEQ ID NO: 13744 - DNA, 417 bp, Zea mays
  Clone ID: LIB3279-219-Q1-K6-H1
ggtgccagcggcggggctgagctgacttagagacactctccttctgcgtgtgaggtagtgacgtgacgcccagccttggcaacaatggcactgcgcgccttggcgacggcgctgctggtggcggctgcgtccgtgtgcggcgcgtcggcgtcgacgctggtgctgtacaaccggtgcggggagacggtgtggccgggcatccagccgagcgccgggaaggaggtgctggcgcgcggcgggctgcagctggcgccggggcggtcggcgtcggagcggctccccgcggggtggtcggggcgcgtgtgggggcggcaggggtgctcgttcgacgcggcggggcgcgggcggtgcgccacgggcgactgcggcggcgcgctctactgcggcggcgccgggggcgcgccgccggccacgctg

SEQ ID NO: 13745 - DNA, 643 bp, Zea mays
  Clone ID: LIB3279-219-Q1-K6-H10
gagcaacccaagtcgccgagggtgactcccacacgacccacctaccccgccgccgccgccgccgcatccccctcgattccgtctggcgatcgggggctcccagacacatcacagatacaccacgccaagccaaatcgagcaacgcctatcaccatattataatttcccctcattcatctcacagtcccaggcctcccctccctcctcccccgtcgccaactaacctccaacccccagccgatcgcgtcggagatgctgggcgtcgcgcggaggcggctcggatccggatgcgtgctcgcccagctggcgcaggccctccgccccgccgccgctcccgccaggacctactccgccgcggccaaggagataactgtacgggaagcattgaatactgcattagatgaagaaatgtcagcagacccttctgttttcttgatgggagaagaggttggcgagtaccaaggtgcatacaagatatccaagggtttgcttgacaagtatggcccggatagggttctcgatactccgatcactgaggcgggcttcactggcattggtgttggtgccgcttaccatggtcttcgacctattgtagagttcatgacatttaacttttcgatgcaggcaattgatcacataatta

SEQ ID NO: 13746 - DNA, 600 bp, Zea mays
  Clone ID: LIB3279-219-Q1-K6-H11
gcaacgtccaaaatccataccgctggtaggagtatctcgtagacattgaacaacggctgcatggcgagcgcctgcgccacctccatccccctcgtctcggcgccctctgcatgcccgtccaagaagaccaccgtcgccaggttccggcgccgcacggcgacgtgcagggccagcagcggcggtggcggtggccggggcggcgaaaatgatggcctcctttggctgccccggcgggacgtgatgctcaacggcctgtccagtgtcgccgccgggctcgcctggtacccgggcgtcgcgtccggcgcggatgcggtgtgcaccagggccgacaaggtgaacgagaagaccgtgcagtgcacggacccggccgggcagcttccgtgccctctggtgtcgccgacggaccccgtggacttcaagccggaaagcaaggtgacgcgcatccggcagccggtgcatctcctgagccgggagtaccaggagaagtacaaggaggccgtcgcgaagatgaaggcgctaccggaagagaacccgctgagcttcgcggcccaggcggccatccaccaggcctactgcgacgcctactacaagtatgacccg

SEQ ID NO: 13747 - DNA, 623 bp, Zea mays
  unsure (1)..(623): unsure at all n locations; Clone ID: LIB3279-219-Q1-K6-H12
ccaacccagctcgctcgtcccagctgatcaggtcgagcacctagtagcgacctgctcgatcatcagtgtagagtgtcggtaggtgtctgagtctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgggttccagtcccggcacgagtacctgttcggcaagatcgacatgcagctgcggctggtgccgggcaactccgccggcaccgtcaccgcctactacctgtcgtcgcatggcggcccgcacgacgagatcgacttcgagttcctgggcaacgtgtccggcgagccctacacgctgcacaccaacgtgttcacgcgggggcaggggcagcgggagcagcagttccgcctctggttcgaccccaccgncgactttcacacctactccatcctctggaaccccaagcacgtcatcttcatggtggacgacatgcccatcagggacttccg

SEQ ID NO: 13748 - DNA, 661 bp, Zea mays
  unsure (1)..(661): unsure at all n locations; Clone ID: LIB3279-219-Q1-K6-H2
cccgggtcgaccccgcgtccgcggccgcgtggggttcggtngtccctctcctctcgaggtattagcagtcgaccggttcctcggagcacgatgaagtttgttgctgcctacctgcttgctgtcctcgctgggaacgccagcccctccgctgacgatttgactgccattctggagtcagttggctgtgaagttgacaatgaaaagatggaactcctgctgtcccaactgagcggtaaggacatcaccgagctcattgccgcgggcagggagaagtttgcttcagtcccatgtggtggcggcggtgtcgctgttgcggcagctgcacctgctgctggcggagctgcttctgcagctgaggcaaagaaagaagagaaggtggaagagaaggaagaaagcgatgatgatatgggcttcagcctcttcgactaggctgcacagtcatcacagtattgttttgggcagtgaaaccagaggaaaaccagagtcatgtttagattttaagcttgttttatgttggaaagtactggaaagactgctacttgtctttatatttggtaattcagccgtagattgctatgctggttgggatttactcgtgaaccnagatttttctgtcttattatcctgaattgttatcccaaagtttcttggctttttaact

SEQ ID NO: 13749 - DNA, 648 bp, Zea mays
  unsure (1)..(648): unsure at all n locations; Clone ID: LIB3279-219-Q1-K6-H3
cggccgcgtgggctcgaaaagaagtggnngactaacactagacatcgtaacaaaatcaccaaagttatactgtgataacgaaccgagagtattttacttctataccaacaagtttagtgccgctgccaaacacattgacatgagatagtatgtcgtaaagaagaaactccagcattaaacaatcgaacttgaacatatgtagacagagcaaatgctggaggaatggaggatccgttattccgttcactaaaggttcggtgctggtgagcaagggggtttgaagtgatacaagtcgctgatcgctgtccgggtagtagtcatatcataatcgtcctcatcgtagtcctctccatcgctttcggtgtcctacaaggctgaagagaacagcatgaattcagttcagcatcgcgggttcaatctcagtttctggaaactgttcgtcggttcgtgatcactgtagtagacgttcatctcggaatcacagcgtgttcagagcattctccagcctggttactaaatgaaaaccatgcaggattcatttgagatttattgtgctgtcagttctgcttcaatagtccaatgtgtaggttaaccgntaacctngatagtcctttgattggtagtagttagggcctgtttggttcacta

SEQ ID NO: 13750 - DNA, 646 bp, Zea mays
  unsure (1)..(646): unsure at all n locations; Clone ID: LIB3279-219-Q1-K6-H4
gctgtgcatcaaggcatgtccagtgtctgatgcaggaatgaataagcttgctgaaggctgcccacgccttgtcaaggttaaggtgaagaagtgccgtcgggtgacctctgagtgtgctgagcacctccgggctagcaggaatggagctcttgctgtgaattttgacacacctggtggagctggtgagttgcaggatggtcggagtgtggatgacagtggtgcgctagacaatgccggcagtgatgttttgcccgaggatttggatgatcggataggaccagacctttcgagtggaagcagtggcaggccatcaagatggaaagcactgatgggtgctttgatgttgaggagcttttctgtttccatatttcaaagacaaccgcgtggagcctgctctacaagtcacgagtcatgaaaattggatgacatggttattccttgagccctttaaattcttttatatttgtatgttcaattaattggtgctgttatttgttgtatcactgtttgtcgttgtggatggtaccatgcttgtcattctgatttcggttaaagaatntagatatattgctagacttgtcagttggagcatacttattattaattgtcctagcaacagggattcatgcgattgcatgctgtaatc

SEQ ID NO: 13751 - DNA, 598 bp, Zea mays
  Clone ID: LIB3279-219-Q1-K6-H5
aatttttttcccgtccataatcattgaactgacctgctttcttctcgtgacgagtaaaaatgtaaaatatacgagcaactttgtcatttttgttgactgctttggtgtgggggtgacggatagcaaattccttccctcttcatctttctcttcctggagaattatggcgtgaggaaactggaggcatttttcgctgtactgattgcaactatggctgtttcatttgcggttatgtttggtgaaacaaagcctagtggcaaggaacttctgatcggtttggtggttccaaaattgagttcaaagacaattaagcaagcggttggaattgtgggctgcatcatcatgcctcacaatgttttcttgcattcagcactagtgcagtccaggaagattgacacaaacaagaaatctcgtgttctagaagcagtttactactataacatcgagtcaattcttgcactcatcgtgtccttcttcattaacatctgtgtcacaactgtttttgccaaaggattttatgggtctaaacaggctgacagtataggtcttgagaatgctgggcagtacttacaagaaaaattggaactgcattctttcc

SEQ ID NO: 13752 - DNA, 534 bp, Zea mays
  unsure (1)..(534): unsure at all n locations; Clone ID: LIB3279-219-Q1-K6-H6
cggncgcgtgggcgagcaggcggagggagcaccgccagtcagnaagcagtgggttggatgaggatgagcggcgtgatccccgaggagcaaagcgatctgaggagaagaacaggaccgcaagaggagctaaagaggagcattgaattggtaattcctatttgatgatgttattgagttcctctatttgtcagctggttcgttgccttgtcataagtttgacacatttgaaacatgatgcttaatatgtgtaccaatatagcatgccctgtattactgcatgtctctctgaactatacttcgagtctattatgtgtttaggatttgataattgatatattgncaaggatttttaatatgatgcattcagttagccttcccccgcaataatattgcctgagagaattggcattagaacatttctcctacatngaaggatcctttctagctatgtaagagagttattgagcattatatgagaggaataacgaggatctctacgagctaaaaaaaaaaaaaaaaaaaaaaaggcggccg

SEQ ID NO: 13753 - DNA, 644 bp, Zea mays
  unsure (1)..(644): unsure at all n locations; Clone ID: LIB3279-219-Q1-K6-H7
gttctttttgccaatagcggnatagtacgactcgattctcaaatacaggaatggagccactctattctatttgactctccaactaaacgcacccatacggttgatgctgatttcttcacatcgcatgctcatttttttctctgtcccgcatagtgaggtagacaagttcgccatgctattttttcttatttttcgcgcaacaaggcagctaggtccgatgcacgtggcacaagtttttcctacgccgttggatcaccactctccacaggtccaccaccccattgtcttctgcccttgaccttgccgctagctagatccgacaagagcatgcttgctcttccacccacgaccccaccaccaagtcagctctaacgtgtcgccggtcaaccaccaaaactagatttaaaattgagctgctccccaaatattaagaactactggagaataaactattttttactcccgatagctatttagtaacttgctaaagatgaattttgggagctttagggaactattagagtttctcttatttcaagcaatgatcgtgcggtcagatttggaaagtagtaagggactagatgtgaatgatagactctcatcaatatcaaattaatgaattagtgatgcatagtgactaggtt

SEQ ID NO: 13754 - DNA, 651 bp, Zea mays
  Clone ID: LIB3279-219-Q1-K6-H8
atccactcgtagagagaggaaaaattccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcgtccgttcctttgggatctgaat

SEQ ID NO: 13755 - DNA, 220 bp, Zea mays
  unsure (1)..(220): unsure at all n locations; Clone ID: LIB3279-219-Q1-K6-H9
ccatcgtcgatttcttgtaaacaccaataagaagaaaggcaagtcattgaaatgcacaagtagaccatcgtgccaagcctattccccaaaggagcaaccttgtattccagatggtatagaacttaaatgtagtgtatgggaatccgatattgtagcctttagtaccagatgctcattacatgttgggaactcggtactatatctgattcccaaccagtnc

SEQ ID NO: 13756 - DNA, 561 bp, Zea mays
  Clone ID: LIB3279-219-Q1-N6-A1
atacaacaaggtccatgcaaagaagcgacatttgggctcagttctcgccttccagataggacagattttcattttacaaaagttcgtggtgaactgaattttgtaggcgctacttgtgctgtatttcccatcagccgtccacctccataaaatagtatcatcaagatcattgagttcatgtgtgttattgataccctgccagagggagatgaattcttttatttctctatcttgagtgtaaggagagcagaagtgcatccatcgattgtttctaagggccaccgagatattcttcctcttggctttcatgtataatgttggtgcaatgttccttggcgtctggccccgaatccagctcgatctccaaaaatctgtgattcaacatttgaactagtgctcaatctgtgattcaacatttgaacaaggtgacagccacaagtcccgccgtaacggctgctaaaatgatagctgctaactcttggctccatacgaaaaatcctgtcaggttgttacaatttatcatatatgaaattgttctaattcagaccagtcctttttttt

SEQ ID NO: 13757 - DNA, 385 bp, Zea mays
  Clone ID: LIB3279-219-Q1-N6-A10
aaaaagccagaaaactttgggataaccaattcaggatataagatagaaaaactctggttcacgagtaaatcccaacccttatagcaatctacaggtgaattaccaaataccgagaccattagcaggctttgcgggactttccaacctaaaataagggtaaaatctaaacatggctttgggttccctttggtttcactggccgaaacaatactgggatgactgggccacctaatcgaagagggtggagcccatatcatcatcggtttcttccttctcttccaccttctcttctttctttggctcaactggaggagcagcttctccaggaggaggtgcacctggcggaacaggcacaccggcggcgccacatgggactgaagcaaac

SEQ ID NO: 13758 - DNA, 578 bp, Zea mays
  Clone ID: LIB3279-219-Q1-N6-A11
ggggaaaaaagcacacaacaaatcatcattaagaaatggtttcatgcatgagaacgtgtttacaaatccgtttgatataattcaaatggaggagacctaggtgcctacctcatgggacaacagcgcattttacaacaaagatcagtaatagtacaaacctgaaatcaacaacaacaagaagaagaagaagacaacaggactccggagtagcatagcacgtcgtcttcagcgcctaaaatctctcactggcaccacaggatgctattttcccctcactactagtaccactgagaaaatcttaaactgcttttggcgctgctactagagatcaactaatcgatctgtgaaagcggatgaggcacacggtaagtttcagatggggcgcatctgggaagcaggatcctctggttaaaaaaaactaggtctcggtgggcttcaggagctcgccaagattcacatgcaagctgttcctcatggtccggcgtcctgctccgccagcattgccctttctcatcatcgcggcaaactcactataatcaatctgaccgtcattggtttggtccacatctttgatcata

SEQ ID NO: 13759 - DNA, 566 bp, Zea mays
  Clone ID: LIB3279-219-Q1-N6-A12
aaaagcaagtgttgataacatgtgagaaatagaaactgttgtgcgaaaaatgaaaaaggggcactacattctttattacttttgatatttatacaagcagaggagacaccaaaaggagtagaccaaaagccacgtccatacatggggatcatgcaggggcacatctcttggaggacgccggttggaaagcagtcagcaactgcttatctttcataacaatttccacacaactgcgtctggcaggcaaataaggtgtttggtttctagtaactattttttagtccatctattttactccactttagtctctaaatcgctaaaacctaattatttcctttagtctcttttagtcacccttaatgagaccagagtctaaagcagtttagtcgctattttagtcatatcatttggcaatttatatgctaaatgggactaaaacgaagggactactctttagtagcacaaactaaacgggtcctaaaagctaagtctaaagaaaccaaataaccctaaaatttaagatggtacgaactacaaaacggcaacacagttcgcgagatcataag

SEQ ID NO: 13760 - DNA, 360 bp, Zea mays
  Clone ID: LIB3279-219-Q1-N6-A2
aaagtcatacaagaaattctttattaataacattcgttacatattttcgacagcaacaagcgaacccaagcaaagaaacctattcttacaacgttcacaaatcacaacaggtggtggctcagaaaaaatccagggatatcaatacaggtagaggttcagcttaaatgagagaccgttcatctttgttgcaattaaacaagcaggtagcatagagccaaagacaaagaccggctactgctatagttcaagagggataagattttcatccatcatattccccattggcaaacttgtcctccgcatagcagacagcgaccactgggttcccaccaaatttccttccatgcagcgctgtctttg

SEQ ID NO: 13761 - DNA, 508 bp, Zea mays
  Clone ID: LIB3279-219-Q1-N6-A3
tgggaaagacggcgcccgcggcatggccagaggggatggggcgtcgtcttgcatgaaggactccatcgctcgcatcagatcctcgctgggcccggggagatttatagcagcggccatcaaatggtacaagaatatactactcacaacttttttttctggggattttttttgtgaggaagaagaagactaaatcgcctggttcttagctaaaatcaaagaactggcacgacagatcttaactagacctacctatgtcaccaaaaggggaagaaaagaaaatgagtagatcagagaccagaaactaaaaggctccggagctctgttctattaggtagtaggatccaaggaaaaagaagagaaatccaactggtctcaaaaagagacgagcgatgcgaaaaggatagtgagagttgcaaggattatacctggaagacggaagaactcgctcagagctagtcctacctcgctcagacctcacggagactgtgtggattgtgttttctggctg

SEQ ID NO: 13762 - DNA, 511 bp, Zea mays
  Clone ID: LIB3279-219-Q1-N6-A4
caagcgtcacgaaaaaaattccataatgcaagaaactcagctgtttcaaacattggggcaatccagttcttcctaaagcaaaactccccaagcaatcttttgcctgcaggatcccaaactgggggctcgaattttcattcccccaacacaggattcaacagacttgcaatgtatacattagccacttggggcaagtaaaacttctggaacatctgtcatcgatcaaaaatatagcgaaatagcagccccagggcgtgtgactatttaaacgtgcccaaccgaaacttcaaagaaagaaagaatcgaaatggaaggagctttactcggttcctgctagcaacaacggaatatctcagtttatacaagggcaaaaatccagtctgtctgcgtttgttggtttcctgatttcagacggttgaacatcatccacatgtaccaccagatctttggagccaaaattcaaaagcaggggttcttttcgcatcaatgtacaaatcatgtttctgggggc

SEQ ID NO: 13763 - DNA, 448 bp, Zea mays
  Clone ID: LIB3279-219-Q1-N6-A5
aagggatgacccacagcagcatcttaacatggtttgctcagttctaacaagtctcaactggtggaacatagataaatataagctgggactacgagccccaacatgccccctgacagaacacaaacttagcgcttaggactgcctgttcttttttttgacaccggacttggcaacctggaggctgcggtacaccgagcttagcctaacaagagctggcttggtcaaatcaggcctgtagtagttggcactaacctggtttttcacagccttggccatcttgcggaactccttgcgcatcacaaacttgtggctgaacttcccaggggcgttctgcttcttgggcttggtaggagagaggaccacagcccagtcctttgcagctggctggatcctcacagtcttcttgttcgccaaaccccaatgtttgaaggagtggatgttgtaaagg

SEQ ID NO: 13764 - DNA, 508 bp, Zea mays
  unsure (1)..(508): unsure at all n locations; Clone ID: LIB3279-219-Q1-N6-A6
agtacacaacgagcgtctgattgctgaagatcttctcgatgaagacgaacatacaataagacacaaggacgaaactagagcaggacacatcccatccacagatctagacacgagcatgctacagcacacagggcaaatgaaggccctactttctaagccttcttgggggacttggcgcccttcttgggggacttgggctccttgctgccggcgctggccggcttctccgccggcttcttgggcaggagcacggagtggatgttggggaggaccccgccctgcgcgatggtgacgcctgccagcagcttcccgagctcctcgtcgttgcggatcgccaggagcacgtggcgcgggatgatgcgcgtcttcttgttggctttcgccgcgttccctgccaactccagaacctcgggggcgaggtactccangacggcggcgaggtagaccggggcgccagtgcccacgcgctgcgcgtaccggncccttttcaggtagcgcccgatccggc

SEQ ID NO: 13765 - DNA, 495 bp, Zea mays
  unsure (1)..(495): unsure at all n locations; Clone ID: LIB3279-219-Q1-N6-A7
aaatgaacatcacttttttcttttattaatagtgtgctatacacgcacgcgcacacgcaaagggtcaatacatttttcgccctcacaacaaccttaataaaagcacagcaatgtgtatgcggggaatatttatgcttattatgaataataagcatgaaggggggtcagtcagtcagtcagctgatgcccctcctgtacaccccgcagccgcctgaaccgtggcaagcgggctgccattgagcacgcccctgaggatggcgagcttcgccggcgtgtacggcgggtacctggccctggcctcgccgaggaagctgcggtccaggacggccttcctgtgggagaaggcgtcnaagctgaaggcgccgtggtaggcgcccatgccgctctccccgactcctccgaacggcaggttcgggtttgtcaggtggatgccggtgtcgttgaacatgatccctcccgccgagacggtcctctcgaactgctgcttgagctgcc

SEQ ID NO: 13766 - DNA, 561 bp, Zea mays
  unsure (1)..(561): unsure at all n locations; Clone ID: LIB3279-219-Q1-N6-A8
agcacaaaaatgttttatttgaaaaatgaactgtccctagtgattacaggtgtggtatttacaggaatggaagctccactttttgagagctctaactatacttattctaaaaacgaatgtaagcaaaaattgagctctaacatataccaggaaatgaatcatcgagagggagaaaacccgggggtaaataagggggaaaaaattatatcagtgatcctctgacatctaagcgaactaattcatgaacttccggcagttagcagtctgacaaaggcatggcactttgcgttcatcggcctcgtctggatcgaacaggtagtcatacgttagctcatcaccagcgcaaacttttttcttcgctattagaacaatacgactttcatcatgtccaacactcataatccttgcatagcagtttggtgtgcaggaatgattgatcagtcgtgccacgtttcctttgtctgtggcatcaacaaccacttnctcgctgattttgaaaagatagcaatctttgccctgcacacgatatttttcttcacgtaaatcagctacactttgtct

SEQ ID NO: 13767 - DNA, 445 bp, Zea mays
  Clone ID: LIB3279-219-Q1-N6-A9
gatagttgagatgatttttttttgtgtggtgaaaattatattacacccaattacaactctttattttatgttttacctgaaatatggcagctacaaactcactggttcaaaaaaaaataacgagcatgtgaccaatccctcggatattcaactaggctctgtcacagcagcactttgggatgaataacgactacaaagacccttaacattcagtagcccaacctttaacacacatatatgtcatacatattgctggttggtcatttcagtaaagatcttgcaaggtgctccctagctgtggctagtgcctgagatatcgtctgctcagaaaagggcacagaaccatcaacagcattggttgcaaccttaccagcaatggtgtttgcatctgtttccaggatgattcccccatctacaatttcatcaatgcagagaagtatcaaat

SEQ ID NO: 13768 - DNA, 560 bp, Zea mays
  Clone ID: LIB3279-219-Q1-N6-B10
agctcaatctaacatttattctgcttccaatatacgtagtacattattagaactaggagcgcaaccctaaaaaaaagcatagctgcattattccaatttccaactaccgggcatagctactcacaaaaaagctggttggttcatgagacagctaggcggccggcaagacagccctcggcgttgccgagatagaacgccaagacaacaaagcgcctttcagtcaagttgacggggccaggccgggtcactaccgcttgccagcagcccccaggactcggcaccggtactctcccagagcccagatcgggaaggtgttcctgtactgggagtaactgatcatgcagttcttggtgaacactcctatgatctcttgctggggaaattctccgtcctctgactgcaagtttatcaaaacccttgctgctcggtgtagaggcgcgggatctctctgggcctgtcctgcatcaatcagcgccagcatggcccaaccagtgttcgctgcatgagctcggttgcctttgagattggtgtaaacctggtcttgagacgataaatagctt

SEQ ID NO: 13769 - DNA, 387 bp, Zea mays
  Clone ID: LIB3279-219-Q1-N6-B11
gcagcaccaagaagcaccatttttttccttaggatttaacttagaataaagcctgacgggggtgacagcacccatcgatccgcagtccatgctggttgatgcatgggtctgctggagccgaggatgaacacagcactaacaactggcacagagcgaccttcaatcaaaaacacagatgggcaacaacaaacacgagacgaacgaagataaacactctggactagggtaaacaacacggtagcgaacaggataacttgggcgcgcgggccccaccggtcagttcctccagttcccgtccgagttgccgtagcccccgccaccgttggcaccggcgtaggcggcggcaccaccaccgtaggcggcggcggcaccaccggaggcggcggc

SEQ ID NO: 13770 - DNA, 576 bp, Zea mays
  Clone ID: LIB3279-219-Q1-N6-B12
atgataataacaccatatattcctgtgaatacgttatgcacactttaaataaaaccagacttcctggccatgtaaatatacaataacctgagaagatggaatttatatcctcaagaacattccatccagatacagcagatgctactgtatagaaatgacaggtaccaaaaacattagcagcctttcatcttttcctccaccaactcgatgcagcggtatagcaccagttgaacaagatttaacatgcacactatttgttttgtaatctcatcagcatccttttcattttccaactgaatttgctccgcgattggtcttaatggggtcagccactccgagtgcaccttgtgcaatgtctctttccgaaacaattttgcagatctttgtcctcttgaatctattatcagaataaatcttagcaagtttagagctgatattacctgttcactgtgatcaggaaggcaaggaggaccaccttctggaggcctcaaaatcagctcaactaactcaagtgcatgagatgcccagcgcggtaacccattacctcgaaatccttcgtcttcaatacaatcattg

SEQ ID NO: 13771 - DNA, 504 bp, Zea mays
  Clone ID: LIB3279-219-Q1-N6-B2
gattaaacatccattctattcagaaactgatgtgaggtcctgttacttgtcctagtatcagtattcgtcaaagccaactgaaataaaccgagtcctccctcaaaatgcatgttagctaaagaaaaactagggtgcgggcagaggaccaagcaaagacacccagtgacctggaatggccacctcaaaaaacgaattgatgatcgggaaagctctgcttgcactgtccactcatgccgtcttctgttttgctgacgccgaggaaaggtaggacagggtcctatggcccacaaacacgaggaagatgccgaggaagccaaggtacttcagagttgtgaaaagggccaacttgagccataagagaacgtagagcagcaagactgctcctattccagcatggaaaactgaggcaaatgcggccggtcccggcaaggacgggaagttcttcacgttcactccaagacgcacgagcccaatcaagaatcccataaaagcggacgcctgggt

SEQ ID NO: 13772 - DNA, 582 bp, Zea mays
  Clone ID: LIB3279-219-Q1-N6-B3
actggaacatcatctattcatcttcagtccattacaacacccgtcgtatgtcacctttgctacaaacatccatagtggtacaacacaacaagagcagcaaacgcgccagatcaaaccagtctccagtatacacgcaggcaagcagcacgacgcattaacttttactaggtgttagattatcaagtagcacgcattatatacacagtacatcgcaggcccaagctatactgctaagcatcaaggagacatcaggatcttcctcgactcacgggcacgggtgccctcctggatgcaccctgaaccagcaagagagtttatccacacgtcatcggttctcaccggctcttcgtcgtcgtttctgtgccaggtccagtgggcatgggtggagttcacgatctttagctcgccgtgcccaaagctcgcttccctgaagaccgaccacgctggcttcgggttacggtacctgcgggccaagccttcacggttcccaccgtcgccgatagttatgtggacagcgccacagggatcaggtctggaattgtagactcgctccgcacgttcataagcatggacatgacctgc

SEQ ID NO: 13773 - DNA, 344 bp, Zea mays
  Clone ID: LIB3279-219-Q1-N6-B4
cccccccccgggggggggggggaaaattttaaaaaccccccccttggggtttttggtccagggccaatgtttttccccggggccccctttaaagaaaaaaaccccgcctttgggaaaaacccccccaattgggggcccaaaaaaaaaacgggaaaaaaaagggggggcccccttgggaaaaaaaaaaaaagcaggttccttttttttttttgggggggccccccccccccccccgaaaaaatttaaaaaggggggggggaccaaaattttccttccccccaagggggggggggaaaaccaaaggggggggggggggcttggggttccctttccccccccccccc

SEQ ID NO: 13774 - DNA, 514 bp, Zea mays
  Clone ID: LIB3279-219-Q1-N6-B5
aaggcgacataggatcagcacaaggatctggcaaacaaaccccccatacaacaatgaaaatccatagctctagtactacttgtgaacagcggcggcggtagcggtagcactcgggtgggggggacagggcaaaagaacttattctcggcgggcgggtggaatgccggatcccctcagccccggcagcgggtgatgcgggagcagccccggtggtaggggttggcctggcccccggggcggcagttgtagtagctggcgccgcggcgggagcagggcacgttgtcccgccgcagcgcgccgtagctgatgtacccgccgcccccgtagagcgcgcggcggtgggactccacggacgcgggccccgcccccaggtccaggccctctgactcgtccaggcactcggccaccgtgccgcggcactcccgccggcggtccccggaggagaggaagcccaagcccagatcgaggtggctcgcgccggcgcccgcccacgcggacccccccacggccagca

SEQ ID NO: 13775 - DNA, 401 bp, Zea mays
  unsure (1)..(401): unsure at all n locations; Clone ID: LIB3279-219-Q1-N6-B6
gatgcttgaggtgtactaaaaccaaacctccttttctcatccctgctaaccaccggaactggaggaaggactgtgggttcatctggaggtgtcttcccttcatgctttaaatcttctgcaaactggcccaagtcttcatgagggcgttttatatgggtctctatcagggcataagcttggcgtgccagtaagactttctcggtgcaaagattcagagcattggcctgactagcttcaatgtccttcttcatcctctccgactcatcatcatncatgtttgacctgtcatacccatgggatgatactcccagaatatactttatctgatctttggtctgacccataatgccatgtgccctgtcatcgagctcccgcatggtggagagaattctttgcaggtc

SEQ ID NO: 13776 - DNA, 513 bp, Zea mays
  Clone ID: LIB3279-219-Q1-N6-B8
cagaacttcaaaatacttggggtgcaatcaaagtacacaagccaacacagcagataattctgtctagggtggaccacacaaactagggcggtcgaccaggcatgttgagcagatccgtttggagcattgctgtagcgttctctcatcttctcctcgaaccaatacttgaactcacagcaagtcacaagcacaggcaaacgatacagatagactcaagggataaaaggctttacctgccgcatacacaatgtcacgggttccttctacctgccgcgtctaggggaaggtgaactgctgctgcggctgtcactggagacgcttcttcctcctctaggaggctttctagggctgcggctccttgataccctccttggcccctttcttggtggagtaggtgatcgggaatatgatgagtctgacctaccacgcctcaatggaggccctcgtccccttcttggagaaattgatctggagcgggagccaaggggtcggcgaggaggagagcgactgaag

SEQ ID NO: 13777 - DNA, 131 bp, Zea mays
  Clone ID: LIB3279-219-Q1-N6-B9
gaatgtaatgacaggagctctgcctttccattaagaagaagattagaattgacctagttttaagaaaaaccgggccaaaaacttacacagagtgcccaaacaacataagcagcggcaaccccacacacaaa

SEQ ID NO: 13778 - DNA, 392 bp, Zea mays
  Clone ID: LIB3279-219-Q1-N6-C1
aaattgttggggggggccaaacaaaaggcggcccccaaaggcagggggccaaaaaaaggccccccccaaacaaaagggggaagacaaagccaaacgggaccccaaccccaagggggaaaaaaaccccccggaaagatactgcccgggggggcacaggccgggcaacgtcaaggaaccttatacgggggggggggggccaggcccctccagagacccccccccgggcaagggccggcccccagaggcacgccggggaaacccccgcttgaaaaagcctttccgggggccccgggggccccccgggccctccgggggggccccccaaccccggtttgggcccaccacaacaggggtgaacccccttaccccgccgggagggggggacacatacc

SEQ ID NO: 13779 - DNA, 588 bp, Zea mays
  Clone ID: LIB3279-219-Q1-N6-C10
agtccagggaatttttgttctaatattgaaaaacttcctgctcctttgggagaggatgcgctttgcaaaatacaaaatgttttttacaaaacaaccctgcataaaatattgatgtttctgcaaaatatcttgggctccacatattccatgcattatatctgatttccccattccgtgggtgaaggtgggctgctgagtacgtttgtactcacccttgcttatttgttgtttttcagaaaaaaggagatcgagtaagagttacgactgttcccaaccttgcctgtggctgttggaccgctgatttgcttcgctgcgtatatcgagctgcttcagccccactctgatgatatgtcccgagttgtggaccaactcttaaagttgatcgccacctttataggtttgtctcgtttaagcagatctgaaatcatctgatgtataaatgtgtttactagcctgctgagactagtaattgtatcacatttgagtcccagaggattggggacgcttcagcacaaagcgaagtcaaacaagatgtttggtggtgataacagtgcgaattccttgcggatccaagtcaaacaagatgtt

SEQ ID NO: 13780 - DNA, 502 bp, Zea mays
  unsure (1)..(502): unsure at all n locations; Clone ID: LIB3279-219-Q1-N6-C11
agctaccaaatacagtcaatacattacattcaatcacaggttgcatactcctttaagccgttgaattttacattaggacagtttttactacgagacagcgtcctgagatcagacaacaacctcagccagacgagaaaaggcggcatttagaatctacctcctcacaggaggcgcgctacctcgtccaacaggaccaccaccacgaccaggagcagcccgagcacgcattggaacagcacgtncacgaccaactccaatagctgatcctttgcccctaatcctcgcttccaagcgcttgaacatgggagcgttcttgagcatatcaggtataatcataaatctcactctgcttcctctgatgaagacgtgctccagctgcgaaaccttcccatccttggcagtgaagggtatgttctcgagctggcaattccagttatcctcgcactcgaccaatgacccccggtacacttcggcggtcttgagctccaccgtcaccacgtga

SEQ ID NO: 13781 - DNA, 595 bp, Zea mays
  unsure (1)..(595): unsure at all n locations; Clone ID: LIB3279-219-Q1-N6-C12
aacaacagagactagtagttaatatacgaatataaagataaccatcatccacataggaagcatgtttttttcatgtccgaatataaaagctctaacaagcaaacaacactcagcaacctactcgcaggcaggagttccaaaacaacgggatcgcaaagagaagcaactcagtacttgtagtccttgacgtgaaggctctcggtgtcggcggcagcatcacccttgtaggtgccgagggtagcctcggagttggccttgcacctggcgaggaaggccgctctagccttctccacgttctccaccttgccagcccaggccttgagggtgctcgcctggagggcacggccgaaggagaaggacagggcccatggcttcttggtgctgagcttgttcatggcattgagattcagggtggcctcctcctcgctctgtccaccggagaggaagacaacagcaggcacagcagcagggacggtcctctggagggtacggacggtgtactgggcgatcacctcaggtgtcaccttcttagagtcggagccaggagtcaccatgttgggcttcaggagggtaccctccangaggacatggtgct

SEQ ID NO: 13782 - DNA, 446 bp, Zea mays
  Clone ID: LIB3279-219-Q1-N6-C2
aaagtcttacaacgtaagttgtaaaccacacaacgacagatagataagaaccgacagaaacataacacgataggagccactcagggcagatcacaggatagcagtggcacacaagcccgacgacgccgcgccaggagagcgtctagtactcgtcaccctcgtcgccgtcctcaccctcgtcaaactcagcaccgacctcctcgtagtccttctcgagcgcagccagatcctcacgagcctcggagaactcgccctcctccataccctcaccgacgtaccagtgcacgaaggcgcgcttggcgtacatgaggtcgaacttgtggtcaatgcgggagaagacctccacaacactggtggagttggagatcatgcacacggcacgctgcaccttggccaggtcaccgccggggacgacgcttggaggctggtagttgatttcccacttg

SEQ ID NO: 13783 - DNA, 443 bp, Zea mays
  unsure (1)..(443): unsure at all n locations; Clone ID: LIB3279-219-Q1-N6-C3
gtagctcaagcaggcattttttttagataatggaagagagttgtggctttcccctcataacgaggttagggccaaactcagtacacatgcctttatatcgcacatgaactgagtacaggatatacaaacgcgtacacatgcctttattggtggccacatcaacacaaactcatacacgtcagtacgtactgagtacaccatcattcgatttagttctctatagtgccggccggtctccacacacctaacaccggctaccaacacgcaggttaaggacgcgacgcttttactttggagagggaaataaaaataataataagctggccaccgatcgagcccgtgtgtccggcggtcgtcgtcnccggcgcggctgatcggccgggggcctcacgcggcggtgacagcgatcttcatgcccgcctggcagtggcctgggaagctgc

SEQ ID NO: 13784 - DNA, 538 bp, Zea mays
  unsure (1)..(538): unsure at all n locations; Clone ID: LIB3279-219-Q1-N6-C4
tcgcgatctagacagaactaaagatgctgctgatgctgccatttcaaaaatcaattctggtttggttgttggtggaaggcccctgtactgcagcaaagggttacttgaggttccaaaaccttcagcgaatcttgttgggcacctctcctcatatgttaagattggtcaaaagcagcgcgacgagcagaagaaggctgtagcaacctcgcattgttcccagcccaacacgatcgagtacgacttggccttggactggatgcttcttcgggaaaagcaagaccagagcttcagagtacttcacaagaagcacagagaagccaggaaagggttcgcaagcctggtcggcaaaggatccaaggcagagtagcaggccggttccaacctttcagagcttggcgcggtatgactgccgactggcaggaagagagggtcgtgcgcccanaaagttctctttttgcagtagccatcgagtagttcgttgggtcaattcgtgttaatttctgttaggaaaggaaaaggtgttaataagtgttatgat

SEQ ID NO: 13785 - DNA, 611 bp, Zea mays
  Clone ID: LIB3279-219-Q1-N6-C5
gcaacggaaacatataatatcagataacttatgtacaaataagtgttatactgttataggtgagtgcaatactaaaacactactattttgctcagaacgttatataagtgaaaatatgtccctcctttccaagtccttggttcagatggtcaaccatctcatcaggtttcaaagggtgcatatcctgcattgcaagcatataataataaaaaaatatccatgttcggagggaaaaaatatgtgtgacaagctgcttaccagagccatagacaggtgcaatcaactgcttgcctagcaatcaagtaagccatattgataatacagtttttatctactggtctggtttgaataatgccaaaaaataacaatggcttaatagtagctaagctaaaaatgatagcatcacacttcaaataatgtgatgttgcaccatacagctccgaaccagtagattcaattagcaaaagaccatttcatcaacatatcattaaggtattccatttttcatcaaaatatgtgttatgccttgaaaatagacaaaagcgaaacacgagtcaaatctgtaaataatcagtgaatctattcaaaatatatgctatgccttgtatgga

SEQ ID NO: 13786 - DNA, 512 bp, Zea mays
  Clone ID: LIB3279-219-Q1-N6-C6
gaaaaatatcatgataaatgaaccaatttttgctgttcaagacattcatggacagaaaccacccggtccaatgtgacccacacccggcttgacagaccaaccaggatcctaagactgacgctacatatatattggtatcctgggggtcatctgtggcaaatgaacttggcaccaccacagaagaaacctcccgtaactaacaaaccaaaatcatcccgcattaagagaccaccggctggtttatcatcccctgggcccattgggcagtctcccgaacttcatcattcaactcttgagcttgacattccctcaagaactcaacatggaataggggggtcttgaacagatcctttgagctttggccaagcgtgtccgcgagatccccaaggacaggaactggagccttcgtgacactggcatccctggtcctatctttggagacagcttcagtgaattgtagtagatggggtgcatatgggatcatcagctgagcttttgggcccttgatgccc

SEQ ID NO: 13787 - DNA, 589 bp, Zea mays
  Clone ID: LIB3279-219-Q1-N6-C8
aagctaatctcaggtcccatattagcgagcggatctgtcacagatggtagcaggaagggaaacaaaagtgcaaaacatgtccagactcagcatggacctggcgacccaaaggcacgcgccatccacatttattcggggcgtacacaagcagcaaccatccatgagaagcaggggggaaaaacccctactgggtcttgaacatgtggcggatcaagtcgacgacgcggttgctgtagccccactcgttgtcgtaccacgagacgagcttgacaaagtggtcggtcagagcgatcccggccttggcgtcgaagatgctccacctgctgtcaccaaggaagtcggtagaaaccagatcctctttcacataacccatgatacccttgagtggaccctcggaagcagccttaatagctgtcttgatatcctcataggagggccccttctcgattctgacggtgaggtgaacaaccgagacatgcacagtaggaacacgggaggacataccagtgagcttgccattcagatcagggagaactttaccaacagccttggcagcaccggtgctgctaggaatgatgtttaagctggc

SEQ ID NO: 13788 - DNA, 545 bp, Zea mays
  Clone ID: LIB3279-219-Q1-N6-C9
gatggaaaatacattattcttcgtctcgatttattagtgccgcatgttcacaagatgcatcatcgtacgattccggctcaaatgcagggaaatagttcaacatttgcatacgcctgtgattgctacaggggttccagagcttcacttttttggtgtatctgcatacttccaggagggatgtgcataggaattgtattgtcttccaccagccacatcttctgcacgtatctggctgccaatttccttcaggtcctcagctgtgagcttcaccttcaaggagtcaacgttggcatctaggttcttcgtttttgttgtccctggtataggaaccacatcatccccttgatgcagaacccaggctagagctagctgagctgggctgcactggtacttcttggccaaatcttctattttcaggtaaatctgcttgttcttctccaagctttctgttgtaaatcttggatgcctttgcagactagattcagaagaaacttgctgtgtcactcctcttccaccaaaaaatccacggccaattggactgtgag

SEQ ID NO: 13789 - DNA, 387 bp, Zea mays
  Clone ID: LIB3279-219-Q1-N6-D1
ttttttttttttttttttttttttttttttttttttttttttttttttttttttttttttttttttttttttttttttttttttttttttttttttttttttttttttttttttttttttttttttttttttttttttttgggggggacccggggggtttccccccggggggggggggggccccccaaaaatttaaaaaatgtataaaaagggggggggcccccgggggaaaaatttttcccccaaaaaacccccccctcattttttttttaaagagggggggaaaaaaaaaaaaaccccctcccgaaaagggggttggggtaaccccccaaaaagaaaaaaaatttttttccatccccgccagaaaaaaatcaagaaagggggggg

SEQ ID NO: 13790 - DNA, 303 bp, Zea mays
  Clone ID: LIB3279-219-Q1-N6-D10
gaataaaaggcggggggcggccttattgcgaacttcaatttcgacgcaaggccggcgcgcgcgagtacaataatatcaaagggcccaaaaaaacaataaattacaattattcattttctcaaggacaactatattattagtactaggagctggatcgatctttggtccgatccagtccgtaatccaccagagaaaagggaaacgtctaggcgggtgctagattagcagcctcagcatagcgcgcgcaaaagccttctccttccttcaatatacccggagagaggcctcgtcttcatcttcgtc

SEQ ID NO: 13791 - DNA, 438 bp, Zea mays
  Clone ID: LIB3279-219-Q1-N6-D11
gggggagggcactataaatacacccatgacaatattaagtacacataagcactaagtaaaaacatttagcaaaaccttattagaaggacgtgaaactaaaggataaactaacgcccatagtgagcatcaatctagggctctatttctttgggaaattttttattggacatttggccgagccagggtaatttctacaggctcctttagatcccatgctcaatcccttggccttcatgcatgcctgagacctgcaatggcgtcgtgctagggtggcaaggggtaccacattccatagcgatgggatcataaccgagccgtcgtccaacaactccatctgtggatctcacacgttgtcattccgagtgctcgcaatcacccaatgcccacctttcatgccatgtctctgaacgttctccctgtttctctcttaattatgag

SEQ ID NO: 13792 - DNA, 589 bp, Zea mays
  Clone ID: LIB3279-219-Q1-N6-D12
agtcataaaaattactagatagcctcaaccaacctattcaacatactcaatccagtaatcataggtggaattgttgaatggattcttccatcataggaagagctgttacaagaatttagaccagacaaaagaacacattgtgctggagtactcgacatgagattctagcttttctctttccccttcccactgcagtcaacgaagcaatttcaccttcctggaatttccttgtacacacattttcagaaagtgttttttgaaaactaaagaatttccagaaacactccttgttttagagcttcttctatttcccagctttcctctgtagctctcagatatctgccacgtgcatctaaacaatctctcttcgcagtcatttttctcttgctcctatgctgagggttagttccacaacatgtgtcagtcagaaggttgaaaattggttttgggatggttgtgctgcaatgcttatctcacaattgccttcatcggtcaccagtatctctcgaggtctagaagcccagagggaacttaaggcacgaaggcggttgtggtactcgccaattgccaagagacatcgagctgcctg

SEQ ID NO: 13793 - DNA, 377 bp, Zea mays
  Clone ID: LIB3279-219-Q1-N6-D2
aaaggggggaaggtcaccccggcaagcaattccttgggaaaaaaaaaaacaaacccaggggcccaaacagccctgggagggggggcccccccccaaaaaaaaaaaccctggccaaacattaaaggggggtcaaacagggggcgctaggtaaacaaaaggggaaccccccccggggggggtttgccctaaaaccaaaccggggaccccttcaagcgggtctgggaccccaaaacgggggacccccctcaaccagggggcccctggaaaaaaaaaaaaaaccgggtccaaatttgccccccaaaaccccccccggggaaaaccaatctggaatggaagaattaaaaccccccgggcagaaaaaaaaaaaaggagccccc

SEQ ID NO: 13794 - DNA, 631 bp, Zea mays
  Clone ID: LIB3279-219-Q1-N6-D3
gccgcagcgatcacctcgaacatgtcctcgtcggaccggtcgtcgcccacgcacagaacgaagtccggcaggtcgtcgtcgtcgtcgccccgctgctcctgcgtcgtcgacaggatccgcttcgccaccaggcccttgcttacgccctgtggcttgagctcgacgaggttgggtccagctttcactgagaccggctcgtttgcaagcacgctctccagatggtcgtggagctccttggcctggcaggatccgaaatctggatcggcgtcctcgtagcaccacacgatggcagtctccttctcctcaatagtcgacccgtccgtagtctcggtataggtcttcatcacaggctctgcgatctgcttccagctgcagtctatcaccggaacgcatgtctcccactctgcatctcttctcagcctacacaaccgtcgacagcatcagcgattagtgtgtgcgctctccagcagtagcagatcacgaactgcttgggagacagcaggaagttattattttacctgaggaagcagccgtgttcagctgctagtccaaggctctcacatggtaagaaccattcgttcagagtcatccggctctttgcgctcacaggaagaccatgttgttcctgtcg

SEQ ID NO: 13795 - DNA, 536 bp, Zea mays
  Clone ID: LIB3279-219-Q1-N6-D4
cagcaatggcaatacgagtacatttcttgtgttatatgtttgtctgctactctcccggtttctaaacattccttcataaccaagccagacagagggttcagaacttcagattacaagcagggcaaagcacttaagaacatgttcccacaacaaaccagcaccaatatacaacactttatcacctaaactgacagtccaacgaacaggaacaactctcctactcatcttccttcaaagcacagactgttcaccagcttctttcccaggcacaatgataattggggctgctttacagttgtggaagcaatactcactgacacttccctgcaacacactttgaataaggcctctaccacgtgtaccaagaatgacagcggcaggcttcagtcgatctgcttctcggcaaataacttttccagcgtctccttcaacaattctggccttggtccggaccagtaacgtcttgaatgcctcgacagctaaatcctccatgagctcccgacttttgtcatacacaatctcattttgcacactgg

SEQ ID NO: 13796 - DNA, 452 bp, Zea mays
  Clone ID: LIB3279-219-Q1-N6-D5
ggaaaaacgaagtgaatccatacatagattcaagctaccataaatacattcatactgctctataacaaattacaagatcaactttggcaatcttgagttagcgtcagttagtaggaaggggggggccggtacctgtcacggggagctagaccactcaacttcacagggcacattggcggacaaggacctaaccttgcattttcaacaacagggtcgcatggctcaaatcggcaaacattccaagggaaatgcacaagtgcaaccacagggtccagtctcaaggggcgggcatttcacaatccaacataggagcattgcttctttgcatgttctggaatcaatttcgcgacaatgtctgatgggactcctctaagttcgtgaggcttgaaattgaatagtggtggcaaaaagcgaccatttggaaggcgagtattatgatctcgaagctcatc

SEQ ID NO: 13797 - DNA, 263 bp, Zea mays
  unsure (1)..(263): unsure at all n locations; Clone ID: LIB3279-219-Q1-N6-D6
gggggaaaagggggttttagggggacggaaacatttggagggcccatagggggggggggggaaccatcgggggcggggggacattaaaaaggggacagggacccccttgtaaagggccataaaaaaaatacgagttggggggggatcacaagggaatgttaaaagggtttttaaaaggggagttttttaaatcccatggaagggccttataangggtagggggggtaaattttgacaaaaaaccctgcccggggggggggggt

SEQ ID NO: 13798 - DNA, 89 bp, Zea mays
  Clone ID: LIB3279-219-Q1-N6-D7
ggggcacacaccaagtgcataataaggacaagacctgtcaaacacatagcattacatatagtgcctgaatgcgctgagatgtcatagta

SEQ ID NO: 13799 - DNA, 447 bp, Zea mays
  unsure (1)..(447): unsure at all n locations; Clone ID: LIB3279-219-Q1-N6-D8
attcaaccttctctgtggttggaggtggcattccattgaaatatttagagcccaaggatggtgctcatcaccgatccatcgactcaacgatgtccgagggcacacgggtgcaccattcaaagttgcaagttatacaggtgatcgcaaaacacgacggaccgttttttggtaaaaaggcaacaagggcagacaaaaaaaaactcaggccaacagtgcaatcatttatcatgttgcactcaggcaaaggtcaccaaaaatgctaccatacgccagtagggcagggagtcatatccatagttgctccttgcgggactttttcacaatgaccggtacactagttggcggaagcattccgtantcagttatgatcatcgacacataatcaggtggggtggcatcggtcgttaaatttagcaattggagatttgcactgtctgcccagttctt

SEQ ID NO: 13800 - DNA, 561 bp, Zea mays
  Clone ID: LIB3279-219-Q1-N6-D9
atagaaagatcagttcagtcggtttactattgtttaggaacatatcatcatcacatatgcatgtagtgccccacagtcgaatatataaggcctagggggtaccccatcatttccaagtcaatcaccaacccacctcactaggttctccccattccgtagattcctcttgtaacccaccacataaagatccttaccaggaagtagggtattacgcctctccaagtggcccgaacatgtagaaaatcacctgtcgtctctcatgcatcttgtacgaaccattgagttacaatcaaaagcaccattctacccaaaagcaccgcgaggggtaaccccgggtgtgcggtcgggctccaaacaccgacagaggacatgagcgattgttactgacgtcgttggactttggttcttctggatgtccgctgcgagcgactgattgagaggaagggatcaggaagtataaggtgcatccacatgaggaaggggaagggaggcataggaataaggcgtggactacttgatagaaatagagagttttacagcttagcagagggccgaaaacat

SEQ ID NO: 13801 - DNA, 443 bp, Zea mays
  unsure (1)..(443): unsure at all n locations; Clone ID: LIB3279-219-Q1-N6-E10
gaaataatacagcgcattttctcttctgtgtcacgcaaaagcttgtgtacttacacggaagtcgtaacaatagactacacagcagcattgcatacaatggaatttgaacatttaacccactttgggggtccggcatcaactgtgcgggcgacggaccggcgaggcaaacttgaactgctccacgaccagcggaaaaaaaactggaccatctgaatctggcccgtctccctcgtttgcacattgatatcttggatagaaatatgtaacaaacacaacccagcactaatgcgttaaccggcaaaacgcaatcatcaccaccacggtgatgaccataccagcatacgcgatccacctgtccacgcggtgccgcctctcgataagcttcanaacggagtttgacagaccgacagtgttcaggacatccaaagctttcctttgagcac

SEQ ID NO: 13802 - DNA, 567 bp, Zea mays
  unsure (1)..(567): unsure at all n locations; Clone ID: LIB3279-219-Q1-N6-E11
aaccgaaataaatttcatctgtttatgcaaaccaccaactcaaattccagcaacaaatgaggcatgctccagcgtcaaactcagaatttggaacataagtgatcaacaacaaagtgttgatgattcacaaataaacaaggccttgctgggttacatgacgcagttcctacagaagcagagcagcgccgacagagaaaccagcaacatctaactacaacacaaggcgaacatcaacacaagagaagcctacaaagggcgagcgtgcaagcctaggaggaggtgaacttggtgacggccttggtgccctcagagacggcgtgcttggcgagctcgccggggagcacgaggcgcacggaggtctggatctcgcgggaggtgatggtgggcttcttgttgtagcgcgcgagcttggcggcctcgccggccagcttctcgaagatgtcgttgatgaaggagttcatgatggacatggccttggaggagatgccgatgtccgggtgcacctgcttcagcaccttgaagatgtagatcttgtacgtctncacgctcttcttgcccttcttcttg

SEQ ID NO: 13803 - DNA, 353 bp, Zea mays
  Clone ID: LIB3279-219-Q1-N6-E12
aggggcgaagaaactaaactggttggggaccgcacccattggtaatctggcatcagaatagttcagagtttttaaatcaagggtttgtcttcagaacaaataactacccaagaacaatatttacacctggactagaacagacttaccagggaacaataacttatgtgcctacatgaaggcgtccaactttgatcgcttaaaatgttgggggctgaaatcaaccaactttaaacttgaagttgtcttgatctcatccaaaaatgaattccctttgtctgattttatggaatccaggactgcacctaggatgtcagccgcaataccgccttgtattaggtaccctggttcttctc

SEQ ID NO: 13804 - DNA, 527 bp, Zea mays
  Clone ID: LIB3279-219-Q1-N6-E2
aatgtagaaccattttcattctaacaagaccatcccaaggaggttttgcagtactcattgcacagatacttagtctcaaacagcataacataataaatcttcaaaattcgacctaaaagcacataagacaagtctttcgcatagaagaacccacaggagaactggaattgaacagcttagtcgaacaagctgaagcccatgtcatcatcgctctcttccttggcctcttctttcttttcttccttcttctcttcagcggcagcagcaccaccagcagccggggcagcagcagcagcagctggagcaccacctccaccagatccgacggaaaggatgaggtcatcgacgctcctcttctccaggagcttggcgaagagcgcgggccagtaggcctcaaccttgattccggcagccttcaccaccgtcgcgatcttctcggaagtgatggggatcccgtcatcgtggaggatgagggcggcaagggtgcaggcgacctcgctggaagacatggcgacggattctcaccg

SEQ ID NO: 13805 - DNA, 134 bp, Zea mays
  Clone ID: LIB3279-219-Q1-N6-E3
ggggggggccccgggggggggttctcccctaaaaccccgcggggaaaaaaaatccaaaaaaataaggggcttttttcccccccggaacgcccctcaaggagaaaaaaaaaataatggggggggaaaaggccccc

SEQ ID NO: 13806 - DNA, 410 bp, Zea mays
  Clone ID: LIB3279-219-Q1-N6-E5
gaggcatgctccagcgtcaaactcagaatttggaacataagtgatcaacaacaaagtgttgatgattcacaaataaacaagtccttgctgggttacatgacgcagttcctacagaagcagagcagcgccgacagagaagcggggaacatctaactacaacacaaggcgaacatcaacacaagagaagcctacaaagggcgagcgtgcaagcctaggaggaggtgaacttggtgacggccttggtgccctcagagacggcgtgcttggcgagctcgccggggagcacgaggcgcacggaggtctggatctcgcgggaggtgatggtgggcttcttgttgtagcgcgcgagcttggcggcctcgccggccagcttctcgaagatgtcgcggacgcgtgggcggacgcgtggg

SEQ ID NO: 13807 - DNA, 364 bp, Zea mays
  Clone ID: LIB3279-219-Q1-N6-E6
ggtttggtttttttttttttttattttaaaattgatgtttttgagatggttaaagataataatagtgtcaaaattaaggtgtttttgatgggaagggggtttaaacgggcgcgtgggtttttcccagaaaaaagggaggggttcaagggggggagaaggtaaaagtagagagagtagggtgggaactggggggaagggtggtaaaagggggggggggggagaaatggaaattcgggaacaagtccatagaggatacaagctggaaaaataaagggggaagaaaggggtggggaataagggaggtaaaggatattaaggggggaaaggggaatgcccggaaataagcaaaaaaaaaaaggggggg

SEQ ID NO: 13808 - DNA, 494 bp, Zea mays
  Clone ID: LIB3279-219-Q1-N6-E7
agggaagtctggctgttttagagccaatgaacaccaaaaaaaattgcatatccatcattatccggcaacttactagagcaaaaacaaccacgctgacccagaaaaggggtctcacagggtacaagagagaacctagttcatcctcttgatgagctcgttgatgtagttctcacgggttccggggtcaccgccctttacgtagggggtccttttcttcttgagggcgccgaggggtgccttcagcttgaacggccaaaggaagttgttggcctccttgaagtgcgggcccaccgtcatgatctcgtggacaagggcctcaatgcaaatgatattgggcttcccgaggccctcctcgatgacactgttgttgctaaggggaatcctctgcttgttcagcttcccgtaacctctcttggagatcaactccctaacgctcttcagggtggggtatccgtacgcaacatatggctccaccctgcgcagcatgttaatgg

SEQ ID NO: 13809 - DNA, 580 bp, Zea mays
  Clone ID: LIB3279-219-Q1-N6-E8
atattcaaactgcacactataaataatacgatctacaatataaaaaagtacagtagttcacccatatatgatcactacaaatacaatgtaaaaaggtacaatgtacacccatatatggtcactacaaactccttttggagggtttttgtagtgtagattatattattcataggtcactatgaacaccttttgcactattttgtagtgtagattatagtttaaatatgggaaagagtaagctactgatggtctaattctcaacccaccggtatcagcttacccatcgcctttactgcaatcaattcccacaccaccatggatttgaaacccttttggaaacttcattttcccaaaaaaaaaaaaaaatgaactaattttccttaggaaaccttggaagaataagttcccaaactagccctaatcaaattgaaaatagaaaatggaacttcgcaaaaaaaagcaacatgaaattgatctccaggggaactcatgctctcgtgcccctagctaaatggatgaattgaactgccaataaataaattgtcgaactgtatgtacagtaccgtcaaaaagcagtaag

SEQ ID NO: 13810 - DNA, 369 bp, Zea mays
  Clone ID: LIB3279-219-Q1-N6-E9
gggggttgtcgggggtgcaatcgtttttttgtggtaatttcacataaggtatgagctttttgcataaaggggaaattttggggtgtttaatgagttaggtaaataaaatttattggggggaattaaatgtgcgttttaaagtgcggaaaaatttttgcgccaattggataaatgaataagccagggggctaaaaaagggggtttgcgtattgggaggcaggggggtttttatattggcctgggggaggggaaatatgaggttggctttctccggatgatcctgacagggcggggggaggggggctaggcttttttgccccacggggggaaatttttttttcctggggggttccggggggttttttttgg

SEQ ID NO: 13811 - DNA, 557 bp, Zea mays
  Clone ID: LIB3279-219-Q1-N6-F1
aggcaagtgttcttccattgggcattgcacatacagttgtcccgaaggacccagttctcacttcacattattcacctttggccccgccccggaccccttcttttcccgaaagccaggtcatcagatgcctctcctcccctaattggttggctcccagcttaaataagcatctgctgagtttccgataaaaattctgaactctaaaccctttttctttttcccaggacgttccgcctataatctcttcaagctcttcttccgcgcatccagcttttttttatccacaggaactttggaagccattgggccatccttttttcgtgccgccgcagctcctacagcaggatcagaaacaggggggttctgatcctgcaaactcgtaccaaatgctctggatgcactggaggtagataccgccggtggcatcgatggggtgttcttgctagaggcagtacttgacttgtcgacattcagagctgtggttgactcagatatagctccggtcttggacgtattcttaggtttaagggcatggatgccagtgtataaccttgcat

SEQ ID NO: 13812 - DNA, 544 bp, Zea mays
  Clone ID: LIB3279-219-Q1-N6-F10
aaaaaggaataatttcattcccattgaatcagatcagaagccggggcacaaccctgtttgtcagttttgccaaagcccgaccggaattacaaacaggacaggggcaaagcaagaaaaggagtgctccaaataaatggcttttaagtaaaaaggctatcttcctttcctttctggttttatggcccctaaacgactttaaacctaaaactaaaccctaactttcctggtgtaagctgctacccgctataggtttccctagaatgtacaaaagccccaagaccagtcatcatacttggaccctttgccttgtcacacggccacccccactgaagtcaagcacttttgggcccccggtccagtcataataatcggagtcgtgggagtcgtcgccacttgccccaccacgggcttttgtaacactcgaggcagccgttctcctgaccctcgtcgtacttcttggggctgtgtttgtcgtatttctcggggttgggcgcttcctaatctggactgaagggatgaacacagcaaagtccatggaatctta

SEQ ID NO: 13813 - DNA, 593 bp, Zea mays
  Clone ID: LIB3279-219-Q1-N6-F11
ctaactcaaaaaagaagaagaggaaaaaattgcaatgatttaaagcgagaacttgttcttaggtaaatcaattgggagatgcttctctagagtgtcccatatcagttttccatcttccatacgaaaactattaatttgcataagatcttcttcagtcttactcaaaaggtccaatagtgtatgtatattggcccttttgagacaattatacgttctagaaggcaattctaattgatcaataaaaatacaattcaatggaattccttttttgtttttctttagattagtgaatcttttttgaaaggttaaaaggggtggagttaacctgtttttattttcttcgaaactagtgccctcttcctctgtgtgtagaaaaggaagaaataaatcaatcaaattacgagaagcttcataaagcgcttctttaggagttaaacttccattcgtccatatttctaaaaaaagtatctcgtgtttttcatttccattcccacaagaaaaaatactataattcacatttcgaacaggcatgaatacagcatctataggataacttgcatcttgagagttctttctgagtttcgtatgatatg

SEQ ID NO: 13814 - DNA, 578 bp, Zea mays
  unsure (1)..(578): unsure at all n locations; Clone ID: LIB3279-219-Q1-N6-F12
ggttttggggtttttaccattacgaataataacgacaaactgttaaaaagggtgaacataacagataaaccagacttatagcctggccagcaggacaaccgataacgtgccaaaaacctcgaacaatagtgaaaattaagctatcacaggtagggggggtagggataaaataaacgggaagcatgcgatgcgacacttagtcgacctcctccatcttggtttcaccagcggcggcctcaagctgagggatctcagcctctggctcaacagggtcgtcctcatcgatgctcaaaccgagtttgagcatgcggtggatccggttgccgaaggtgttggggtcatccaggctgaagccggagggcaggagagcagtctcnaacagcagcatcacgagatccttgactgacttgtcattcttgtcagcctcggcacgcttgcggagctcatccatgataggggtctctgggttgatctccattgtctttttgctcgacatgtagcccgccatgctcgagtccctcagggcctgtgccttcatgatcctctccatgttggcggtgcagccatactcgccagtc

SEQ ID NO: 13815 - DNA, 429 bp, Zea mays
  unsure (1)..(429): unsure at all n locations; Clone ID: LIB3279-219-Q1-N6-F2
aagtgacaggaactttaaagggatatgaccagctactcaacctagtgctagatgaagcagttgaatatgaaagagagcaagatgacccattgaagctatcagggaaaaccagacaggttggcctcattgtgtgcagaggcacggcagtcatgctggtctcaccgactgatggaactgatgagatcgccaacccttttcttgcggaaggagcataagcttgcagttggtcgattatttagaaccgtgctctcatgtcaccctcagaacgatgtgtcccagtgggaaaaagaactctattctcgtaccggttggtgatgaactctgtaatattcaccgtgcaagtgcaacttaaaacatctgtgatacgagctctttttttttaaaaaaaaaaaannaaaanaaaaanaaaaaaaaaaaaagggcggccgc

SEQ ID NO: 13816 - DNA, 299 bp, Zea mays
  Clone ID: LIB3279-219-Q1-N6-F3
gacgtggtaagaaggaaatggttaaaaagggggccccgggaaaaaaaagaaggtaaaccccgggggcccaaagggggggggaaatccataccctgaaaaagcgggctggggggggggttaaagcgcttggggcgggcgggaaaggaaaacccgtgcaggggaaatccacagcccagagggggggggagggaaaaaagggttgcctaaaaaaagcattgagtgaaaaaagccacaaaaattgaaaaaaaggtccctccaaaatgggggggagggaaacccctcccccaaaatatataaaa

SEQ ID NO: 13817 - DNA, 555 bp, Zea mays
  Clone ID: LIB3279-219-Q1-N6-F4
caagagagagaaacccttaatgtcattgaccaaacagctcaatcagtacttggaagttccaacatacagattacatcatgacagtccatgagcccacggtgaacaggtagtcacgacaggtaacatgcagtagagtgaacttaaacgacacatcttcgccacctaccaagaaaaggcttgcctaacctctggtatttacacgaaggggtagatcatgattgtgccggagcaatgttattcagcaggcagttcggatcatttcagcagtttacaccacactgcccacgggaaagagccttctgggtaggggatatgaaggggtcgatcttcacccacagcagcgagaatatggaagcaagaaggacggaccaaacgatgacgatggtcggtgtgcggttctgcttccccatgagacccttcaggaaagggtagaggtggaggatcacccagattgcaaagaacagcttcccgaatagtggaccccatgattggtagccactgttgatagcatacgacactccagccactataccaaccaggttaatcacaagcaca

SEQ ID NO: 13818 - DNA, 476 bp, Zea mays
  Clone ID: LIB3279-219-Q1-N6-F6
gagaatgttatcctccaagctggcttaaaagataaccttgctacatattaggtgtcccaaataggtgactgaatatgaatgaaaagaataggctaatatataatggaaacactaaataaaatagatctaatacatctttctaagggggaaacaacatatttgtttggcatcagatgcatctttactcgtttgggcatctttacccgtttggtgtgcttgattaatatcccttgatagatggccagacttcgaagaacttaggatttcttgagtagcctgatgacttggatcctttggttggttattgcttcgatagaaatttggcaacagcgtggctttgaagcaaaagctatgtcgtgattctttaaacccatgttcattggggatctttctctctttttctttgggtataccatatttctgatgcaatgtttgaaatgttgaaccaaatagcttttctttgagtttcattatat

SEQ ID NO: 13819 - DNA, 355 bp, Zea mays
  Clone ID: LIB3279-219-Q1-N6-F8
gaacatcaaccgaggggcactctttcataaagaccctaatgggaaatggaactttaagccttcctcgggccagggggggaacaaaacctgggctggggagcgttgcccccctccaaattattatgcatcaagcgtaaacttttcccagcgcaaaaaaagacctatttcgcctggttaaaggggtcctctcatcaaaagggtgacgggcaaaatttccggtaagattaaaaaaaatttgggaactaaactctcgaccgggtggtacaattccaccccaccaaatatgatctcaggggaccccgaaaaaaaaatcaagccctgggtttcaattcaacctcttcttctggggcagggg

SEQ ID NO: 13820 - DNA, 598 bp, Zea mays
  Clone ID: LIB3279-219-Q1-N6-F9
aagccgaaaaaattatcatacacgctaaacatcactgaattactgaacatgtgtttccaaactccagcagttcatccgactctacgatgacaacaggcagcctgcttgctaacacaacacgtcaccactagctaccatggccattactaccagggtgcaacacacgacgaggaaaatacaacagccagcacacgcactggtccactaaacagagggagggattctaatgacacagtttcacactttcactggtcctaatgattctaaatgcttcgtcaagggggagcgagtcctgccccagggcgcctggcattcccgggtccgcttggtgctgcagctgggacacttgtactgcttgatgtgctctgcctttgcaggggtgatgcggacacacttgccatggaaccacttctcgcagatatcgcagcagatccagaactccccattcgcatagctttccccacaggacccacacaggtacgcctggtcctcctctgcgtcctcacgggcgctatcctcctcttcgtttgggtgggctggctcacaggcttactggtagaattgatctggtttgatgggttagagttagatttgctgc

SEQ ID NO: 13821 - DNA, 98 bp, Zea mays
  Clone ID: LIB3279-219-Q1-N6-G1
atcgaatatttggcgcccgctaactcatttttaaaacaaggacggggagggtgctttgggtctgggttagctagaacatttacggtggtccacacttc

SEQ ID NO: 13822 - DNA, 437 bp, Zea mays
  Clone ID: LIB3279-219-Q1-N6-G10
gattctaattacctcctcacgtcgaggtacctagttatttgactggagaacaatcacatcacgaaccataaacctcaaacatggtgcaaggtgggaattcattttagctccttcatctagaaaatttttatccgtaatcaggtgggtcccgtcgggcaacaaaggtgttgtcgtcgacatcgcagcagaggggctctcacaccgtgtagttctgctggatggtgtcgatgtccaagcccttgagcttgaccaccgattcgacgtggcccttgagggtattgagctccctcagcctcgcgatctcagctcgtctcttggcctgctcggcgatctggaacagctcgcggtagttgctcttgtcgttgaacagcgtgttggaggaagcctcctgcggctggagcccgtgcagcgtcctctgggcccactgcgcctccctc

SEQ ID NO: 13823 - DNA, 578 bp, Zea mays
  Clone ID: LIB3279-219-Q1-N6-G11
gaataataaatatataatataatacgatactagaaggtgcacgacaggaaatacggtccaattgaattttctacatgagctgcacataacgctccgtaaaagttatttggcactgtttggtttccaggtacagattattgagggtctcggatggctagactccagactacttactgaatcaaaatctccatcattctataaacagatacaattctggagctccagcatcaacttattgtttctgccacgattgaatgactggatggccatggaaggagtggtcagaagatgatgtcgtcgtccttctccccaccagcaaccagcaggtttgccgcagcccccacggagatacccctcttaagcgcgagatcctcggcaagctgttcctccgcaaatagcctggcggcggccatctggcgctcgatctcccttttcttgtagccctggatcttcttgagcctgaagaagtcctcgcgctcgagctcgtcgagctcccccttgatgtagctgatggtgttctcgatcctgggcttgacgacgttctcgagcgcgttgacgcggcggttggtggtcttgat

SEQ ID NO: 13824 - DNA, 568 bp, Zea mays
  unsure (1)..(568): unsure at all n locations; Clone ID: LIB3279-219-Q1-N6-G12
gttaaaaacatcaaagtgtctcttagactgctactagcgtagcaacaaagacacaaagtgtgcttagagttatcatgttcacaggtgtgcaatactacagtcaaagatgcacgacacatacactggttgtacacacaggaggagaagaaacaaaactcctgccctttttattttagccgagatcagggacgatgaggtggtcctcgtcgtcgatgacctcggtccgggccttcttgctctggcgcaccccgccggcagtggcagtggctttggccggcctgtagtacgccgcgccgttcgcggcctgggttccgaaaagctccggtacctcggccaacctcctgccggctttcggcgtctgcccgtggaagaggtcgatgtcggtgaaccactccagctccttgaacccgagcggggactccttgtgaagcttgtcgctggactcgcagtcggagaactgcaggagctcgtcgacggcccagccctgtggcaggaactgcggcggcgagggcacctgctgcgccgcggaggagacggcggccttgggcggggcgtggtggtcntgggc

SEQ ID NO: 13825 - DNA, 502 bp, Zea mays
  unsure (1)..(502): unsure at all n locations; Clone ID: LIB3279-219-Q1-N6-G2
ggccatggcgcgcgcggctgcctggccacgacgcaggccccgggggccgcgccaggctgggcccccggcggcacgggcgcagaggcccctggcggcgcgggcgctccggctaggccccagcgagccgagcatcccttggccgtcagcctcgtgcgtgcccccccttcccgtcggcgcgggtgccagccaaggcacggcggcggcggcccggccgcagcctcggcgcgcgggctcgggtgcggccccggctcaggcggcttcggccgcggcgcgaatgggcgggcgcgcagccccggcatgcggcgcgggtgcgtgtccgtcgacacgtgtgcgcaacccgcggtacgcgggccacgacggctgcgtgggcagcggtccccgcgtggcctacggcgctcgagcacgcggtttcagtccgaaccatgcgggcacggtggactttggcgcacgggcacgtggacccgtggggcgagcacctgccangcttgggcgcgcccgcccg

SEQ ID NO: 13826 - DNA, 436 bp, Zea mays
  Clone ID: LIB3279-219-Q1-N6-G3
cccggggcaaataaataggttattttctcatggcacaacctaacttttagatcataagcggggcatttggtctttgggcaccaggcaccactaacctccaggggggtcataaactttttcacgacacctttgtgttacagatttcttaaattaaatccgatccaaggggcgggtttaccactgggtaagcttaatcaggcaaaaagaaacaggaaattggtctggctgaccaattaccctacgtagttccagaccaaatgatcttttccgatgctacacacccaccctatctatgtacatctcgagttcttcccttcctatggctatgggactggagtccctcagctttacaactccaccgttcaccagcgggggagggcagggcaaaccccagtcttttactctagccagagttgaactgttttaaccgggcagg

SEQ ID NO: 13827 - DNA, 520 bp, Zea mays
  unsure (1)..(520): unsure at all n locations; Clone ID: LIB3279-219-Q1-N6-G4
ctcagggcgcatttctgcaccaaaacaactgcatttcacagtaattttcattggtcactgagaaccaaaaccttagatttagggctcaaagtctaaacatgggtaaaaacacaagaaaaaaatacgactgccagaaacgtagttctagggcaagggcaccaggatacaagctccactcaacggttggccttggcaacacgctcaatctcgtccttcttcttgatggcgtanctgttggaagagcccttggcagcgttgatcaactcatctgcaaggcactcagcaatggttttgatgttcctgaaagcgctctccctggcaccagtggtgaggaggtaaatggcctgnttcacccttctcaggggtgagatatccacagcctgccttctcacaacaccagctgaaccaatacgggtggcatcctcacgtggtccactgcaaagacaatatcagcacagaacaccagtttgacatctcaagagccaacatgtgtaatcaatagtttgagttatagttgaca

SEQ ID NO: 13828 - DNA, 550 bp, Zea mays
  unsure (1)..(550): unsure at all n locations; Clone ID: LIB3279-219-Q1-N6-G6
gcagcaccaagaagcaccatttttttccttaggatttaacttagaataaagcctgacgggggtgacagcacccatcgatccgcagtccatgctggttgatgcatgggtctgctggagccgaggatgaacacagcactaacaactgacacagagcgaccttcaatcaaaaacacaggtgggcaacaacaaacacgagacgaacgaagataaacactctggactagggtaaacaacacggtagcgaacaggataacttggccgcgcgggccccaccggtcagttcctccagttcccgtcggagttgccgtagccgccgccacggttgccaccgccgtagccgccgccaccaccaccgtagccggcggcggcaccaccgtagccgccgccaccggcgtagccgccgccgccatcacggggcccgccaccggcgtagccgccggcttcacgggcaccaccgtacccggcggcgncggcggctccacgggcgncgngggactgggcctcnttgacggtgatgttgcggccgtccaactccttgccgttcatgccc

SEQ ID NO: 13829 - DNA, 563 bp, Zea mays
  Clone ID: LIB3279-219-Q1-N6-G7
aggcagaagaaccagcaatgtttgagaaccaaaccagccaaaatactggaacagcaatatagtctgctcacgaccaaccaaaccttcgactcataacatcctgaacaagcacttcatctctggcctggttatatgatattgctattggtttggtagagctagcctgcagcttggtcattcaaaggcccactgattctccctcctcactttagcctcttcctcaggtgtgaagtcattctcgatgtcgaatggctcgcgtatctcctctggagtcttccccttgatcatgtccgcgacggcctggcaggtcaggtctagcagcccattgatctccaggtagtctgcagccttaatgagctccaagagggtgaccaggtcaacatcgacgaactcagcatcaaaggacttgagatcgtccgctgaggccttgttactcgcagcacttggctccgcatcaccgccatcggcgcgcggcgccgaggcgtgcttcctgcagtacgcgatgaccttgtcgaggatcttggcgttgacgttgaagaccgggatgtcactgtcgtcgcagt

SEQ ID NO: 13830 - DNA, 558 bp, Zea mays
  unsure (1)..(558): unsure at all n locations; Clone ID: LIB3279-219-Q1-N6-G8
gggcgctttntttgggttttttttttttttttttttttttttttttttttttttttttttttttttttttttttttttttttttttttttttttttttttttttttttttttttttttttttttttttttaaaggaaaaagggggggggtttttttttaaagggggggaaaaaaggggggggggggaaaatgggaaatttttggtttttccccttttttttttggaaaaaaaaaaagggttgggggggaaaaaaggggcccaaaaaatttgggggggggaattctggggggggaaaagggaaaaatttttaaaaaagggtttgaaaaggggaaaaaggaggggggtaaaantaaaattcaaaaacggggggaaaaaagaaaaaaaaagggggcaaaggggggggggggggggaaaaaaataggagggggggggggggggggttttttaggggggcaaaaggggccggggggggggtttggggcctccaaaaagggggggggggaacaaggggaaaaaaaaaaaaaaaggggggggggggggggaaaaaaattgggggg

SEQ ID NO: 13831 - DNA, 339 bp, Zea mays
  unsure (1)..(339): unsure at all n locations; Clone ID: LIB3279-219-Q1-N6-G9
ttnngggcccggggttatttgccttattcctccttatttttttcttttaccttccaaaaggcaaattccccgggggaaattaaagttgggctttttggccaggtttgcaggttggtttttcctttttaccctttttgcttaaggtaagttttggttcacttttaacttttttagggaacccagggaaaaattttttaatttttttggggggggcttttggaacgaaaacaacacaattaacgggttccggtttcccccccccggccggaaaaccccatatatttttttttttaaaggggcctttttttgcgggttttttcgggcccaaatttatttttt

SEQ ID NO: 13832 - DNA, 294 bp, Zea mays
  Clone ID: LIB3279-219-Q1-N6-H1
gaaacgaacgcacgccagaacattaaaacgcaaacgcaggcggggggtaactaacaacacgcggccgaagaccttaaaaaaataaaagttcagcggcggtgcgggcagaagggggcggcgtaggaggcgccggcggagcaggggaggatggacgttgggtcgttttaggcgttggagtaagccttggggcacgccgtcttgaagaggcgcgagtaggccgtgggcttgaactgctgggggcttcccaactggtctgtgccataatactggggtgccgctttggtgggtccggcg

SEQ ID NO: 13833 - DNA, 355 bp, Zea mays
  Clone ID: LIB3279-219-Q1-N6-H10
cacgacttgaggatcttttgagagttcccctcctgaatacaagttactcacaacatctcgccacaagtaaaattctcatttccagaggctggtgcaatcattcgggaaccataaaacagacccagagtcacgcccagccttccggttgggggggggaaaataagcggaactggaactggagtactgaacacctttcggggggtttacaaaaactcaactcatgctttagttgagttgcagcggcagggggtactcctcacaccattatgcgacacgtttttttggggcccgggcattaaaattagacaaaaaaatgcaacatgcagggtttttctggactaggcgggtgctgcca

SEQ ID NO: 13834 - DNA, 592 bp, Zea mays
  unsure (1)..(592): unsure at all n locations; Clone ID: LIB3279-219-Q1-N6-H11
caatcataacaatgttattatatttattccgtagaatctaccattggcgcggctcgatcctaatccatgcgaaataaaacacacaataatgcaacactggccgtcccgcactgtgcgtgacagcatataaacgatgatggtcgatgaatgaccacgcgatcgagtacatacgtacgtacgtacagtgtgcttgatgagcactagtagcagctagctcctagttccgattcttgatggtggggcgagcgttgagcgtgatcttagcatttgtgcgcggcacgataacgacgtcgacggttttatcgccgtcagcgtcgatatcgaacagcacttcggtgatgcacagggagagcttcactttccgcgtcttcccggcgccggagcccggcacgacggcgaagcttccggcgtactccttgtactgtgggcctacctgcaacgctttgtccgcgggcaggttgatggcgacgtcnaacttattgttcgcctgggggtcgtactcgatgccctcgatcaccagcagctgctccttccccgggtccttggccggcacaggcacggccggcacctncaccacctggcccttggtcag

SEQ ID NO: 13835 - DNA, 304 bp, Zea mays
  Clone ID: LIB3279-219-Q1-N6-H12
ctctcgggggggggaaaaaaaaaaaaacaccatgggggggggggggggggggcgcggggaaaccaaaaaccacccccccccccccccccccccccccctttttttgtggggggggaaaaaaaaaaaaaaaaaaacccccctctttttattaatagggggggggccccgtccccctcctcccggggggggggggaaagggttttaaaaaatatttttcccccccccccccccccccccccccccccccccgggggggggggggggagggggggggataaaaacacaccccccccccccccccccc

SEQ ID NO: 13836 - DNA, 550 bp, Zea mays
  Clone ID: LIB3279-219-Q1-N6-H2
agttaaaaagccaagaaactttgggataaccaattcaggatatataagacagaaaaactctggttcacgagtaaatcccaaccagcatagcaatctacggctgaattaccaaatataaagacaagtagcagtctttccagtactttccaacataaaacaagcttaaaatctaaacatgactctggttttcctctggtttcactgcccaaaacaatactgtgatgactgtgcagcctagtcgaagaggctgaagcccatatcatcatcgctttcttccttctcttccaccttctcttctttctttgcctcagctgcagaagcagctccgccagcagcaggtgcagctgccgcaacagcgacaccgccgccaccacatgggactgaagcaaacttctccctgcccgcggcaatgagctcggtgatgtccttaccgctcagttgggacagcaggagttccatcttttcattgtcaacttcacagccaactgactccagaatggcagtcaaatcgtcagccgaggggctggcgttcccagcgaggacagcaagc

SEQ ID NO: 13837 - DNA, 269 bp, Zea mays
  Clone ID: LIB3279-219-Q1-N6-H3
aacatgtgggggcgttgcatgaatggaatgggggctgatggtggagggaaaagataaatgaagatgggggggtggaaaaatggggagcagtgatgctggtggatggcggctgtgtgaaatgggatgcggaaatgggtcacaaagaggccgactgggttcccatggattctcggaaagggggggggggggccatgggtgggtgtggagcgccgggatggggggagaggggggcggggggggggtgggggggggggggggggggggaaggg

SEQ ID NO: 13838 - DNA, 576 bp, Zea mays
  unsure (1)..(576): unsure at all n locations; Clone ID: LIB3279-219-Q1-N6-H4
gatctgatagtcttgtttccacatcatatttttcagcccaaacaattgtttctaagaagattacagcatgcaatcgcatgaatccctgttgctaggacaattaataataagtatgctccaactgacaagtctagcaatatatctaaattctttaaccgaaatcagaatgacaagcatggtaccatccacaacgacaaacagtgatacaacaaataacagcaccaattaattgaacatacaaatataaaagaatttaaagggctcaaggaataaccatgtcatccaattttcatgactcgtgacttgtagagcaggctccacgcggttgtctttgaaatatggaaacagaaaagctcctcaacatcaaagcacccatcagtgctttccatcttgatggcctgccactgcttccactcgaaagggctggtcctatccgatcatccaaatcctcgggcaaaacatcactgccggcattgtctagcgcaccactgtcatncacactccgaccatnctgcaactcaccagctncaccaggtgtgtcaaaattcacagcaagagctncattcctgctagccc

SEQ ID NO: 13839 - DNA, 580 bp, Zea mays
  Clone ID: LIB3279-219-Q1-N6-H5
ggaaagaatgcagttccatatttttcttgtgagtgctggccagcattctcaagacctatactggcagcctgtttagacccataaaatcctttggcaaaaacaggtgtgacacagatgttaatggagaagggcacgatgagggcaagaattggctcgatgttatagtagtaaactggttctagaacacgagatttcttggttgggtcaatcttcctggactggactagtgctgaatgcaagaaaacattgtgagggatgatgatgcagcccacaattccaaccgcttgcttaattggctttgaactcaattttggaaccaccaaaccgatcagaagttccttgccactaggctttgtttcaccaaacataaccgcaaatgaaacagccatagttgcaatcagtacagcgaaaaatgcctccagtttcctcacgccataattctccaggaagagaaagatgaagagggaaggaatttgctatccgtcacccccacaccaaagcagtcaacaaaaatgacaaaggtgctcgtatattttacatttttactcgtcacgagaagaaagcaggtcagttcaatgat

SEQ ID NO: 13840 - DNA, 303 bp, Zea mays
  Clone ID: LIB3279-219-Q1-N6-H6
agctcgtagagatccacgttattactctcatataatgctcaataactctcttacatagctagaaaggatccattaatgttggagaaatgttctaatgccaattctgtaaggcaatattattgcgggggaagggtaactgaatgcatcatgttaaaaattcttgacaatgtatcaattgtgaaatgctaaacacatgatagactggaagtgtagggtacagagacatgcaataatacagggcctgctttatgggttcacatattaaggctgatgtttgaaatggtgtaaacttattacaaggtt

SEQ ID NO: 13841 - DNA, 601 bp, Zea mays
  Clone ID: LIB3279-219-Q1-N6-H7
gataaataatttctctattttgtgaataaaaatacatcaaaactacccaattttttaataaaattaatgacaagaaattaggtacaaattaacataaataactgacttgcctacaggttctaaccataaataaacataaacgttaattttttaccataaataaacactagttcattacacctggtgcacaatacacataaataaactaaatgttaattttcgaccatatctcgatcattcagtacgtagcttgaataaacaagcagatcaacatgagaaaaaacaactacacaaatgaatttaagattgaagcacatagatttacatctacaattaaaactcaaaactaaaacatgcaatattatgtatatactatgtagatttgctcataagaagtccaacaaaacatttttttcattttttgaatcttcctatgatttacaatggatttttaaagatacacacgattttctacattaaaaaataaaacaacatgaagaacaatcgattttcatctgaacctatatgtgaaacactagttaactcacaacctagtcactatgcatcactaattcattaatttgatattgatgagagtcta

SEQ ID NO: 13842 - DNA, 348 bp, Zea mays
  Clone ID: LIB3279-219-Q1-N6-H8
gaaacgggaatttcagttctcatagccttatcatgaatctcagaacctaacaggtgaaacacgaattaagccgaggcgccctggggttcacagatccccacctaaaccggttaattaaactgggagccgttcctgataaactaaaacccccccttagatcacccccctttttttcagatccaaaggaaccggccccgggggagtccaccattaccgagggagggcgggccaacagaccaaatcagagagatcttggagagctgtccccaatcagcgacctttaccacctttgaggtggagcccttgcgggtgcccaccttctctatgggcttgacgacgtccatgccc

SEQ ID NO: 13843 - DNA, 221 bp, Zea mays
  Clone ID: LIB3279-219-Q1-N6-H9
ggactggttgggaatcagatatagtaccgagttcccaacatgtaatgagcatctggtactaaagggtacaatatcggattcccatacactacatttaagttctataccatctggaatacaagggtgctcctttggggaataggcttggcacgatgggctacttgtgcatttcaatgcttgccttttcttcttatttggggtttacaagaaatcgacgatgg

SEQ ID NO: 13844 - DNA, 630 bp, Zea mays
  Clone ID: LIB3279-233-Q6-K6-A1
gcaaggcaagctgctctgggtgccgggataccaaactctgttgtttgcaccactgttaacaaagtctgtgcatctggcatgaaagctactatgtttgcagcacagtcaattcaattgggtatcaatgatattgttgtggctggtggcatggaaagcatgtccaatgccccaaagtacattgctgaagctaggaaggggtctcgttttggtcatgacacacttgttgatgccatgcttaaggatgggctttgggatgtatacaatgattgtgccatgggaatgtgtgccgagctttgtgctgacaatcatgccctcacaagagaagaccaggatgcatttgctatccaaagcaacgagcgtggaattgctgctcgtgacagtggtgcttttgcatgggagattattccggttcaagttcctgttggtagaggaaaacccccaacattaattgagagagatgaaagcctggataagtttgacccagtaaaactaaagaaacttcgcccaagtttcaaggagaatggtggtacagttacagctggaaatgcttctagtataagtgatggagctgctgcattagttttagtgagtgggcagaaagctcaagagcttggccttcaagtccttgca

SEQ ID NO: 13845 - DNA, 626 bp, Zea mays
  Clone ID: LIB3279-233-Q6-K6-A10
cttcagtgagatccattcacagataaagaacaagaacatgaccgtagatgtgaaagcaaactcagagtcaaatatcattactacagttactgtcaatgagattgcaacaccaggactgaagactatcttaagctttgctgttcctgatcagagatctggaaaggttgagcttcagtatttgcatgattatgctggagttaatgcaagcgttagtctgacagccaatcctgtagccaacctctctgctgcctttggcactaaggctctcgcagttggtgcagaaatctcatttgattctgccactgggaacttcaccaaatacaatgctggattgatgttcactcatgaagaccttatcgcatcccttaatatgaacaacaagggagacaaccttactggagcttactaccacaaggtgagcgaattgacaaacacagctgttggggcagagcttacccacagtttctcgaccaatgaaaacaccctcacctttggcgggcagcacactctggacccactaaccgtcttgaaggcacgcatcaacaactcgggcaaagccagcgccctgatccagcatgagtggaggccaaagtcgctggtcaccatctcggctgaggtcgatacaa

SEQ ID NO: 13846 - DNA, 509 bp, Zea mays
  unsure (1)..(509): unsure at all n locations; Clone ID: LIB3279-233-Q6-K6-A11
cactgnanctgagaccgacaaagtgtatgaattatgccagaagtgtttcgatcgagtagtggatttagacgacggattacgtggcatgcatgagcatctgatgacaagttgacaactaggctgagatcgccatcttcttggttggtcggaaatgagctcgacaggttgaggttgtcagccagcgagatatctgatctcctccggctccggtgcggtgaggaccccatcccgccggcggacaaaagtgacatggcctgccccccgcccgaacaggaagagggcccacacgtcggccactctgtctgaccacagcacccccaccacctagctttattcccaaaacgttttcccctggaaagagaaaaacggagattccttgcccccttttcccttccccatcgtcgaaaccctagccccgcctctccgccggcacgccggatcggtcggcgccatgtccaaggccagggtctacgccgacgtcaacgtgctgcgcccccaggagtactggg

SEQ ID NO: 13847 - DNA, 575 bp, Zea mays
  Clone ID: LIB3279-233-Q6-K6-A12
ggcgccgccggccgaggccgagtgcgagcagacctacggcttcctcccctgcaccaccaccgtgctcggcaacctcttcctggtgctggcctacggcttcctcatgttcaaggcggccacgttcctgtcggcgggcagcgagctgctgctagagatcatggggcccggcctcgtcggcggcctcctcctccccatcctcggcgccctccccgacgcgctcctcgtcctagtgtccggcctctccgggagcaaagaggaggcgcagagccaggtgctgatcgggatggggctgctcgccggttccaccgtcttcctcctcaccctgctctggggaacctgtgtggtcgttggcaagtgtgacctcgggccaggccgtgaggcagttgatgtgacagacaccaagggcttcagcttgaaaggcactggtgttacgaccgacgtgcagaccagctacgcggcacggatcatggggctatctgtcatccccttcatcatcgctcagtttcccaaagagttgaagacgcaccacggccagtgcctcgctatgctgctggcccttgtcctgtcgttcgcgc

SEQ ID NO: 13848 - DNA, 604 bp, Zea mays
  unsure (1)..(604): unsure at all n locations; Clone ID: LIB3279-233-Q6-K6-A2
gtggttnctgatcccttcctgataatgccaaggctgaagcaactgatgaccgtgctactgtcagtcttcctgatgaaaccgggaatataccatcagttcatactgataattcgcaaaatgatgccagtngaaaaccaaggtgatgcaacttacactacctcggattcgtctgagcatggcattgttgaggctgtccatattgaaactggattggaagatgaaagtgcaacagcatcatctgggactggatctggtgatgacaacggtaactcatctgatagcgcctctgcagaagaaaatactgagactgtatctggtgatgatgagaagggcatgggaacaggtacaaccactgaagcgtcatattccatacaacagaactctgagaacagcagtgtctcagctgaggcagagaattcccaaggggattcttccagcggagtgaatggttcttcagaagagacatctaacaagggtgatggagctacagaaacgtctaacaagggtgagcaggtggatcccaagattgaaactagcacatccaccaatgccgagcataatgaatctcaaggggctgatggcagctctggatcaaatggtaacg

SEQ ID NO: 13849 - DNA, 498 bp, Zea mays
  unsure (1)..(498): unsure at all n locations; Clone ID: LIB3279-233-Q6-K6-A3
naaatccaccaccgccataccagcgcgacagcgattccgtcgagttagaccaagcgagagagtagtctcagacgagaagaggtgaatatgagttccggcggcggcaggggcaagcccaaggggtccaaggctgtgtcgcggtcgaccaaggctgggctgcagttccccgtcggccgcatcgcgcgctacctcaaggccggcaagtacgccgagcgcgtcggcggtggtgcgcccgtctacctctccgccgtcctcgagtatctcgcggcagaggtgttggaactggcgggcaacgcggcgcgcgacaacaagaagaaccgcatcgtgccgcgtcacatccagctcgccgtgcgcaacgacgaggaactcagcaagctgctcggagctgtcaccatcgccgccggaggtgtgttgcccaacattcatcagacgctgctgcccaagaaggccggtgggaagggcaaggccgacatcggttccgcatcccaggagttctaa

SEQ ID NO: 13850 - DNA, 521 bp, Zea mays
  Clone ID: LIB3279-233-Q6-K6-A5
gttggagagaagagatacactacagtactacatggcgaagcagcagcagcagggcatggcggcagtggcgctggtagtgctggtggtgctggcggcgacggcggccgagacggcgtcggcggcttcgtgcaacgccgggcagctggcggcgtgcgcgccggcgatcactgccggcgcgacgccctccgcgtcgtgctgctccaacctcaaggcgcagcaggggtgcttctgccagttcgtgaagaaccccacctacgggcgctacatcaacagccccaacgcgcgcaaggtcgtcgcctcctgcggcgtctccgtgccgcgctgctagtactagtacgtgtgctgtgcatgcatgtacgtgcgcacgtgggctgatcttcctgcttgtttcgtgtcttgccgcgcgccatcaggtgtttgtgtcacttttctgtttagtctctctacatgtgtactggcctcgtgtaccgctcctctatagtcgtgtcgtgtacgggctaattaatatatatacgacgaat

SEQ ID NO: 13851 - DNA, 596 bp, Zea mays
  unsure (1)..(596): unsure at all n locations; Clone ID: LIB3279-233-Q6-K6-A6
ctgctctcccgcttcaccaanaacaccttcgccctcgactccaagtccaccatcggcgttgagttcgccacgcgcacactccaggtggagaacaagattataaaagctcaaatctgggacactgctgggcaggagaggtnccgagcaattacaagtgcttactatcgaggagctgtcggggcgttgctagtctacgatgtccctaaagttatgacatttgggaatgtgaagaggtggttgaaggagctccgggaccatgctgactcgaacatagtcgtaatgctcattggccacaagactgaccttaggcacctgcgctctgtcgccgttgaggatgctgcaagctttgcagagagcgaaggtttgttcttcatcgagacctctgcgctcgatgcgacaaacgtcgagaaggccttccacaccgttctagccgagatctaccggataatcagcaagaagcccctgtcttcggaggagtctggtttggggtccggtgacctcagaggggacagtccatccaagtgtcagccacaaattctggcgcccttacgtcgcggtgctgttctttttagagcccccccccagaatcatctgaa

SEQ ID NO: 13852 - DNA, 574 bp, Zea mays
  Clone ID: LIB3279-233-Q6-K6-A7
caaccaagccgaggtgccctctgaagagtcgtcgaggtggtggtgagtccgcctttcgtttttctgcagcaggtcaaggggctgctgcggctggacttcgccgtcgcagcgcagaactgctgggtgcgcaagggcggcgccttcaccggcgagatcagtgctgagatgctggtaaacctgcaggtgccctgggtcattttgggacattctgagcgcagagctctgttgggtgaatccagtgattttgttgctgataaagttgcatatgcactcactcaaggtctcaaggtaattgcttgcattggtgagacccttgagcagagagaggcaggaacaacaatggatgttgttgctgcacaaacaaaggctattgctgaaaaaatatcagattggacaaatattgtgttggcatatgaaccagtttgggctattggtaccggcaaggttgcaactcctgctcaggctcaggaggttcatgatggtctgagaaagtggctccactccaatgttagccctgcagttgctgaattgacaaggataatttatggagggtctgtaaatggagctaactgca

SEQ ID NO: 13853 - DNA, 629 bp, Zea mays
  Clone ID: LIB3279-233-Q6-K6-A8
ccccgcgtccgccgccgcaaagacgtcaatggactcgtcttcagtcggtgaacccttctacgtcgtccgcaagggggacgtcatcggcatctacaaaaccctcagcgaatgccaagctcaagtcagcaattcggttcgcgacccttctgtcaccgtcttcaaaggctactcgctgcgtaaagacaccgaggaatacctcgccgcgcgcgggttaaggaacgctctctacgccattgatgcaacagatgcacgagatgaattgttcgacgatctagttccctgccctttccagcaacctgatggagctgcatcgtctactctgaaaagacacaggagattgaaatcggaccatcaaagaagcatcccaaagttgatgagcaggtaccattacctgatagtcatctctcttgtattcttgaatttgatggtgcctctaaaggaaatccagggaaagccggtgctggagcaataataaggcaggtagatggttccgtgattgctcaactacgtgagggtctgggcattgcaaccaacaatgctgctgaatatcgtgcattgatcctagggctaacatatgcagccaagaaaggttcaagtatattcgtgctcaagcgactctaagcttgttt

SEQ ID NO: 13854 - DNA, 316 bp, Zea mays
  Clone ID: LIB3279-233-Q6-K6-A9
tgctcacggacgcattaacccttactgtcctccccttgccacattgagctgattctgtcagagaaggaagagcctgtgaagaaagaggctgacaacattgtcgcggcaaggaagcagtgaagtatgttagcctgctgataatggcatcctttcgaagcattatagccgtagctcttttatgtaccttttcaggctggtaccgataccgtggatctggatttgctatgttttgtactgtgctcgagtgtaaggtcagttcgtaatacaatcaatctgcgtggaacaatttgatatccttgaatatgttagtgagatc

SEQ ID NO: 13855 - DNA, 534 bp, Zea mays
  Clone ID: LIB3279-233-Q6-K6-B1
ccccgcgtccgcccacgcgtccgcccacgcgtccgcccacgcgtccgaacccaaacatctattagctaagctctgaagccaagggttgtagaaaactgccgctatcagtagccgccactgcaaaatcaagcggagtactcctacatggattagagtaagatacttagcttggccaaggagggaactccgagctaaaacttgggcaattgaatttgagaaatggatggaaccaaatttgattgagaaagaaaaggcaatacttggtttcctccaattttctcatgttcggttgatcggatgtgtaggtggcagtgcagcaagatgagacctgtctgaagaatttggaagctgaaggtgagcgttggcggaaaccaagtctccaactgcacgcaaagcacaagatttagttccctccaatgtctcatcttcaaatgtctcaaatcaatgcaaatctcgaggcgttagtaggatcattattatcctccaaatacggtgttcctagttaagcaaagtaatgggctctttgtttgcacc

SEQ ID NO: 13856 - DNA, 648 bp, Zea mays
  unsure (1)..(648): unsure at all n locations; Clone ID: LIB3279-233-Q6-K6-B10
gngaacagtaaggaagttgatgttttatctgaacctggaggaacagcggattgaaatgcttcgtgaggaagaggaagctagaaaacgtgaagcggaagagaggaggaagagagaggaggctgaaaggaaagctaaacttgatgccatcgctngaaaagcagcgattgagagagatagagctggaggagaaggcaaaggcaacaagggagaagctcttaaagggatccgaggctgtgcgcgctccagattctgcacctgttgcacagccacctcgagagtcagcagcagcgcctgcagctgctgcggctgctcctgctcctgctcctagtaaatatattcccaagtttaaacgcggtggtgatagcagcagcatcccttctggcagccgcgatgaagatcgctggggttcacgtggtccgctcaggcaagatggtcctcctgcacgactggatgcaccctcatcacgccaagatactgatcgctggcgtggatcaagattttcctctaactcaacgtcctcttcatcaacctggagccgttcacggaactgatcctatgctgcangacttttttctagccatgtgtcgacctccgtgcacatgtctaatcgtacctttccagcactgcactacatgcatattattgctg

SEQ ID NO: 13857 - DNA, 527 bp, Zea mays
  Clone ID: LIB3279-233-Q6-K6-B11
cgaaacccagtctaaaacaggtggcccaccaacgattcacttccccgatcccaggggcggcgatcggaattcgcaacttctccccgcggcgaacacggcagagatgatgagctcccgggccggatccatcctcctccgccacgccggctcccgtctcttcaccgcagcggcgatctctccggcggcggcctcgaggccactgctcgccggcggcaatggtgttccggcagtcatgctacggctgatgtccacctcctcccccgccgctcccacggaggcgaaggacgaggcagccaaggcctccaaggtgggaggggacaagaaggcggtggtgatcaacagctactgggggatcgagcaaaacaacaagctagcgcgggacgacggcaccgagtggaagtggacttgctttaggccatgggagacgtacacggcggacacgtccattgacctcaccagacaccatgagcccaagacgctgatggataaggtcgcatactggaccgtcaagtcgctgcgcttcccca

SEQ ID NO: 13858 - DNA, 605 bp, Zea mays
  unsure (1)..(605): unsure at all n locations; Clone ID: LIB3279-233-Q6-K6-B12
ccccgcgtccgctcttctcggcggccgtggcggcgccggnagactatgcgcggcctccaccgctgcccgcaccagctcctcctggtctctccaccgccgcggtccgcccccgcgtgccgccagtcggccaccgcctcatcgcggggcctcaggagctccctcgccgtcttctccgcacccggggctcgggtagcggcggcggcgcgcgagcagaagtggggccacgtggagggtgatgaagacggtggagaggagggcctaggggaggcgctccacaggacgcgggagctcgtggagtgcgccatgttcgcggccgtcgctgggctcgcctacttcctcagcaattccctcgccattgagaattatttcagttgctttttcccattgccgatagtcatttcctcattaagatggggactagaagccagcaggaaaaccgtggtggctactgttttactgctattcacattatctggccctgtaaaagcgtcaacttatctgctaatgcatggagtaggtggtctcatcatgggtactgtttgggagatggagaccaactggattgtcttcatcatcctctgctccattgtccgtgccctgggagc

SEQ ID NO: 13859 - DNA, 674 bp, Zea mays
  unsure (1)..(674): unsure at all n locations; Clone ID: LIB3279-233-Q6-K6-B2
ccgtccgcttcccgngngnagnatacaaaggcacccggnnatcgaggaaaccaatccattccattccattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgaccccggagcaggcgcggctcgcggaggaggccggcgcgtgcgccgtgatggcgctggagcgggtccccgccgacatccgcgcgcagggcggcgtggcgcgcatgtcggacccggggctcatccgcgacatcaagcgcgccgtcaccatcccggtcatggccaaggcccgcatcgggcacttcgtggaggcccagatcctggaggccctgggcgtcgactacgtggacgagagcgaggtgctgacccccgccgacgacgcgcaccacatcaacaagcacaacttccgcgtccccttcgtctgcggctgccgcgacctcggcgaggcgctccgccaggtgcgcgagggcgccgccatgatccgcaccaaggggaggccggcacgggcaacgtcgtcgaggccgtgcgccacgtgcgc

SEQ ID NO: 13860 - DNA, 574 bp, Zea mays
  unsure (1)..(574): unsure at all n locations; Clone ID: LIB3279-233-Q6-K6-B3
cccagcgtccgctttgaggataggttccagagagaagcaaatctgtgtgcttcagcaatctgtccatcacttgtgaagcctcctgaatacatgcccngagaacctagcaaggtactcggcctggttgggtggtgcgatattggctaaggtcgttttccctcaaaaccagcatgtgaccaagggcgagtatgatgagacggggccgtccattgtgcacaagaagtgcttttagaggcaaatgccttgaactagcacggttggtgcaccatttgctgctgttcatgtcgcaggtgtgctcgtacctgaacgttgcggcctttcgggtgctgatgcagcgatgcttgtgtctacaccttactccagccacagttcatacctgacggttgctaagtgttgatgcatctagctagctcggttaggatggattggcccttangtttatttagagtggaatagagtgtagtgtcggcatgtactccttaggagttttagccaattgcccatttgtacctgttgtaccagagaatttgttgagatttccttttaaatttacattttgaaccatttcctgttc

SEQ ID NO: 13861 - DNA, 609 bp, Zea mays
  unsure (1)..(609): unsure at all n locations; Clone ID: LIB3279-233-Q6-K6-B5
cggtcgcgtggggcagngatgggaaaatcccgatcatgtacccagcatttaatgggcatcgggagcttgttgaaattctatttcctaagacaagaccagtttcatctttgccagactggagcgttgatgggattattagaagtatgaaagatctgtttttcaagcctcaggatgcagctgtggtggaaaaaaagaagctgatgcgaagtcacaagggaaggaagctttcgcaaggggagagtaccctgcagcagtatacttctataccatggtactagagaacgaccttgatgctaccgcgtttgccaaccggagcctatgctggttgcggctgagggagggggtcaaggctctgttagatgctcaacagtgcaaaatgatacgacctcgttggtcgaaggcatggtatcgcgagggcgcggctctcagcttgctgaaggactaccaaggggcagtcaacgcgttcacggaagcattgaaactggatcctgcaagtttagagatcaagaaagccttaagggaggccaccgattctctggcgaacgttggccgctccggagaacagaacccatgagctgctgctgcatccatgcgctttatctcacgtta

SEQ ID NO: 13862 - DNA, 597 bp, Zea mays
  unsure (1)..(597): unsure at all n locations; Clone ID: LIB3279-233-Q6-K6-B6
catgnaagcggggcatacttatttaaaccagttggggatgctcgctcaattgtcgaggaaggaggacatttcatccttactgaagggccattggttcaagaagcccattctcttccaaagacagagtggcgtaagtcacctctctcacatagtacacgcatctacaattgtggggacgctatacaggacatgctgatcgagaaggaataccatgttgagcttgttggccatgcttttaatgatagggaattgattgtcagatacaagacagatattgacaaccaaaggatcttctattctgatctaaatggctttcagatgagtaagaggcagacatatgataagattcctctacagggaaattattacccaatgccatcacttgccttcttgcaggattcacatggtaatcgattttctgtacactccaagcaatcattgggcgcagcaagcttgaaaaatggatggctagagattatgttggatcgtaggttggttcaggatgatggccgtggtctggggcagggagtaatggacaacaagcccatgaatgttatatttcatctcctcacagaatccaatgtctcagctttgcct

SEQ ID NO: 13863 - DNA, 658 bp, Zea mays
  unsure (1)..(658): unsure at all n locations; Clone ID: LIB3279-233-Q6-K6-B7
ccccgcgtccgcccacgcgtccgcccacgcgtccgcaactttgaccgtgtacgtgtccccaaaattcgatatgctgggatgcttcagtatgatggtgagttgaagcttccaagtcgctaccttgtttccccaccagagatagatagaacatctggggagtacttggtgaagaatggcatccgcacctttgcttgcagtgagacagtgaaatttggccatgtcacatttttctggaacggcaaccgctcgggatactttgatgaaactaaggaagagtatgtagaagttcctagtgacagtggtattacattcaatgttgcacccaagatgaaggcgcttcaaattgctgagaaagctagggacgctctcctaagtggaaagtttgaccaggtacgtgtcaacctgccaaatggtgacatggttggtcacactggggatattgaggccaccgttgttgcttgcaaggcagctgatgaagctgttaagatcattctggatgctgtcgagcaagttggtggtatttaccttgttactgccgatcatggcaatgctgaggatatggtgaaaaggaacaaatctggcaagccgttgctcgacaagaatggtggtatccagattctaacctcgcatacncttcagaccgtgcccggttgccatt

SEQ ID NO: 13864 - DNA, 563 bp, Zea mays
  unsure (1)..(563): unsure at all n locations; Clone ID: LIB3279-233-Q6-K6-B9
ngtggggtttatacaccaccatctacgtcttcaaatggtcccagtgctttatctggccctccaggaccaccattttttatggtgtactcttatgaacaaggctcaaatcatggtgctactgctacctcatctgaaccaattgaatttggatctcttgggccacttcctgcagcagatggtgatgacataccaaggtcgacacgccaaataatggctaatgggttttatgggcaaagacgtggtccatataggggcggttcctctcattcgtctcctgatcaaccatcctcacctcagcctcgtcggtagttgagtcttcatatgatggcttgatcacttggtttctgtcattgaaaccttgcgatagcaatattttggttcacccctcgtgatcatattctgcatgggtgaagatggttgggccatcagcagccacaaaaaaaaacacaagtatatgccctagttggttcttggtgctttgtgatctctcagaagcactgaattgtgaataccgtcaaaagcattatcggcaggttattttaccagtcacaatggtgcttttt

SEQ ID NO: 13865 - DNA, 588 bp, Zea mays
  unsure (1)..(588): unsure at all n locations; Clone ID: LIB3279-233-Q6-K6-C1
gccaagcacgactccgactggcgctacttcgaccgcctcgacgacctgctcgctcccgtgctgctcaagcccaattcttcttcctcctcggctgctgctgctgcggcggcggcggcggcagcccggagcgccgggcccatggtccctccgcgcatcaacttcccgcagcgcacccgcacgcccctccactcctccgcgggggcaaagtggaggatgccgtcgccgctgctccagccgtcggcgtcgtccgactcctccgacgggttcccgccgtccgcggtggcgaacggcaagaggcagcgcgtggaggagcccgccgccgccgccgcggacaacggcgcggagagcagcgtcagccgcgcgcagggtctgcgcgagctggcgcaggcgatccggcggctaggggaggtgtacgagcgcgtggagagcgccaagagggaccaggaactccggatggagcgggagcgcctggactccgcccggcagctggaggagcagcgcgtgcagttcttcctcaagatgcagatggagctctccaaggccacgggcggcgcgggcaccgncacgcccacgcccatggccgtcccg

SEQ ID NO: 13866 - DNA, 649 bp, Zea mays
  unsure (1)..(649): unsure at all n locations; Clone ID: LIB3279-233-Q6-K6-C10
ctcgcctgcgatctccgtagcctccgtcgcgtcgagcatcgatcatgtcggcctactgcgngaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaggccatgacgaccttggcaagcgctgcgccaagtactacgaggccggtgcccgctttgccaagtggcgcgctgttctcaagattggccccaatgagccatcacagcttgccatcgacctgaacgctcagggtctggctcgctatgccatcatctgccaggagaatggtctggtgccaattgttgagcctgagatccttgttgatggccctcatgacattgatcgctgcgcttacgtcactg

SEQ ID NO: 13867 - DNA, 615 bp, Zea mays
  Clone ID: LIB3279-233-Q6-K6-C11
acaaaatgaaaatggctaacctcctgataggacatatggttctgctggacacatggcaagcgcaaattccgcattttccttatgtcctgttaatatctgaacaaacagtatatgctagtaagccatgttgccaaagaaagagtatatctggcacactgaacaaaacaatgaatcataccagatcagggcgagactcgcttgatcctaggacagcatgtctatttggttgtgcttcaacatcccaaataagtacctggatgacaatgggaaaaaggttgacatcattccaactgtaacacattatgcctcacaaggattaaacaacatcacaagatctgaacatacatcccaaataagtacctggatgacaatgggaaaaaggttgcctgctcatctaaaaaaatctaagggcatgtgttttcaccacctggtagctgcgctagctcgatgaagtcacttgcttcactcggggattcaccaagatatgctacatcattatattagtttgaaccgtgcagagatcgaggagggttaaatgtgcaaaacaatctacttcagatgcttatgtaatattcagaacattttccagctaagaaagcacgcaacagaatcact

SEQ ID NO: 13868 - DNA, 451 bp, Zea mays
  unsure (1)..(451): unsure at all n locations; Clone ID: LIB3279-233-Q6-K6-C12
cctttccccttccctccctccctctccccgcgggccgccagnagcaatttcgccctcngatcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaagggagaagaaccctaagaacaagtctggtcgctgcggtggggaaaagctgctgggcgacaggtgggaaatacctggagccgagtcgggacaagggctccctaagttaagccaagggcttaaca

SEQ ID NO: 13869 - DNA, 517 bp, Zea mays
  unsure (1)..(517): unsure at all n locations; Clone ID: LIB3279-233-Q6-K6-C2
gcaaaacttacctggncagcaatgtacaggaagcagcacaagaaggatatccatgctgaagcagtaaagaagaggcgccgcgccaccaagaagccatactccaggtcaattgtgggtgcttccttggaagtaatccagaagaagagagctgagaagccagaggtccgcgatgctgctagagaagctgctcttcgtgagatcaaggagcgcatcaagaagaccaaggatgagaagaaagcgaagaaggcggaggtgagcaagtcccagaagacgcagacaaagggtgcggtccagaagggttccaagggccccaagttgggcggcggtggtgggaagcgctgaaagaacttagtgtcgtttctcgacattgcagtcgttccttagccaaagccactttcgtagaacctgtgttgaatttgcaagacttattcaagcgttgcttgtgcgtgctaaataccatggcaagagaacggatttatatttatgcctgaaaaaaagaccgttcatattcttaact

SEQ ID NO: 13870 - DNA, 623 bp, Zea mays
  unsure (1)..(623): unsure at all n locations; Clone ID: LIB3279-233-Q6-K6-C3
tcgacccaacgcgtccgcggtctgcggtggtnngcaaccagctgtcgccgcaggtgggagcgccgccccttcacgcccgaggaggacgccgcgatcctggccgcgcacgcccggctgggcaaccggtgggccgccatcgcgcgccttctcccggggcgcaccgacaacgccgttaagaaccactggaactcgtcgctcaagcggaagctcgccaccgccacggcgacctccagcggcagcgatgctgagcgggcgtgcaagcgcgcaagccctggcccggggagcccgacggcgtcggaccgcagcgacctcagccacggctgcggcgccgcgcaggtgttccgtcccgtcccgcgcgccggaggcttcgacgccatcagcgccgcagacgtgcgccctccgcccccgccagcagtcgcagacgaggacccgctcacctcgctctccctctcgctgccggggctggaccagtcgccgtcgggcttccaccacgacagcgcccggagccacttccaggagctctccccctcgtcgtccccgtcgccgcagtctactccacccgccttccctccgcaggcggctccgtctcagtcgtcgtacgcgttcagcggcgagctggttgc

SEQ ID NO: 13871 - DNA, 586 bp, Zea mays
  unsure (1)..(586): unsure at all n locations; Clone ID: LIB3279-233-Q6-K6-C4
gagctctttctctcccnggcagcccctgctctagctcccactcggcgttctcctcgaagacaccactgcagcccctgcactttggccggcactctgctttacccggcagccatggcgctctcctgctccatcttccatccatggtcagccccttcccagcagccccagcatggtaccccttccctgctccatggacgcctgcacctccttctgttttcccccgcaccgcccttttccccatggtgcagctcggcctccccattagtgcagctccccgtctcctccctgcgtgcgtgctggaaacaaggttgaagaagtcccccatgagcctatgacgaatgggcccagggtcaaatggatcgccggtgatcgtcggacttcagccaccgggacgttacagggaaccggcggactaagcgcggcgttgctgggcggctgtgcgttgtgcgccacctgcacaaaggggtggcggctgcacgctgcggaggtcctcagccgctggcagtttgtatgagtacgcgggtaaagcagaaacacatgcctctctctagattctttgcgcttgcttattatctggttggtttgc

SEQ ID NO: 13872 - DNA, 567 bp, Zea mays
  unsure (1)..(567): unsure at all n locations; Clone ID: LIB3279-233-Q6-K6-C5
tttactgaccttgtgacccaaagatattcatcgtgatgtcaaagctgcaaatattttgttagatgaagacttcgaggctgtggtgggggattttggtttggccaaactaatggattacaaggatacccatgtaactactgctgttcgtggaacaattgggcacattgcacctgaatacctttcaacaggaaaatcctctgagaaaactgatgtatttggctatggaattacacttttagagcttattacaggacagcgggccttcgatctagcttgccttgctaatgatgatgatgtcatgcttcttgattgggtcaagggattgctcaaggagaagaaactggagagtctggtcgaccaagatctagaacacaactacgtcgacgttgaggtggaatctctggtacaggtcgcactcctctgcactcagagcaaccccatggaacgccctaagatgtcagaggttgtgaggatgctcgaaggcgatggtctcgccgagagatgggaggagtggcagaaagcgnaagtagtacggcaagaggtcgagctaggccctcatcgaacttc

SEQ ID NO: 13873 - DNA, 180 bp, Zea mays
  Clone ID: LIB3279-233-Q6-K6-C6
tagggtttagtggccacgcttttgtttattttaccatcaggaatacatctttaatcagttaccctatcgtatctattatcttatctcaaagtttactctatagttagtgtaatctataatgcaaaattttcatacattttatatgatgtgctgcagacagccttaggccgtgtttgtttc

SEQ ID NO: 13874 - DNA, 620 bp, Zea mays
  unsure (1)..(620): unsure at all n locations; Clone ID: LIB3279-233-Q6-K6-C7
cgttgttgtgcaggtgttggacgccaggnatccaatgggcactcgatgctaccatctagagagacatctaaaagagaactgcaagcacaaacacttggttttcttgctaaataagtgtgatctaatccctgcttgggctacaaaaggatggttaaggaccctttcgaaggactatcccaccctagcattccatgcaagcatcaacaagtcatttggcaaaggatctcttctgtcagtattgaggcaatttgctcgtttgaagaatgacaaacaagctatttctgtcgggtttgttgggtaccccaatgttgggaagtcatcaattattaacacactacggtcgaagagtgtctgcaaggttgctccaatacctggagagacaaaagtgtggcagtacatcactctcactaaaaagatatttttgattgattgtcccggtgttgtatatcaaaacaatgattcagaaactgatatagttctgaagggtgtggtccgggtgacaaatttggcggatgctgctgagcacattggtgaagttcttaggcgtgttaaaaaggagcatctccaaagagcgtacaaaattcaagattggtctgatgataacgattttcttgtccagc

SEQ ID NO: 13875 - DNA, 588 bp, Zea mays
  Clone ID: LIB3279-233-Q6-K6-C8
agccgataccctaaccctcgcccttctcgatgtcggccgccaccaccggcccagccccttcagtagccactccgatggcgccccctccgtcctacccggcctcctccacggcctcttcctccatctccgcgtccgccgaggaggaggaggacctctatggccgcctcaaatcgctccaacgccacatggagttcgtcgaaatccaggaggagtacgttaaagacgagcagaagaacctgaagcgcgaactccttcgtgcgcaggaggaggttaagcggatccagtctgtaccgctcgtcattggccagtttatggagatggtcgacggcaacaacggcatcgtgggctctaccactggcagcaactactacgtgcggatcctcagcaccatcaaccgcgagttgctcaagccgtcagcgtccgtcgcgttgcatcgtcactccaacgctctagtcgacgtgctgccgccggaggccgactccagcatctccttgttgggatcgtcggagaagcccaacgtcacttacaacgatattggaggatgtgacatccaaaagcaagaaatacgggaggcggttgaattaccct

SEQ ID NO: 13876 - DNA, 563 bp, Zea mays
  unsure (1)..(563): unsure at all n locations; Clone ID: LIB3279-233-Q6-K6-C9
cccagcgtccgggnaaaaattccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcct

SEQ ID NO: 13877 - DNA, 195 bp, Zea mays
  Clone ID: LIB3279-233-Q6-K6-D1
gttggcggttgcaacaggtgctctcactgcactggtatcgtgcttgtctgacataccgtagtatttgcatggcatgctggtgatgttatttgtgcaaaaaaaaaaaaaaaaaaaaaaaaaaaaaaaaaaaaaaaaaaaaaaaaaaaaaataaaaaaaaaaaaaaagagggcggccctcgcaatctaaaaccgcaa

SEQ ID NO: 13878 - DNA, 546 bp, Zea mays
  Clone ID: LIB3279-233-Q6-K6-D10
cccatttccccatctccgacctcccccttcctctcccccctgccgctccccgcgccgagaaggagaaccccagccgccgcgcagcgcgccgcccatggcctcctcgtcggagaacgcggctgtgccgccggaggaggagccccaggccccgccgccgccggacacagagcctaccgaggcggcgcccggcgaggctgaggatgagccgcaaaccctagagcgagcgcaggagctcttcgacaggggttccaaggccatcgaggatgaggacttcgtcgacgccgtagactgtctcagccgagcgctcgagatcagggcttcacattatggagagctcgcgccggagtgtgccagcacatacttcaaatatggatgtgccctgctatacaaagctcaggaggagagtgatgttttgggaaatgttcccaagagcttgccaaaagaagactcagtgaagagtacagctactaaagatgacagtggaacctcaaagtctctggtaccgatgcggaggatgctgcgccatcagaaaaagtgatgctgaag

SEQ ID NO: 13879 - DNA, 559 bp, Zea mays
  unsure (1)..(559): unsure at all n locations; Clone ID: LIB3279-233-Q6-K6-D11
cccagcgtccgngacagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggaccgtccttcgaccaaggtccacgctgctcctggcggtggctcttccctgggatacctgtttggtggcaactgatgccgctcaccaagctatcaccccccactgtcgccgcatgctttttctgaatcgtgaacagccgttgtcatttcatgtgtacccaaacctcccgtcccgcgtgggcccgtaagctgcgcctagatttcaggctaatcgtgtg

SEQ ID NO: 13880 - DNA, 456 bp, Zea mays
  unsure (1)..(456): unsure at all n locations; Clone ID: LIB3279-233-Q6-K6-D12
gttaaattcgtgtctgtgccaggaggtcacctgcgtatcaccagnaagcgacatgaanaagtacatcgtgccttacttgacgccggaggcgtcatccaagaagagcatacacatacaccggatgctgtcgctttgagcgagtatctaacaaggtttgtatcggtggccactgtgccctgacacgtgggccatgtgttgacgccttgtaaatacgctgaacatgaagggaggaaatgatagcgccgtggaagcgtggatccgaacttgtgaagtggagcgtgtttggtcctttccgtttcctgtctgacaaacaaatatgtccatgccgttgccacaacacgcataaatcattatgcacatttcctattgagtaaaatacaattccggtctgtaaacttgtcgaaccatgtcatgccggttcataaacctttaaaatatgtttcttaaatgcttaag

SEQ ID NO: 13881 - DNA, 558 bp, Zea mays
  unsure (1)..(558): unsure at all n locations; Clone ID: LIB3279-233-Q6-K6-D3
anaaatagactgaacttgcagctcaaaagagttctataccaatgctcttaatgcggctaaagaggctgaggcattggctgaagcaagagtcaacagtgaagccaaagttgaactggagaaccttttaggagaagctggtgaaaaagaaaatatgctgattaagacaatcgaggagttgaggcattttctcacccggcaagaacaggaggctgctttcagggaagaaagactaaaaggggactatgatgatcttcaaaagcggtatcaagccagtgaacttcgttataatgaactggtaacacaagttcctgagtctaccagaccgctcctaagacaaattgaagccatgcaggagacaactgctcgaagggaagaggcttgggctggtgtggagagaaccttaaactctcgccttcaggaagcagaagctaaagctgcttcttcagaagaaaaggagcggtctgtaaatgagagattgtcacaaagtttattccggataactgtccttgagacccagattacaattcttagaacagagcagacacagctgagccgatc

SEQ ID NO: 13882 - DNA, 500 bp, Zea mays
  Clone ID: LIB3279-233-Q6-K6-D4
cccacgcgtccgcgtgggactacagcaaaccgctctttgttgccccagccatgaacacgttaatgtggaacaacccattcacggagcggcatcttcacacaatcaaccaactgggcatagccttgatccccccagttaccaaaaggctggcctgtggcgattacgggaacggcgcaatggccgaaacctcgcagatccatactgccgtgaggctcgcgtgcaagacgcaaccgcacgatgcgagcagttcactcgcgggtcctgtcagtaataaccggccatctagctgatgcagcggttggccacttgattgtcaagcttaggaatttgttttatctgcagtgtgcatgtggagtgttgtaccaaattttttttccatctagtgtttgtgtgtattgaaattgggggggaaaggctgttgtcacaggataacaataacttcctccctgctcagtaattatgactctattcagtttgtaattgccggtgggagtacaatt

SEQ ID NO: 13883 - DNA, 617 bp, Zea mays
  Clone ID: LIB3279-233-Q6-K6-D5
cgcggctctatggttgtagaattgtgggtgaaattgttgggcaacgggttgctgacagaagagagatcgaataccagtccgggaaacggcaacaatataagagtgcatgttatttctttaagattgacagggagcatattattgatgccacccgcaaaggtgggattgcaagattcgtcaatcattcatgccagccaaactgcgttgcgaaaataatctcagtcaggaatgagaagaaggtaatgttctttgcagaacggcacataaacccaggggaggaaattacgtacgattaccacttcaaccgggaagatgaaggccagaggatcctttgcttttgtagatcaagatactgcaggcggtacctcaattagtttccggtgggcgtaacatgtctatatataacttatatatctatatgtatatcttatatatttacaaattacaattgcgattcatgcctgctgtatatgtaggaacttgcatctagaactgcctgtttatcttttgtgaagtcaaatgagttatcagctgttcatgtgacaaaaaaaaaaaaaagggcggccgccctttttttttttttttttttttttttctcctaaatcttaatccattct

SEQ ID NO: 13884 - DNA, 642 bp, Zea mays
  unsure (1)..(642): unsure at all n locations; Clone ID: LIB3279-233-Q6-K6-D6
cggacgcgtggggcgcagcgcacgcaggcataggagggccgcgcgagctctgcgcggtggcctgtggtggggcgagggaagcgaggcgaggcggggcggcccggcagccgcctcctgactcagtcggtgggagctggaggtgcgagctgacggtccgggttaccgaccgggcagcacggcggccacagcggaggcaaacggcgggggcggcgaccccggggccgcggcgaggcggcgctgggacctgccggccggaaacattgcaatggggaaagaagttgttgatatgtctactgatgaagaatcagattgcgtagttatgtgtccacctaacagaaatgctgatcatgaggaagctgtgagtggcagccatgatgaagattcttcaggaaggcaagagaacccttatgctgtgaactcacatatgaaaacccgtggccaggaagatgtgtctgtaaacccagacctgctcaagctgattcatcagcaggagtcttctgtcagcaattcaccatcaaaacctgcaggagctagacagcaagggtctagccatactgtccctgagtcatgcactattgcacctgaaagcaggtcatctggagcangaacttgtgctccaatttcttatcccaccagcagcgg

SEQ ID NO: 13885 - DNA, 628 bp, Zea mays
  unsure (1)..(628): unsure at all n locations; Clone ID: LIB3279-233-Q6-K6-D7
cgatgatgtcgctcccaaaagccgcnagcctgaatattcgatggaccactgctgtcttcgcgcgataaagccaagattgaacggagaaaaagaaaagaggagaggcaaagagaggttcaatatcaaatgcatgttgcggagatggagacacttagggctggaatgcctcctgtttatgtaaaccacagtaatgatggtgggccagctgttagggatatacatatggagaacttcagtgtcactgttggtggtcgtgatctaattcaagaagccactataacacttgcttttgggaggcactatggacttgttggaagaaacgggactgggaagacatcttttctcagagcgatggcattgcatgcaattgatggtattcctaagaactgccagatattgcatgttgagcaagaggtcgtgggtgacgatacgacagctttgcagtgtgttctgaacgccgatgtcgaacgagttcaacttttgcaggaagaagctcgtcttgttcaacaacagaaagatttagagattgaggctgagtttgggcagagctccgacaaggcaaggatggttttgacaaagattctatcagcaagaggcttgaggagatatataaacggcttgagctcat

SEQ ID NO: 13886 - DNA, 644 bp, Zea mays
  Clone ID: LIB3279-233-Q6-K6-D8
ctaatcgcgacggccattggagggaagaatggagagcctaaaagactatcagctacatggcagagagagttgtgggaactggatcatttggaatcgtcttccaggcaaaatgtctggagactggtgagactgttgcgattaagaaggttttgcaggacaagcgctacaagaacagggagctacaaatcatgcgatccatggatcactgcaatgttgtttccttgaagcattgcttcttctctaccacaagcagagatgaacttttccttaacttagtgatggagtttgttcccgagtcattatatcgggtgttgaaacattacagcaatatgaaccagaggatgccactcatttatgtcaaattatatacctaccagatatttcgaggcttagcctatattcacacagtacctggagtttgccacagggatgtgaaaccacaaaatcttttggttgatccactgactcaccaagtgaagatatgtgattttgggagtgccaaaatgttggtcaatggtgaagcaaacatatcatatatatgttcacgttattaccgtgctccagagctcatatttggggcaactgagtacacaacatcaattgatatttggtcagctggatgtgttcttgctgagctgcttctt

SEQ ID NO: 13887 - DNA, 531 bp, Zea mays
  unsure (1)..(531): unsure at all n locations; Clone ID: LIB3279-233-Q6-K6-D9
gcggnaagcagggagcccaaggagccgcagcccacagntcaggtgatgagcccaccactaagataacggcgataggaatggttcagtaccgttgggcgaccaggcccccagtaggggaggggaagacagcaggagccgcagccgcagcccatccggtggtaaccgcagccctgcagctaatgggcgtagcccgagccccagagtgaccgtaccccgagccccatggctgaccgtggcccggccccaggctgaccgtagcccgagcccaaaggcaatggtaacaacgatggtggtgatgatgatactggccgtggtggttcccccacaggaagcaagtcaccctgaacgctgcaccgtctcagttcttaggtgcttcgtgatgcagtgggcaaacataccaaagacgtgatagctgtatcgtttccctatctgagacgtggacttatttagcttgctttgatcttggactccttatttttttctcttatggatttatgatatgaagccttcgggcctggctcgggatctgaa

SEQ ID NO: 13888 - DNA, 622 bp, Zea mays
  unsure (1)..(622): unsure at all n locations; Clone ID: LIB3279-233-Q6-K6-E1
ccagccgccaccggtgcangatctttcgtcatctcttctccggcgaagaacccccagtcgcccaccagatcacttgttaaactttgttgaggggtgatggcggtttctttcgcaaacctcaacaccgaggcagggcttaaaaagcttgatgagtaccttctcactcgcagctacatcactggctaccaagcttccaaggatgacttggctgtctacacttcgttttcgtctgctccctcgtccaagtatatcaacgtagcaaggtggtttaatcacattgatgcgctcgtgaggctgagcggaattactgcagagggccaaggtgtgaaggttgaatcctcagcagttccttcagccccaactccagatgttgctgaagcacaggccccagctgctgaggaggaggacgatgatgatgttgacctttttggtgaggagaccgaagatgagaagaaggctgctgaagagcgtgctgcagctgccaaggcttctggcaagaagaaagaatctgggaagtcatcagttttacttgatgtgaagccatgggacgatgagactgacatggccaagcttgaggaagctgttaggagtgtccagatggaagggctgctctggngcgcat

SEQ ID NO: 13889 - DNA, 487 bp, Zea mays
  unsure (1)..(487): unsure at all n locations; Clone ID: LIB3279-233-Q6-K6-E10
gnatggtttcaagtgatgaagctattgagatgccaagctcttgctctgaaagaaggttgttggttggaatctcttctggtgcagctgcagctgcggcagttaggcttgctaagaggccagaaaacgccggaaagctatttgttgtcgtgttcccgagcttcggcgagcgctacctctcatcggtgctgttccagtccatcaagaaggaagcggaaagcatggtggtcgagccctagagcacacagttctgggcttctggcaaactatttcctgagacgttcatcatttccatcacagaaaaataaagctcgggtgccttctgttgatttcgacgtacatttccctgccgatggtgtccagcccactgttgtcgctggagaacacgtcgtttttagacttgtgatgttttactactgttttgacactcgttgtatttctgtatatcgcgtcagactgtgaaataaaagcagtacagtgtgtttcttgc

SEQ ID NO: 13890 - DNA, 545 bp, Zea mays
  Clone ID: LIB3279-233-Q6-K6-E11
cccagcgtccgcagacttctgctgcagcgcctccgccgccgctgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgttctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctggtttggtttggattgtgatgaactaatggctctttgaatttatattatgatgttgacgatatttggcg

SEQ ID NO: 13891 - DNA, 582 bp, Zea mays
  unsure (1)..(582): unsure at all n locations; Clone ID: LIB3279-233-Q6-K6-E12
tgnaaagccaattgctgcaagtgatgtgttgctaactaaaactagtgagtgtgggagttcttcactgaaagacagctgcacgaaatgcatgatatcatatcactatttatgtgaacagacttagtgttaatgcaatatgtttcattttgatgtgctggctgtgtcgtgtttgtgtgcagagcacatagcatttacagagcagttgctcccatattagaaagctgaaaacgaaaatgatttcaagaaatgacctacgtgagatatttcttgaatggacgtattctcgttgccatttcaactacaagaaatcagtttgagttcatagctactaccattggagtgcttttctgaacttatgtgcactgccaatatatataggtgatttaactgtgacatgttcacaaaataaaattggattttgaactaatgcgtgcatctaacatctatttggtatttaccttccatcttcatgtttttaattttgtaactgaggagagaaatcactttgaatttctggttattcattatgcggtgcatcttctgtcttatatgctctctgctcctctgttggctaacgcattg

SEQ ID NO: 13892 - DNA, 565 bp, Zea mays
  Clone ID: LIB3279-233-Q6-K6-E2
atcgcccttatggctaacaaccatgaccacaagaagcagttaaaaagagtacttgatttatagacacagcgacacatatatggccatggagctaagagataatcggaatgaccttgtctttatgttcaataattcttttcaatcttctaatatgttgttctcctttacctttatattccactcatagctgctcactaatgtccattacatttactcctgcatcttttactgtccataccaatgatccacatcctcacattcttcccttattaaaattctaccttgccccctatgtcgatacggatatctgttacatatccaatgatcctgaagccggcgaacggtttgctgctgcattatcaacttccctgatgactgaaggcgtatcattcttatgaagatgcctaaaacaaagaatcttatcccgaaaatacctcatgtgttcagtaaagacaacaacaagcatgtgtctcactgtacataaagtcattgcagccttcactagctttcttcctaacaagtaccaggaaggcccttctcctgcagtcagtctcatagtcaacat

SEQ ID NO: 13893 - DNA, 644 bp, Zea mays
  unsure (1)..(644): unsure at all n locations; Clone ID: LIB3279-233-Q6-K6-E3
gcaggnagaagcaccactgattgagcaagcttttcaaaacgtcttgaggaagagaagatccttcacgagcaagagcagcttcgggagattgaactcagcaagcaacaccatgccagcgacttgcaagnagaaaaatagactttcacggatgttggagcacaagaatgctttacaggagagaatcatccaagaacgtgcagctgagtttggccgtctgaagaaagagagagatgaacggatgaatcggttgatatcttcaagaaagcgtgaaagggagacagtaaggaagttgatgttttatctgaacctggaggaacagcggattgaaatgcttcgtgaggaagaggaagctagaaaacgtgaagcggaagagaggaggaagagagaggaggctgaaaggaaagctaaacttgatgccatcgctgaaaagcagcgattgagagagatagagctggaggagaaggcaaaggcanacaagggagaagctcttaaagggatccgaggctgtgcgcgctccagattctgcacctgttgcacagccacctcgagagtcagcagcagcgcctgcagctgctgccggtgctcctgctcctgctcctagtaaatatattcccaagtttaaacgcgtggtgatagcagcagca

SEQ ID NO: 13894 - DNA, 645 bp, Zea mays
  Clone ID: LIB3279-233-Q6-K6-E4
agcgtccgacccctcccgttccactgttgcccaagtccaaccaccagcgagatggcggggaccgtgaccgcgaccgcaaccacggccaccaccgaggtcgggaccacagtgaccgcagccacctccgagatggaggccaccgcgaccgcagccacctccgagctggaggccaccgcgaccgcagccgccatcgggccgccttcagccatccccgataaatatatgcataaaaaccggttgcagtcatttgctgaacgaacatataagaaaacgccaatctacaaggttgagtctgaaggccagtctcatcagcctaagttcacatgcacagtggaagtgggtgatcaacagttctcatcaactggtagttttagtcgtaagaaggaagcagagcaggacgctgcgagagttgcttatgagatcttgacaacagttagtgagagtgacgttaaggaggcatttgagctaattgatcaggatgcagttttctgcaaatcaattctcattgaatttgctgtcaagacaaagaccactttgccctcttactctgtagtttgtgtttgtctcaaaaagcctttgaccctgttcgctgcaattgtggtgtttgatggaaatgcatatcatggtgaatctgcacccaacaag

SEQ ID NO: 13895 - DNA, 458 bp, Zea mays
  unsure (1)..(458): unsure at all n locations; Clone ID: LIB3279-233-Q6-K6-E5
ngaccatanagtttcagtgtgatgatgcatctggcttcgctggcaatgcgtgtggagcatccacatttatggtgccataacctccccttggcccaatagcatttgggcctttgcattaatgccgccatcaaagggtaccataagcgatagcaagcatcccggctggtacatgtaagtctaactgtcagtttagctatctcgtgtgtagctccctgagttttacaacattagtcgattttaccgggagttgcaataccatcatgtgtcacattgtttgtccactctttacccccttcaatgctgtgaaaagaaaggctaagtagctgtagcatgttatagtaggtgtatgtggggtaattcctcattagctcttagatctagtctttcctctgtctatttatacggttatcattgacatattgcggaatggagagccagacttacaggatttgtcactg

SEQ ID NO: 13896 - DNA, 576 bp, Zea mays
  Clone ID: LIB3279-233-Q6-K6-E6
cggccgcgtgggttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacctcgaggaggcagcaatggtggatgtttggatcgaggtggaggctaaccagtacaccgctgcactgaatcccatcctcttccaggtcctcatcagtcctatgcttgggggaaccaccgaccagaaagttgtggatgagaaccttgagaagctgaagaaggtgctagaggtgtacgaggcacgcctgaccaagtgcaagtaccttgctggagacttcctcagcctcgccgacctgaaccatgtgtctgtcactctctgcctgttcgctacgccctacgcatctgtgctcgacgcctacccgcatgtgaaggcctggtggtctggtctgatggagaggccgtctgtccagaagtcgctgccctgatgaaccatctgcttgaaacgggtgccctgtcaatcggtgaat

SEQ ID NO: 13897 - DNA, 584 bp, Zea mays
  unsure (1)..(584): unsure at all n locations; Clone ID: LIB3279-233-Q6-K6-E7
cagttcctttcaggcatggcgagcgcattggcttcagttatctggtttctcagaaatatactggcgagaaagctcttgttaaagttctgcgtgattcaaaagttcatgaatttaaaataaggctagcaactcacaaacgactcgttgcggctcatgtgaagggcaggccgccgtcatattacatagttgctggttttgtttttgcagctgtttctgttccatatcttcgatccgagtatgngaaaagattatgaatatgatgcacctgtcaagttgttggtgaagcatttacatgcgatggcagaatcacctgatgaacagcttgtggtggtatcacaggtgcttgtatcagatatcaatataggttatgaagaaatagttaatactcaggttcttgctttcaatggccagcctgtaaaaaatttaaagaacttagccaccatggtggaaaattgcaaggatgaatttttgaagtttgatctggagtatgaccagattgttgtcctccagaccaaaactgcaaagtctgcttcccaggacattctgacgacgcacctgttaccgtctgcaatgtcggatgacct

SEQ ID NO: 13898 - DNA, 594 bp, Zea mays
  Clone ID: LIB3279-233-Q6-K6-E8
gttcaagtggacaactcttctgatcccccccacactgtgcttgtgattaacctggttggtatagtggctggagtgtcgtatgctatcaacagtggctaccaatcatggggtccactattcgggaagctgttctttgcaatctgggtgatcctccacctctaccctttcctgaagggtctcatggggaagcagaaccgcacaccgaccatcgtcatcgtttggtccgtccttcttgcttccatattctcgctgctgtgggtgaagatcgaccccttcatatcccctacccagaaggctctttcccgtgggcagtgtggtgtaaactgctgaaatgatccgaactgcctgctgaataacattgctccggcacaatcatgatctaccccttcgtgtaaataccagaggttaggcaagacttttcttggtaggtggcgaagatgtgtcgcttaagttcactctactgcatgttaactgtcgtgactacctgttcaccgtgggctcatggactgtcatgatgtaatctgtatgttggaacttccagtactgattgagctgtttggtcaatgacattaagggtttctctctcttgaattt

SEQ ID NO: 13899 - DNA, 614 bp, Zea mays
  Clone ID: LIB3279-233-Q6-K6-E9
ctttccctcgcgccgccgccaacgcaacccttgcagccccaatccctcacagcaaccatggctggcgcgcaggagtccctctctctggtgggcacgatgcgcggccacaacggcgaggtgacggcgatcgcgaccccgatcgacaactcgccgttcatcgtctcctcctcccgcgacaagtccctgctggtgtgggacctgaccaacccggtccactccaccccggaatccggcgccaccgccgactacggcgtccccttccgccgcctcaccggccactcccacttcgtccaggacgtcgtcctcagttccgacggccagttcgccctttccggctcctgggatggagagctccgcctctgggacctctccaccggcctcaccacccgccgcttcgtcggccacgagaaggatgtcctctccgttgccttctccgttgacaaccgccagatcgtctccgcgtcccgcgacaagaccattaagctctggaacaccctcggtgagtgcaagtacaccatcggaggtgacctcggtggcggcgagggccacaacgggtgggtctcctgcgtcaggttctccccaaacacatttcagcccaccattgtctccggttc

SEQ ID NO: 13900 - DNA, 653 bp, Zea mays
  unsure (1)..(653): unsure at all n locations; Clone ID: LIB3279-233-Q6-K6-F1
atcaaactggctgtaatgatcttaagatacttanatgtgattggatcggacccagaggggcgactaggagaagctccaaggccagagctacgcgagcatggacggatatccggtgcttgctttgatgcggctttgggaatcattccagggctaaaggttcgtggaactgattactccactgcagatggaacttgtattagggactacatcgatgtcacagaccttgtagatgcccatgtcaaagctctcggtaaagctcagccaggcaaagttggaatctacaacgtcggaacaggccaaggtagatcggtgaccgagtttgtagaagcttgcaagaaggcaacgggagcttccatcaaggtcgaatatcttgcccgtagacctggagattacgccgaggtatacagcgacccgtcgaaaatcctcagggacctcaactggacagcccaatacacggatcttggccaaagccttgcccaggcgtggaaatggcagaaggcgcacccgaacggatatgcgtcagcctgattcagagctcaaaaggttgagagactcatcactcagattcaatccaagggtccgtccatgtgcagtcaatatagccttcagacgattgggtcttcaccatagaaaaaacgtagcaacagcaacag

SEQ ID NO: 13901 - DNA, 625 bp, Zea mays
  unsure (1)..(625): unsure at all n locations; Clone ID: LIB3279-233-Q6-K6-F10
gaatttgcatctcaaggcgagtggcagcagattttcacctgcaagaaacggatcatcttccacttatgtgagggacacttcacaaaaagaaaaaggtggctatttgctaccacttctgtttgtgccaagatcagaagatctttgtcttaatggaacatctacagacaccgatgcccaacaacatattggaactgaatgtgatactgaaagcggtcataatagatctctgaatcttcacgagattcagcctagcgctgatctatccattacagctggttgttcttttgctgcaacttctgatgtagtagccgatacaagtgatgagcagaggagtcatcagcgccatccaaagaaatgcaggttcaatggttgctcgaaaggtgcaagggatgcatcaggactttgcatttctcatggcggtggccagaggtgccagaagcctggttgcaacaaaggtgctgagagtcgaacggctttctgcaaagctcatggaggagggagacgctgccaggagctaggctgcaccaaaagcgccgaaggaagacagagntctgtattgctcaatggtggtgggcgcccggtgtgggcattgangaatgcccaacagcggcaaggggggaagtct

SEQ ID NO: 13902 - DNA, 546 bp, Zea mays
  Clone ID: LIB3279-233-Q6-K6-F11
agcgtcctctgactggtaaccaatcgaagcttgaatatctcaattcctgcggttcggatgttatagaggttggcgtaccatactcggatccactggctgatgggccagttattcaggcttctgcaacacgggcgcttaagaaaggcactacacttgattctgtcatagagatgctgaagggggttacacctgagctttcttgccccattgttcttttcacatactataatccaattctgaaacgtggtgtgggaaacttcatgtctactatcaaacaagctggcatacatggacttgtagtgcctgatcttcctttggaggagacagcgttgctgaggagcgaggccattatgcacaacatagagctggtgctgtttacaacgccaaccacgccgacagatcggatgaagggaattgcacaagcttcagaaagatttctctatcttgtgagcgctgtaaggggttacaggtgcacgctcaaatgtaaacttacgtgtagaaacacttcttaaggagatcaagaaggttacagacaaacccgtagct

SEQ ID NO: 13903 - DNA, 492 bp, Zea mays
  unsure (1)..(492): unsure at all n locations; Clone ID: LIB3279-233-Q6-K6-F12
gnaaaatggcatgtcccttgatatcggtatctatgatgagccaatgactccagggcaatgcaatatggtggtggagaggctcggcgattacctgatcgaacagggcttctaagtttgtcataatgctattttggtcattgggcacttaagtttgcacctcatttggttctgtaatatgtgggcttgtgcatgtgcttggcgtattgcatgcagtgaataatttatcttcgcgttgggttggtgacaatgttgggaacggatttgaattggggtttatgcttgccatctcctcatatctcgaactcagctgctgtttcactgagtaatgtacatttccctggtaatggtacttgtgcactctgctgctttaaaaaaaaaaaaaaaaacacaaaaaaaaacaaaaataccataaacaaacccatcaaatatcaacaataaaattttcttaataaatcaccaaaacaaaaaaaaaaaaaaaagggggcgcccttt

SEQ ID NO: 13904 - DNA, 592 bp, Zea mays
  Clone ID: LIB3279-233-Q6-K6-F2
gccgccgccaacacgtctccgaccccaacaggtcgccgtcggccagcagctctggatccccgtgccctgcagctgcgaccccgtgggcggccagcccgttgtgcacttcacctacgtcgtgccggccgggggctccgtgtccggcatcgcggaggagttcggcaccacggaggagacgattctcacgctgaacaagatgcccgacgccaagtcccttctcgccggccaggttcttgacgtgccactccgagcttgtggttctgccattagcagcacagccattgaccgcaaccttctcgtgccaaatggaagctacattcttaccgccaacaactgcgtcaagtgtggctgcagctctagcacctggcagttggactgccagccgacacagggactgagctcgtcgttctgccctgccgccaagtgcggagacatgttcctcggcaacacatactcctccacctcatcctgcgagagcacagcatgctcctacgccgggtacaccaacagcacatcgttcgccatcctcgccaatgtgaccaccagcaacgtgtgtaacgctgggatgactccgacggcgcagccggctcac

SEQ ID NO: 13905 - DNA, 593 bp, Zea mays
  Clone ID: LIB3279-233-Q6-K6-F3
ccccgcgtccggccaattccagtaccgcttctgcccccagcaggtgccagcgccaccgccgttcgcctcctctccacactccgccagatcccatccctctcgcccaccgcgcgggtatcggagtcggagcatggcgtctgcagtggtggtggacgccggcgacgcgccggagcccacggttcgtaacctcctggaccaggagtccctcaagtgggtcttcgtcggcgggaagggcggcgtcggcaagactacctgcagctccatcctctccgtcctcctcgccggggtccgcccgtccgtgctcgtcatctccaccgaccccgcgcacaacctcagcgacgccttccagcagcgcttcaccaagttccccactctcgtccgcggattcaccaacctctacgccatggaaattgacccaaaggtagaaaatgatgatttatccaatgaaggaatggaaggattcctgtcagaactgacaaatgcgattccaggagtagatgaagctatgagttttgctgaaatgctaaaattagtccaaacaatggattactctgttgttgtttttgatactgctcctacagggcatacattac

SEQ ID NO: 13906 - DNA, 601 bp, Zea mays
  unsure (1)..(601): unsure at all n locations; Clone ID: LIB3279-233-Q6-K6-F4
cagcaactgaaagagaacaaggtgaattgtccagcagtngatgagaagaagtacaaggcactaaagcgtgccnactgaaagagagatactgcagagtgctgatgtcatttgttgcacctgtgtcggtgctggagatcctcgtctttcaaacttccgtttccgacaagttcttattgatgagtccacacaggcaacagagcctgaatgtcttattcctttggtgcttggtgtcaagcaggttgtccttgtcggagatcattgccaattgggtcctgtcatcatgtgcaaaaaagcagcccgtgcaggattagcacaatctctctttgaacgccttgttatccttggagtgaagccattcaggctacaggtccagtatagaatgcatccatgcctctcagagtttccatccaactgcttttatgaaggcacactgcaaaatggagtgactgttaatgagaggcattcgtctggaattgattttccttggcctgttccaaatcgcccaatgttcttctatgtgcagatgggacaagaagaaatcagtgctagtgggacatcgtatctcaatagaactgaagctgcaaatgttgaaaaaattgta

SEQ ID NO: 13907 - DNA, 648 bp, Zea mays
  Clone ID: LIB3279-233-Q6-K6-F5
ttttcttttccgctgacagaagccgtaagcatcttgctgctgcgcgagtgctcgtctctccttgtcctcctactacagtcgtcgtcgtctctctccagggacacacatccgccatcacctttgcttcttcgattcgcaaggagcacgagtactcatggagcagggacaggggtggaggaggcggcagatcccggcgttcgggaggtggaaccagcataccgacgaggcggggtacttggagtcggcggtgcaggctggcctcgtcaggcccggccactgctaccacgacgacggcggcaacgaggtggtgctgttcaggtcctccgcctcgccgcctccgcacaagccagccaagaaggtgcgaagcacgatggagggtcacggtcaccaccatcaggttcaggttgaggcggggagcaggaagcagcggccgttcgtggcgggcgacgggtcccgctcccgcgcggccaagccgaggccgagggtcgttagggcggcggtggacgaggacctgtacattgtcccttccgatatgtcgcgcaagaagaaggggtaccgttaattttcagctgctgtatttatttaacacacacatatatataaggccggcctgatcaggtcaaccctagctagctccactttgaaact

SEQ ID NO: 13908 - DNA, 649 bp, Zea mays
  unsure (1)..(649): unsure at all n locations; Clone ID: LIB3279-233-Q6-K6-F6
atttcatccttctgtatctaactttccaccattttcccctttatcgaagcatcaagacccagaagcaagtctggtatacaggcattgtgttcactacatgtggctcttgataaagccaaaggcttcttcaacattgtgcagactgcagcagactctacttggcaatcacttcggaaactgtgcttttaaagtttgagaagtctagaagccagcttcaggagagtctaaggcgcattgaaagcatagtaactgaagatatcggctgtaagattgtggagattgttggtgaactggagcaaattgtttttacattggatagatcagagaaggaagctggtgatgagctgatcaatttgctacagagaaacaataaaacaaatggttctagtgataatggggagcttgaggtcttccatatttctgctcttaaattgggaattacatcttctagggcagcactcaccgaaagaagagcccttaagaagctaattgagaaggctcgttctgatgaagacaagcgtaaggagcttgttgtgtcatacttgtacaatctcatgaggaagtactcaaagttcttcagaagtgagactggtgatgatacatattctcaggggatcgtctncatgctcgccaacagtattaggcatgg

SEQ ID NO: 13909 - DNA, 522 bp, Zea mays
  Clone ID: LIB3279-233-Q6-K6-F7
cccagcgtccgcggccgcgtggggcttctttggttgagcaggaggcatatctggctggcgcgacgcagcacgtgttgcccgttcttccacaagctggtccaaccatcatggctgctgattatcctgcacagccggtggctagcaatcgttgctgctagcaatggaagacctgtaactgcatcactgtgcacagccgttggggaagctgaagtgagaatgtgacaggcatgcctgcatgtgccccgcatgatgtctactgcctcacaggtttcattgcttttcggtgggggcgactggagagcaaccgaattcgtactttcgtagtagtagtagtacggaacaatctgaatatcagatgaaaccatagaacgcgtctcccagtctgcaaaatgcacaaggcttccgtcgatttgctggtagtactatgatggaacaatttggttgacataggcctgggtgtatgtctgcaaaacgcttttttaaagtcggtctcaacagcgagtttttatgatacattgtgtt

SEQ ID NO: 13910 - DNA, 598 bp, Zea mays
  Clone ID: LIB3279-233-Q6-K6-F8
cccaaaccaatccgtcgcagaacactcaagtcgcaggatgccgccgccgcgtgagcaccaccagccccaggacgaagaggacgacgataccgcaggcgttgtcaagctcatcagcgccgagggcttcgaattcgttgttgacaggaaggccgccatggtctccaacaccctccgcaacatgctcacatccccaggcggcttctctgagacgcgccagggcgaggtccgcttcccagagatccccaccaacatcctcgagaagatctgccagtatttctattggtcgctccattactccagtgggaaggagacagcggagtttccaatcgaaccggagataaccctggagcttatgatggccgcaaactatctggacacttgatgaggagcctgaggggtataatcctagtttgttattaaatatgaaagaacgaagcaatgaatactagtgaatctttccttccattcgtttctttttctttttctttttttttttgcattacatgatgtaaccagcatacgctggatgaaatgcttgttttttcacagatttgatctgatctgatccgatccagtgtggtctggcacaatgtaatgt

SEQ ID NO: 13911 - DNA, 181 bp, Zea mays
  unsure (1)..(181): unsure at all n locations; Clone ID: LIB3279-233-Q6-K6-F9
ccccgcgtccgcccngatagaatttatgtgtttctcatatgtaattcttaaaatgtcagagagtaaactttcatcacggacgtcactcattgtcacgacagatatgcaaacttccactgctctaaatgatggagactacttgcaggacatgaatgcaaattagcaagacggtttacttttc

SEQ ID NO: 13912 - DNA, 632 bp, Zea mays
  Clone ID: LIB3279-233-Q6-K6-G1
cggccgcgtgggttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacctcgaggaggcagcaatggtggatgtttggatcgaggtggaggctaaccagtacaccgctgcactgaatcccatcctcttccaggtcctcatcagtcctatgcttgggggaaccaccgaccagaaagttgtggatgagaaccttgagaagctgaagaaggtgctagaggtgtacgaggcacgcctgaccaagtgcaagtaccttgctggagacttcctcagcctcgccgacctgaaccatgtgtctgtcactctctgcctgttcgctacgccctacgcatctgtgctcgacgcctacccgcatgtgaaggcctggtggtctggtctgatggagaggccgtctgtccagaaggtcgctgccctgatgaagccatctgcttgaaacggttgccctgtcaatcggtgaatggaataagccaagtctgttctgggttgtttgcttgttcagtgatgtgtcttcta

SEQ ID NO: 13913 - DNA, 602 bp, Zea mays
  Clone ID: LIB3279-233-Q6-K6-G10
taccagcggcgccgcaggctgacgaggaggcggagtagagtggccggactacctcgacacctccactgcaaccatgggtatctcacgtgattcgatgcacaagcgccgggccaccggtggaaagcagaagacgtggcgcaagaagcgaaagtatgagcttggccgccagcctgctaacaccaaactgtctagcaataagacagtgaggagggtccgtgtacgtggaggcaacgtgaagtggagggctctccgattggatacaggtaactactcgtggggaagtgaggctcttacccgcaagacccgcatcctggatgtggtctataatgcatcaaacaatgagcttgtgaggactcagactcttgtgaagagcgccattgtacaagttgatgctgctccattcaagcagtggtacctcactcactatggagtggacatcggtaggaagaagaagtgcctgttgctaagaagatgcgactgagggacaagagggtgaggctatagctgaggaaacaaaaaagagtaaccatgtgcagaggaagattgagaagcgccagcaggaccgtgcactcgacactcatattgaagagcaatttggcagt

SEQ ID NO: 13914 - DNA, 609 bp, Zea mays
  Clone ID: LIB3279-233-Q6-K6-G11
cccacgcgtccggccgacgccgccctcatcctgtcacccaccgacgtcgccgtcgccgtcgccacctatatcacccaccgcctctgaagaagaagacgcggatccgagggtagttaactgctgaagaagaagatccggtacggagaagacgcggagcagtacttctccgatctggatgttggtaaggttcatcctgatttgaacggcaatctcactgataacgagttcctgggaggaggaagctagacaatttctgttagaggaggaagaagaggatgatgaactcttattagtacttgtccctgctattctctcggccatgcaagaagagaaaagagccatagtagcatctgctgttgaaccggtgcaacatgtaccaagagcgggcagcgagatcaatgttgctgggccaagtgtgggcagtgagactaatgttgatggactaatgttggatcaagaggcttgtgaagttcagtctccaccttctgttacgtcagtatatagaagtgggaaaaagcggaagaaaagtcaagttgcaagtgttctggatgactatttggagcacaagaagaagcaaacacagaagattatggaggtgttacttgagaa

SEQ ID NO: 13915 - DNA, 617 bp, Zea mays
  Clone ID: LIB3279-233-Q6-K6-G12
cttgagcagaggatcgcgttcacgagcaagaagaatttcggcacggaagaaaggagcgcaagtgggcgcatgcccagaggactcttcacgggctccagccgccagaggcatccatcttcgagaacaagacgacattcaatgagctgaaccagctcgcggaagaggcccgcaggagagccgagatggcgaggttgcgagaagtgagcaccctgaaggggaggatggagtcagtggtgaagcagaagggtctggacatcgagaccatccagcagtcctacaccgtgtgactggctgaccgacgacgacggggtttatagaggtttcttcttcttatactatacaatctgtactaggtagcaataaggatcaaggaaggaacccctatatattggctgtggttcgcgggaaatgaatgatggtcatatttatgatgtcggtgtggtgcttctgtcgccaactctcgaccatactaccctcaactcaccccttgtatgctgtggcattaaccacccccggcaccaccggcaggcattgatattgagagatgaggtatagtagtctgtagcctctagtagatgatgatgaattgatgatatagtacatttttgcttgctttt

SEQ ID NO: 13916 - DNA, 628 bp, Zea mays
  unsure (1)..(628): unsure at all n locations; Clone ID: LIB3279-233-Q6-K6-G2
gngnaaaaagctatgaaggattgcaagccaacagagaaggtggaatgtactatgagttcagacgaaatactcgatcgattaagtcaactattctacattttcagcttcgaaatttggtatgggctacgtccaagcatgacatctacctagtatcacattactcaattcgtcattggtcagcattgagtggtgtcgatactgaacttatcaacgtccaaggacacgtggcaccaagggagaagcatgcaggaagtttatcagagggtttttatcagactcaagttagtaccttggcagtcaaggacaatttactggtagctggtgggtttcaaggagagctgatctgtaaacaccttgatcgggaaggtattagtttttgctgtcgaacaacttatgatgataatgctattacaaatgcggttgagatatttaatacctctagtggcgctgttcacttcatcgcatcaaataacgattctggtgtgagatactatgacatggagagattccagctattcaagcatttgcagtttgaatggccagtgaatcatgcttctttgagtcctgacagaaaggtcgttgttattgtcggtgatgatcctgatggtctacttattgatgccaactc

SEQ ID NO: 13917 - DNA, 670 bp, Zea mays
  unsure (1)..(670): unsure at all n locations; Clone ID: LIB3279-233-Q6-K6-G3
ccggngtcgacccacgccgtccgcccacgccgtccgcccacgccgtcccggccgaccccgntcgagtccttngagcgccnagtggaggagggagagacacnncgcatcacgtcgccggggcttagacgggnnccgcacatggccacnncgcctcgccaccggagtcgtctcgtggtctacccgccatcgcgcccatgccgagagcgagagggtncgagagagacagagagagcgcgggggggggggaaggccgccgcggttgaccttcacgctccgagccgcctagctccaaccacgtgcacgggaggtgtcgccggtgcacgccgcccacatacgtggattttccgggtggaatagttggtcggagtacgggagatttctcaccggagctgcttcatcgccgccgagtcgccctactcgtggtctgcaccaccacggccttaatcaccgaagtgaggttacgaggaacctgaagcccaacttagagaagtacctggagttgcacccaaaaaggcaagttgtgtccttgatcacattctttgacctaataatgttagctgttatgttctcaccaatgctcgcactgttaggttaagctgatgggacctaataggttacctagttttgtttaccccacacttgcatataaatgaattattgggtagttctg

SEQ ID NO: 13918 - DNA, 496 bp, Zea mays
  Clone ID: LIB3279-233-Q6-K6-G4
cggtcgcgtgggcggacgcgtgggcggacgcgtgggtattgacagtagtgctgttgagttcagcaaaattgcagcggcgcctcttgattgggactactacagaacagcggaagtgcaggagaagtacatgaaagatgatgagtttgcgcaactgacaagcaggatgcaatgaggctggcggtgccgtcccgcacccccactttggtagcactacgggtgaaccacgacagtgtggcacgttgaacttcggttgccagaacgatgtgaaacctgtctaaattcatgtagctcagttgtaggtgtttactgaagctgattgctgtagttgcctgatcttctgggagtaccctttgggcagtaaaaaaatgcacttgtcaccggtgaccaaccggtcatgtcctgttttgtttgttcgcttcaacctaactgttcgactgcttgtttgaactgctgcagctataatctttagagacaaaacattggttctagatcgcga

SEQ ID NO: 13919 - DNA, 621 bp, Zea mays
  Clone ID: LIB3279-233-Q6-K6-G5
cccacgcgtccgcggacgcgtgggggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcgggggggcccgcgcggccaagttatcctgttcgct

SEQ ID NO: 13920 - DNA, 574 bp, Zea mays
  Clone ID: LIB3279-233-Q6-K6-G6
atctgcttctatttaagaaacattctgaacctgtcagggtcatgctaactagtattgtgcttccatgtgagatatgcttatatttgttctgtgtgcaaaattgtttctgatttcattcttatgcatgccattgcgttacctactctataacacaagaatttgatggatgaatgttcttgttttctttcatctttccagaactcacaacaggggtccaaatttgttaagacaggtttagatagttcaggtaacattgggagctcatcaattgcacctccgaagaaagttcaccctggatcaaatggaatgcttccggcagaagaagcggatatgccatcacatctctctatatccactaagatgctaccaccacccctgaagagcatgctgccactgccacccagaagcatgcccccaccaccacctaagagcatgccttcaccgccaccaaaatttccttcagatgagtttttgtcacagaaacgagaacaaattttttcctttaaaggagccaacagcacctccaaggtcctttgatgcaatatcagtcttgccatcttgaaccacgaccaaa

SEQ ID NO: 13921 - DNA, 653 bp, Zea mays
  Clone ID: LIB3279-233-Q6-K6-G7
ggacacttaaaaagcttggaggttatcttgagttcttcatgaatcgcgatcttgcttcaacttatgtgagtttgaagagagaacttgagaatttaatccattgcaagctccaaaacccaaggatggatatccaaacgagtgaagagctgctatcagccatccgtttgctggtgactgaggatccatgcagtgggcggttcgtgtacggccgacaggagccaagatcaaagaaagcaaagacgatgctttcgccatcctctctgagtgaggctggtggcaacggaggggataatgccaagaaccagctccagacttacctgacccgggccgggcacagcaaccccacctacaagacgaagcagatcaagagctatctcttcagatcgacggttgagttcaacggcatgcagttcgtggggcaaccgtgtgcaaacaagaaacttgcggagaaagatgccgcgagcgaggcactgaactggctcacaggagatggtggagcgattactgactctaggggggctcaggatgcagaccccatgtccttgctgatgcaaccaccgcgtaggcgtcgacatagccatcgtcggaggaactgattagcacgacatgctttttcttcctttttgatcgcttttcttatttatgtagcattc

SEQ ID NO: 13922 - DNA, 572 bp, Zea mays
  Clone ID: LIB3279-233-Q6-K6-G8
cccagcgtccgcccacgcgtccggtagtatactagaagaggaggaggagagggagaagacgaagcgaagccatagcaaggtcgtcggagccggagagggaggagggtggggaacctcttcctgcgtcacgtgacaactgtctcctgacccaccggagcggcggactccctctgcgcgccgcgcacggcctgttccggtgcggtcgcaggccgacggccggcgacggaggcagcaggaagctactataccaaccggcccaagagaattgcgggtccagaggcagtgatggcggggcgctacgattgacgtgctacgattatgggcatccaagggaacaaggcggcgacgcacgagcacgacttcctctcgctgtacgccgccgccgccgccaaggacgctcctctcctgctacacgactccaaggcgccgcctccttctcaaggtaatttcctcttgaagacgcacgacttcctgcagccgttggatcagaagccgggagcgccgccggagccgtcgccgctgcccgcttccgccgcggagagcaagcaccagccgcagcagcaggtcgtcgt

SEQ ID NO: 13923 - DNA, 535 bp, Zea mays
  Clone ID: LIB3279-233-Q6-K6-G9
ctgggaattctgaaaaggttactgcatactcagatggccaagtcaaggtctacgagctcttggattcattcgaattagacaagtggcagcttcaggcagagttccaaaacattactgatccaatctctagatttggaaaacctgcatgcacttctgcatccatagcatggaatccaagaagaggtggaagccaacaagctagttttgcaattggctttaattcagattctcctcatttcaactcttgtaagatttgggagtttgaagaagctcatcagcgctggcttccacttgttgagctaggttcacctgaggatacaggagataaagtgtgtgctgtagcatgggctcctaacattggcagaccatatgagattatcgcagttgcaacctgcaaaggaattgcaatctggcatataggtttgaacgctgatgctgatggcggaccttcgatgcagaacgttgctttacttaatggccacgatggcgaggtgtggcaactggaatgggacatgggcggtatgacactcgcatc

SEQ ID NO: 13924 - DNA, 622 bp, Zea mays
  unsure (1)..(622): unsure at all n locations; Clone ID: LIB3279-233-Q6-K6-H1
ggctggccccctttctctcctgttacatcacaatctcataggcctctgcaagctccaccgacttttatggcagtgagacctcctatttccgtctctcctcttggtgcaactccaccgcaaggtcccattgcattgacaccaccaaatatgcccaccatgtaccgcggccagcatccaccagtaccaaatttcactggttcagcgccattggtttccaggcctcctggtggtggggctcagtcttttcctacagctgcgcctcaaggcccttcctcagtagcatttcccggtggaccatcgctgcggccaccttaccctccggcgcctgatcaagcgagggggccacctccagctttctctccagttggatcaactcctggcatggtgcctccacctattgcatcttccggcctgcctgccccgcgtcctgcgaacacgagctgcatccagacacaagtagtagcccctttgagacctccgctcccagccgcgggcgattttactttccggcctgccataccaccggcgcatgctccagagttcgcagcaccaggcagtcaaatgggagcaatacatggccagactcaccaccctgnaccattctcctcccatcctggtgacc

SEQ ID NO: 13925 - DNA, 555 bp, Zea mays
  Clone ID: LIB3279-233-Q6-K6-H10
tattgctccactagatttgcctcattcattgcatgcgttccatcgtgtctcaagtagtgattctctcaatatggaaggttaccacaccattccgtggaggattttggaattactttagtatggggatggatgcagaagtgtcttatgcatttcattctgaaaggaagaagaatccagagaagttcaagaatcagctgacaaatcagggtacatacgctaagcttggacttaaacaaggatggttttgtgcttctcttagtcagccatcatcaaggaaccttgctcaaattgcaaaagtaaagatcatgaaaagagctggtagcctctgggaggaacttcgcattcatcacagcattcggtccatcgtgtgtctgaatttgcctagtttttctggaggtttgaatccttggggcacacctggcacgaggagagcagaagatagggagttcactgcaccttttgtcgacgatggactttttgaggttgttggcttccgtgacgcctggcacgggctggtcctgctggcccctaatggacacggcactcgcattgccc

SEQ ID NO: 13926 - DNA, 506 bp, Zea mays
  unsure (1)..(506): unsure at all n locations; Clone ID: LIB3279-233-Q6-K6-H11
gtaaaaagtaaccgctgtacagtctcggngggaacatcggataaaggctggccagcttcgtgttgtaggacgactggacgaggaagcattgtcggccaggcccgagaggaagtgtccagcgataatcagtggatcatgagttcacgagaagaagacccttgatgatgtcttagatcttgttccgttgcgtttggatcaaagagtccatgcagttatttcatgcaactattcttgaagagtccatgcgggctattcttgaagagtccatgcgggcacgtgatttactaatggagcagaatgttgccctggatttagctcgaagagaggctgagatggctatccgtgctcgcaatgatatcctagctgttatgaatcatgaaatgagaacacccatgaatgcaataatagccctttcctccttgcttttggtaaactgagcttactcctgagcagcgtctaattgggggaaacagtacttgaaaagcagcaattttgtttagcaacac

SEQ ID NO: 13927 - DNA, 651 bp, Zea mays
  Clone ID: LIB3279-233-Q6-K6-H12
gcagggaggagaggcaagggaagccgccgccgccgccgccgccgccgcccccgccccgtccctcctcgccggcccgccgccacaggtttcaagatgtcaacctgcacgtttgcgacctcctgcgtgctcttgggcaatgctcggacaaccgatgtcccccagaaagcgctcaagagccgtgtgagcttccttggccgaggcgcgctgcagctgccgagcctgaggtcctcctcaaagaagaagctggatgtctcagcggcggccacgtacaaggtgaagctggtgaccccggaaggggaggagcacgagtttgaggcgccggacgacgcctacatcctggactcggcggagacggcgggggtggagctgccctactcgtgccgggcgggggcatgctcgacctgcgcgggcaagatcgaggcgggcgcggtggaccagtcggacgggtcgttcctggacgacgcgcagcaggaggagggctacgtgctgacgtgcgtcgcctaccccaagtcggactgcgtcatccacacccacaaagagggcgacctgtattaggggtctcacctctggctcccccggtttgtgttgagtagaaccttgatgctctgtaaaaccaaacttgaagggtggttatcccctggctgcctgcct

SEQ ID NO: 13928 - DNA, 513 bp, Zea mays
  Clone ID: LIB3279-233-Q6-K6-H2
actcacttgcctggtacctggccatgtgtgtgcccagtaccaggggtcatgcccaaggactattacaatgactattggtgtaaccataagcacttccataggcacgtttactggacaacatttattcataccaaaatccatacaaaaatgctaaaccaaagactctggcaaatagaacgcattctgcgaaccatgcttcactacttgtatcaacacttgtaatcacgattattagacttgttacaaaccatgagtccatctaaaactatattagaacttgaatgaatagttaaaggaactattgatggaaatatgaatggaaaatacatgtgttgacatatataagaacctgtatgataaccgatgaactaggaaatgacttaagataattctgacagagacatgacaaatggatttgcacacagatcacaaatgtgacaagctagctaacgagaaactgctagagaaactgtttgactactatgctgactgctcatgacatcactcgtctca

SEQ ID NO: 13929 - DNA, 323 bp, Zea mays
  unsure (1)..(323): unsure at all n locations; Clone ID: LIB3279-233-Q6-K6-H3
gtatttcaaggctcacctggccagttgcgctccgaggaattgagtcatgtgaaaactctgagtaggttatgtagtttcctggccctaagtagtttcctggccataagtatggccccaattgacattggatctgtcttctcatgctcctagagctgtacccttcgaggtgcttgtgcctttgtgagcttgtgttgaaccatgttgtatgactaaatagtccgcaaacgagtcagctggatggctaatctgtaggccaactattgggatattgttggatattatcaacaaccggttcagattcgtgatgagattgtccgncnnaa

SEQ ID NO: 13930 - DNA, 644 bp, Zea mays
  unsure (1)..(644): unsure at all n locations; Clone ID: LIB3279-233-Q6-K6-H4
gcatgcctggcgcgagaagcaccagccaaagcccacagttccccccatttcatttgtgtggtagccgaggactgggagggagctgctcaaccttttttttgtgtgtgtgtgaaagatcgagagcgccgctcaaccaatagagctgtttctctgccttgtgtctttgctctgtcctgtggtctgtggtggactggtggccgcggcggcggggacggcggtgatggagttcacatctaagaagacggcttcgcttgccctcctctgcctcaagctctcctgccttcttcttcttcttcttccccgggcttcgtctgctgcgcctctgtccagaagcctgtcgctgacgaggaaccgcctgcagcccgcggacgaccctgctccggaggttcgcgctcccgcccagcagggtgcggatgcgggtgctggtgctggtgcggtgggagttcgagaccccggcggcgaggtggcggcgaggatggacatcgaggtcaacgactaccctgggtccggtgccaacaaccgccatgaaccgaggagccctnggaggccatgaggcttgaagctagcccatcgtcccctgcgtacgtctcagacaggaatcaggaatgaagaccatggcatggagctgctgctgcgctgtcttg

SEQ ID NO: 13931 - DNA, 626 bp, Zea mays
  Clone ID: LIB3279-233-Q6-K6-H5
gttcaagctctgcaggtgaggtccgttcagtttggccagaagggcatcccctacctgaacacctacgacggccgtaccatccgctaccccgacccgctcatcaaggccaacgacaccatcaagatcgatctggagaccaacaagatcatggacttcatcaagtttgacgtcggcaacgtggtcatggtgaccggcgggaggaacaccgggcgtgtaggtgtgatcaagaacagggagaagcacaagggcggcttcgataccatccacgtcgaggactccatgggccaccagttcgccacccgcatgggcaacgtgttcaccattggcaagggcaacaagccgtgggtgagcctgcccaagggcaagggtatcaagctcagcatcatcgaggagcagaggaggcgcgactttgctgcccaggctgctgccaaggcataagttctctgaatgtgctgcttggagctttttgctatgtctagttttatttttatctgcaaggatatagagctaccttcccaagacgttttatcatcatgttttgttgcttttggttcttgaacagcgtttgcagctagctgtaatgctttaattcgactttctatatattgttgaaccgtgttgtcgac

SEQ ID NO: 13932 - DNA, 502 bp, Zea mays
  unsure (1)..(502): unsure at all n locations; Clone ID: LIB3279-233-Q6-K6-H6
gnaaggagtcactgtcacttggtgagatcgatggcccgcgtcgccgccgtcctcgttgctctcctcgccctctttgccgtcgcggccacggcgcaggcccctgccgcgtcgcccaagcgcgccccagcccctgcgccacccaagatggcccctctcccgccgccgccgaccagggcccccatggcctccccgccctcgcctcccacgatgtcgccggcgtccgcctcctccgccgacgctccagccacgagccccgtcggtgcgggatttggcgacgcgatggccccggcgggagcctccgctcttactccggccgccgcgcccgtcacggagaagagcacagccgcatctgcctccgccatcagcttcgtcgccatcgccggcgctgtggcagccgcagccgtcgtgttctagacatccggaggtggatctgaggagctgcagctgcagctgcacctgagccgctctgctgttgttgatagatgccctctgtttgctctgt

SEQ ID NO: 13933 - DNA, 533 bp, Zea mays
  unsure (1)..(533): unsure at all n locations; Clone ID: LIB3279-233-Q6-K6-H7
cctagctttacctccccacaagcgcctccaanatgaagctcgtcaggttcttgatgaagctgaacaacgaaacggtgaccatcgagcttaagaacggcaccgtcgtacacgggaaccattaccggcgttgacatcagcatgaatactcatctgaagactgtgaagctgacactcaaaaggggaaaaatcctgttacccttgatcaccttagtgtgaggggaaacaacatccgctattatatccttcctgacagcctaaacctggagactttgctggttgaggaaacaccaagggtcaagcctaagaagcctacttctgggaagcccttgggacgtgggcgtggccgtggtcgtgggcgcggtcggggtcggggacgttgagcatgctagctgcttttggaaattgcattgcgtgcatctgcagtgtaacctacattcctatcaattgtacgaagtatgcctttgattatgcaaccatgtatcaattgttttttttttttgccgtggatttatgttgatgaggttaccatgtga

SEQ ID NO: 13934 - DNA, 619 bp, Zea mays
  Clone ID: LIB3279-233-Q6-K6-H8
ccggttctggcaagcatgtgccgagggccatcttcgtcgaccttgagcccactgtcattgatgaggttcgcactggctcgtaccgccaactcttccacccagagcagctcatctcgggcaaggaagacgcagctaacaactttgcccgtggccactacactgttgggaaggagattgtcgatctatgcctggaccgtgtgcgcaagcttgcagacaactgcactgggctgcagggattcttggtgttcaatgctgttggtggtgggactggctctggacttgggtcacttttattggagcgcctttcagttgattatggcaagaaatccaagcttggtttcaccatttatccttccccacaggtgtcaacagctgttgtagagccatacaacagtgtcctctccacccactccttgcttgagcacactgatgttgcagtcctcctggacaacgaggctatctatgacatatgcaggaggtcccttgacatcgaaaggccaacctacaccaacttgaacaggctgatctcacagatcatatcatctctaaccacctccctgaggtttgatggtgctatcaatgtggatgtcaccgagttccagaccaaccttgttccata

SEQ ID NO: 13935 - DNA, 665 bp, Zea mays
  Clone ID: LIB3279-233-Q6-K6-H9
cgctgatatttgtcatcgtctcgttcctgccctcggccctcccctcgctcgctccccaactccagcaggcagatcagatacatccattcgcggaccggaaggaaaggaaggggcgttgaactatgagcgccgtggcggtttcgtcgtcgctgaacccggacgcgccgctcttcatcccggcggcgctactacaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcagggccccgtcgccgccgcccttaagacagattcggtgctcaaggcgctgaacatgacctccccgaagggcggcggcgacgccccgcgggggttccgggagaaacccaggaacgccgagaagccgaccaagtacgccggcagccccaagagcagcgccccccgcgtgatccaccagcctcgctaggttcgctgggggaactcatcaggaaggctgctgcccctcttgcagccttgctcctggctgccgccgctgtcgtggactcgtggtctgctctttcaagtcgaagtaacggtggttcgagct

SEQ ID NO: 13936 - DNA, 98 bp, Zea mays
  unsure (1)..(98): unsure at all n locations; Clone ID: LIB3279-233-Q6-N6-A1
tgtagcatcctcgnaaaattctaagctgtgtctatgaaacatccccattgctcttattacatgatactctactatgcaaccaacagaagcacgacttt

SEQ ID NO: 13937 - DNA, 471 bp, Zea mays
  Clone ID: LIB3279-233-Q6-N6-A10
aaaaggggcccccccccccctaaaggggcaggggcccccccccccttgggaaacagggtcaaaattttcgggggcccgattttttgggggggggggttttttaaaggggggctaggggggggccccaaaattttcccaaaggaaacttttgggggtttaggaaaaaaacaggggggcccccccaaaaggggccgggccccccaacagttttttttccccccggggccctgttttgccccaaacgggtttggggggcccttaaaaaaaaaaaagttttgaaaaaaaaaaggggggggggggccccaaaaatcccacccttggggcttttttaaaggggttttggtccccccccccccgggagggggcccagggactttggcccccccctttgcgggaaaaggggcttttttttccccgagttgttgatgcggcccttaaaaaggttggggggcccaaaggggcctccccccc

SEQ ID NO: 13938 - DNA, 594 bp, Zea mays
  Clone ID: LIB3279-233-Q6-N6-A11
acatgaacaatcattaatataccatgttcgcaatcacgtcccaaacctcacaactcctcgaggaggttacgttacgtacagtacaggctctaccgctattgtttattttctgccaagtgacccaacggctactcatctcatacaacctgactgactgataaaagagcagatggtcttcgctctttgcctgtcacgctcgcgtcctgctgttctcagcggctctcacttgttggaagtacgggtgcgtcatagcttcaagtgcagtaagcctctcctgatgatcataacgcaaaagcttgtcaaggaaatctatggcctcaggagacactaggtgctggttatctgcgttcataaactttaaccagggtttcctgctatgccttccaacgagggcttcaagctgagggtcaagctcaattctgtacttgttcaaataaacattcagcccatctgtcccaagtaccttggctatcttaacaagttgatcatggttgtcatgcccgtagaaaaaggttccttacgaaaaatcatcccagcaaacatgcagcccagactccacatgtccaaagagtaatcataatcttgcaagtcaac

SEQ ID NO: 13939 - DNA, 619 bp, Zea mays
  Clone ID: LIB3279-233-Q6-N6-A12
ggcggcggagcccagcagcagcagcgccacggctttggctatgcaccacccggggttctccacgctctccaccgcctcgtcggacctgtcgaccagctcgtcgtgctcctgcctcgtcctctcgtggtactcgtggatgaacttgctggagaaggcgccgcccacgggcacgctgcgcctggcctcgtccagccacttcctcatcccctgcacgaactcctcctcctcgacgacgtcgttgcgggacgtgtcgaagtcgtccatgaccttgtccaccgcgtccgtcctgtcgaagtcgacctcctcgaagttgatgccgacgatgagggcgtggagctcggcgcgggacagggaccggctctcgtccatgtcgatcttgcggaacagctttctgatgacttgttcattgggcgtgccgtcgtcgttcagcaggcggccgagcgactgcatctgggcgtgcctcagtatcccggagatcacgtgcttgtgcttcgcgtacgcgagcttcctcctctgaatccaaggctggaaaacctggtacaggcagtaggcaagcacgagcgcgaacgacacgacaagggccagcagcatagcgaggcgctgcccgtggtgcgtcttc

SEQ ID NO: 13940 - DNA, 217 bp, Zea mays
  unsure (1)..(217): unsure at all n locations; Clone ID: LIB3279-233-Q6-N6-A2
agagtaccatgtagagattaataaccgtgcagaaatactgactcaagtacaacttgacgagaaatcatgccataagcaataagcatagcagacaaccaatcttgcgatctgcacaatgtatacttcggcagtagtcaaactaaaatctcgataagaccacnnagtgaacagtttttcttatggtggcacctattcccccccctttcttttttttttt

SEQ ID NO: 13941 - DNA, 497 bp, Zea mays
  Clone ID: LIB3279-233-Q6-N6-A3
ttagaactcctgggatgcggaaccgatgtcggccttgcccttcccaccggccttcttgggcagcagcgtctgatgaatgttgggcaacacacctccggcggcgatggtgacagctccgagcagcttgctgagttcctcgtcgttgcgcacggcgagctggatgtgacgcggcacgatgcggttcttcttgttgtcgcgcgccgcgttgcccgccagttccaacacctctgccgcgagatactcgaggacggcggagaggtagacgggcgcaccaccgccgacgcgctcggcgtacttgccggccttgaggtagcgcgcgatgcggccgacggggaactgcagcccagccttggtcgaccgcgacacagccttggaccccttgggcttgcccctgccgccgccggaactcatattcacctcttctcgtctgagactactctctcgcttggtctaactcgacggaatcgctgtcgcgctggtatggcggtggtggattt

SEQ ID NO: 13942 - DNA, 534 bp, Zea mays
  unsure (1)..(534): unsure at all n locations; Clone ID: LIB3279-233-Q6-N6-A5
attcgtcgtatatatattaattagcccgtacacgacacgactatagaggagcggtacacgaagggccacgtaccacatgttaggaggaggactataacagnaaaagtgacacaaacacctgatggcgcgcggcaagacacgcaaacaagcaggaagatcagcccacgtgcgcacgtacatgcatgcacagcacacgtactagtactagcagcgcggcacggagacgccgcaggaggcgacgaccttgcgcgcgttggggctgttgatgtagcgcccgtaggtggggttcttcacgaactggcagaagcacccctgctgcgccttgaggttggagcagcacgacgcggagggcgtcgcgccggcagtgatcgccggcgcgcacgccgccagctgcccggcgttgcacgaagccgccgacgccgtctcggtcgccgtcgccgccagcaccaccagcactaccagcgccactgccgccatgccctgctgctgctgcttcgccatgtagtactgtagtgtattctcttctctccaacc

SEQ ID NO: 13943 - DNA, 570 bp, Zea mays
  Clone ID: LIB3279-233-Q6-N6-A6
gccacggttaatagcaagcagctttgctggggtctgatacacacagccttcttctatgctcgagagcaatacaacttttctcccacagcacctctcgacggaacatgactatgcaggtcaagtatatatagtcagcgtctgagtctgacattctttaaatctacgcttattgttcacacaaaggggagtaaatatttcgacttcggaagagaggaccttcttgacgaactgttgttcttcagatgattctggtgggcgtggctctaagaagagcagcaccgcgacgtaagggcgccagaatttgtggctgacacttggatggactgtccctctctgaggttaccggaccccaaaccagactcctccgaagacaggggcttcttgctgattatccggtagatctcggctagaacggtgtggaaggccttctcgacgtttgtcgcatcgagcgcagaggtctcgatgaagaacaaaccttcgctctctgcaaagcttgcagcatcctcaacggcgacagagcgcaggtgcctaaggtcagtcttgttgccaatgagcattacgactatgttc

SEQ ID NO: 13944 - DNA, 612 bp, Zea mays
  Clone ID: LIB3279-233-Q6-N6-A7
ctagaatagcgcagttcaattatgcagttccaaagggtacacaaggatgattcaggtaaatgactactctgtgcacatacgcaggagatgatgatatacaaacgatgcactggagctagaataccaaaacgagatggtaaaatggcaatagctttaaaagatcaacagcattcagtacgacaagcatccaggtgcattgaaagtcaaaacactaggcagatgaagacttgacagtggcagacttgatgatgtccacgaattcaggcttcaatgaggctccaccaacaaggaatccatcaacatctggttgagctgcaagttctttgcagttagctccatttacagaccctccataaattatccttgtcaattcagcaactgcagggctaacattggagtggagccactttctcagaccatcatgaacctcctgagcctgagcaggagttgcaaccttgccggtaccaatagcccaaactggttcatatgccaacacaatatttgtccaatctgatattttttcagcaatagcctttgtttgtgcagcaacaacatccattgttgttcctgcctctctctgctcaagggtctcaccaatgcaagcaattacct

SEQ ID NO: 13945 - DNA, 556 bp, Zea mays
  Clone ID: LIB3279-233-Q6-N6-A8
agagaaggagcaattaaagtttccggtactaatactgttctgaatacaaacatcgtatatcagcaaacactggtcctggacaaatcaactcgcactatctagaagtttgagacgattaaatttcctaagaatctactcaatattgcatctgtctgttcaatactccgcagatatatcagacccactaccacttccaatacaactgttgtttcgtctcttccttttgtgtcaatgagaactgaacaaatgtgacatagcttcagtcccagaaccttagcgatgcacaaaccacacttgaccacaacacaactgctagcatgggaagttcgactgctcttgaacttcaccaacaggaagttctactgcaaagttagcttgagcatcagcagccgaattatattccctcaaaacatgtctgatttgaaataaatgaaatgttccctttagctccttcactttcttgcagaagctagccatattatcattcttaacacgccagatatcttggactttggcatgttgaatgaagcaacaaccttccgtgatacaagaatga

SEQ ID NO: 13946 - DNA, 316 bp, Zea mays
  Clone ID: LIB3279-233-Q6-N6-A9
gatctcactaacatattcaaggatatcaaattgttccacgcagattgattgtattacgaactgaccttacactcgagcacagtacaaaacatagcaaatccagatccacggtatcggtaccagcctgaaaggtacataaaagagctacggctataatgcttcgaaaggatgccattatcagcaggctaacatacttcactgcttccttgccgcgacaatgttgtcagcctctttcttcacaggctcttccttctctgacagaatcagctcaatgtggcaaggggaggacatgtaagggttaatgcgtccgtgagca

SEQ ID NO: 13947 - DNA, 535 bp, Zea mays
  Clone ID: LIB3279-233-Q6-N6-B1
ggtgcaaacaaagagcccattactttgcttaactaggaacaccgtatttggaggataataatgatcctactaacgcctcgagatttgcattgatttgagacatttgaagatgagacattggagggaactaaatcttgtgctttgcgtgcagttggagacttggtttccgccaacgctcaccttcagcttccaaattcttcagacaggtctcatcttgctgcactgccacctacacatccgatcaaccgaacatgagaaaattggaggaaaccaagtattgccttttctttctcaatcaaatttggttccatccatttctcaaattcaattgcccaagttttagctcggagttccctccttggccaagctaagtatcttactctaatccatgtaggagtactccgcttgattttgcagtggcggctactgatagcggcagttttctacaacccttggcttcagagcttagctaatagatgtttgggttcggacgcgtgggcggacgcgtgggcggacgcgtgggcggacgcgtggg

SEQ ID NO: 13948 - DNA, 580 bp, Zea mays
  Clone ID: LIB3279-233-Q6-N6-B10
ggtgcccatagatattaattttatagctcataaaaattgataatcttgcaagagttttacatgcatacatagtcctgcaattcttggctatatgtaggtatagagtgtttcatgcacagacaaaacagcattactaacaaacagggacaataatcatggattgtagagtattactacaaaagtacaaaacagcaataatatgcatgtagtgcagtgcctggaaaggtacgattagacattgtgcacggaggtcgacacatggctagaaaaaagtcctgcagcataggatcagttccgtgaacggctccaggttgatgaagaggacgttgagttagaggaaaatcttgatccacgccagcgatcagtatcttggcgtgatgagggtgcatccagtcgtgcaggaggaccatcttgcctgagcggaccacgtgaaccccagcgatcttcatcgcggctgccagaagggatgctgctgctatcaccaccgcgtttaaacttgggaatatatttactaggagcaggagcaggagcagccgcagcagctgcaggcgctgctgctgactctcgaggtggctgtgca

SEQ ID NO: 13949 - DNA, 581 bp, Zea mays
  Clone ID: LIB3279-233-Q6-N6-B11
atgcagaaattgtacacttcgagattagcgagcccaattcagctgacatgaaaaacaaaggaactttaggaagaagtgatagacgccaaaaaagccctctcgaactttagagatatgtacatagattgctctgataaagaagacggtggagacgtacatataataggtttcactctcaaacaactggttggaaaatatcctcctaatcgccgtatcgtaactcaattctttctttcccttgaaggcaagacactcatttgcttattaccgacgcaaaactcagcagagcacaaacagcatcactgcatcagtggtacccaatcggcgcaggagactgcttcagctgcatcccctggcaatgtatgtccgatgcaaagtggttgacgtcgcggtggtgagcctcgtcggcgcgcacgacggtgacgacgtccttgagcgtggcgttagcggggaggcgccagtagtcgatggcgatggccggggcggggacgttctcgatcttgccggcctccagatccttgaggtactcggtgtacgagtggatggcctcctcctccaggtagccgacgacgcggtgcgcg

SEQ ID NO: 13950 - DNA, 623 bp, Zea mays
  unsure (1)..(623): unsure at all n locations; Clone ID: LIB3279-233-Q6-N6-B12
agcacagatgattgataatcccgaattttgcttgtcgcgtttgcatgcacagatgcaccccatggttacagttcccagtataggtaggggcgacaaacagcaaggctaaaacagcataacagtcactacgtacgatgccctactcctaaatttttcacatcactctgtccagccatcttggtgacctcagcgacggctttatcccaagcttcgccaggaataccgtatacatcacatgcaggaggaagacgaagaacccacaattaagtagaagcagtgtcccaaagagtagatatattgtgcccatggaaggaattgtgttcacgccagctgccgtcaggatgtatgtcaacgaagcatgaatgttaacagttatcagcgcgagaatattttctcttatcagaaacgatgacactagcacgtaaccacaagctcccagggcacggacaatggagcagaggatgatggagacaatccagttggtctccaatctccaaacagtacccatgatgagaccaactactccatgcattagcagataagttgacgcttttacagggccagatnatgtgaatagcagtaaaacagtagccaccacggttttcctgctggcttctagtccc

SEQ ID NO: 13951 - DNA, 433 bp, Zea mays
  Clone ID: LIB3279-233-Q6-N6-B2
gattcatcgtccatagcaaaaaaaagggctggctcagggaccgacatacaacccatccaacatttgggtccatgaaaacccaggggggggggggggactaggctaacttagtccaggaccccaaaattaaagagggtctgcataggaaaaagctttgtttcttaccatttcattcattccattattcccgattgagaaacatgaaaccaccgaaatgccacccaaggcaaatggatggatggatggaaataacccccgaaaaaaaggttcactcggatctggcggcgtatcgtcccaccctggggtccttgaggttgatgcccaccatggcccccccaatccccgtgctgacctcggccaaaatgggggggtccctgtagggggggactgcctggaccaaggccccggccccgcccccggggtcccccctctt

SEQ ID NO: 13952 - DNA, 456 bp, Zea mays
  unsure (1)..(456): unsure at all n locations; Clone ID: LIB3279-233-Q6-N6-B3
gaacaggtaatggatcataatgtaaatttaaaaggaaatctcaacaaattctctggtactacaggtacaaatgggcaattggctaaaactcctaaggagtacatgccgacactacactctattccactctaaataaacctaagggccaatccatcctaaccgagctagctagatgcatcaacacttagcaaccgtcaggtatgaactgtggctggagtaaggtgtanacacaagcatcgctgcatcagcacccgaaaggccgcaacgttcaggtacgagcacacctgcgacatgaacagcagcaaatggtgcaccaaccgtgctagttcaaggcatttgcctctaaaagcacttcttgtgcacaatggacggccccgtttcatcatactcgcccttggtcacatgctggttttgagggaaaacgaccttagccaatatcgtaccacccaaccaggc

SEQ ID NO: 13953 - DNA, 559 bp, Zea mays
  Clone ID: LIB3279-233-Q6-N6-B4
gcgccaccaaaactgaaacctcattgtttattctttaacaaagcacaaaagaactaaaacttgcgaattcgttacaggacggcagcagataagttaaacacaaaaagacagcgtgtccaaaaccagcatggatccagcgtccaggggcaccgttcacatttattctcagcatagacaagcagcaaagatggtctgcgaccaaaggccattggggacgacccacgatagggaggcagaaatctatctctctactagcctactgggtcttgaacatgtggcggatcaggtcgacgacgcggttgctgtagccccactcgttgtcgtaccacgagacgagcttgatgaagtggtcgttcagggcaatcccggccttggcgtcgaagatgctcgacctgctgtcaccggtgaagtcggtggaaaccagatcctcctccacgtagcccatgatacccttgagtgggccctcagaagcggccttaatagctttcttgatttcctcgtaggaggcccccttctcgattctgacagtgaggtctacaactgacacatccacggtggg

SEQ ID NO: 13954 - DNA, 593 bp, Zea mays
  Clone ID: LIB3279-233-Q6-N6-B5
cattagaactgcaactttactacgagcaacaggtgcacttagatatccagatacatataatagttcaaccagtccatagatatgctaccctgcccaacctcacttggttgccacatgtatcttaggctgcatcccgaaggagcaaaacatataggctgagatcgaaactagtatctccagcagtgcgttaaggcgacatatatcaacatataatatgaggctgagccccatagtgttagaggattcttaacgtgagataaagcgcatggatgcagcagcagctcatgggttctgttctccggagcggccaacgttcgccagagaatcggtggcctcccttaaggctttcttgatctctaaacttgcaggatccagtttcaatgcttccgtgaacgcgttgactgccccttggtagtccttcagcaagctgagagccgcgccctcgcgataccatgccttcgaccaacgaggtcgtatcattttgcactgttgagcatctaacagagccttgaccccctccctcagccgcaaccagcataggctccggttggcaaacgcggtagcatcaaggtcgttctctagtaccatggtat

SEQ ID NO: 13955 - DNA, 585 bp, Zea mays
  Clone ID: LIB3279-233-Q6-N6-B6
ctcgaaagcaagaaccatgtatctaaactatctcaggtttttgacagtaggatgatggcactacaaaaaggatgcaagcaaaacagaattatacaaaacttgctctgatacaagttatcgttggccggagcaacacagttgtgttaacacacatttttaccgtaatcaagttagctctgcttcaatgtgccccaaatcttccgatctgttgagcataataccaagaacaagtgtatgtaccttcgtggatgacaaggctgcaactgccagcaaattctagaggttcaagcactaactgtatgccaagaaaatgacacgtatacatgcagcattgcagcattgctgttccagtactatctaactgccgctatcaagtatttcgggaagatccatcttcactgtcatgtaggactgttcaatatgcatgtactgttttcacaaactaaaactactcttcctgcgatgatggtggttgtaggtccaacttgtatgccagaatctccattggtgagataagaacgtctccctcctgagcaacatcaccggtctgctcaaggtaacctagcatttctgggtcatcgtgta

SEQ ID NO: 13956 - DNA, 603 bp, Zea mays
  Clone ID: LIB3279-233-Q6-N6-B7
gcagtctcagatacattatatagctaagtaaagatagccatcaaactgctaaaagccagaagaggcgattgtcaacggtataaatagagcatctaaatgcaagtcaaaaggcgtttctcaatgttttggtgagtttgagcaccgtgcttgcaaacagaaattattgaatggcatggccatatcccttctcaaaactatagaaccaaaattggacatagctggccagtatttagttgtcagccacttcaattagggtttgctcgtagtcagcaggggcctcaaatccatggaggttcatcacagttgcggctacattggcgagcccagggatttgaatgtcgttccggaatttcactccggggtgaagaccagggcctccaatggcaaccggcaccggctgaagggtatgcgaggttagaatctggataccaccattcttgtcgagcaacggcttgccagatttgttccttttcaccatatcctcagcattgccatgatcggcagtaacaaggtaaataccaccaacttgctcgacagcatccagaatgatcttaacagcttcatcagctgccttgcaagcaacaacggtggcctcaatatccc

SEQ ID NO: 13957 - DNA, 580 bp, Zea mays
  Clone ID: LIB3279-233-Q6-N6-B9
ctagtgtggtatctaattacgattagacttaaacaaacataatttaagattattagttactcattacgttacaaatatgtgaccaaacggcacctttgttcctacgtttcacttagctcatagtacatcttagtgaatagtgtgctgtgtgttacatgagcttaatcctacctaaaaatggtacgagaattcattattagctttcacttacgcacgcccagacacattaaaacccaaagcattccagattgtttctgatgcagcgccacaatgcttgttcctgctccatccatactaatattgttattacccttgacacaattcatataatgagacggccagagcagagttcgtccttgctcataatcttctattcaattctgatttctgtgtgaagatattctgggtttgatggttccatgatttcttctgaagataattgttttgaatccaagaagcaccattgtgactggtaaaataacctgccgataattgcttttgacggtattcacaattcagtgcttctgagagatcacaaagcaccaagaaccaactagggcatatacttgtgttttttttt

SEQ ID NO: 13958 - DNA, 555 bp, Zea mays
  Clone ID: LIB3279-233-Q6-N6-C1
aaacacaaatagagctaacaatttcccacaaaagtaagcatgttacatacgatgacaatctctccaagacaacagaccacaatcacgggaacaaactggcaggtacaagttacacacagtcacccccacactattttgtgttgagttaccattccattgctgaagaggagagcaatcactggctctcttcatcttcgtcttccgcatcctcctgggcttccttgtccgagtcgctgccgttgtcatcgcccccggtggggcttgtgctgttctggtaatgcgcctgctgcggggcatgctggtgcctgctgcccttgatgcggtaccgaacgcggtgattgctgctggtggcgacctcggcggtcacgcccgctctccgcgtgccgttgccgtccgtagggatcgggacggccatgggcgtgggcgtggcggtggccgcgccgcccgtggccttggagagctccatctgcatcttgaggaagaactgcacgcgctgctcctccagctgccgggcggagtccaggcgctcccgctccatccggagttcctggtccc

SEQ ID NO: 13959 - DNA, 440 bp, Zea mays
  Clone ID: LIB3279-233-Q6-N6-C10
gcccaccccaactcaacatataaaattgtttttgccgatccatagcccgcattacagcatagttgataaaacaaaaaaggggggtggtcgattttccatcgggggggccaacttacacgaaatttaacagcaaagagactaattaacatacaaatttaaagataaccctcatcccacataggaagcatgttttttggatgtcccaaaataaactttaacgagcaaaccacactccggaacctaacttggaggcaggagttccaaaacgggcccccaaaaaaaaacaactcaatacttgtagtccttgacctggaggcttttggggtcgggggcaacatcacccttgtaggggcccagggtagcctcaaaattggccttgcacctggcgaggaaaggaactttaaccttttccaaattttccaccttgccaacccaagcct

SEQ ID NO: 13960 - DNA, 499 bp, Zea mays
  Clone ID: LIB3279-233-Q6-N6-C11
aaattcaactgggcttttcattaaaaaattatttctctacctacacagggattctgttgcgtgctttcttagctggaaaagttctgaatattacataagcctctgaagtagattgttttgcacatttaaccctcctcgatctttgcacgggtcaaactaatataatgatgtagcatatcttggggaatccccgagtgaagcaagggacttcatcgagctagcgcagctaccagggggggaaaacacatgcccttagatttttttagatgagcaggcaacctttttcccattgtcatccaggtacttatttgggatgtatgttcaaatcttgggatgttgtttaatccttgggaggcataatgtgttacagttggaatgatgtcaacctttttcccattgtcatccaggtacttatttgggatgttgaagcacaaccaaatagacatgctgtcctaggatcaagcgagtctcgccctgatctggtatgattcattggttt

SEQ ID NO: 13961 - DNA, 544 bp, Zea mays
  Clone ID: LIB3279-233-Q6-N6-C12
ctattaactgcatttataatactgagtcttaaagttatgtcatatagtctcttagctgtctcatagaaaaatggagtctcagacttgtacatgccctaagtctgctgaatccaaaaacacggccccatacgcagtcgtcaaacataaacaccacttgcaaggagcacgaacagagacccaaagcccagtaaaacagaagcaacagctgctgttgtgatctcctttgccaggctacggctttttttttttttttttttaatctaacattacccaaactgacattatgacaatgttagccgatgacgacgacaatggaaacagtaatctaggtacaagcaggcgcctctgctagctggcaagtgtgaccacccacaaacacaccagaccagaggcagaaccacccgccagtggcgccaacgaggagcgctatccgttatagcacgacaaaagtaaaaataaaacatcacgatggtggagtgaaactgaataattctagtacatggatataggctccttttttttgatcgcccggggccttgtgtag

SEQ ID NO: 13962 - DNA, 518 bp, Zea mays
  Clone ID: LIB3279-233-Q6-N6-C2
agttaagaatatgaacggtcatttttttcaggcataaatataaatccgttctcttgccatggtatttagcacgcacaagcaacgcttgaataagtcttgcaaattcaacacaggttctacgaaagtggctttggctaaggaacgactgcaatgtcgagaaacgacactaagttctttcagcgcttcccaccaccgccgcccaacttggggcccttggaacccttctggaccgcaccctttgtctgcgtcttctgggacttgctcacctccgccttcttcgctttcttctcatccttggtcttcttgatgcgctccttgatctcacgaagagcagcttctctagcagcatcgcggacctctggcttctcagctctcttcttctggattacttccaaggaagcacccacaattgacctggagtatggcttcttggtggcgcggcgcctcttctttactgcttcagcatggatatccttcttgtgctgcttcctgtacattgctgtccaggtaagctttgc

SEQ ID NO: 13963 - DNA, 444 bp, Zea mays
  Clone ID: LIB3279-233-Q6-N6-C3
aaaaaaaagggggggccggtcccgatttttggcaaacccccgttccgcccccgggtttaccccccccgtttggtcctttttgggttcaaagggcccgccccccaaaaaaaaaaaaacccgggcccccttggtaaaaacaacgggccaaaaaccacctgggggaggaggaggttaccgagggctggttcccaggggggggggggatttaaataaaaaaaaggtttccattgaacaaaactgaattgggcccgttccggggttttaccggccggggaaaaaccccacccccccccgggggggggccaaaaaacccttcaccaagtgggggaaggaaaacttgcccaagggcccggggccccattcggggggggaccccccccccggaaatttcttgggccccctggggcgggaaaatttctggattgggggaaccaacttcccctt

SEQ ID NO: 13964 - DNA, 570 bp, Zea mays
  Clone ID: LIB3279-233-Q6-N6-C4
gcaaaccaaacagataataagcaagcgcaaagaatctagagagaggcatgtgtttctgctttacccgcgtactcatacaaactgccagcggctgaggacctccgcagcgtgcagccgccacccctttgtgcaggtggcgcacaacgcacagccgcccagcaacgccgcgcttagtccgccggttccctgtaacgtcccggtggctgaagtccgacgatcaccggcgatccatttgaccctgggcccattcgtcataggctcatgggggacttcttcaaccttgtttccagcacgcacgcagggaggagacggggagctgcactaatggggaggccgagctgcaccatggggaaaagggcggtgcgggggaaaacagaaggaggtgcaggcgtccatggagcagggaaggggtaccatgctggggctgctgggaaggggctgaccatggatggaagatggagcaggagagcgccatggctgccgggtaaagcagagtgccggccaaagtgcaggggctgcagtggtgtcttcgaggagaagccgagtgggagctagagcaggggctgctcg

SEQ ID NO: 13965 - DNA, 533 bp, Zea mays
  Clone ID: LIB3279-233-Q6-N6-C5
agatgtcaactgtcagtacaattaacttatcgcagacccagatgacagccacagcaccttagctccccctaccttcgcaaatccaggaccactagtgcatgcaccgacagcgcacgacactagcttgtcgagctctgctgccctcgcatatatgaactcagccatgtcacctcagcaacatacatccaatgcacatcatggctgaccacatttcctcgcttcacccaacgattggtatgaacaaatgggggattcttgactaggatgattgatacacatcgctattgcccttgcaagatacaagaatcagtgagtccaaagctgccttcacctcggccctgacagctgttcagcgtggaggttgtcggtcaagtcgaggatccattccgaagttcgatgagggcctagctcgacctcttgccgtactacttccgctttctgccactcctcccatctttcggcgagaccatcgccttcgagcatcctcacaacctctgacatcttagggcgttccatggggttgctctgagtgc

SEQ ID NO: 13966 - DNA, 419 bp, Zea mays
  Clone ID: LIB3279-233-Q6-N6-C6
gggaaacaaacccggccaagggggggcggcggcccatcaaaaaaaaggggggaaaatttggctttaaagatccccccacctaagggggaaacctggggaaaagaaaaaagaccccaggggggaaccggtaaaagggggttcccgggggggaaaaaaaaaaaagggggggccccaaaaccccacggccgcggggggcgccccgggaattccgggccggccccggggggggcccccctttcccctatgggggggcgtattaggggggggggtaattcggggacaaggggctccccgggggaaagggtgttccgcgcccctttccccacaaaatccgagccggcgccaaaaggggcaaagccgggggggcctaaggggggggccccccgcacaaaagggcggggggcccccggggccctttc

SEQ ID NO: 13967 - DNA, 580 bp, Zea mays
  Clone ID: LIB3279-233-Q6-N6-C7
aagtaaaatagatgtaactgtatctgtagtagacagcacagataagcatcccgatacaaccaggtacctagcaaaactctcttcttgccctattacaaagattcaggtacgatagttacaaaaagtgcaactcaacatgatcctttttttcctggcacgccagtgatatggtcaagtagctacacaacacctggggctgacaaattcattagccttgacatatcaactctaataatccacatctgtacccaaagatcactcagatcgctctgcaggctcgatgtcatcattgtcttcgttatctgaactctcaatgtcttcgttatctgcattttcagtgtcttcattgtctgcattgttttccttatggcagggcacattcatgttctgctgtgacgagattattcctgcaatggctttcatggctgcggcagtcctgtcgctgcttactccgtcctctttggtaatcccaataggttgttcagcactttcagatgcaccgccgtcgctttgctgcggagggggtacaaagaaagggattttacccctctgccagtcatgaagtaccatcttggctgct

SEQ ID NO: 13968 - DNA, 550 bp, Zea mays
  Clone ID: LIB3279-233-Q6-N6-C8
ggtgaagcagatcaccatgaacgacaggcaaacaatccaaaaaacattacagaacacacatcatcattggggaacttgaatatttgtaatggcaactatccataaactcagctggtggtaaaagataatcaattggtaaacaagaaacgagttcaacactctgggttgactcatttgcagaaagaaacgagttcaacactctgggttgactcatttgtaaaaatcaaagtctgtctcgggctttttcacgttggttcggtagcccttttcaaagtccttggggaggatgacatatcggtttttgcggacagcatgcatgccagccttttggcagatagcagcaatatcagcagcactgatcttatccggtctggaaacataatcttccaaatcaacctcatcgctcaggttcattttggcagtgcaaacttgaaaaacaagccttttttgaccccggtctggcagagggaactcaattttcctgtcaagtctaccaggacgcaacaaagcaggatctagagtgtctgcccgattagttgccattataacc

SEQ ID NO: 13969 - DNA, 596 bp, Zea mays
  Clone ID: LIB3279-233-Q6-N6-C9
gaggtcaaagatttaagaagcatgaaacgggaatttcagttctcatagcattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagccaaggggtcgcgacggtgcagatgaagaactgggagccgttggtgttgggcccggcgttggccatggagagcacaccgggggcggtgtgcttgcgcacgaacttctcgtcggggaacttctcgccgtagatggactcgccgccggtgccgttgccgcgggtgaagtcgccgccctggcacatgaac

SEQ ID NO: 13970 - DNA, 194 bp, Zea mays
  Clone ID: LIB3279-233-Q6-N6-D1
tcgcggttctagatcgcgagggccgcccttttttttttttttttattttttttttttttttttttttttttttttttttttttttttttttttttttttgcacaaataacatcaccagcatgccatgcaaatactacgggttgtcaaacaagcacgataccagggcagggagagcacctgttgcaacccccaac

SEQ ID NO: 13971 - DNA, 562 bp, Zea mays
  Clone ID: LIB3279-233-Q6-N6-D10
accgccatgatgatctcagcaatttaacatttcaatggtcagctcacgatgagtctatggccccagcagtcccttcttaagcgtttacatagcagctaatatgttccagcaagttaacattacagtagggctaatgaaattgtaatttacttagatactgactcgtctccagtctgcgttgcaggaacaacctcagagttgatgctgctgtcaccttgttgagatggtgaatcaagtgcaggtttcttagcagcaggttcagcagagatcggcttgatgctagctcgtttgacgcctctgcctacaaccccaaggtcagtcacggtgcttccagagcttccggttgtcgctgctgtagacataaccgaggagtcgaatccattgcttgaggttgccatctgggaagaagtaaaagatgcagcttttggcatcacatcagttaccctggacacaattgccttcaccatctcatccatgtcagcgcttgggtttgcttcagacaggtcctcaagcttcttctcaagatcaggcaatatgctagtaagctgctctagctcttttt

SEQ ID NO: 13972 - DNA, 504 bp, Zea mays
  Clone ID: LIB3279-233-Q6-N6-D11
aaatagggccagcgggcaacaaccaaaccataccattacgggtgcaaacgaaacgagaagctgggtacagagaccacttatgatgagggttcaggcacacgattagccctgaaatttaggcgcagcttacgggcccacccgggacgggaggtttgggtacacatgaaatgacaacgggtgttcacgattcaaaaaaacatgcggcgacaggggggggtgatagcttggtgagcggcatcagttgccaccaaacaggtatcccagggaaaagccaccgccaggagcagcgtggaccttggtcgaaggacggtccctaaggaagtttccggtgttctgaccgtcggccctgtggtagttattggtttggctggtaaccccagcagcaatctgactggtgccatcaggctttgcagcaggtggtttctcaacaggtggagcacctgcagcagcaggtggagcacttacagctggtgccactgctggtttggggggctcaccgcttcc

SEQ ID NO: 13973 - DNA, 424 bp, Zea mays
  Clone ID: LIB3279-233-Q6-N6-D12
aaaaaacattttttaaagggttatgaaccggcctgacaggggtcgccagggttcccgcccggaattggtttttccccaaagggaaaggggcctaagggtttatgccggggggggccccggcctggccctttttgtttggccgcccggaaacgggaggggccaaaccccccccacttaacaaggtgggatccccccttccacggggctataatttccccccttcagggtcaggggttttacaaggggtaaacccatggcccccgtgttagggcccaggggccccccatacaaaccttggtagaaaccccctcaaagcgacagcatccgggggatggggatgcccttcttggaggacccccccggcgtcaagaaaggcaccaagtaccttttcaaggcccttttggggaaacccaggggaccccct

SEQ ID NO: 13974 - DNA, 577 bp, Zea mays
  Clone ID: LIB3279-233-Q6-N6-D3
ggacaaaagagctctcgatattattgattgcattcctctgaggtacacttgcaaatggattcaaatttgatacatttcaacggaaacaaatcacaaagaatacacgtaaagctgtgaaactactcaacctactagtatacaacaacgtatcctcctaaacccaacaactgtgtttcgatgtatacaaacgaaaacattcagtgccgttgtatggtgttacaaaatttgaaacaaaacatgctcaagtcacggacctggtatcttggcctggccgcgatgcactggacaagaattagatggtatgacaaattcataccagcgcaggcagcgctatacacgagcacccaatgcctggagctggctaacaagaagatccacctgctctctgtacatctcttttaagtcaacaatatcatttcttagctcctccaactcttcatcacgttcccccatgagttctagagcttgaaagtgcctttgtttcagagcttccaattcagcccttaagccaggcacagcagtggcttcagtccgtaacttttcacattgttctgtcagttttaccaactcctctgct

SEQ ID NO: 13975 - DNA, 499 bp, Zea mays
  Clone ID: LIB3279-233-Q6-N6-D4
aattgtactcccaccggcaattacaaactgaatagagtcataattactgagcagggaggaagttattgttatcctgtgacaacagcctttcccccccaatttcaatacacacaaacactagatggaaaaaaaattggtacaacactccacatgcacactgcagataaaacaaattcctaagcttgacaatcaagtggccaaccgctgcatcagctagatggccggttattactgacaggacccgcgagtgaactgctcgcatcgtgcggttgcgtcttgcacgcgagcctcacggcagtatggatctgcgaggtttcggccattgcgccgttcccgtaatcgccacaggccagccttttggtaactggggggatcaaggctatgcccagttggttgattgtgtgaagatgccgctccgtgaatgggttgttccacattaacgtgttcatggctggggcaacaaagagcggtttgctgtagtcccacgcggacgcgtggg

SEQ ID NO: 13976 - DNA, 619 bp, Zea mays
  Clone ID: LIB3279-233-Q6-N6-D5
tcgccggccgccgcactctactccgccggttcccccgtcctccactcaatcccacaacttcaaatcgaagtgctgaactcgaacggcgtggtgctggttgaattcttcgcgccgtggtgtgggcactgcaagcagctggcgccggcttgggagaaggctgccggcgtgctcaagggcgttgccacggtcgcagcgcttgatgccgatgcgcaccaggcgctcgcgcaggaatatggaatcaagggatttcccactattaaggtgttttcccctggtaaacctccagttgattatcaaggagcaagagatgtaaagccgattgtagagtttgctctgtcacaggtcaagtcccttcttagagataggttgagtggtaaggcatcagcagggtcaaatggcaagacatctggaggctcaagtgagaaaagtgaaccaagtgcatcagtagaattaaattcacgcaactttgacgagcttgttgtcaaaagcaaggacctttggattgtggaattctttgcgccatggtgtgggcactgcaagaaattggcacctgaatggaaaaagctgcaaagaacttgaagggccaagtgaagctagggcatgttgattgcgatgctga

SEQ ID NO: 13977 - DNA, 591 bp, Zea mays
  Clone ID: LIB3279-233-Q6-N6-D6
cgacagcaatcagaatcgctttgccaatatgcccacaacaggttacaacagctcactcaggtcacattacatagtatcagcgaatgctgcccccacgcaatgacaatatgcccggccgtttggttctcacacaggaccgactcggtcaccccatacaaaacttgcagcaaatttacagacacggacacagcgcacggtctctggcagtggcagccaggttcttacaagggcaacgccaaaaaaaaaacaatccagcaccaggcacactgtctgctgccggggcatgaggccatatttccgggtgatgtgagggtatatgaattaagatgaaaaacggcatggcaatggatgcttcacgggtcaggtttgtacagcggcggcgcttggctgctgtcccgctttcttctcatggaagccctcgggtcttccctggatttgggggcgccctggacttagcagctggtccagtctttggagagcattgtgccttgccgccgatgtctttggagttcccgacgctgtggcggtgcagccggcagcacactgcgccgccgccgtttcctccctctggtgtgtgaggggtgtcgctgc

SEQ ID NO: 13978 - DNA, 600 bp, Zea mays
  Clone ID: LIB3279-233-Q6-N6-D7
aaaaagtgagaaatcttctcctttcagcattaggtatgtgttataataatttcgatgctttactcccaaaatttacggtaatacaacgtaatagcaagcatatagatatataggctatggtcgataatacatgtttttgttacttgagcatcttcttgtagtccttgaaagtgcccgagaacggggtcaccctgccttccgacaccacccaaagctcgtccacgcttccagtgataagatgctcatcgtgactcaccatcagcacccctccctgaaaaatgagtaaaccctggatgagcgcctcaacagcgtccagatcaagatggttagaaggctcgtcaaggagaatgatgtgcggcttcttgaaggttattttcgcgaatgcaaccctactcttctgaccacctgataaagtgtacatagattggagggcaaggcttcccgaaacaccaaacgaacccagatgtgccctcaacttctgctccggcacacccggatagcacttcatcatgtacaaaaggggattcaccgtcaaatcaaggccatcaacatgatgctgattgaatacagccatgcgaaccttgggagagcgaaatactg

SEQ ID NO: 13979 - DNA, 595 bp, Zea mays
  Clone ID: LIB3279-233-Q6-N6-D8
ggttggaaaacacgaaaaatttcccattaataacatttacagaattacactgactgacaacaggggatatatggaacacttacaggcgcactacaacgtttaaacgttggagaaagtaacacaatagcagggatcgaattccttcaatagcttaacaatacaccgaccacccccttccctcctctcactacttgggcaaaaatcagatttttgcattaagacatgcgacaaattaaggatggctgcacgagaacataccacctctccttacgcgccagctcatgtttgaccttccaataattgtcagattctacaccttgaatgtgggaacatgcaggttgccttccgcaccaccatagagccttcgcctatggtccagtagcgggcaataatgtgagcccaagatgccgcctagcatggtctgggatcaacctgttgatgagctctggggaggcatttgctagttcctgtttaaagttgaacagtggaggaaatggccgtccatttggcaacctcgcatgtggttctcgcaaatcgtcaaagaatggatgtgcacacgcttcaagagcagtgcatcttagatttggtgaatact

SEQ ID NO: 13980 - DNA, 617 bp, Zea mays
  Clone ID: LIB3279-233-Q6-N6-E1
aacagaattccaaccggaacggtgtttcgaattaaagcaaattaactctggtactggtacattcgactcgaataggatccaaaaatactcacggcaatatcactggccacacaaagcagacatatagctatggaaaaattaggctggtgcattgcccagccaccaccatcgccagcaccccaggggaaggactgatcgaaagtcacgcctagatcttgttgaaggcaacgatgtcgcagctctggacgtactcgttaactggctcagcgcacagatagtcctcaatgagagtgtcgacagagacaagatcgtcgactatggtcatcatgatttgcagcttcttgataccatatccgactgggacaagcttggatgcgccccagagcagcccttccatctggacactcctaacagcttcctcaagcttggccatgtcagtctcatcgtcccatggcttcacatcaagtaaaactgatgacttcccagattctttcttcttgccagaagccttggcagctgcagcacgctcttcagcagccttcttctcatcttcggtctcctcaccaaaaaggtcaacatcatcatcgtcctccttctcagcagctggggcctgtgct

SEQ ID NO: 13981 - DNA, 489 bp, Zea mays
  Clone ID: LIB3279-233-Q6-N6-E10
gcaagaaaacactgtactgcttttatttcacagtctgacgcgatatacagaaatacaacgagtgtcaaaacagtagtaaaacatcacaagtctaaaaacgacgtgttctccagcgacaacagtgggctggacaccatcggcagggaaatgtacgtcgaaatcaacagaaggcacccgagctttatttttctgtgatggaaatgatgaacgtctcaggaaatagtttgccagaagcccagaactgtgtgctctagggctcgaccaccatgctttccgcttccttcttgatggactggaacagcaccgatgagaggtagcgctcgccgaagctcgggaacacgacaacaaatagctttccggcgttttctggcctcttagcaagcctaactgccgcagctgcagctgcaccagaagagattccaaccaacaacccttctttcagagcaagagccttggcagtctcaatagcttcatcacttgaaaccattc

SEQ ID NO: 13982 - DNA, 492 bp, Zea mays
  Clone ID: LIB3279-233-Q6-N6-E11
cgccaaatatcgtcaacatcataatataaattcaaagagccattagttcatcacaatccaaaccaaaccagatttaagtttggaagtagccaacatgcaacacatagctgctcgagaacaacttatggaaaatcttagctaaaggcagttcatgacgctagtatctggcatagagcaaaacttgaagaccacatccgctctagtctcccttcctgcggaaagaacagccctcagggagccttgcctttcctcctgtgggttggcagaggacagtttggcagccagggcacacaacaacagtctgggagtggctgaaaacagtggttatgctgaagcacccctggcacttaacatccatgaaaaaggagttgggcgactggacaagtctctttttcttgtgcttgagcttctcgagttctgccggcgggttgagcaaatcaatgtcgttctggagaacatcttgcctcgggctgcggcggagggaactgcgtt

SEQ ID NO: 13983 - DNA, 603 bp, Zea mays
  Clone ID: LIB3279-233-Q6-N6-E12
agtctccaaaaaaacttagatggatggttatagtaatgtacaaggaaggatagtacactgaccaccatggttcactagtaagagatgaacacttttgaaggccctccacaaaatttagtcacttaggtacaataagctgacagccatcaagcttcctatcttgaagcagccacagcttagctgcagacgtgttatacaacaatcgtagtgagtttcacaaactctgagctcttgagtggaataaataagtagctaactatacccaattgaagaatacataatgatggaataatcataagctaacaagaaacagaaaagcaatctcccagtcacggctaccagaaaaactgcgtgcaggtgcacaagcaacaacaggtcatcatcatgcatgtcacctattgttcttaaacaattggtcacatatatgaccaactgctcaataacatacgatgattccagtgctggacttatcttgataacagctatcctcctgctattccacactcgtcttaaaaattgtttcctgaacaagtactaaaccatttggcgctgaggaacaagaacctactacttacttctaactcaagcaatgcgttaaccaac

SEQ ID NO: 13984 - DNA, 528 bp, Zea mays
  Clone ID: LIB3279-233-Q6-N6-E2
gctataaaccgagaaagttttaacgtgttgacatgacgcatactgtcatgtacaaatggattataaatgcgatagtggcgtttgtaaagcaggaggggaagaggtgagctctctaagcagtctcctacaatatatacaaatgtccggcttgggcaaaacaaaaaactgaaggaggcattgtacaaaaaggtgatagatggagtggaagtcaaaccaaagccatcaacaggcttttttggttttaccattagaaggcactggttggaagaagaaactttggggtctaactgctcagtgaccatgacaaagagcatcttgacccatagccactaattgctgatctgtcctaagcattgtaccagatttctataaaagaattgttaaaaactcttcttcttctccatgatagaccatttctgactgaacaccgtattggctacttatatcacacaccatacaaactccctaacataagaggtaaatctactgaaagcctttgatgtgaattaacacacattatatgctgtt

SEQ ID NO: 13985 - DNA, 584 bp, Zea mays
  Clone ID: LIB3279-233-Q6-N6-E3
gcacagacaaaacagcattactaacaaacagggacaataatcatggattgtagagtattactacaaaagtacaaaacagcaataatatgcatgtagtgcagtgcctggaaaggtacgattagacattgtgcacggaggtcgacacatggctagaaaaagtcctgcagcataggatcagttccgtgaacggctccaggttgatgaagaggacgttgagttagaggaaaatcttgatccacgccagcgatcagtatcttggcgtgatgagggtgcatccagtcgtgcaggaggaccatcttgcctgagcggaccacgtgaaccccagcgatcttcatcgcggctgccagaagggatgctgctgctatcaccaccgcgtttaaacttgggaatatatttactaggagcaggagcaggagcagccgcagcagctgcaggcgctgctgctgactctcgaggtggctgtgcaacaggtgcagaatctggagcgcgcacagcctcggatccctttaagagcttctcccttgttgcctttgccttctcctccagctctatctctctcaatcgctgcttttcagcgatggcat

SEQ ID NO: 13986 - DNA, 578 bp, Zea mays
  Clone ID: LIB3279-233-Q6-N6-E4
cggcatcactgttcaatctttccgtagataaaggctgttaccattcgttcgttatatctttggtggaaactgatccagccgaattgttatgcagttacaaaatgcagtggttacgaattaaagttaaggttaaaaaagcaacctacaacgatatgcagtggtttgagcaaacaacatgacaggcagaggtaccaagacgaatcgaatgccaaaaggttgaccacaggatcctagatgttgatggctgaaaagttaatgacccttggcaacccatgtgtcgttgcctcctgctccttcaactctgcccttgcgcttttttgagcgacttacatttgctgacgatgggttcacagatgtcccaactgcaggtacaacattgatgcctcgttgaacagctaatgaggaagattcatttggcaaaacaggtgttgtatcatctggtctgccatatgctgcatatgaaacaggccgtgtaaactgtataggagtaaaagtagctggggtgtttccaaaagatctgacagcagttataagttgtttcttcgatctaacaattctcaccatacaattgtcatgct

SEQ ID NO: 13987 - DNA, 457 bp, Zea mays
  Clone ID: LIB3279-233-Q6-N6-E5
cagtgacaaatcctgtaagtctggctctccattccgcaatatgtcaatgataaccgtttaaatagacagaggaaagactagatctaagagctaatgaggaattaccccacatacacctactataacatgctacagctacttagcctttcttttcacagcattgaagggggtaaagagtggacaaacaatgtgacacatgatggtattgcaactcccggtaaaatcgactaatgttgtaaaactcagggagctacacacgagatagctaaactgacagttagacttacatgtaccagccgggatgcttgctatcgcttatggtaccctttgatggcggcattaatgcaaaggcccaaatgctattgggccaaggggaggttatggcaccataaatgtggatgctccacacgcattgccagcgaagccagatgcatcatcacactgaaactctatggtt

SEQ ID NO: 13988 - DNA, 585 bp, Zea mays
  Clone ID: LIB3279-233-Q6-N6-E6
aacctaacgcaaagtttattttcaagaagagcacaggaatgctcatttccgaacaattcaatgtctcgttacaagcaagcatgctcacacataggcactcaactttcgtcatagaagacacatcactgaacaagcaaacaacccagaacagacttggcttattccattcaccgattgacagggcaaccgtttcaagcagatggcttcatcagggcagcgaccttctggacagacggcctctccatcagaccagaccaccaggccttcacatgcgggtaggcgtcgagcacagatgcgtagggcgtagcgaacaggcagagagtgacagacacatggttcaggtcggcgaggctgaggaagtctccagcaaggtacttgcacttggtcaggcgtgcctcgtacacctctagcaccttcttcagcttctcaaggttctcatccacaactttctggtcggtggttcccccaagcataggactgatgaggacctggaagaggatgggattcagtgcagcggtgtactggttagcctccacctcgatccaaacatccaccattgctgcctcctcgaggtttccttccctc

SEQ ID NO: 13989 - DNA, 610 bp, Zea mays
  Clone ID: LIB3279-233-Q6-N6-E7
gtaatcacttaccaatgattcctttaccgttaataatttgatgtagtagttgtaatgtaatcatgtgaatagaaaaaaaacggattcttactagctactatcgctttcacacctctgctgtaacatctccagtttatcgttatctgacagtggtactccctcaaaccttctataatggggaagcttagacagtctgctctttgataaacccctcaaaaaacatttaattcatgtaacacagaaacattggggtttcttttgctcccggaccaggtagtatgctgcgctaatcaattcaaccgaaaatgtggcccaagctgttggcccacctgatggcccagggctgcatcatgctcccacctctcactactaggcgtctaggccttaaggtcatccgacattgcagacggtatacagtgcgtcgtcagaatgtcctgggtagcagactttgcagttttcgtctcgaggacaacaatctggtcatactccagatcaaacttcaaaaattcatccttgcaattttccaccatggtcgctaagttctttaaattttttacaggctggccattgaaagcaagaacctgagtattaactatttcttcataaccta

SEQ ID NO: 13990 - DNA, 570 bp, Zea mays
  Clone ID: LIB3279-233-Q6-N6-E8
caagagagagaaacccttaatgtcattgaccaaacagctcaatcagtacttggaagttccaacatacagattacatcatgacagtccatgagcccacggtgaacaggtagtcacgacagttaacatgcagtagagtgaacttaaacgacacatcttcgccacctaccaagaaaagtcttgcctaacctctggtatttacacgaaggggtagatcatgattgtgccggagcaatgttattcagcaggcagttcggatcatttcagcagtttacaccacactgcccacgggaaagagccttctgggtaggggatatgaaggggtcgatcttcacccacagcagcgagaatatggaagcaagaaggacggaccaaacgatgacgatggtcggtgtgcggttctgcttccccatgagacccttcaggaaagggtagaggtggaggatcacccagattgcaaagaacagcttcccgaatagtggaccccatgattggtagccactgttgatagcatacgacactccagccactataccaaccaggttaatcacaagcacagtggtgggggggatc

SEQ ID NO: 13991 - DNA, 465 bp, Zea mays
  Clone ID: LIB3279-233-Q6-N6-E9
aataaacttcattaacaaagctaagcttagataggtgggcgaccataaagtaccaagcagacgatgtaactcacataaaaaaaactatgttccgaattgcaatgtttcgcagaacaagacctcctaaaccctcgactggatttcgacatctagcctgcgtagccatatccagagatcttccagaccctgatagacccatcggtgtagccagtgtagagggggcttccatcggcgctccagctcaagcttgtgcagtacaggatctggttcttggagatctggatgtcaggcttgaggtcctgcacgacgtgcttcgactcaaggtcccagatcttaacagagtcctgggtcgcagcgcaaatccagtagcggttgggcgataagcaaatggagtggatgatggagcccgcattcagcgagtacagcctcttcccctcagccaaatcccacagtgagaataacacc

SEQ ID NO: 13992 - DNA, 618 bp, Zea mays
  Clone ID: LIB3279-233-Q6-N6-F1
acaccaacttatttatatatcctttcattctaccaccacgaagacgaaggtcgatacacgagatttgatctaccctatctacaacacgatttccttgtgtgttattaaaccaaattgtactaaaatgacaccaacgaaaagaggacctatacatataaatgaaactaatcaaggaacaggtagtgtattctccctgcgatactcttgtcttcttccagctctgcaataaaagaatcacgactcttctgttgctgttgctacgttttttctatggtgaagaaccaatcgtctgaaggctatattgactgcacatggacggaccccttggatgaatctgagtgatgagtctctcaaccttttgagctctgaatcaggctgacgcatatccgttcgggtgcgccttctgccatttccacgcctgggcaaggctttggccaagatccgtgtattgggctgtccagttgaggtccctgaggattttcgacgggtcgctgtatacctcggcgtaatctccaggtctacgggcaagatattcgaccttgatggaagctcccgttgccttcttgcaagcttctacaaactcggtcaccgatctaccttggcctgttccgacgttgt

SEQ ID NO: 13993 - DNA, 493 bp, Zea mays
  Clone ID: LIB3279-233-Q6-N6-F10
cagcaaacaggtttgcaaaaattcggggggaaacaacttacaagcttccgcataatttctgaccccaagtaactttgcagttctcagctctttgcccaacattgcctagatgccaaaaccactcttgtccatagcaaatcctacaagggccaattggcaagccctttagttccccaagggccattggaagattcatgtttttgtcccattgcaagaatcataacaggggcctgcaaaataacctaaattatgggcttctacccctcatccttggtatttcaggctttcaaaccatcaggattgcttcccaggttgcctccaactccaagcatggacattagccctccaccgggaacccttcccttaggccccacgagcccacagttttggttccggctccctccgtcgtcctggccgttgcctgctaaacccacaaaggagcgtccttcagtgaaccagggacaagcccctgacgtggtattaggagcctgcc

SEQ ID NO: 13994 - DNA, 480 bp, Zea mays
  Clone ID: LIB3279-233-Q6-N6-F11
aaggtaaaccctttttttttatggggaaagccagatttggttttaaccacgggggaaaggacccggccaggactaagaggggtttggaaggccaaacccaggcccagaatttgggaaaaaccaggttttaattacctggccggggagggggggggagatcagttaaggggataaaagccttaatactcggggggtactcctggggcctttcaaaacccttttaaggggggggagcctaaaaaaaggggctaaaaatgggacgggaaaaaaaaaaacgggcggttcccaagccaaagatttgtttaaaatgcttgggggtggaaacaccgaaaccaaaagttacgggttggggggaaacctttttgatctcccaaagaaggggttctacacgaaagttaaaattggggggggcacctgtaacccctacagggttaaaaaaataaaaaaatcctttggaaggtggggcaattcccttaaacc

SEQ ID NO: 13995 - DNA, 373 bp, Zea mays
  Clone ID: LIB3279-233-Q6-N6-F12
aaaaggaggagggggcccaagtcccattcccgggggaaaggttcttttcttagggaaacagcgggtggtttcgaaatttgggggggggggaggcataaaccccaattaaaatccggtcccaaaattggccccaacccaacgggaagataaatttttcactgggtggaaaacgccaaggacatgcccaagcccacattttaaaaaaccaaagggggggcaaacttaagggcccaaggaccaaaatagctttttgaaaaacttaaaacccctgttcaataaggtaatccccgagcctttccaccaccatattggattgccctggaataattggcttataataaataccgataataaaggacatgccatttttccg

SEQ ID NO: 13996 - DNA, 619 bp, Zea mays
  Clone ID: LIB3279-233-Q6-N6-F2
aacagaagaaatttctttgcaaaagtttgacgaagtacaaatgtttcctgatctaccgtctaacacagatcagtgttaccctagagtttgcccttacaaatccaaccagctacagatcgaagtcgcgcaaacactgcagatattactcacaacatcaaactagccaactaggaatcagagggccagattctaacgacatacgcatggcaacagcgctcagtctttgccgcagatagcctagacgaagcaagacagcgtcaagagagacaaggcaaatagctccgtccatctcagccacaccggctccaaccgaagcgccgaagagtgagccggctgcgccgtcggagtcatcccagcgttacacacgttgctggtggtcacattggcgaggatggcgaacgatgtgctgttggtgtacccggcgtaggagcatgctgtgctctcgcaggatgaggtggaggaggatgtgttgccgaggaacatgtctccgcacttggcggcagggcagaacgacgagctcagtccctgtgtcggctggcagtccaactgccaggtgctagagctgcagccacacttgacgcagttgttggcggtgaggatgtagcttccatttggcacg

SEQ ID NO: 13997 - DNA, 498 bp, Zea mays
  Clone ID: LIB3279-233-Q6-N6-F3
aaccggcaaaaaaaaggatctatttttcttgggggaatcaaacacttctttgccgatagcttttacaaggctaaactcctcgatggggaaacatgattgtgaaatcaacaagagggtaatgccccgaaaaaattggtcggctctctggttttacccacttgacctggggaaaaaaaaaaacactggctggttccctttcctaaccctatctaactctgtctcagcttcttgcagggcagattttaatatagttattctctggtcgagctcctcgacggggccccttttaagagtaaacttgtttggggtaaggaagtgctgggaaaagttttggagagcttgaacaccacaaaccttttttgaaagcagggaagcttggtgatgttgaagtcatcgtataacatatggaactgatcaatgtatttttggtgcattttcatccgggcttttagcagttttgactcgacagcttcctcatcaaatataacttgattaaaa

SEQ ID NO: 13998 - DNA, 598 bp, Zea mays
  Clone ID: LIB3279-233-Q6-N6-F4
gactatccaaattatacaataaacttcatgatcagccattcctcgcaggattcagggtcaaatttactttcacagaacactcccaaatttccagtcgtcactaactaattttaccatcacctaaatcatctctggcataaatatcaaaaccatatcagatgcatacaaaatgtaaaggtaaatatcttgtcatgtgtgatatccaaaagggttgtggccacccaacctatagcacctttatacaaagccactctacaccatggaggcatgcaattgctgcaacttgacttgagtggcagcaaatcctggaatatgttcacattgtaccactataggcccagattgcctttatatacaggtgagggatgaggatagtgccgccaacctcttccgatgcacaatatgacccctcttgtggtctaaacgggtagtgaaccacaacgatcaagaacatgatacattgcaatccttgtgctcctcggcgctggctgttggtcagtagccatagccatcttgtacaagcctgccccgataaacatccaatacaaagtgtgtcatatgcttgttcacattgcttgcatctgatgtctatgcacca

SEQ ID NO: 13999 - DNA, 584 bp, Zea mays
  Clone ID: LIB3279-233-Q6-N6-F5
gaccacagacaactcacgcctggtgataaactcatcagctacccatgcacaatgacagcaccaagcaatatacatatgcgacatccggatggacggcaggcatcgagcccgtgtccgacgtggtgattgacgatcatccattggatgggatgaaacagatagtctgggttgtctgtctcgtggactctctttttgagttttttccatgcgacccgaaaaagctggaagaaaggctacggaaggtccggtcatgtctggtcaggcgacgcagttgaggcccacgcaccccatccacatgctcctcacgtgcttcctctgaaaaagaaacaaacaagaaaagtacagaaagctttaaagtcaacttgctgggtctggaaactggatgactagctaatatatatacacagtagatacatcatcagctcgaatagaaggacaaaatatttagttttctgatatttgttgtagctaaccaaacgtagaaatggcaaactattatctcagtacactttgctggaagtgtgcactagccagattaattcaaagtggcatactgtttctggatcaacgtgcaatctgcattc

SEQ ID NO: 14000 - DNA, 444 bp, Zea mays
  Clone ID: LIB3279-233-Q6-N6-F6
gggaaaaaaaacggggacccggaaaaaaaaaaaaaatgggccaaagttttggggggggccaaacccaaaggggaaaagcccccccccccccccccgggggggggggggaaaaaaaacaaaggtttaaacttttttttttttccccccaaaaaaaaaaaatcccccaaaaaaaagaaaagggcccccgggaaaaaaaggggaaaaaaagttttccccccccccttggaaaaaaaaaaaaaaaactttttttaagaggcccccaaaccgggggaaaaaaaaaaacccctttttttaaaaaaaaagaaaaaggccccccccactttttgggatttaaaaaaaaaaaacggttttaaccccggggggggggccccaaaaaaaacccccccccatttccccccctcccaaaaggggttttaaaaaaattttttgggggggggcggcccc

SEQ ID NO: 14001 - DNA, 440 bp, Zea mays
  Clone ID: LIB3279-233-Q6-N6-F7
aacacaatggttcataaaaacccgctggtgagacccactttaaaaaagcgttttgcagacatacccccaggcctttgtcaaccaaattggtccatcatagtcctcccagcaaatcggcgggagccttgggccttttgcagactgggagacccgttctatgggttcatctgatattcaaattggtccggccttctactactacgaaaggcccaattcggttgctctccagtcccccccaccgaaaagcaatgaaacctgggggggagtaaacattatgcggggcacatgcaggcatgcctgtcacattttcactttagcttccccaacgggtgggcacagggatgcaattacaggtcttccattggtagcaacaacaattgctaaccaccggctgtgcaggataatcagcagccctgatggttggaccaacttgtggaaaa

SEQ ID NO: 14002 - DNA, 610 bp, Zea mays
  Clone ID: LIB3279-233-Q6-N6-F8
gatagtagcacacactgtagattgcaaaatgtattccttggtttctgcttccctcccacctttacattacattgtgccagaccacactggatcggatcagatcagatcaaatctgtgaaaaaacaagcatttcatccagcgtatgctggttacatcatgtaatgcaaaaaaaaaaagaaaaagaaaaagaaacgaatggaaggaaagattcactagtattcattgcttcgttctttcatatttaataacaaactaggattatacccctcaggctcctcatcaagtgtccagatagtttgcggccatcataagctccagggttatctccggttcgattggaaactccgctgtctccttcccactggagtaatggagcgaccaatagaaatactggcagatcttctcgaggatgttggtggggatctctgggaagcggacctcgccctggcgcgtctcagagaagccgcctggggatgtgagcatgttgcggagggtgttggagaccatggcggccttcctgtcaacaacgaattcgaagccctcggcgctgatgagcttgacaacgcctgcggtatcgtcgtcctcttcgtcctggggctggtggtgctca

SEQ ID NO: 14003 - DNA, 184 bp, Zea mays
  Clone ID: LIB3279-233-Q6-N6-F9
ggaaaaggaaaccggcttgctaatttgcattcatgtcccgcaaggggtccccatcatttagagcaggggaaggttgcatatctggcgggacaatgagggacgtccgggatgaaagtttactctctggcaattttaagaattccctttgggaaacacataaattcttttcgggcggacccgtggg

SEQ ID NO: 14004 - DNA, 585 bp, Zea mays; identical to SEQ ID NO: 13988
  Clone ID: LIB3279-233-Q6-N6-G1

SEQ ID NO: 14005 - DNA, 563 bp, Zea mays
  Clone ID: LIB3279-233-Q6-N6-G10
agacaagaagtttcaataaatagcaaacctaaatatcacaattacaaccaccgcatgtgaaaattatcaattcttagaatcgagagttgattcacttatgaagtgttcatcaggtccgcaaatgatatgcataaagactaacaacaaaatcccccaagtagaagatattttgcagttctagctaaaagaatgctctaagatgcaacacccttgcccttcttcctctggagcttcttcatgtagaactcgagctctttaccctcaaggatgtagccaccagctcggccacactgcccaggacgggcagaaatgcaggccaacaatctcccactgccaaattgctcttcaatatgagtgtcgagtgcacggtcctgctggcgcttctcaatcttcctctgcacatggttactcttctttgtttcctcagctatagcctcaccctcttgtccctcagtcgcatccttcttagcaacaggcaccttcttcttcctaccgatgtccactccatagtgagtgaggtaccactgcttgaatggagcagcatcaacttgtacaatggcgct

SEQ ID NO: 14006 - DNA, 485 bp, Zea mays
  Clone ID: LIB3279-233-Q6-N6-G11
cggcaaggggttttaaggggggccaaaaaaaaccctttggggcccccaaaagggggaataaaggggttttaaaaaaaaaaaaaaaggcccgggggggggagggggccccccccaaggggaaaaaaccctttggggggggggcggggttttttggggggggaaaaaaagggccaaaaaaatggccgggggtttttttaaaaaaaaaaaaacagggggaacaaaccctcccccccggaaagggggctcccctttgttggaaaaaaaccaaaaggcccaaatggcccatttttaggggggaggcaacccttttttttttcccccaaaccaaaataaggcgcccgttaactttttttggaaaaaaaaaaatcccccgaaaaaattattttttaaaaccccttgggggaaggggccttttcctaacccgaaaagcccccaaaaaaaaaaagggggggagaaaccctttggaaaaaaacccccttttaaaa

SEQ ID NO: 14007 - DNA, 566 bp, Zea mays
  Clone ID: LIB3279-233-Q6-N6-G12
aaagcaagcaaaaatgtactatatcatcaattcatcatcatctactagaggctacagactactatacctcatctctcaatatcaatgcctgccggtggtgccgggggtggttaatgccacagcatacaaggggtgagttgagggtagtatggtcgagagttggcgacagaagcaccacaccgacatcataaatatgaccatcattcatttcccgcgaaccacagccaatatataggggttccttccttgatccttattgctacctagtacagattgtatagtataagaagaagaaacctctataaaccccgtcgtcgtcggtcagccagtcacacggtgtaggactgctggatggtctcgatgtccaaacccttctgcttcaccactgactccatcctccccttcagggtgctcacttctcgcaacctcgccatctcggctctcctgcgggcctcttccgcgagctggttcagctcattgaatgtcgtcttgttctcgaagaggatgcctctggcggctggagcccgtgaagagtcctctgggcatgcgcccacttgcgctccctt

SEQ ID NO: 14008 - DNA, 599 bp, Zea mays
  Clone ID: LIB3279-233-Q6-N6-G2
agaccaagtcacatctcaactcggtatctgaataggcatatgtatacatttcttttatatatacacatcgggcacggtacaacatttattaattcaattatctttgtcaacttaaaatcctgatataaggataaccgcctaatcatgctgacaacattcagagaaccgcggcacaccaaacccaacagtccaacatccgtttggttccacatcaaaacacggagtcaagatacgagtagttgtacaggcggccaaactgaagcaggctgccatacatcctatcccacacgccaacgaaaagcgcgtcagtgtctgggctgaacgatgtgccggatatctcgccaaagaagtccagctcctgccttttgttgtagtcactcttcacgtcgtagacgtgcacaaagtcagcaggttcagccatggacatgaactggccatccgaggtgaagcggatggaccggatggctccaaggttacccctcaacacatggacggattttgagagattcctcgcgtcccagattcggcatgtcttgtcttggttgccagtagcaaatgttcgcccatcagggctccaagccgatgcaaatgagtagtcc

SEQ ID NO: 14009 - DNA, 456 bp, Zea mays
  Clone ID: LIB3279-233-Q6-N6-G3
gggggaaccccccaaaaattcatttttttgcagggggggggggaaaaaaaactggggaaccttttggggcccatcaggttaacccaaaagggggggccttgggggaaacataacagctaacatttttggggcaaaaaatgggataaagggcccaacttgccttttggggggcaaccccagggccttttttaagggggggttaagggtcctcgaaaccccactttggggaaaaagggcgggggggggcaaaacaccagtggggggactcgggggggaaaaaacacctccggggaaaaaattcccgttcttcgaccaatttttccacccggaaaaaccacctttggggggggggggccccgggaaaacctcccttacccctgggtggagctagggggctccgaacgggaaggacaacacgggggggttttccccccccccgggctttttttggttttt

SEQ ID NO: 14010 - DNA, 491 bp, Zea mays
  unsure (1)..(491): unsure at all n locations; Clone ID: LIB3279-233-Q6-N6-G4
tcgcgactanaccatgttttgtctctaaagatatagctgcagcagttcaaacaagcagtcgaacagttaggttgaagcgaacaaacaaaacaggacatgaccggttggtcaccggtgacaagtgcatttttttactgcccaagggtactcccagaagatcaggcaactacagcaatcagcttcagtaaacacctacaactgagctacatgaatttagacaggtttcacatcgttctggcaaccgaagttcaacgtgccacactgtcgtggttcacccgtagtgctaccaaagtgggggtgcgggacggcaccgccagcctcattgcatcctgcttgtcagttgcgcaaactcatcatctttcatgtacttctcctgcacttccgctgttctgtagtagtcccaatcaagaggcgccgctgcaattttgctgaactcaacagcactactgtcaatacccacgcgtccgcccacgcgtccgcccacgcgtccg

SEQ ID NO: 14011 - DNA, 579 bp, Zea mays
  Clone ID: LIB3279-233-Q6-N6-G5
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgccgtagccgccgcctccacggccaccaccgtacccgccgccgccgccgcctccacggccgccgcgggactgggcctcgttgacggtgatgttgcggccgtccagctccttgccgttcatgccctcgatggcgttccgcatcgcctcctccgt

SEQ ID NO: 14012 - DNA, 518 bp, Zea mays
  Clone ID: LIB3279-233-Q6-N6-G6
gctctgaaccaggagttggattgcccttaggtatgttgtctgtcacatcaatatcgtcgtcatcgtcgtcatctccataatcaataagtttcagcaaagtttctataaatgaacaaccagagataatacgtaaattattgaagttaaaccatatcctacgcacaaagtaaattacagtgtgcaatattaccagacacaggggtgccttttgttttttcctccttaggctcccttggtcgtcgttcaaatggcaagactgatattgcatcaaaggaccttggaggtgctgttggctcctttaaaggaaaaaacttgttcttgttttttgacaaaaactcatttgaaggaaattttggtggcgggggaggcatgctcttaggtggtggtgggggcatgcttctgggtggcagtggcagcatgctcttcaggggtggtggtagcatcttagtggatatagagagatgtgatggcatatccgcttcttctgccggaagcattccatttgatccagggtgaac

SEQ ID NO: 14013 - DNA, 599 bp, Zea mays
  Clone ID: LIB3279-233-Q6-N6-G7
gaattcagtacccacagcaaaaaaaaaaatggatcacccttcgaccgttacagctagtgttctctgcgattctcgcacgccatcagcccatcactcaccgtcaccactgacgaaccatgctctaaaattcacaggcactgcacgtcaaaactattgtagtacatttcaagagtctataacattttttcctcgctaccttctatgcttaactatgcttctcgaatgctacataaataagaaaacgatcaaaaaggaagaaaagcatgtcgtgctaatcagttcctccgacgatggctatgtcgacgcctacgcggtggttgcatcagcaaggacatggggtctgcatcctgagcccccctagagtcagtaatcgctccaccatctcctgtgagccagttcagtgcctcgctcgcggcatctttctccgcaagtttcttgtttgcacacggttgccccacgaactgcatgccgttgaactcaaccgtcgatctgaagagatagctcttgatctgcttcgtcttgtaggtggggttgctgtgcccggcccgggtcaggtaagtctggagctggttcttggcattatcccctccgttgccacc

SEQ ID NO: 14014 - DNA, 617 bp, Zea mays
  Clone ID: LIB3279-233-Q6-N6-G8
cacacaactgacgatcagttcactgagacggcggggcaactacactcccagcaaaacagaacaccgtacataagtaacccaacaactcgactagccagtggtctggcagagttgtttgttggacatcatcacatatcttacaggtggctacaggtctacaacacggagatctgtcaaggaggggggaagcttctcacattgaatggaagcctgtgtacaagagcggcttcacaatccgcgatggaaagctccacggttcctcttctctacgtaaacaatgggatggcgagcgaggggggtgatcgaatcaaagaatacgccggaggtctcagcttgtcaccaagcacagcacacaatgtacagcctccccgttggctgggagggaaaagaagaatgtcaccaatccgtcatccgtccgttggggagcgaggtgagggacagcggacatcagctgctaccccgtttatgccgctttgttgcgtgagagaggccgtcggcaccggcaccgccaccagacagcgtcagctgatgccctaattcgttgctagatgccggatcagctggttccttggagttggtggatacaccagcagcgggtctcttgacggcacgctttc

SEQ ID NO: 14015 - DNA, 585 bp, Zea mays
  Clone ID: LIB3279-233-Q6-N6-G9
agcttagactcaacgtctgtgtagcttccccaattacaaggttacaagcaaatgtaccttcgttttctggacttttcaatgcggtcccacggccgttaatggtccagttttgatagcgcccaaccagccacacaggagacagcaatagttgggcggataagcgaaagaagtactggataattctgcagcaacttctagtgtgctgggaacaaaaaaaagttttctcaaacacgtagaccctagacatgtgatccactgcagtcaagaacagcctgctcatgccaaactccatccaaattagcctgccatagcttaaccatgccatctcctccggttgatgcgagtgtcataccgcccatgtcccattccagttgccacacctcgccatcgtggccattaagtaaagcaacgttctgcatcgaaggtccgccatcagcatcagcgttcaaacctatatgccagattgcaattcctttgcaggttgcaactgcgataatctcatatggtctgccaatgttaggagcccatgctacagcacacactttatctcctgtatcctcaggtgaacctagctcaacaagtgga

SEQ ID NO: 14016 - DNA, 550 bp, Zea mays
  Clone ID: LIB3279-233-Q6-N6-H1
caaacaaggtccactagtttattttttatttttgtttttcgttcaagcatggcacctgtctatgatggaacggaattcagtaccatctagagatacattggaggagattagtaacccgcacatcttggcaagcaataggaagaagcctctgtgtttgtgccacagacagatcaggggccagccagcagtcttcgctacttcatgccaactgatgccatgagatcctcgtactcagggtcagcctccgctctctgagccgccgccgcagccgttggtgcaaaagggttgtagatttgattgccaccgggccacctggtgccgcctgcgccagacatatcctgctgcggcggtggcggtggcctcaactgaaacggcgggaaagacgatggatgtgacggtgccggcatcggaggtgcctgcacggacggccaggctccccggaaccccgctgggaactcaagaggagatgcgttcctggggaaggctccgtggaagtgtggaggaggtggagcgtgcatccgagcctgattcgtcgtgtacatgggcctgc

SEQ ID NO: 14017 - DNA, 609 bp, Zea mays
  Clone ID: LIB3279-233-Q6-N6-H10
acccaaaccaaacacccgctatattgttcaattgaactggtaacaacaaaaggagaaaaccgtagagttcgcgtgtttttaccgttccactgaatctatacatacattgatcatatatagcaacgcagcacttggttacctaggattcacttacacatggctgcaacaatcatatcgcaaatatatgaaatcaaaagaaaggagatggttataaaccaaaccatactcgtatgatcagaacgcacacgacgatgcactagtcaaagctcaactgaaatgagcaatgtcaatctcgtcaggaatcttaaatgtatctgccgccccaaacttcctcctgccgtcctcccactcgtcttcatcctcctcaacgatatccttgtcatcaccatgactgtcgtgcgccggcgacagtgacgactggtcgttgacgctcttggacctgcacggctcatttgctagcatggtgacctgcccaaggtgagagatttccaccacaaccgtgtcatcgtccttgggaaggggctgcttccatggctctccgtcaaccctcatgaacgtgtggtctgctgcgcctttgtggaattcaaagcggatcctatgggcctgggc

SEQ ID NO: 14018 - DNA, 602 bp, Zea mays
  Clone ID: LIB3279-233-Q6-N6-H11
gaatatagaaaatagtagcatttgtcactgaattgaaacgttgaataaatccataagtttggtcaattccgacccccaaaattttactacacataatagtagcatcaaggttcagcacaatatctgtataaccttagctagagctagaatctagatttgtttcaaatgctcagatgcacttcattatcagctgttgctggtaggtgtttgtgttgtcacacacgcccagcttgatgacgaatgttgcggtgcaacctcttccggttccttcgttgtcgatccagatgtgccctcccataagactaacaaacctcttgcatatggcaaggccaagaccactaccattaacccctcggtttcctccactttgaggatgagcaaactttgtgaatacatgaggtagatcctgaggactaactccacagcctgtatcttttacctgaactttcaaatagaaatgttcatcacttgcagttggatgaaattctggggttctgaactctctcaaagagtcagccttcataatggaagctacaagcgtgatgtgtccctccttggtaaactttacagcattgccagagatgttcagaatagtttgcatg

SEQ ID NO: 14019 - DNA, 515 bp, Zea mays
  Clone ID: LIB3279-233-Q6-N6-H12
cgcaaaaaccatgaaactgcattttagtcccttatttctcattctcctccatctccatctccatctccatctccatgggggggttcacccaacaatccgactaacgaccaaagcacacaggcgggcaggcaggggataaacaaccatcaagattggttttacagagcatcaaggttctactcaacacaaccgggggagccagaggggagacccctaatacaggtcgccctccttgggggtgtggatgacgcagtccgacttggggtaggcgacgcacgtcagcacgtagccctcctcctgctgcgcgtcgtccaggaacgacccgtccgactggtccaccgcgcccgccttgatcttgcccgcgcaggtcgagcatgcccccgcccggcacgagtagggcagctccacccccgccgtctccgccgagtccaggatgtaggcgtcgtccggcgcctcaaactcgtgctcctccccttccggggtcaccagcttcaccttgtacgtggccgccgctg

SEQ ID NO: 14020 - DNA, 600 bp, Zea mays
  Clone ID: LIB3279-233-Q6-N6-H2
agaaaccgcaagaaacatttaatctttcgtggtcacggcatacaaaatcgagatggaaatgaaaaaacatgtgagtttcaactacaaaacaaacatcaggaataaaggacagtaattataacactatacacaatagttaacaacacacatttgtcgagcgagcgtatgcgcggagctagcactcttctagcaggcgcatccactccccgcctgctgctgctagttggattggtcggtcctcctacttcattaagagcatctccgttcccaatagggccacgacgatcttgcgaaatagcgactttttgaacttgctggcattgcaagaacattgcgttgttccaagacttggcatagcttgctcggtgaaatgtgtggatccacgatatcgaagaacaccatattggtctcgaccgaagatgaatccaccgtgaactgtttaattttcgtgaggccctcttgtcgatgaaggcctctgaaccaacaacaactgatccgatgggtgcgcctaaccctttagataggcataccgaaactgagtcggcagcttttacaagtctatgtacaggaactcccagtgccacagaggcattgaaaata

SEQ ID NO: 14021 - DNA, 327 bp, Zea mays
  Clone ID: LIB3279-233-Q6-N6-H3
ggggggcaatctcatcacgaatctgaaccgggtggtggtaatatccaacaatatcccaatagttggcccacaaattagccatccagctgactcgtttgggggctttttagtcatacaacaggggtcaacacaagctcacaaaggcccaagcccctcgaaggggccagctcttggggcctgagaagacagatcccatggcaattggggccctacttatggcccggaaactacttagggcccggaaactacataacctactcaaagttttcacatgactcaattcctcggagcgcaactggccaggggagccttgaaattcccgacccc

SEQ ID NO: 14022 - DNA, 545 bp, Zea mays
  unsure (1)..(545): unsure at all n locations; Clone ID: LIB3279-233-Q6-N6-H4
agcaataattaacaagctaattaagtacacgataaggctctccttgacctctctatagctaacaacaagcaatgtactctccttcgcttcgctacttataaaactctcaagacagcgcagcagcagctccatgccatggtcttcattcctgattcctgtctgagacgtacgcaggggacgatgggctagcttcaagcctcatggcctcccagggctcctcggttcatggcggttgttggcaccggacccagggtagtcgttgacctcgatgtccatcctcgccgccacctcgccgccggggtctcgaactcccaccgcaccagcaccagcacccgcatccgcaccctgctgggcgggagcgcgaacctccggagcagggtcgtccgcgggctgcaggcggttcctcgtcagcgacaggcttctggacagaggcgcagcagacgaagcccggggaagaagaagaagaagaaggcaggagagcttgaggcagaggagggcaagcgaagccgtcttcttagatgtgaactccatcaccgncgtccccg

SEQ ID NO: 14023 - DNA, 586 bp, Zea mays
  Clone ID: LIB3279-233-Q6-N6-H5
gtcgacaacacggttcaacaatatatagaaagtcgaattaaagcattacagctagctgcaaacgctgttcaagaaccaaaagcaacaaaacatgatgataaaacgtcttgggaaggtagctctatatccttgcagataaaaataaaactagacatagcaaaaagctccaagcagcacattcagagaacttatgccttggcagcagcctgggcagcaaagtcgcgcctcctctgctcctcgatgatgctgagcttgatacccttgcccttgggcaggctcacccacggcttgttgcccttgccaatggtgaacacgttgcccatgcgggtggcgaactggtggcccatggagtcctcgacgtggatggtatcgaagccgcccttgtgcttctccctgttcttgatcacacctacacgcccggtgttcctcccgccggtcaccatgaccacgttgccgacgtcaaacttgatgaagtccatgatcttgttggtctccagatcgatcttgatggtgtcgttggccttgatgagcgggtcggggtagcggatggtacggccgtcgttagtgttcaagtaggggatgccct

SEQ ID NO: 14024 - DNA, 469 bp, Zea mays
  Clone ID: LIB3279-233-Q6-N6-H6
aatctgcttatatgagcatagaaacaactcccgtcagaaaattgataggattacacatcctcatttttgtctcagacctttaaatggcaaacaaacaaattaataaataaacaatgggtcgtaaaacagagcaaacagagggcatttatcaacaacagcagagcggctcaggtgcagctgcagctgcagctcctcagatccacctccggatgtctagaacacgacgggtgggggtgccacagcgccggcgatggcgacaaaactgatggcggaggcagatgcggctgtgcttttttccgtgacgggcgcggcggccggagtaagaacggaggctcccgccggggccatcgcgttgccaaatcccgcaccgacggggcttgtggctggagcgtcggcggaggaggcggaccccggccacattcttggaagccagggccgggaggccattggggcccttgtccgcggccgc

SEQ ID NO: 14025 - DNA, 598 bp, Zea mays
  Clone ID: LIB3279-233-Q6-N6-H7
actaaagagtaaagatagtatttagttcttaaaagttctagggaaagaacatatgatcacatggtaacctcatcaacataaatccacggcaaaaaaaaaaacaattgatacatggttgcataatcaaaggcatacttcgtacaattgataggaatgtaggttacactgcagatgcacgcaatgcaatttccaaaagcagctagcatgctcaacgtccccgaccccgaccgcgcccacgaccacggccacgcccacgtcccaagggcttcccagaagtaggcttcttaggcttgacccttggtgtttcctcaaccagcaaagtctccaggtttaggctgtcaggaaggatataatagcggatgttgtttcccctcacactaaggtgatcaagggtaacaggatttttcccttttagtgtcagcttcacagtcttcagatgagtattcatgctgatgtcaacgccggtaatggttccgtgtacgacggtgccgttcttaagctcgatggtcaccgtttcgttgttcagcttcatcaagaacctgacgagcttcatcttggaggcgcttgtggggaggtaaagctaggcggacgcgtgggt

SEQ ID NO: 14026 - DNA, 573 bp, Zea mays
  Clone ID: LIB3279-233-Q6-N6-H8
cgatgaatagcattgcaaatcaaaacaggatgatttgaacaacaatcatggccaatagggggctacgaacaatttatcacaaaatacaaaatggaaacacacagcagcagcacgcaatggagtggacccatacagagtttactcaaaataactcaaccattaagcaccagcgaactaattattaaccggctactcaatagtcatcgccctcgtcaccctcgtcatctgcaccctttgcgccgacttcctaatagtccttctcaagagcagccaagtcctcacgggcctcggagaactcacccttttccataccctcaccgacgtaccagtgaacgaacgcccgcttggcgtacataaggtcgaacttgtgatcgatgcgcgagaacacctcagcaacggcagtgttgttgctgatcatacacacggcacgctggacctttgccaggtcgcctccagggacaacaaacggtggctggtagttgatgccacacttgaatccggtggggcaccagtccacaaactggacagttctcttggtcttgatggttgcgactgcagcattgacatccttgg

SEQ ID NO: 14027 - DNA, 573 bp, Zea mays
  unsure (1)..(573): unsure at all n locations; Clone ID: LIB3279-233-Q6-N6-H9
acttgcttgctatacaaaaggaacttctacagttgagccacactatccactagctcgaaccaccgttacttcgacttgaaagagcagaccacgagtccacgacagcggcggcagccaggagcaaggctgcaagaggggcagcagccttcctgatgagttcccccagcgaacctagcgaggctggtggatcacgcggggggcgctgctcttggggctgccggcgtacttggtcggcttctcggcgttcctgggtttctcccggaacccccgcgggncgtcgccgccgcccttcggggaggtcatgttcagcgccttgagcaccgaatctgtcttaagggcggcggcgacggggccctgctcgagctggtcgtcgtagaagaggtcctcgtcgtcggggaggaggccggccgcgtcgatctgctcggccatctcgtccaggtgggcgcgctcgcgggaccagtggtcgcggaaccaggcagtggtggtgatgaggtcccaccactgcggcgagaagtcctccacctgtagtagcgccgccgggatgaagagcggcgcgtccgggttcagcgacga

SEQ ID NO: 14028 - DNA, 550 bp, Zea mays
  Clone ID: LIB3279-234-Q6-N6-A1
gaggaagttgcaacagtttagcaagttctataaaaaagcttaaactgaccatgtgtccacatccacatcttaactaactcgtgccatcattgtttggtacagtgtttgcctcactaaaatacaattgatacacagatgatttcgttgtcttcacatttagctgccgtacaaacatgtacacggaacaccacacgcccagattcactcggcactcaccgacatataatccttgttgccaccagtagatatcttgtacacgtaaaatatcagtacgagtgcactgatagaagcgacaattccagcaggcattatcttttgtgttttgacatatcttattcccataacaacagtcaatagcacagcacaaacgatctgaaggacggtggcaaagatggcggcagcgccacctccggcgtgcgcgaaggcccaggcgctgagcgcaccagcgagaaggagcgcagcaccgaatccgcccccggcgaccagagacgcggcgctgccgcgcttcatgtagccgggtacgccgccggctacgaacagcaggccgtag

SEQ ID NO: 14029 - DNA, 571 bp, Zea mays
  Clone ID: LIB3279-234-Q6-N6-A10
agcaataaaaccttctttttattcctttgactacaatataaacaggtatgcatgggtagctttacctagttaagtatagtgtagagtagtgatgcacacttgtgaaaactagttctaggtaatcccaggagagagaacatgataagtttgagaacaaacccatctccaaaaaaatgttgaaataagcaagatggcggtgttgtagcgacatcggacatgggactgccctgtttaaaatagatatgacaccagtgtgtcgggtgtgcattggacaagtcatcaagaaatcttgcatatgaaacttaaatgctaagtactcactaaacatgtctgatgtgtcacccaaacatggcaccggacaggtagccataaaggctgcaaattgtgtctaaaaggttgagtactcattagacatgcatggggtgtcaccaggcatggcaccatataaggtacttagataggtatagaaactatatatttgaatgggatactcgctgggcatgtggggtgaagcaccatataccaggacataatgacttgtttttaaaaatagccattggagctacaccaa

SEQ ID NO: 14030 - DNA, 342 bp, Zea mays
  Clone ID: LIB3279-234-Q6-N6-A11
gaagatatcatcatattcctctatttcaaatgcatcatgttatataatgttatcctaactttgcataaactcgtcagtccgcagcactcttaagtccatgtacctaataatacacaaaaggttttacagtacattaggatgcctggattatcaccaggctacaaacctaagaccttttccatggttacaaaccggccctgctcgattgataattgcccagccacaccgacggcaacagatagtaggccgtcacttaagttcacagatggtccggatgcaccttgagcccttatagcagacaagaaattgaggtgctccaagtagctggatccatgatgaaaa

SEQ ID NO: 14031 - DNA, 225 bp, Zea mays
  Clone ID: LIB3279-234-Q6-N6-A12
aaaaaaagcaattaaggggcccaacgtggggggtgcttttaaggctcgaaccaacaatggggacaacaccaccggggcccgtcctttaattatttccccccccccggcccggaagttgattgcaacgggggcgagctaagttgaggcaaaccttgggggggggcatggatactcatatggcccacacctttgtatatagacttggggggaccagcgtgggggccc

SEQ ID NO: 14032 - DNA, 554 bp, Zea mays
  Clone ID: LIB3279-234-Q6-N6-A2
cgatcaatgcagtcaccgattttaaagtgaaagaccaatgcagtaaccaatattcaagtaaaagaaggctctctagtctgagagagacatattaaagtaaaataacaggtactctagtctgagagagtaagacaggcaggcaggccataacaaagattctcagcttcttcaatagaagaaacctagaaccttgcctccgacgctcttccggcgggcctcctcgtggtccatgatgcctgccgaagtcgtgaggacgatgtatccgaactgcctggacgggagcagccttgcagtccatccctcgatgtctttcacgccaatatcaaagcgagggctgatgacgccgcacttgttcagcctcccgttgagttcgaccacaatcttgcccgatcggtggtcatcaacgtactcgaactctccaatgtagccatggcgctgcatgaccgtcaggaacttgatgatgaccttggatgacggcctgatcatgacctgcctcttgccaatcttctcaacgttgtacatggacttgagcgcatcgttgaacacactgaccc

SEQ ID NO: 14033 - DNA, 429 bp, Zea mays
  Clone ID: LIB3279-234-Q6-N6-A3
aatgaagtgcagaacgcaaactagttcaaaaggtcacttggatgatatcaaattcagaagtgtgcataacacatggtaatggaacgattgagagccatagctacaaaactctggtttcacatagaactaggacacaacagatgaactaggatgcctaatgcagcacttagatgatgccgattttgttggccacatcaagagcatcatagtcgggagtcagcttcacgtaagccttcttcttcccatcaggcctgatcaaggggttgaccttctttgcctggatgtcatacatcttcttgacggcagcctagatcttcttgttgtctgccttgaggtcaacaatgaacaccacagtgttcttatcttgaatcttcttcatcgctaattctagggtaagggggtactatgagaatttagtactgatcaagc

SEQ ID NO: 14034 - DNA, 525 bp, Zea mays
  Clone ID: LIB3279-234-Q6-N6-A5
gacaacataactgcacttgctatatagctttcctttcttttccattgcactgttgatttacagtatataatttacacaatctataactgggagaggctacaaacattgcatctaccccttctcaccacacccttgggtaaaaggattgatttcatgttgccctacaaagaatcatttgccccgctttaaaagataaggccttttctaactgtaagggcggaaatcccatcccaaccctaacaaatacctatatgaatttttacaaaagctagctgaaaaggataagataactaaaaaaaggcacatgtggtagaaaagatccaaaaaatatacaacaaatcaataaatgatctgacaagatatctagcagcataaaatgctcgaggacttcactagcgctaatcctgtaaaaactggaaggcagggttctcgagtagctcatcagccggtttgatatccgtgaagtccttctcctgcattgagttggtgatatcatccacggagaacgggatgctcgaattatca

SEQ ID NO: 14035 - DNA, 504 bp, Zea mays
  Clone ID: LIB3279-234-Q6-N6-A6
aagaaaatagggttctcaaaatagccctaagaaatgcaagaaatccggcacgttacacattctgtccacaacatagctttttgcagagattcagtacataaggattcttcaaattaaccataccacaccataacatgggacatttgcgaaactacgggtacaggtatcaaaatgcaacgagttcaatactaaaatataagcgtagtgcaatctaatcttcttcctcgccctcgttctcagcaatgttgaagtagcggagctcatagacgtttcggtccttgttggcagcaaccacgcgtagccaatcccgcacgttgtgcttcttcaagtacttcttggtcaagtacttcaggtacctcttggagaagggtccgtcagaagggacggtgaccttggtcttcttcccagagatggtgacggagtcgcccaggttgtcagccttgcccacggcgaacttgatgcgctcctgcaggaactttttgagcggagcgaccctcatgatct

SEQ ID NO: 14036 - DNA, 586 bp, Zea mays
  Clone ID: LIB3279-234-Q6-N6-A8
agagtcttatagagtagtagatatatgtgcttagacgcgtgttccatccctcctgtatgagattggttggacgcaatgttggctccatctaattaaaaatattaacaggggattgcatgtcccgatgtgctgcaggcacacatgttatttcctttgtgcgtgcgtatgataaattttagctagatagcatcatccttgcaaaaaatgcgaactattcagcatgctccacctgtccatcgcgcttgagtgacatcagagtcaaaccatttcaaaaacgttgcagttcacgacttctgctccaaatcgaaatccgtaaaagagcactgctcatcttgtaccagtgaaaaaaaagaaacttcagattgatacactagttatttgacggatgcttttacagctttctctgccgcatcatcaagatcttctgcagtgatcaaagtcattccactttccttaagaatcctctttccttggtctacattggtgccttccaaccgaacaacaacaggaactttcaggtcaacctgtttggcagcattaacaattccacttgctatcacatcacattttataatgccaccaaaaa

SEQ ID NO: 14037 - DNA, 568 bp, Zea mays
  unsure (1)..(568): unsure at all n locations; Clone ID: LIB3279-234-Q6-N6-A9
gcgatctagatggagacaatggttancggaaattctatgaatatcaagagaaccataaaaggatatatcaatgctggttttgctggaattatgcttgaggatcaggtggcacctaaagcatgtggacatactgaaggaaggaaagtcatatcaagggaggaagctgtcatgcacataaaagctgctgtagatgctaggaaagagagtggctctgacattgttattgtagcaaggacagattctcgccaagctatttctcatgatgaagcattatggagggtgaaagcatttgctgatgctggagcagatgttctatttattgatgcccttgcttcagtagaagagatgaaagcattttgtgcggttgcaccagaagttccaaagatggcaaacatgttagaaggtggtggtaaaactcccatattgagccctgctgaacttgaggaaattggtttcaggcttgaagtatatccttaatccttagttggggtatcaatgcgtgcaatgcaggatgctctaattgcgataaaagacggcggggaaccttcaacctacgaactgcatcttt

SEQ ID NO: 14038 - DNA, 551 bp, Zea mays
  Clone ID: LIB3279-234-Q6-N6-B1
gataaaatcacagccatgcttacttatttaaacaaaatacgccaccaacatcacgaacaattcagcacatcaagcgacttcagtgccctcaggggtcattgttgagcctcctgcagttcttcctgatctcaccttgtgaccctgtcaggggcgagatgtttcccatattcaccatagactgtgcaaagtgctggaagaagagattgacatcagcagcatatgccttcacgagggccgctgtctcagcgctcttggttaacagaatctcatcagagcttaaaaggcccttgccggccaggaggttcttgtagtaaaaattgtcaaacttggcaggggtgatgaagtccaaggggaagaggttgttgtcaccaccagagcgggggcatccctgcctcagctttgcggcgtaggatacatccagtgtgctgtcagccatgccattgcctgtctggttgtatagcctctgccggaaactagtgcaccgagacataccaatggtgtgaccacctgagagggcgacaacatcaacaacattgagggcctggcgcttg

SEQ ID NO: 14039 - DNA, 563 bp, Zea mays
  Clone ID: LIB3279-234-Q6-N6-B10
acacataacaaaaccaatccacattaaagaaaaaacattaacaactagtccagcttgcttattattcatcacatccggggctcgctgcctattattttcaaacaaatacaagtaaaacagcataactgcaacagctagctaggtttgtcttcacataatagcaatataatgttacaaaggtggaacaggctcaacatgatccctcacattgttcaccgagaaaagaacactttgaatacaatggcagatgactcagtgtggcgtatatcaagccttctaatcggcgcgagattggcctgcacgggatgagagaatgataccgacgatgagaccgtacagagcaagagcttctgcgaagataaggatcagaatcatgcccacaaacaactttggctgctgtgcattcgccctaactccggcgtctccgacgatgccgatggccatgccggcagcgaggccagcgaggccgcaggcgagtccggaggagaggtgcgcgtagccgtcgaagagaagtagggcttggccttggggttgatcccggtggagatgatgacggcgatgat

SEQ ID NO: 14040 - DNA, 603 bp, Zea mays
  Clone ID: LIB3279-234-Q6-N6-B11
gatcaggattttttcttgcacatactcagggaataacagagtcacaaggatcgtttcacacgctctttccagttttaagattaaccaaaaatttccatgccagcaacgttggacaacagggtcagctagaaagccccaaaacagaagtgctcaaagcaaagcaaagcatagctatagcagatgccaaaagattctggacatctagacttcacaaaaaatactgaacttaagctgcagaagactagacttcacaaaaaatactgaacttaagctgcagaagactagacttcactactgaacttaagctgcataagacaggtctcatagtagactatgcctactcccagccttgggctgtcggcggggctgcttggtcccaaccagtaggagcaaccactggaggtacagtgccgtccgcaggtacaggggccccggcttgatcccagccttcaccggtaggaactggagccggagcagcaccccaatcagcaccagtaggagcaacaggcggcgcagccacatcagaggtccactgatcaccaccccactgatcagttccttggtaatcagtgattgcggcaaactatggggcccgggagcttc

SEQ ID NO: 14041 - DNA, 355 bp, Zea mays
  Clone ID: LIB3279-234-Q6-N6-B2
atgcaaaaaactacaaaaggggggaacatttatgcttcttttaaaaaaaaactggagtaaccctcatttgaccccagtcggggggatgaaccgaaggaaaaaaaagaaccctcatatgaataatacatcggccctgcaataatccccccggaaagaacaagcaaattccccatacgataccagcacaaccgggccacccttttaaacgtgaactccaggcccccaaaccttttacagaaccaaagcctaaataaaacatgttgttccctgctctgaaacattggggtcctgatacaaaaaaaacatctccatgaaactagagctgaagcctccccccccccgactgggcatatat

SEQ ID NO: 14042 - DNA, 80 bp, Zea mays
  Clone ID: LIB3279-234-Q6-N6-B3
gcaattagaaccgtgccaaacaaatttattgatctgaaaaactaaacaggggggggcataaaaccatgggaaatgcaggg

SEQ ID NO: 14043 - DNA, 340 bp, Zea mays
  Clone ID: LIB3279-234-Q6-N6-B4
gggcacccaaattgcaaactagatttctgaaatcagggaatcacgtttcaaccacaatgcacagatctactaaccagttccaataacaacgacgacactacagaagtaaagatctactgaacacgagcattcaacatcacagcggtaaaggcgcccctctatgccttcttgggggacttagcggccttcttgggcgacttggcctccttggccgccgccttctcagcggtcttcttgggcaggagcaccgggttgatgttggggaggaccccgccctgggcgatggtgacgcctgacagcagattgccgaactcctcaatattgcagatggccaggaaca

SEQ ID NO: 14044 - DNA, 220 bp, Zea mays
  Clone ID: LIB3279-234-Q6-N6-B7
atagggataaatggtataaatattatttttacatagaggggagtcttacaaaaaatgagaacaacaaagagaactaagttttatttcttagcgccataaaggtgactgggagatgccacctaaattagctcgaactcctcgtggtaggggttcccttggaccacctgttgtttttcttgaataagctcctgctgaggaactttacctactgaacacttgg

SEQ ID NO: 14045 - DNA, 428 bp, Zea mays
  Clone ID: LIB3279-234-Q6-N6-B8
gatggcatcaaagcaaagctatcaggaaacgggccagcagcacaagcattagccggggaaacatattcagggcaatcaaaagctcgtctaactaaaaactcccttctaaagtccccattttaaatgaaacttcgacaaactgcttcagttaaacgatcgcatttgccgcgctagcaatcctgggccagagatcagcgcactcctttccgatgggcccagtgatggcagaacctttcatctttccctttgggttcacaatcactccagcattgtcttcaaagtacatgtaaacaccatcctttaagcgccatggcttgcgctgcctcacaataacagctggcactgaccttttttctaaggtcaggcttattcctttttcacgggcgccattaccatgttaccaacacaggcagaaggaagcctgttaa

SEQ ID NO: 14046 - DNA, 423 bp, Zea mays
  Clone ID: LIB3279-234-Q6-N6-C1
aagaaaaaggcatttttttccataaagcagcagagggcacaagtcccattaccagggaaaggtccattactcagggaaacagcagctgagttcgagatatggggggagggcaagcataaaccccaataaaaatccgttcccaacattgacaccaacccaacgcgaagataaatgattcacgggaggcaaaaccccaagcacatgcccaagcccacattttacaaaaccaaagggggggcaaacttaagggcccaaggaccaaaatagctttatgacaaacttaaaagccctgtacaaacagggaagggccaagcctttccaccaccaaattgaattgccctgggagacattggctaatcatagataccgaaaataaagggcatgccagtttccttgaaagaaaggcccccagggccctttttt

SEQ ID NO: 14047 - DNA, 397 bp, Zea mays
  Clone ID: LIB3279-234-Q6-N6-C10
gacaagaacatgctgcagccacaagatcatagatctactagtttcagctgggtacagcaccagaaaattaagaatctaggcaaacggaaaatgggttccgattcaaccatagacaaagtaccaagaacagataaatttattacaaagaagacactagacaatctgatggttcaccctgaatcgcacgagtccatacaggcagcagtttgtgtcccgctccaggatatggaccatttaagcatcagcataccccagttcggagagcttgaggggggcctctttgtagtcatcaaagaatgccttctcatttgcagcatatttctccacaagagggcggaagacagggtcgctcaacagggctttgtcacttgggagctgaaaaaggccctccttgtcg

SEQ ID NO: 14048 - DNA, 248 bp, Zea mays
  Clone ID: LIB3279-234-Q6-N6-C11
ggggacctgaacacttttaatgtagtattttaaatttgagacatcattgagtcaccttgttagaaagggtcttaaaccttgctcttaaacctaggggatttgcgaatacaatagcaatgcatgaacaactagtaatcaagttttaaaacgtcacagattggggggcaaaaaaaaaaaccctggttttcacctataaaccttaggagatacttgaaacctagcttcaactcaagagagatcaataatag

SEQ ID NO: 14049 - DNA, 150 bp, Zea mays
  Clone ID: LIB3279-234-Q6-N6-C12
gatgggaaacattgctcttggatctctgatttgcatgtcccttattcacaaagtgaagccgtacacctggtcctcgagcatgcttgctccttcgaatttacacttgcaaagttacacagcccgtaaacagctggcagctgcaagctgcag

SEQ ID NO: 14050 - DNA, 545 bp, Zea mays
  Clone ID: LIB3279-234-Q6-N6-C2
cagggaatacagttatgcttcaaactgcaaaagcactccttttggccttgatatttttacagcaaaaaatttacaaaccctgcattggggggtaggtaacatctgctatgctagcattattttacaaaataaacgaattgctagtgctgtcgagattttcaactgccccctcaaaccaaagaaaaatgaactctcgaggagaaagttggtgcgaaggccattgcctcttctgattagtcagtgcggtgcccgtgtatgcctgccaaaatcaggtagatcaagggaagatgtgcttgattaccagcgcccatagcaacggacacctttgtatgtgcacgagaaatggaacttcatagtgtgagccccagctgcactctgttctgttatcacatttttattcctaatctcctcatctctgcttcaagagtggggctggatgtcaatgtccggtatgccaaattccttatatcttctcggagacagtcccttgagatccgaacaagctcccatagggcaccttcattgataatgtcttttgaatttac

SEQ ID NO: 14051 - DNA, 197 bp, Zea mays
  Clone ID: LIB3279-234-Q6-N6-C3
cgatcgccgccgcagcgatcacctcgaacatgtcctcgtgggaccggtcgttgcccacgtcacagaacgaagtccggcaggtcagatgtgatctacgccccgctgctgctgcgtgatcaacaggatccgtttcaccaccagaaccttgctatacgccctgaggcttaacctggacaaggatggatgcagatttttct

SEQ ID NO: 14052 - DNA, 474 bp, Zea mays
  Clone ID: LIB3279-234-Q6-N6-C4
ggggcacaacataatggtatgtacatattattcaaatggtggcgattaaaaagcgtatacaggtggggataacgttgctacatccaaatagcgggtagcatgcctagcaagccaaacatattaccttacagcaagcatcccattgccgcttcacacatttttgctgccttcgatacataaacagcccaaatgggttactagcagggattatagttctacaatatatggaatcacgattatcaccggtgaccagagtctactccttcgaggcgtggactggggacacgggagaaaccatggaatcgaccccgcacttgttgcgaacgttggaacccctgcatatcttgtagtatccgttctccccccagttctcgccccacgagttactgatgatccagaaagggttgtcctttaggcgaaggggggggaaaccagaagcccctttccaacaggggaccaccctgggcaaggggc

SEQ ID NO: 14053 - DNA, 103 bp, Zea mays
  Clone ID: LIB3279-234-Q6-N6-C5
acccaattacgaacaaacaatgtaggcatgaacattatttttggaaaggggttatcacaaccgacaacgagcactttcttgccttggaaggcctcccttccct

SEQ ID NO: 14054 - DNA, 288 bp, Zea mays
  Clone ID: LIB3279-234-Q6-N6-C6
aagggcggggaataaaattattgccccaccccaagggttgtttaagggggcaagggacaacagatttaacccaaaaaaagggggggttttgggggaaaagggaaaaatttggtgccaaaatataaaatccctaaaccaaaaaaattaaaaaacggttttccccgggggcaacgaaaaaaaggggaccctgggaaaacccccggggataacgggaattaaggggaaaggggaggacgcaaaaaaaggaacaaaattttaggaagaaaaaactttttggggggccaaaga

SEQ ID NO: 14055 - DNA, 566 bp, Zea mays
  Clone ID: LIB3279-234-Q6-N6-C7
atgtatatgatatgatcatacttgggttcagttttcacaacctttcggtaaaacaccagatcggttagtgttgcctctatcaaaggaaaatcatcttcagacatctctctctctcgcttgcatctcaccatctactgccgcgagttagtaatcatcttgaaatagaaaaagaaagtagctaggcaaccctaaaccatgtattgcatccccacctgcatcagcctcgtgtggggtatgctcagcgtcgcgatgcccctcctgcagttcctcctcaggaaagcatagaaatagttgatcaccagcttcttgacgaagaacgactctttccgggccctgatgtctccgtgcccaagaaggtacaccacgcccgactccttggccttgtggatgaaagatagctcgttgtccatgcttgatccctcctccaacgacatgcttgatcccagggctgagttgtcagcaccgcctgactcgtcaataactcttgatgatgaagaagcaatctcctcttcagagtctttgtcgtcattatggtcgctctccagggagcgttccagggagcgttc

SEQ ID NO: 14056 - DNA, 572 bp, Zea mays
  Clone ID: LIB3279-234-Q6-N6-C8
catgcaaacactacaaactggcaatcttttgttcgaatttactacaagagtctagtctcctgaaaccaaagcacaaagcatgttcgttgctcccagaaaatgatggataaaaccacaaccttgtggcactaccggccttgcaatcaatcggttttcattgcctccgcgtgatagctttccaggtctttatccagctcatctgcagtcttctcaggctacctgcctctccctcgtccctggaactgggcacggcctctcccccggctctggaactgaccacggcctctcccccagctctggaactggccacggcctcgaccagcttggaaaccaccacggttgttaaacctgttgcttagaggtctactgcttgaacctctgccacgttgactaaactcaggcgtcataacaactgttcttgtagctctgccattagaagccccaacaacatttatacgaggtgtcataggcaatcctaagtcatttccgatgacttctatcttcatagcttttccatcaagtagaacattattataacgcttcagtgcagcaattgcatcgctcctccgtgt

SEQ ID NO: 14057 - DNA, 443 bp, Zea mays
  Clone ID: LIB3279-234-Q6-N6-C9
agggattcacattgactccaagcatgtccatgggtttgaaacgttttattggaaatgagctcattggaaggggatccaggtgaaaaggccattttccaaacagaagggacgtaaaaaaagggagcctcattagttttgtttgaggccatggaaggaattgctcgcaattgcccatgagcatcaaaatgcgggttctcaatggctccatcgtctattctaccattccacgctgcttgaaaatttcaaacatgggagagccaatctttgctggtgactcgacaacggtaacacctgcctttttgagtgccttgattttgtcctgggcagtaccctttcctcctgccacgatagctccagcatgacccatgcgacggcccgggggtgccctaagtccagcaatgaatgcaacaacaggcttttgggttttgctttcctggaagaat

SEQ ID NO: 14058 - DNA, 455 bp, Zea mays
  Clone ID: LIB3279-234-Q6-N6-D1
aaaacaaacgtctattgtgatctgagatttaaaacaggcaccatagatgcttggggcaagtacagactgcaggctaaacatcccaatccaacaacggtcgagtgccgatgaagcgaagaaactacaaactaaactgcctcactccagggacgggacgaatcttgcaaggaaactactcagaagacggcactaatctactgcatctagaaaggccttcgagaaaacccggttaggccgacaacgacgagattttttccctgactgcaaacacttggacagagtttcatccgtcatacatcactcgtaaccctcctcgtcctcgtcgttcacctcggacttggacttgacggaatcaccagacgccgtggggtcttcagactgcttgttgttgtaagcgtcgatcttcttggtgtactaaaccttggacttctttggattaaacacgtaaggagcct

SEQ ID NO: 14059 - DNA, 495 bp, Zea mays
  Clone ID: LIB3279-234-Q6-N6-D10
agcggcaaactcagaatttggaacataagggatcaacaacaaaggggtggtgattcacaaataaacaagtccttggtgggttacatgacgcagttcctacaaaagcagagcagcgcccacagagaaaccagcaacatttaactacaacacaaggggaacattaacccaagagaagcctacaaagggcgagcgtgcaagcctaggaggaggggaacttggggacggccttggggccctcaaaaacggggtgcttggcgagctccccggggagcaccaggcgcacggaggtctggatctcgcgggaggggatggggggctttttgttgtagcgcgcgaacttgggggcctccccggccagctttttaaaaatgtcgttgatgaaggagttcatgatggacatggccttggaggaaatgcccatgtccgggtgcacctgcttcagcaccttgaagaagtagatcttgtacgtctccacgctctttttgcccttttttt

SEQ ID NO: 14060 - DNA, 558 bp, Zea mays
  Clone ID: LIB3279-234-Q6-N6-D11
aaactaaaacactctgatagatagaacttgctaagcacataacacaccgcctgagacactttgggcacacacttagtttgtacagtacctaactgacaccaaccacaatcagagcttagacctaaagcaacccatctcatgcggaggccttccgtgccttcttggaggcaggggacttcacggtcttcggcttggccttggccttggcggcgggggacttcttcggcttcgccacgaccttcttctcgggcactttgcgcttggtcccagcagcagcggccttctttggcttggcagccgctgccttctttgacttggcggcggcggccttggccggcttgggggcggtggtcttggcagcggcggcctttgccggcttagccttggtcttgggggatgccttcttggcggcgtccgagagcttgtacgaagccttgaccttcacgagcttgcccttggctgcggacccacggagctggatggaaagcatcttcttgaagttggccggcagagacgcgccgtgcttgtcccccacatacttggcgatcgcttgcgagc

SEQ ID NO: 14061 - DNA, 555 bp, Zea mays
  Clone ID: LIB3279-234-Q6-N6-D12
gccaaactaaaccagcacgtaaggtaaaggtaataatcccgacacaagaatttaatcgacaaggtagcctaaataaaaacacacgccgctagcacactcaaactgtggtgttaatagctgctgcactacacacacgcactccccgacaatggcagcaagtgcagttgttagactcccctcctcctgcctggcgcgctcatcatacagcaacaactagactagaccgcccctagtgcgagatttgcagcaagagtcaggaacaaatgaaccaatccatgaccccatccttccatcttccagcggggaccttggctcccagtcagtgcgtgggtggctagctccggctgggtttcagagtgctcatgatccggacgtggtcatcttcaggtccccagacgacggcgtcctggacacctcggccatcggctgctgcggcgcaggggacaacacccagctctggtccgcgccgtaggttcctcccgggaccgtcatgttcacccctctctgggacgcggagctctgctgcccttgctcgctgctgcgggtgtctgtgct

SEQ ID NO: 14062 - DNA, 582 bp, Zea mays
  unsure (1)..(582): unsure at all n locations; Clone ID: LIB3279-234-Q6-N6-D2
tcgcgatctagaacgcccccaggcggccccactcactccgctgttgatatttcgtttggttctcctttccgtcttgtccgtcgccgaggccttcttcccctcgctccccagctccagcaggcagatcagatccatccaaccacgaacaggaaggtaggaggcctgaggggctgggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgcctggttccgcgaccactggtcccgcgagcacgcccacctggatgagatagccgagcagctcgagttggtcgccctccttgcctacgatgaggatgaggaccttttctacggcgagcaggcccccgccgccgccgccgcccttaagacagattccgtgctcaaggcgctgaacttgggctccccgaagagcggcgacgccccgcgggggttccgggagaaacccagcactccgagaagccgaccaaatacgccggcagtcccaagaacagngctcc

SEQ ID NO: 14063 - DNA, 552 bp, Zea mays
  Clone ID: LIB3279-234-Q6-N6-D4
ggagagaaaaaagcatatatctccatgcaccaatgatgcaaaaaccgctccatgctttccctgatttctacacatactagcagtgtgcatagatgccatgaggtatgtaggtgcagttcctaaggctaaatcatccctaacatactccctccgttcttttttatttgtcacggtttagtttaaaaataaactagccaacgacaaatattcgagaacggaggtagtacaagctacagcaagatatttaaacctacataccactaaaccttccatattccaagagacatacacgcagaagacgatggcgaaaccaccaatctcaaaaaggttgaaccctctagccagcctttgaaacttcttatttgttgccgattcatgtctttgtaccggtgttactgatcgatcggggatgcaagcgactcactgatcgatcggcgatgtaggtgactcaactgctagctgctcagatacctctgcgagagactttgagttgcatttgatcacagcctcaacaaagaagatgtctcatcctttgggttgccgtcaggcaca

SEQ ID NO: 14064 - DNA, 483 bp, Zea mays
  Clone ID: LIB3279-234-Q6-N6-D5
attctgtcatggatataaacatccaatccaaccgaggcgatcatgcatatatttgttctgtgatcgaagagagctgcacccgtggtcggtctgtgtctatagctatttgacacagtagtaactcaaattcacatgatggagcatgcgttggggttgtcgtcgctgaacatgttgacgagccgctcctcctgcgggccggccgccgtgggtccgccgtagctggagacgggcatgacggcgtcgaccctgcgcacgtagcccggcggcgccttcctgtcgtaggccggcgcggcgtaagggtgcgcgacaaggctgtagggcacgtagggccagatctcggccgccttcttccccgtggcctgcacccgcttgaccaccttgtgaggctccacgtacccctgcaccgtcaccttggactgcttccggtcgatctccacggaatgcaccccttttatgcgggagagggcgttcctgaccttcatc

SEQ ID NO: 14065 - DNA, 430 bp, Zea mays
  Clone ID: LIB3279-234-Q6-N6-D6
ggcaggcccaacaaaaatccattttcggacaagagcgggtttatacatcaattgccccggggggggtggcccaaccccccaaggggaattgttcaggggaaacagagacccctttcccaccgaaagacccccccacataacatgggggggaagcgcttctccctgaaaatggccagccccgggaaaaccgaaaaaacattggcttcctatttattcagcccttcaggggggatttctttcctgggaatgctgcaaattttggggctttttttttgggcccccctggttccttttcaggggccttttggggttggctaccaccaaagccaaaaacaagttttcctggggccttacccgaagaactgccctgtgatgtgggggctgttgaaggcctcccacccttgggcgcattggcttgtccctttgcagg

SEQ ID NO: 14066 - DNA, 117 bp, Zea mays
  Clone ID: LIB3279-234-Q6-N6-D7
cacgtcaatgatggggctcatgaaccataaaatatgaatgaaggaattttacagagagaattctcgcctacgaacagagcagcctgaatcagtttcatttcaggccggacccgtggg

SEQ ID NO: 14067 - DNA, 344 bp, Zea mays
  Clone ID: LIB3279-234-Q6-N6-D8
aaaaaaaaatttttgggggaacgcaatggggggggcatccccctttcaggcacccaagaggcgaccccgggtaaaaaaaaaaaaaaaaaaaaaaaggcgaaccaagaagggggggaggaccgccccaaaaaccgagggggaaggaccccccttgggaaaaaaaccaaaaaaaaaaaccacccccggaaaggggggggggggccccccaaaaaaaacggggggggggccccccagggaaaaaaaaaaaagggggaaaaaaacccaccctgaccccaccttttttttaaaaaaaaaaaatacctaaattggacccggggccccaaccaagggggccaaaacccccc

SEQ ID NO: 14068 - DNA, 619 bp, Zea mays
  Clone ID: LIB3279-234-Q6-N6-D9
ggatgacacataactatatttacacgcagctctgccattacaaccatctgcaaaccccagcagcataatcaagcaggaacaaaacaaaaacaaaaaaaaaatctagtagcagtcgcgagcaagatacccagtcaggagaggactcatcaggaagaacagatcactagctagtaccgtaagtagctcatcactacacctcacagcaagccgcgaggcccgcgaagaatgaaggcgcgcgttccaccaccacccaccgactcgaacaactccatcgatcggccgagagtcagtagagcctgtagtggcggtaggacttgagcatggcgccgcagaaggtgcagatgatggcgcgccaggtgcggcggtgcacggtgagcaggtagcagaccctggtggcggtctccatgtccgccacgctggcgcacccgccgcagcgcgagcagatccccgccgccggcttgctgctccgcaccgtccgccgctgctccaccaggaagcagaagacaccatcgacgatccctcgtccttgctccttgcccggcccgcgcgctctccagcaaccactgttctgattgcgtgctgcgcgtgcgcggcgcgcgcttgtatgcgtatatatagc

SEQ ID NO: 14069 - DNA, 515 bp, Zea mays
  Clone ID: LIB3279-234-Q6-N6-E1
aaaaaaaacaatcatatagcatgtatctgtgaaaataaatagctttgtgacactgacacgcaccagtgccaaagccaaacaacacagaacatcccaagatgccaacttgttctagcaactactacattacattttcatctttctaaaatggccacttgggtcaggccagcaaaggctgatcagccaaacctgccccagcgccggtaatccttactgaagtccgtcattagctgtgttctttactttcgtacaacctatttatccatgcgaaaaaaaacccggaatgataggggcccaaaacagaacacttccacacatggctgttgagtatcgcagttttgaagatggtgatgctggatcatcgatcactggctcgcctccttggacaagctcagatcaggattggcgatctgaggtcccagcccaagccatggctgaccatccgacatctccttcttcacaggtgtaacatctgaaggggaacccgggtacggtgctttcgcagtaaggcgatc

SEQ ID NO: 14070 - DNA, 478 bp, Zea mays
  Clone ID: LIB3279-234-Q6-N6-E10
gaccaacatctgagaaatcactaattcgattcgcatcacagtagatatgaaagtcacacgaagataatatagaacgagattgttgcaacgacgatatctatgtatttcgggtgctccctagggagcagcagccgaccaatcgcgtaggacacataatcgacgatggggtactagacctactagggacaatagaggtctggcccaccaaatgagcgtcatttgtttggtcttgtcgatcagcatgcccatcacctcatgcgtgagggtcttgagacctgttgtcctcgagagcgcaccttcgccacaatgtgtctcatgtccatgacgttgttcactagaatgttgcagtcatggcgtaggtgctcgacgtcgccccgccaaccagatgatcatccttgtatttagaaaacacatcaaaatccaaatctagaagatattctaacgcgacatgttgatcacgatataactgaagcggttc

SEQ ID NO: 14071 - DNA, 580 bp, Zea mays
  Clone ID: LIB3279-234-Q6-N6-E11
tttttttttttttttttttttttttttttttttttttttttttttttttttttttttttttttttttttttttttttttttttttttttttttttttttttttttttttttttgggggttttagcaacccaaaaccaaaccgggccaaattaaaacaaccccaaaacgttttgaaacgggtccctgggggggggggttgttttgggccttaaacgggaaaggggcccccaagttcctttggggaccttaaaactaaagggccgccaaaacaaaatgggccgggccaaggtttccccccctaaaatgtgcaaaataaaaaaattcaatcaccttaacaaattgccgggggggggggagcaatcccctttggggggaaaacctttaaaaacgggtattttttttaaaaaaaccaaatttgaatttagggggcgaaaaaacttccgggaaaactgtttgaaacccaaaatttgcaaactgcacaaattggaaaaagggaaatttcggggcaactcttattttcttttacaaaaaaaaaattgtggtttcggtccttaggccccggaattagtgtcctttgtcc

SEQ ID NO: 14072 - DNA, 549 bp, Zea mays
  Clone ID: LIB3279-234-Q6-N6-E12
aaacagccataattattctcaataacccggtagcaatgcaggggaattaacaactcttacaacatcaggtgttgtaaaccacacaatacttcagaacagacacacataacacgatagcaggagcaactctcggcagatcacgggataagggcagcacactggcctgatgctgcgtcatcagcaaacttctctagtactcgtcaccctcgtcgccatcctcgccctcatcgaactcagcaccgacctcctcgtagtccttctcgagcgccgccaggtcctcacgggcctcagagaactcaccttcctccataccctcaccgacgtaccagtgcacgaaggcacgcttggcgtacatgaggtcgaacttgtggtcgatgcgggagaacacctccacaacactggtggagttggagatcatgcacacggcacgctgcaccttggccaggtcgccaccaggcacaacgctaggaggctggtagttgatgccccacttgaagccagtcgggcaccaatccacgaactggatggtgcgtttggtcttgatggtgg

SEQ ID NO: 14073 - DNA, 410 bp, Zea mays
  Clone ID: LIB3279-234-Q6-N6-E2
atcagaaggcgcgtacgaaaactaggaatacatgtgacacttgacgcaacggatatatgaccccttgcacagggccggtggaagctaaactaaggcacaagtgtgccgctagtcatctatccctggtgcccgacctgtacaacatggtggtccacacacagcaatcatcgaggcttggacaaagcttccgtgaaggacctgccgaagggaagagactgatctacgcccggtgcgccctttgcaagtcataagcaccccaggaaccatgccttggaccagttccatactgaacaaccaaacaagctggctccgctgcttgattaatgccatacctacgttctaagggttggcaggataaatggcctaggggttggcatagctttcattataaccttgattgacctgacact

SEQ ID NO: 14074 - DNA, 234 bp, Zea mays
  Clone ID: LIB3279-234-Q6-N6-E3
atgaagagcgtttattgagaagtgtagtgcatccatgatccatggattcgaggtcgagagaccgtcaaattttctatctcatattacaggttccacaacgacaatctgcacaacctaccggacataatttttattattattacttgcaaattcgctgcaaacgacaactcgcgtacaggacggacattcacgaactcaaatgcaacgcaactggaccaaccggaccgtcgaccg

SEQ ID NO: 14075 - DNA, 445 bp, Zea mays
  Clone ID: LIB3279-234-Q6-N6-E4
ggaaccaaaggcttggattattctttttttttgactaattaaacaggttttaataaactaacacaggtggcatttaacatcggggggaaagataacaatggggggaagaagatcttcctggggggctttcgattttaaggggaaaaatgactaagcgctacgacccgaactggccctaagctttttaacaagggcctaaagtttttggtaacagaaaaggggaacaaaatggaagagctgaaaaatccaggccaacggcaccaatggcaggggccacctttatcatactcatcatttagagctcggagtgctcctcaaaggccttgtcatccttgggataagagtgggccttgtcataggctggcttggaaaggggggcctaatcctttaaggaaatattgaaataatcgccaccctgtgggggttcctttttttgctgtttttt

SEQ ID NO: 14076 - DNA, 430 bp, Zea mays
  Clone ID: LIB3279-234-Q6-N6-E5
aagaaataaaactcataataaaaaaaaacatttacaagtttattagatacacataattaaactcacgggtaatctctccttttttactggactactacactttccactagctttggcccataaactccagtaggatgcaataccggatggagatacccaaagcgtttttcccttggacttccacacaacacaacagaaccgcccaaaaagtgcaaacaggctgtgagtacctttcagttcaactatttgtgcacctacagcaagataatcactgaactaacagacgtgctctttggttggagccctttttgctcgctggcctgacgatatataggtagagagccggagggctaccagttaagatgcctggctagcgacctggttcaataaaggcggcacaagaagttttgctgaacctaaacctgtctcg

SEQ ID NO: 14077 - DNA, 558 bp, Zea mays
  Clone ID: LIB3279-234-Q6-N6-E6
aagggcatattaacacgattaatagacgtaacttagaagaacaaagtcgacctgaaactacttccccaaagcatttccatatgcgagtagcaaaaaagaaataacaggctcagttagttctataataacaaaatggctccccccgacctctgctcctcaaacaaaacagtcagctcgagctaggcgtttgcacccagctcaaccctcccaggatggccatggccgcctgcctgtgcacctccaccatggttgttgtaataagagttgcgaccaccccggcctctgttgttgtagttcctcggctggtagtatccagattcgtagtacccaccgcctccgccacggccattctggtatccaccgccacctcggccattctggtacccacgcactccacgaccattaggatagcccctcctgccgccaccacgaccgccgccactacgctggttctggtaagagcgccgctgggtgaattgttggtctttttgttcctgatcggccacataatcgtcaaatgtctcctgctctgcctcagctgaaggaacttcatgagct

SEQ ID NO: 14078 - DNA, 510 bp, Zea mays
  Clone ID: LIB3279-234-Q6-N6-E7
gtaaggcatcgaaacttcgattgcagtggagtggaggttcacaaggagttcacatacgagaacactggcagcaacatcttttcaacaccgtctccatctccagataagctactttgaggttctaaggttatctccaacggcttgttcatcgccgttatcttctatttcaaacatcactttgtaaacaatgcacaacaatattttgcacaacgatttgctagccatagcctaagcctagcattatgcacaggtaaatttattctcatcccagacttttatcacagtacgctgtttcacctatacttgttttggtcacctcttccaggatctcccatgttcttcagttgaggttcttgtagattctgaaggagacaagcaccgctgcggcagctgcaacaacagcaagagcggcatatgtgtcagctctctcccaggtctcaaaccagatgggcactcggcaagtctttgtatcccccttcttgctgccagcaccaccctccttgtcagagc

SEQ ID NO: 14079 - DNA, 523 bp, Zea mays
  Clone ID: LIB3279-234-Q6-N6-E8
ggcatgtcaattttcactgtttgtcggtctccaggcgatgatacatccattcccattgctctatgatgtagcttttaactatgtcagagtaggtatgcatttgtatccacattagagtaattggggccttactcgaagattatagccaccaacatgctccacatacgtttctagtcttgagcagccctgttcttcatagaatgtagcaaccaaagagatctctaaccgttagattggatgaccgcacccacgtgtacaatctcgcgtgagcctggtcgaccgcgtacgaccgttttaggcgtacgtgtggatgcaaccaacataactttttttgcgtctgtctatacaacccgcgcttcacatgtgcatgcaaccaaacacaaactcagataaagtcaacgcacgtggtaacgcgggacgggacggtgcaactaaccgatcaccatggtacatcttgtatccactctcccgatgcccctcttttctagatgaattgtcgatgtcgcaagcgtgccacattcaa

SEQ ID NO: 14080 - DNA, 505 bp, Zea mays
  Clone ID: LIB3279-234-Q6-N6-E9
aatgcacatcaacactgctagctttcactgcaacggcggcacgcacgcacccatccacagaccaccagagtctctgcaagcagagcagggttttgttcattcacatctcaaagcatcccaagtacagtacagtacagtacccccccgtagacgccctagagagagcccccccccgtgccctcgtcatcagaaagtggcggaattcgttcgccggaggtcgtggcggtgcttcggcggcagctgctgaatcggcggcggaggcggtggcggtggctgcggctgcttcctcttcggttgcggcggcggctgcttcttgttctgctccgccggtggcggctccagtggctccagtggtttcagcaccttgagctcaatgagacgcttgttctcctcctccagccgggccaccttgttctccagctcgatggtgtacgcctgcttcctggcccgggacctcgccgcggactcatggtatttgatcatgcgcttttgccgccggtccacc

SEQ ID NO: 14081 - DNA, 360 bp, Zea mays
  Clone ID: LIB3279-234-Q6-N6-F1
ccaaaaaaaaaaaagttcctttagggggggaatcccaatccccaaaaaaggagggggcccaacccccccgttcaaaaaaaggagggaaaggggcgtcccctgaaaaaaaaccgactgggaaaatggtttcaaaacccggtttttttgggaaaaaaggggataaaaaaaaacccctaaacaagcccaccccgtcccccaaaaaaatttgcccagggataaaaaaaccacctccggggagaaaatttgggcccaccctagggcactcccccacaccaggagaaaaaattccttttaaccgggggcggagaaaggccccccatcgctaaccggggggttaaaaaaggggaattaacccggggg

SEQ ID NO: 14082 - DNA, 473 bp, Zea mays
  Clone ID: LIB3279-234-Q6-N6-F10
gcacaagcatcatgattcctatgggggatctcaaatatatatacaatattttgcactaacattgaccactgggaccacaagcatgggaaatggcatcatcacacgccaatgaggcaattctcatagtatttctaaatagcactgaattcatacatacaccattagctctcgagctgcaaaatggtactgctagtgctaaacaccccacaggtccatgccatgcaatgcggcacacttaaaagctagcaggaggccccaaaccccagttgagtctgcctcaaaacataggattaacctaaatgctgggagatttatcttaaaccaataccaggttgctacttgccataaatgcacatgcccacctcatagctcactaaaagcattattgctgaaaccaaaaaaaggcagaagccaccacccagcaccgcggtaatggtgttgcagccacaatgtatacgggcatcaggttcaaa

SEQ ID NO: 14083 - DNA, 524 bp, Zea mays
  Clone ID: LIB3279-234-Q6-N6-F11
aaacacgattatacttttatttttaaattattagtatatgtatacataacacaaacagacaagcttaagcgcgttataccaaacgaagagatagagatatatatgatttggtttcgcgagtgacgttcctccttccattttacaggcatgacggccaccactgttttaaagtgctagcaggtcttcacaagttggccgacggcgtcggctgcggcagcaggccttccctcttggccatctcgtacagggctatcgcggagagtgctttcgcgtcgccggtcgaccgccagagctcgctgtacggaaccacgcgcagcttgatcagctcaccgtggtcgcgcagcccggtttccttcccctggagcgatcttatggtctcctcgtcaacgcggcccctgtacaggaacaggccaatctcttcgtcgcagccacccggtgatggtagcattcgacctccagtagcagggtccagcagtgccgtaagatcaaccatgtcttctatattcagctttataccagtctct

SEQ ID NO: 14084 - DNA, 567 bp, Zea mays
  Clone ID: LIB3279-234-Q6-N6-F2
gccgctaagtcatctgcctctgcggtggccacgccggagaagaatccggcggcgccggtaaagtgggcggtcgacagctggaagtcgaagaaggcactgcagctcccagagtacccgaaccaggaggagctggacacggtgctcaggaccatcgagacgttcccgccggtggtgttcgccggagaggcgcgccacctcgaggagcgcatggccgaggccgccatgggccgcgccttcatcctccagggcggcgactgcgccgagagctttaaggagttccacgccaacaacatccgtgacaccttccgtatcctgctccagatgggcgccgtgctcatgttcggtggtcaggtgccggtcgtcaaggtggggaggatggctggccagtttgccaagccaaggtccgaagcgttggaggagagggacggcgtcaagctgccaagctacaggggcgacaacgtgaacggcgacgacttgaccgagaagagccgcgtgccagaccctgaggagatgatccgcgcctactcgcagtcggtggggacgctaaacctgctcccatcgttggcg

SEQ ID NO: 14085 - DNA, 172 bp, Zea mays
  Clone ID: LIB3279-234-Q6-N6-F4
gagaggtaaaagggaaagggagagacattatgttgggggtgggattttttaattttatatataggaaaaagaatggaaaggagaggaaaaacaaagtgagaggaaaattaaggagagggagaaaaaagaaaaaaaaaagggagatggggggggaagaatgaaaaaggaaaaa

SEQ ID NO: 14086 - DNA, 507 bp, Zea mays
  Clone ID: LIB3279-234-Q6-N6-F6
actaagtatgggtccgatattttaaacaatgggagcagggagatattgccaagcacctggtttctgacagaaaaagaaaactaactcaacatcaaataccactaaaactggtggaagaatgataacattttttcagaaatctaagacctttagtaaattatcaagatttcatggagcatgtcgactctgcaccagttggcaatggcaatcacaaaactcagggggcttgaagctttcgcctagatgtaatgacaaaggaccatgatattcccaagaacaaataaagcctatcaagcaattgatgaatatgatccacatggatgtcattcaccttgaaccatgaaaacttaggtttcaaccacacactaatcctaaacatggccatttgttggggaaatttctgtgcctgaagtcatgactttctttttttaacactcaggggctacattagaaaagggatttttcaacactgtcaaaatatctgattttgaagctccacccaactta

SEQ ID NO: 14087 - DNA, 359 bp, Zea mays
  Clone ID: LIB3279-234-Q6-N6-F7
aaccacccaaaacaatagggcagggggggccacaaaatcgggccccgccggcggaagggggggtgggttatacaattataggggcggggggtcaaaaaaccaagaaattttgggcccgggggttagaaaacatccgccccccgaaaatttttaaaccaaatccttaaaattgggccagaaggggggggccacctttttaaaacggggctcgggcatttggaaggaaagggagggccgggtgcaaaatactggggggcggccttagcggggccctggtagggagcgatcaagacgggggggagggggtggaaaaggggggggtggggcccggggttcatgccggggacgatgacgagggg

SEQ ID NO: 14088 - DNA, 456 bp, Zea mays
  Clone ID: LIB3279-234-Q6-N6-F8
gtagaaatctcaccatccgtttctattttttatgaatcattgtgtacatccgacgtttgagccaacatgggaagacgctagccatctaccagcatgcatctatgtctacatctgaactaattattgactgccaaaattaaaatatcatggggagaagagaagccaagattcggctaactataaccgtggtcggagagatggtgctcttgcaatatgttacgtacattgtcagactccgcattcactggtaaaaaaaacacctcccggcttgaatccttatcaagaagtggtggtggacctcacaggcacttctttacttcagggaataccgggttttccgtattcgcagcttcaacatcatctattgaggcaacggcaaccacgaccccattgtccttgatggtttcaacagcatcagcgaactccttgaaatccttcgggcttgttgctagtatc

SEQ ID NO: 14089 - DNA, 386 bp, Zea mays
  Clone ID: LIB3279-234-Q6-N6-G1
aaaattaaaattttttttttgtaaaaaggagggtttttgttttttaaaatttttttttgggggggggggaaaaaaaaaccccttttaaaaaaaaagggggggacccaaaaaaaaaaaaaaatttcaaaacacgggagaaaaaaaattcccaaaagaaggggaaggggtaaaaaaaaaaggaaggggccctttaaaaaaaaaaaaagggagtttcccaaaaaggggggggtaaaaaaaaaaaaacaaggggggggccaataagaaaaaaaaaagaaaggacccacaaaaggttattaaaaaaaaaagggagaaaaagggaaaaaaaaagggggaaaaccaaaaaagaggaaaaaaggggggaaaaaaatgagaaaaaaaaaaaaaga

SEQ ID NO: 14090 - DNA, 571 bp, Zea mays
  Clone ID: LIB3279-234-Q6-N6-G10
gagaaatagaagattatatcagcactaagaggattgccacaacaaagtttatcatcaaacagagttacaaagcaatgtataaagtagccagcaaattcatggcgaggagtaccatccatttccacactcaaaagatgcaacacatccaaggagaaaaagatgatccagacaatgagaactcaagagttcaccctagaacaacttaaaacacgcaaggcacaactcctgctcaagttcaagactcatgatcctttctactcaatcagatcatcatcgtcatcaggaagaggttgtgcagctgctgcagcaagctcagcttcatgctgctgctgcatagccatgtcgatggtaacttccggaggcttaagagcaacagcttcaacaaagtgaaggttcggatcaccagccagcttccttgcgaggtacaggaaaggtttctcaaagttgtagttgctcttggcagaaatttcatagtactgcagattcttcttcctgtggaaagtaacctgcttggctttgacctgcctgttcttcacatcaaccttattaccgcagaggacaaatggggatg

SEQ ID NO: 14091 - DNA, 153 bp, Zea mays
  unsure (1)..(153): unsure at all n locations; Clone ID: LIB3279-234-Q6-N6-G11
cacaaggtaaaaccaaacaagcaaatttaataaacttcatnntaacaaannnctaagcttannatagtgtgggcgaccatttaaagtaccaagcanaccgatgtaacttcacattaaaaaaaaactatgtttccgcaattgcaattgttttcg

SEQ ID NO: 14092 - DNA, 497 bp, Zea mays
  unsure (1)..(497): unsure at all n locations; Clone ID: LIB3279-234-Q6-N6-G12
aggcatggtaccacatcacaattcaagctccacttatgaaaatccacataacatttataaaatgggaactactnatcctctcaacggaaccaatccaaataccagtcccaggtgggacgtactnnactagtgataattgacctgtgnatacatgccaagcatccccaaagcagtaaaagaatggagctgttttgggcagaaaaaaatacacctcgagtggtagccagtcacttagaagtaagcccccaacaatcacaatggagggggtgggccccccccaggaacctagtgggccattttttttgggaccccccccccccccgtggatatcaaagggggccccccttgacggggggttttaaacccccccctttttttcccccgggggaaaggggaaaaaaaacctttttttttttaaaaactccccccaaaaaaaaaaaaagggccccctcctcccttttggtggccccccccccttttttttttaatccccccca

SEQ ID NO: 14093 - DNA, 229 bp, Zea mays
  Clone ID: LIB3279-234-Q6-N6-G2
caaccggggaaaatacttcagttttacatcaaaaaaggcatgacggaaaaccctataataaataagttgactcccaggggattcataaaaacaaagccggttcattcatttggccgacgatgacgacatcatttttttacatcacaaacaaaacaaatccgggcaaactgcaggggcgatccatccacccaaacggtcaccctaatcaaaggggggatttggatttgat

SEQ ID NO: 14094 - DNA, 420 bp, Zea mays
  Clone ID: LIB3279-234-Q6-N6-G3
ctaatatacttcctttacatattacagttggggggatacagttacaatagttacagaaatgattacaactgtaagagcaaaaaccgcagctagcgtggtaaacaggggcagaattactgagttgccatgacaggggaggggcaacaaattggacaatagatttatttcacacacattactactagcgtacacaagatgtttttttcccggcttaggggaataggacgtactgtatttgagcggcatgccaatgcaacatttaatctcggggatttttgtcaaaccagttttaattgggggcaaaacactcatgtttccacctcattaaaggaatccacttgtttttccccaacccatgggtttgatggaaaaaatcacgcagccagcaacgggtccaagaatgagttcccaaaatttttt

SEQ ID NO: 14095 - DNA, 435 bp, Zea mays
  Clone ID: LIB3279-234-Q6-N6-G4
aacaaacaatgtgggcatgaacattatttttggaaaggggttatcacaaccgacaacgagcacttttttgccttggaaggccccccttcccttttgggggcactcgagtgcataacttgcccttaaagctatcgattcacagagggccaaacataataggctatacattctctttaggggcaacaattagccactttggttggggggggactctattattgagttttttggcccgggacttccttgtagagtaaaaaacaaacttttcaccattgtaatctttgatggggctggtggggaaaaaatccttggggtggatgccccggggaatcactattgtactcggggggaaccactttaaaactgaagaatgggcggatgtcgaattgaagcttacccccagaaataaaattaaccttttttagcagcttcccc

SEQ ID NO: 14096 - DNA, 557 bp, Zea mays
  Clone ID: LIB3279-234-Q6-N6-G5
acaaattcaccggagcaacatcaggtcatagttatacattcctaatttttctacaagtaccaaacatgagacgtacaaactcttcggcgtgttgcctgtaggcttcacttcccttcacccagattacggcaacaccggggacccttgtgctacggatcgctgcaaaggatttcggtgaagacggagagtgcgtcctgcaggtacgacgacctgctctcgtccggaactggagcgttgagcatcgttagaagacaccccatgggtaggttcagcgtctcgcttggggtgtccaccagaagcgcacatagctcctctgccatcttcgagtagcatgcccttgactcaacaggtaatttgcttccccagactaacaacgactcgtttaatcggccaaagaaacttctgcatgatttactcatctcctcgagtgaacccgaatcatccatggcattactttcttgcattgagttcttcaaaacgagaagtctacgtatattccggcaccaaggtcccagtcagcaattttatacttgtgggttcttcaaaggacttgggat

SEQ ID NO: 14097 - DNA, 323 bp, Zea mays
  Clone ID: LIB3279-234-Q6-N6-G6
ggccaggaagttgggcaaaaaccaacactttctgttctcattagcatcaaaggctaacatttaaatcaagttctcaaacacaacaactctgttagtacacgttccaacattgcatccaacaaaggcaaattcccacaatcacacgtgagggtccaggtgcccttgggacaaagactattatcattacaggatcctaatgctcaccaccagtagagtttagtcgtaggacacctgccgcgcacccaagcgcatccaaacctgctaaccttaaaacatttgccatcgaagggacagagatttgagaatgctcccggacgcgtggg

SEQ ID NO: 14098 - DNA, 605 bp, Zea mays
  Clone ID: LIB3279-234-Q6-N6-G7
agcctcaatccaaaatgtcattggtaaaaatgttggaagtgcagtatgttaaaagtaattaattctaaatttgacaacaccactcataataggaggtacatctttgcctattattgcatatgtttcttctcgccaagacgaacagatcagggatcctccaaacagaaagtaaacgcccttgcttatcgtcccataggaccaaaatcccccacttgataaatagctcaagaagcatcgatgaaaagaaagaaatcacatctttcttgaagtaaaacaacaacaacacagatgctctaaacaagctggcaaagctcactaagcacccatggcaacccttctgcccctcttgggcgtcgactgtgcattctctgccaagatcctagacagaatatctgcttgctttgagtatccttcggattttaagctctccatcaagtcatcgcagcctttctggctgacaacacctcctttgttcttgatcttgcacagcatggagtacgcaggcaacgttttttcttccgcgtacagggccttcaaaactctgtcatatgttcgaggagctaacattaaaatccctgtccaacccaaaatcagccagcttttgc

SEQ ID NO: 14099 - DNA, 499 bp, Zea mays
  Clone ID: LIB3279-234-Q6-N6-G8
ccagttgcagagaaacttgctattagtttccttcagattattcccatgaaagagagaaaaaaggaaaggcgaacagtggacactgacgcgttcggaataaaaaggtggcgccaaacaactccggcgacgacgagacacccgacgactacgaccacgacacgatacaacaccgggcggtgggggttattatgtaaaccaacgccggccggccactgacaacttcctggcgacggactcgccttgtttcacccggggcgggcgggcgggcacgtcatcagacggtgagcccgcgcatgaactcccactcctcatcgtcttcctcctcggcggcgccggcggccgaccgctccgagtcgctgctctcgccgccggacatcacggcggcctcggggtcgaacaccaggtacggcattgcgccgaatgccctggcgagggcggcggccgtggctccgtcggtcctctgcttcagcacctggtacattaccttgggctcgtgctg

SEQ ID NO: 14100 - DNA, 606 bp, Zea mays
  Clone ID: LIB3279-234-Q6-N6-G9
catgtaactttggtgcagccaaaattaatgtcactgcagttgcttatttgggtgtaaagtgtttgaacaacaaagagaaaaacaagcatctcagcaggagatggacctccaactcgtgctgcctaactgcgaaaagcataaacaatcgcttaaatccaaaaatggaacttgattgtacaggattcaacaagcaagaagccgccttatgaagcagactccttggcgattttctcggccttagcaatgacttcctcaatgcctccaaccatgtagaatgactgctcagggaggtcatcatacttgccatccaaaacaccctggaaactcttcacactttccttcagctccacatacttccctggagcacctgtgaaaacttcagcgacatggaaaggctggctcaggaaacgctgaatctttcttgcacgagcgaccgtcaacttgtcatcctcactgagctcatccatacccaagatagcaataatatcctgaagatttttgtagttctgaaggaccttctgaacaccacgagcagtattgtaatgatcctcacccagcacgtggggagaaagcattcttgatgtggaatccagtggatcgacagca

SEQ ID NO: 14101 - DNA, 341 bp, Zea mays
  Clone ID: LIB3279-234-Q6-N6-H1
gaaggcgccggaactgttcaattgacaaaaaaaaagaagtgaatgtgtggttacaattatgacgtaaaaaatcgacatgtctctctgactacaaaagcagtgaagagcttatttgcagcacaaccaagtcaaggggtgggtggggccggaaggtgctatctcggttatgcacttgagtctgcagcggttcccttggctcgctccgcttcgatcatagccttgatgtagaattcacctgccttgtacgaagaccggaccattggcccagacgcaacgtagcgaaacccctgtgccatttgcaacaaaagataaggcggttctgtcagcaacccccccccccc

SEQ ID NO: 14102 - DNA, 417 bp, Zea mays
  Clone ID: LIB3279-234-Q6-N6-H10
ggggacccacaaatttatgttttcacaaagattccccgatttgcttgcagaactaaatacccggcacattattttgatcactacgggtggcagaacaaaaacaaaagtttatttcccctggaaaagggtggcgcccacccgggggggggggtaaaaaggcaaagggaggttgcccaactggaacaaaaagcacaacatgtcgggggggcaaccaacccatttacccaccccctttgtgggctggtacacaactcccaacaatgctccaccaaactttggagatgcaaaaaagggaacttccaacccccccccttcaaatttaaaccggcccccggtttggggtggccctccaaaccgaaaaaaaagggccccctggaaccggccccctcaatttaaaaggcgacagggcaccccccc

SEQ ID NO: 14103 - DNA, 599 bp, Zea mays
  Clone ID: LIB3279-234-Q6-N6-H11
gagacggaacaaacaaataaaaccataagcaatagcacatcagcgaagcgaagcaaagcaaagcaaccagtaaaacaaaattgggtaggcagaagaaccagcaatgtttgagaaccaaaccagccaaaatactggaacagcaatatagtctgctcacgaccaaccaaaccttcgactcataacatcctgaacaagcacttcatctctggcctggttatatgatattgctattgttttgttagagctagcctgcagcttgttcattcaaaggcccactgattctccctcctcactttagcctcttcctcaggtgtgaagtcattctcgatgtcgaatgtctcgcgtatctcctctggagtcttccccttgatcatgtccgcgacggcctggcaggtcaggtctagcagcccattgatctccaggtagtctgcagccttaatgagctccaagagggtgaccaggtcaacatcgacgaactcagcatcaaaggacttgagatcgtccgctgaggccttgttactcgcagcacttggctccgcatcaccgccatcggcgcgcggcgccgaggcgtgcttcctgcagtacgcgatgaccttgtc

SEQ ID NO: 14104 - DNA, 351 bp, Zea mays
  Clone ID: LIB3279-234-Q6-N6-H12
ggggaacaaaaaaaaaaagaaaaaagggaacaaagggggggggggaagggggcggaaaaagaaggggaaaaaaaggggaaggttataaggggtggggaaagaaagggggacaaagaaagaacttttatggggagaaaaaaaggggggggaaaaaagggaaaaaaaaggttctaaaaaaagggggggggggggaccgaggaaaaccgaaaaaggaccaaggggaaaaaacggtgcgggaaggaagcaaaggagcgtaagaaattggtaggggatggggcccccggggggcgaaggggagacaagggaaccaaaggggaaaaaaggggggaaaacatggggagaaatgggaaa

SEQ ID NO: 14105 - DNA, 335 bp, Zea mays
  Clone ID: LIB3279-234-Q6-N6-H2
gggggggggggggggaccggggaatttggggggggggggggggggggaccaagttttttttttgggggggggttttagaggggggggtaaagggggggaagggggttttgggggggaaagtgggtggggtttaaaatttgaaaaaaaaaagggggggggggtttaagggggaagggggggggggccaaggggggggggtaagcgaaattattgggggtggggggagtgggcctttttgaaaggggaaaaattggtgggcgaagtggtgtaaagaaatggagaaaaggggggggggggggggtgtggtgtttgggcgccggggggggttgtttttt

SEQ ID NO: 14106 - DNA, 493 bp, Zea mays
  Clone ID: LIB3279-234-Q6-N6-H3
aacagcgtaaacacatctttgaaacaaatttgtcctcagaaaataacacaactacacaagtttttgttggtattacacggggaaaacaaaaatggataataaaagagtaaaaactacacaaatacacgaaagattggaaattggctaataacattgcactagctcataagtttttaacacgactgttgttcctgcttttgctttgagtgctcaccttgccaagcccacactatttccttgagtgcgggcctcatttcttggttcaggaccttttgatactctagagtgtcgccattcgtcttctttatctccacaagatggaagttggggctaacctataatcattcggcatcgatacccattacccttttccttccgggctttgaagcttccatctttaacaagccaccatccttttttgtcaaattcaaccgcaaattctttgcactatcttcgatcttcaatataattgtcgagcttgtgttggtagatg

SEQ ID NO: 14107 - DNA, 524 bp, Zea mays
  Clone ID: LIB3279-234-Q6-N6-H4
gagccatgcttccgtcgtcaatcaggggggccaggtgaccatttcccacgcaggggctctaatcgatcacccaggctgctgacgacctaatgccacgctgcgttttctcatgcgctgctcttcattccgtcagctgtgttgccggagaaagcccagtgcggcttggccagggttcgcttcgtagccttcactgacagtgacagtgggctgtccttgcccatgaggcaggttccctgcctgacgttgcagatggggtagtcatgggggcagcagctgtagtgatcgtcgcagcaggtggcgccctcgagcgggcagcagccccaggcgaagcagtacttaccgtactcgtagatacagcagcaggtggtgctgtcagggcacgagtagtagttgtcgcacacggagggcgccggggtcggggacggcgggctgggggccaggttcggctggttggcgccctccttcacgggtatgacggctcaaccgcgatccgcacttgccgctggacgccttgatgttgggct

SEQ ID NO: 14108 - DNA, 405 bp, Zea mays
  Clone ID: LIB3279-234-Q6-N6-H5
gaaggaacaagggccttcattaatttcggacaagggcagtcgctttccattcagagagggcaacacatccaccaaaggccccacatgaaatgaacccaccatccttttcaaacattacaacgacgaacaggagcgcgacagctcaagccctctcgcccctgatgcggcgggcgaactggatgtccttgggcatgatggtgacccttttggcgtggatggcccaaaggttggtgtcctctaaaagccccaccaggtacccctccgcggcctcctgcaacgccgccacccccgacaactggaaccgaaggtccctcttgaaatcctgcgcgatctcaaaaaccaagcgctggaaggggagctctccgataaacaactccctgctcttttgggacttgcggacctccc

SEQ ID NO: 14109 - DNA, 552 bp, Zea mays
  Clone ID: LIB3279-234-Q6-N6-H6
ggcagaaagagtgctttattcttaaattgcatcagtgttctatacaatgtgaaccatctattctgcattttcttgcacaaatttaagagtaataactctgtaatggatacaatgtttgcaagaatgagccatcatggaatcacatggaccgtactgatcagaacatcttaccagtgccatctttgcgtggaacagaatcttcaagatccattctgcgccagctcccagccaaagatgacaactggtcagccttatcatacaacccaagaagaccacctgtgtggataaacagaacttttcgacctttccatttggctggattgccagccatgtcttttagcaaaccataaaccgccttcccactgtagactggatcaaggacaatgcctgttgatgcagctatgtctttgacaaacttaagctcctcagctgtgttcatggcatagcctaaccccttagcattttccatgctaactatatcatgtgaatcgaaaccaggattaagtccatcaatcaagccttggacatagtcataaaaatattcagggtcat

SEQ ID NO: 14110 - DNA, 382 bp, Zea mays
  Clone ID: LIB3279-234-Q6-N6-H7
aaaagatcggttccgatgacctcagaccacagaacaatagtaatcggtccagggcaatgcctctgtggacactgtcactgaaagcttcacatggttcacggcatccacaaaatcaatagacagagaaggtacgtcttacgcacaaccttttagcccaaatgtaccatttatacacctccgattccaatacccgacagactccaagtcactggatctagacaaatcttgtcttaccacccttctcatgcttcttcaccactttgaatgttgactgcagcttgcttagctcaaccgggcattctcccttctcatcatactcagaaaattcatcttcagagcagtcaatttcaaaaggagtcccatgcacagactcagccttcca

SEQ ID NO: 14111 - DNA, 456 bp, Zea mays
  Clone ID: LIB3279-234-Q6-N6-H8
gtagaaatctcaccatccgtttctattttttatgaatcattgtgtacatccgacgtttgagccaacatgggaagacgctagccatctaccagcatgcatctatgtctacatctgaactaattattgactgccaaaattaaaatcgcatgggagaagagaagccaagattcggctaactataaccgtggtcggagagatggtgctcttgcaatatgttacgtacattgtcagactccgcattcactggtaaaaaaaacacctcccggctagaatccttatcaagaagtggtggtggacctcacaggcacttctttacttcagggaataccgggttttccttattcgcagcttcaacatcatctatcgaggcaacggcaacgcacgaccccattgtccttgatggtttcaacagcatcagcgaactccttgaaatccttcgggcttgttgctagtatc

SEQ ID NO: 14112 - DNA, 402 bp, Zea mays
  Clone ID: LIB3279-234-Q6-N6-H9
ataggcgaggaaataattacttaaaatatgtagtatttgatttggtacaaactaggccaattaagctcagggcaaatataaagcaaggcagaactcggacaacctattccaggatgtcctcgtcaatctcgattgaaatgatctccccatcatcgaactgatccttccttggaggagcaggaggggcaaagagccgcgcaggcccagttcccttcttcttgttgcgcggcctcgcattgccatatgaatggttgaaccttttgccccttttcgttttcttgtcccctctcccgcagtagacgtcaagaactggagtgacggtggccgacaagacggtgccgacggcgaacgcagctcgggcgcgggggaaggcggcggaggctgcgagcgcgtaagaggagg

SEQ ID NO: 14113 - DNA, 653 bp, Zea mays
  Clone ID: LIB3279-175-Q1-K6-A10
ggacttccgcaagctattggtgccacttgtaagtacttaccgctatgatggaccagaggtcaacacaaggttggcacactcagaagccaaactacttcatgagaagatccatcacaaggcttacagtgatgatgagatcatcagaatcctcaccactaggagcaaacctcagctgattgctacattcaatcattacaatgatgcatttggccaccgaatcaacaaggatctgaaggctgacccccaggacgagtacctcagaacgctgcgggcgatcatccggtgcttcagttgccctgacaggtactttgagaaggtggctaggcaggccatagcggggctaggcacagatgagaactccctgaccagggtcatcaccacccgcgctgaggtggacctcaaactgattaaggaggcgtaccagaagaggaacagcgtgccgctggagcgggccgtcgcgggggacacctccggcgactacgagagcatgctcctcgcgctcctggggcaggagtgatgagccgtactggtgcgctggtgcctttctgaccggcgccgtggtgtttgttcgtgatcgtaataaacctgattgcctagctgtacgtgaggctgtttcttcggtcctggtactgtcgctgcagcatgcatagcag

SEQ ID NO: 14114 - DNA, 530 bp, Zea mays
  unsure (1)..(530): unsure at all n locations; Clone ID: LIB3279-175-Q1-K6-A11
attaggaattccaaanaaactataaaggaagtagagaattcctaatgaagcatcttcttatcagccatccccgcccaactccgacgacgaattaggagtgccccgaggatccttccttcgcttcgacacccttggtatcttccccgatccacaatgaatcccctctgactacccaccgaggtcggggaacggctcgaatgaaaccccgacgcggcagctctcctttctcggcgtcactcacaactaacgacgactggactcactcgatcgctttcggtcaggagcatggaggcgcggggcaggggatatttatacaaaatactactactctcactatcccgaatgcaattctagcacaatatcatggtgtagtatcttatgtttgacaaaatatagataaaaaatcgaatcgctatgtcaccacaattgtattactgtcctgtaccaacatccgtgacaaaaaatagttttatgaggttgtacatgttggaaaattaatatggtctaacaataatttaataatgtagtat

SEQ ID NO: 14115 - DNA, 582 bp, Zea mays
  Clone ID: LIB3279-175-Q1-K6-A12
ctgccccgccatggcacagctcctctccataccctgtactacaagcgattcttcccatattacgccttcaatgtgctcggtgggcttgacagcgaggggaaaggatgcgttttcacctatgatgcagtaggttcctatgagagaaccggttacagtgctcagggaacgggatctactttgatcatgccagtcctggacaatcaactaaaatcaccaagtcctctattactccctgtcagggatgctgtcacaccattgtcggagtcagaggccatcgatctagttaaggacgtgttcgcatctgcaactgagagagacatctacactggagacaagttggaaattgtagtcattaacaaggccggtactatgcgcgagtatatcgacctgagaaaggattaagccaacacttcagttgtgctgcagctgtcatttgctttgaactttttttcctagtctggtgatttatgtctaaagctgttgcttcataggaacacttgtgtttacttgcatatgtaatgtacggtatgtaccaggattcagtgagttttttttctgttgaaacaaattgcttggatactg

SEQ ID NO: 14116 - DNA, 401 bp, Zea mays
  unsure (1)..(401): unsure at all n locations; Clone ID: LIB3279-175-Q1-K6-A7
ctgtattccgtcactaccagnacatctcggacctccccccgcatcgccttcaagagatccgccgcttttttgaagattataaaaagaatgaaaacaaagaagttgcagtgaatgatttcctcccagccgaagatgccatcaaagcaatcgagcactcgatggacctgtatggctcgtacgtcatggaaagcctgaggaggtgatctgctgctgcttgattgtggatgctacgtaattttctcaacagctcatcgagagtaccgtagtccgtagtacggcaaatgttaacacgcacgaactggaatcatgaccaagggatattaccttctgttcatgctgaaacgatcagcagtttctttctttgcatcatatgccacgtcaaatcaaggcacttgcctctg

SEQ ID NO: 14117 - DNA, 672 bp, Zea mays
  unsure (1)..(672): unsure at all n locations; Clone ID: LIB3279-175-Q1-K6-A8
gttccctgcntgcttcccacgccgtctctaggttcgttcgttccacgtcgccggccacccctgtccacagccgcgacaaactcttcctcagacccacgccacgtacgatgcctctctccccttccctttcccctccgcccaacgccaccgccgccgccgccgccgccctacccctcctcctgctgctcgtctgcgccagcagcattgccgcgcagccgctggcgtcgtcgcaggccaaggcgctcctccgggtgcgccgcctgctgttctacccgccggcgctcgagccgctgcgcggggcgccggacccctgcgcgctgccgcccgcgccggccctcgccgtcgcctgcgagggcggccaggtcacggcgctctccgtcctgggcgaccgcgacccggacgcggcctggcgcgccgcgctgccggccagcttctcctccgaggcgctgttcaccacgctcaccaggctcccggcgctcgcgcgcctctcgctcgtcggcctcggcgcctggggcccgctcccgggcgccaagctccgccggctccaggcgctgcagcagctcaacctcagctccaactacttctacggcgccgtgcccgatggcctcgcccggctctactcgctgcagagcctcgtgctgtcctggaactggctcacggcaccgtgccgtc

SEQ ID NO: 14118 - DNA, 640 bp, Zea mays
  Clone ID: LIB3279-175-Q1-K6-A9
tctttgtgttggaaacagatggacttctattgccacatactacaaccgaccaagagcttcagcatctgaggaattgcttgcctgatcaagtggtggttcagcgcattgatgagaggttatctgcccttggcaattgcatagcctgcaatgaccatgttgcacttacgcaccctgaccttgacaaggagactgaggagttcattgcagatgtgcttggggtcgaggtgtttaggcagactattgctggaaatatccttgtggggagttactgcgccttctctaacaggggtggtttggttcatccccatacatccgttgaagaccttgacgagctctccacgctcctccaagttcctcttgtcgcaggaactgtgaacagaggaagcgaggtcattgctgcaggcatgacagtgaacgactggactgccttttgtggctcggacacgacagccaccgagctctcagtcatcgaaagcgtcttcaagctgagagaagggcagcccactgcgattgtggaggacatgaggaagtctctgatagacagttacgtgtaactggggggccagcagatgtgggtcagagtttgcctttgctaaaaaatgtattgcaagctatagtcgaattatcagtagcacaacat

SEQ ID NO: 14119 - DNA, 664 bp, Zea mays
  unsure (1)..(664): unsure at all n locations; Clone ID: LIB3279-175-Q1-K6-B10
gtggactcgggggctggccggatttctctcattagctattacaaagataggaccgaaatcccctccgtgattgccgctcgccgatggctacaaggccagccgactgtgtttccccccgcctatcgatctggatacaccaccactcgacgcagaaaaagtcgatggcctcgccatggccatgagttagtaggagagagagtacacgagcgttgccgccgggagagtgctcaacggagtcgtgtactggacgttcagggacttccctgtgcgtgagggtggagcggacccggaccctcgccgggcgttgaaggctgcgcgggcgccgtcgtccggccgtgtcgcggacctgggcgtgcttcgaagggcaccgcggttcggccttgccgtcttgatcagccgtgaggtcacgaggatttgaagaatcaccctggtaactggaatctcaagtgccagtgtaccacactgcataaaattcagcagcagcgacggcggatcttggaggagcgcacatggcgtggaatcccggaggcgcgcgccgcggagtggcgcccgctggcgtcccccctcccgcgacgacgttgaccttccctaggcgcgagcgacgatgacagacttccctgnacggcgagcggtggcggaccgacgaccttgttttatgctatct

SEQ ID NO: 14120 - DNA, 661 bp, Zea mays
  unsure (1)..(661): unsure at all n locations; Clone ID: LIB3279-175-Q1-K6-B11
ggcatctccaatctcctcgccccccacgnacctgaaccgagaacctttaccgccgccgcctctcgcctagccgccggagaagcgccgctcgctcaggaggacagccatggcgccggagccggaggatgatattatgaacgagaagaatccccgcccgctcgacgaggatgacatcgcgctcctcaaaacctatggactggggccgtattcgaccagcattaagaaggtcgagaaggagatcaaggaaatggccaagaaaatcaacgacctctgtgggataaaggagtctgatacagggctggctccacctagccagtgggatttggtttcagataagcagatgatgcaagaagaacaaccgttacaagtagcaagatgtacaaagattataagccctaatacggatgatgccaaatatgttataaatgtaaaacaaattgcaaaggtagcaagatgttcaaagattataagccctaatacggatgatgccaaatatgttataaatgtaaaacaaattgcaaaggagctgatataaggagcgtttagacagaagccaggatgtacgccattcgtgcccgcaggaaaacggtgacagaaaaggattttctcgatgctgtcaacaaggtcatcaagggctaccagaagttcagtgcaacaccca

SEQ ID NO: 14121 - DNA, 245 bp, Zea mays
  unsure (1)..(245): unsure at all n locations; Clone ID: LIB3279-175-Q1-K6-B12
tttttcgcgtgggcagcgaggtctttctgaaaccttcctagaggacgagactcagtaatcttgccttcctgtattgcgttgttgctgattcaaaggattttaccctctgtattttttttttcgtttaccctttgtgggcctttttggtggtttgaaggtggggtagtggttagtagactctttctatattccgattcatgctcatgtttatgtgactactataatggtatatacaatattgtntt

SEQ ID NO: 14122 - DNA, 661 bp, Zea mays
  unsure (1)..(661): unsure at all n locations; Clone ID: LIB3279-175-Q1-K6-B7
ctagttctagatcgcgagcgatctagaaccctagcccgccccccatggacgatccctcctccgcctccaacaagcacaagcgcaagcgggggcgcaagcccaaggcgtcgccgccctcccccgaccgctcctccccctctccctcggccgcgcccgctccggctgggcgccgtggccgcaagccgcgacgtcatgagtcccccgccgacgcggacgccacgcgtccgccgtccccgccccgccgcggggagccgaagccggtggcaaacggaggcgatgtggtggcagtggcggagtcaggccccgcgagctgggatgaggtggtgagggtagtgccgtgcatggacgctgtggtcaaggtgttctgcgtgcacacggagcccaacttctcgctgccgtggcagcggaagcgccagtacagctccagcagcagcggatttatcatcagcggtcgccgtgtcctcaccaatgctcactccgtggagcactatacccaggttaagcttaagaagcgcggctccgacaccaagtaccttgccaccgtcctggccatcggcacagagtgcgacattgcgctcttaactgtcaatgacgatgaattctgggaaggagtttcacctgttgagtttggaacattaccagccccttcagagcagntact

SEQ ID NO: 14123 - DNA, 676 bp, Zea mays
  Clone ID: LIB3279-175-Q1-K6-B8
gtcaggagaggcgtttccctcgcaatcgaccatcacagatcaaatcgctgcaactagctagggtttcgtcgcctcatctctcgtcgatccatcgatggcgtccgagggcgacaacaagaggatgatcacgctcaggagctccgacttagaggagttcgaggtggaggaagcggtggccatggagtcgcagactctccgccacatgatcgaggacgactgcgccgacaacggcatcccgctccccaacgtcaactccaggatcctctctaaggtcatcgagtactgcaacagtcacgtccacgccgccgccaaacccgctgactccgctgcctccgagggcggcgaggacctcaagagctgggacgcgaagttcgtcaaggtggaccaggctacgctcttcgacctcatcctggctgccaactatctgaacatcaagggattgctggacctgacctgccagacggttgctgacatgatcaagggcaagactccggaggagatccgcaagacattcagcatcaagaacgacttcacccaagaggaggaggatgagatccgcatggagaaccagtgggccttcgagtgattgttgtcttcctttccctggtgatggtggtggttcttttacaagacagatggatgtctgcactgcactctacaatgctagtctatctac

SEQ ID NO: 14124 - DNA, 511 bp, Zea mays
  unsure (1)..(511): unsure at all n locations; Clone ID: LIB3279-175-Q1-K6-B9
cccagcgtccgcccacgcatccgccgagcaggcctcctttgccatcatccgcactgcacactaatgttccaaccgtgcaacattgttcctgtatccagctgtatgatagttactgagcatagggtattttgttttgcacgcggatctactgattgggcggccagcacaactcttggtttgggcattcagaatacactggtttagacttttcaaaaaaaaaaaaannaaaaaaaaaaaaaaaaaaaaaaaaaaaaaaaaaaaaaaaaaaaaaaaaaaaaaaaaagaaataaaaaaaaaaatagggtaagctaaaaattatataatatgtacaaattgtttacggtgtaagtttcttgaaaaaaaagggggggccccccttttgggtccccttttttctcttcccgctgtgccccttcttttctttttttttggggggccctttacccccttccctggccggggttccccccccctccccccggaaaaaccccggccctccccccttttttcc

SEQ ID NO: 14125 - DNA, 624 bp, Zea mays
  unsure (1)..(624): unsure at all n locations; Clone ID: LIB3279-175-Q1-K6-C10
tgagtttgtgacagtggttttctctgtgccgccttttgcaggggaagggggtctgggttgcgtacaggcgaaaggcacgcgccgccgctgccgcgcgagcctctccgtccccatcgccgcgcagatggatccgtcgtcggagcccctgtacgcgcaggtcgagccgtacgactccgggttcctcaaggtctccgatgtccacaccatctactacgagcagtccgggaacccgcagggccatgcggccgtgtttctccacggcggtcccggagccggcacgtcgcccggcaacaggaggttctttgacccgcagttctacaggatcgttctgtttgaccagaggggtgcaggcagaagcactccccatgcttgtttagagcagaacactacttgggacttggttgctgacattgagaagctcagggagcatcttggcatccctgaatggcaggcaattatcttctttttcaacaacactgattactcactcttcagtgctggaactcaatgctgccagacaatgtangtgtttggtggttcatggagaagcaccttggcacttgcctacagccaggagcaccctgatnaggtcactggcctttgtctgagaggaaatttcttgct

SEQ ID NO: 14126 - DNA, 250 bp, Zea mays
  Clone ID: LIB3279-175-Q1-K6-C11
cccacgcgtccgggcggcggctattctatggctgggagccgctacggcagtggcactggggcttggagctcgcacgatccccatggctacccgcatctttaactgtgcttctgaccggtgtttcctcctgaacagctccctgagtaccttggctaagtttcttgtagtagtataacttgtggtgcaccattgctacccttcctctggtcaatacacaacaatataccaactttggttgtcttggttgttt

SEQ ID NO: 14127 - DNA, 545 bp, Zea mays
  unsure (1)..(545): unsure at all n locations; Clone ID: LIB3279-175-Q1-K6-C12
cgatcctaatccatgcgaaataaaacacacaataatgcaacactggccgtcccgcactgtgcgtgacagcatataaacgatgatggtcgatgaatgaccacgcgatcgagtacatacgtacgtacgtacagtgtgcttggtgaggactagtagcagctagctcctagttccgattcttgatggtggggcgagcgttgagcgtgatcttagcatttgtgcgcggcacgataacgacgtcgacggttttatcgccgtcagcgtcgatatcgaacagcacttcggtgatgcacagggagagcttcactttccgcgtcttcccggcgccggagcccggcccgacggctaagcttccggcgtactccttgtcctgtggttttacctgcaacgctttgtccgcgggcaggttgttggcgacgtcgaacttattgttcgcctgggggtcggtcttgatgccctcgctcaccagcagctgcttctttcccgggtccttggcccgcncatgcacggtcggttccttctcgctctggcccttggttgggttctgc

SEQ ID NO: 14128 - DNA, 656 bp, Zea mays
  unsure (1)..(656): unsure at all n locations; Clone ID: LIB3279-175-Q1-K6-C7
cggacgcgtgggcggacgcgtgggtgctcttcaacttcggcgactccaacagcgacacgggcggcgtggcggcggtcatggggatccgcatcgcgccgccggagggcagggcctacttccaccaccccacggggcggctctccgacggacgcgtcatcctcgacttcatctgtgagagcctgggcatgccgcacctgagtccgttcatgaagccgctgggctccaacttctccaacggcgtcaacttcgccattgcagggtccacggccatgccgggagtaaccaccttctcgctggacgtgcaggtggatcagttcgtcttcttcaaggagagatgcctcgactccatcgagagaggtgagagtgccccgattgttgagaaggcgttcccagatgctatatacaccatggacatcgggcacaacgatataaacggtgttctccacttgccctatcatacaatgctcgaaaatctccccccagtaattgctgaaatcaagaaagccatcgagaggttgcacgagaatggagccaggaagttctggatacatggaacgggagcattagggtgcatgcctcagaagctntctatgccgagggatgacgacagcgacctcgatgagcatggatgcatcgcaagcattaataatgtctgc

SEQ ID NO: 14129 - DNA, 426 bp, Zea mays
  unsure (1)..(426): unsure at all n locations; Clone ID: LIB3279-175-Q1-K6-C8
ccctcgcgtccgcggacgcgtgggnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaattattaaaaaaataaaaaattttataaaaaataaataaaaaataattaaattttattttattttaaggggggggggccttttttttggtgatccaattttccctgctcggatcttgggagaactttttcttttttttttggtggttgccattttagtttttttggcctttgtttttcccccgttccaaattgggagaacccctgggagttgcccctttttatatggttttgaaacttttctttttttttggggggggctttttttaaggggtttttgcccggttcctttttccaaaatc

SEQ ID NO: 14130 - DNA, 655 bp, Zea mays
  Clone ID: LIB3279-175-Q1-K6-C9
cggtcgcgtgggcggacgcgtgggcgaacttagccttttggcgcctcaaaaactacacctctccggtgtatatctggatggcagtttcatgaagcatgtcagttcagggtgcccgtatttggaggttctcgagctcaaagattgcccgtgcacatttgaagaggtcacatcccacacactgaagaacttgattctggaaaattgcggatgcaatgagctttctgggattacatcacccacgctgaagagtttaacaattattgctagtggatattaccacataaataggctggttttgaaggcccctgctgttgcttatctgctcctggatgtgaatgcttattttgttaaacgcgatgtttcatttgatgagatgtcatctcttgccaaggcttcaatttatctaagggacagtgtaggaagtggactcagcaaggaccaattcaagcttctttgtagtgtgtctaatgtgacaactttggtgttgtcaggtttccagacaatggtgatcagtgaagaattcccagaattccataaccttttgaccttgttattggaaaaatgtgatcttactgacaacttccagatgttggcaaactttcttcagcattcacctgatttggagaagctactttgggccgttgcaagttctcaa

SEQ ID NO: 14131 - DNA, 635 bp, Zea mays
  Clone ID: LIB3279-175-Q1-K6-D10
cgtccgtcccctagtccctacgaccctactccctaccgcacgccaccgcccaccagcgccgccgaggggcaaggccgaaccctcctccgttcgccgaggcggagcacgcccttccaggccagcttccaccggagcaagagctaagtcgcctcgaattcttcccagctagtagcgtgtgccgtaccccgtcgctcaaccgggatggcgtcgagtggggatccgcccggatctgctgatgagaagaaaactccaatatccgaagggtcttccgacgaacgtcaagggcttcctccagcaggcttttcaaatccttttgattttggttctatgcaaagtttgctcaatgatccatctattaaggagatggcagatcaaattgcaagggatcctgcattcaaccggatggctgagcagctacagaaaagtgctcaaagcacaggagaacagggcacacctccattaaatcctcaacaatacatggaaacaatgcaaaaggtcatggaaaacccccagtttatgaccatggcagagcgtctggggaatgctcttatgcaggatcctgctatgtccagtatgctggaaacctttagtagtccatcacataaggagcagctggaagagcgtatgtctcgcat

SEQ ID NO: 14132 - DNA, 677 bp, Zea mays
  Clone ID: LIB3279-175-Q1-K6-D11
tttcaaaaccggatttgcgaaccacacctagcagccgaggttagcacgcgtcctgcgtccatggaggacgaggagcacgaggtgtacggccaggagattcccgttgacggcgaggacgtcgacatggctgccggcgacgatgccaccaagctgcaggaacttgacgatatgaagcgccggctcaaggaaatggaggaggaggccgccgcgctccgcgagatgcaggccaaggttgccaaggagatgcaaggtgtagatcccaatgcaaccacatctgaaaacaaagaggagatggattctcggtcagtattcattggaaatgttgactatgcgtgcactccagaagaagtgcagcagcacttcaattcttgtggaactgtcaacagagttacaatcctgactgacaagtttgggcaaccaaaaggttttgcttacgtggaatttgtggaagttgaagctgttcaggaagctatcaagttgaacgagtcagagttgcacggtcgccaactcaaggtggcaccgaagaggactaacgttcctgggatgaagcaaccccgcggtcgaggtttcaatccgtaccatggccacccctacatgaggccgtatggttatagtccttatggttatgggagattccccagattccgccgcccgcgaagaccttattttgaagctcg

SEQ ID NO: 14133 - DNA, 537 bp, Zea mays
  Clone ID: LIB3279-175-Q1-K6-D12
tgtttcttccgcctccgcctccgcctccctggggttttgctctcggctcgtcggatccagttcgggggatcctccatggcgtcgcgtccgtcgctgaagtcgaagcccaagggcaagggcgggaagaaggccaccgctgacgacgaggacgccaccgcggcggcgaccacggtgaggctcatgaaggagtggaccacgtggacgatgaagaaggcgaaggtggtggcgcactacggcttcatccccctcgtcatcgtcatcggcatgaactccgagcccaagccctccgtcttccagctcctctcccccgtctgatcggatcatgacagggcccggatgaggtcggtccgtagtagtttgtagctggtacttcatttgcttacatatgtccgagatcgagttgaagaaggtggatcatgctttctgggcgaatttgaaggatttggtttaataattttgtagtggcggatgtcttctatacatcggatcaaaaatgtcttggttatgtgatctgcagtgcttatgattgtatgaact

SEQ ID NO: 14134 - DNA, 451 bp, Zea mays
  Clone ID: LIB3279-175-Q1-K6-D7
caaggaggaagaggaggaagacgaagaggagtctgacaagtccaagtcggaggtcaatgacgaggatgacgaagagggtagcgaggaggatgaagatgatgacgagtgatggagagctcgctcgagacaatggacggtgcttcatccaacaatggagcggctacacaaggccccgtggcgatcaaaaaaaaggagcctatatccatgtactagaattattcagtttcactccacatcgtgatgttttatttttacttttgtcgtgctataacggatagcgctcctcgttggcgccactggcgggtggttctgcctctggtctggtgtgtttgtgtgtggtcacacttgccagctagcagaggcgcctgcttgtacctagattactgtttccattgtcgtcgtcatcggctaacattgtcataatgtcagtttgggtaatgttagattaagt

SEQ ID NO: 14135 - DNA, 675 bp, Zea mays
  Clone ID: LIB3279-175-Q1-K6-D8
gtcgcctcagcttgcccctcctccaagcgtccaagccccacccggccattgcctcctcctcctgccggctgccgcaggcacatggcgccgaccaggcacgcggatgagggcgggcagctccagctcatagacgccgccagcgtcgacgaggaggaggagtgctttgagtccatcgacaagctgatttctcaggggataaatgcaggagacgtgaggaagctgcaggatgcagggatttacacttgcaatggcctaatgatgcataccaagaagaaccttacaggaatcaaaggtttgtctgaagcaaaagttgataagatctgcgaggcagcagaaaaacttctgaaccagggcttcatgacaggaaatgatctccttctcaagcggaagtctgttgttcggattacaaccgggagccaggcacttgatgagctgcttggcggggggattgaaacactttgcatcacagaggcattcggggagttccggtcagggaagacccagttggctcataccctatgcgtctccactcagcttccaatccacatgcatggggggaatggaaaggttgcctacattgacactgagggaacattccgaccagagcgcattgtgccaattgctgagagatttgggatggatgccaatgctgttctcgacatatcatatatgctc

SEQ ID NO: 14136 - DNA, 664 bp, Zea mays
  unsure (1)..(664): unsure at all n locations; Clone ID: LIB3279-175-Q1-K6-D9
ttcggntccgcctcctggctgccgcttcgcagctcctctctctgttcttcctcctcctcctccctgcttgtgatgccatctactgcgacgaagacgactgctacgacctcctaggggttaagcaggacgcgaacgcgtcagacatcaagaaagcgtactacaagctctctctcaaacaccacccggacaagaatcccgatccggagtcgcggaagctcttcgtcaagatcgccaatgcttacgagattctgaaggatgaatccactagggcgcagtatgactttgccattgaacatccggaggaggttttctataacacagctcagtactatagggcatactatggacataaaacggatcctcgtgcagtgttgattggtcttcttctaattgtttcagcatttcaatacattaatcagctaacgaggtataaccaggccatgaaaagtgtcaagcaaactcctgcttacaaaaataggttaaaagctttggagtatgagcgaacaggaggaattgctagcaaaaagaaggcatcaagcaggtggataagaaagttgaagaagagctaagtaatgaagttgaattgcaaattcatggggttgaaaaaccgtctgtttggaggctgtttggtgtccaatntatactttggccttactctgttggc

SEQ ID NO: 14137 - DNA, 660 bp, Zea mays
  unsure (1)..(660): unsure at all n locations; Clone ID: LIB3279-175-Q1-K6-E10
cggtcgcgtgggtgactatctaacgccacccctagcaaaagggaagcccttgccctcatcatcttttatcacattgggtaagcactcttctcatatcctggcccaccttgcatgcccccctagttccccatcaccctgctactatcgcatgaatacaaacaacgtattgggttgaagcatcaggaagtattagaaacatgttggtgattaaatccttctattttttaaaaccacaatttcatggtagttcccgatatgcatatcacaacatttcgcagtatccttccatgtcgaatatgggtacaacagcctacctcacgtatcagtgaaacctagattttcatcactcttagctcttgctcaaggcagatagagaaggaagaataaatagagttaaagtatgtccaagtgctccaagtgtttaccatcttttatttactcatggttctttgatcctcgttggtgcaaatggacaaaacgctttgcagctaaaaagaattcttagtttgtacgagcaatgctcgagccaaatgatcaataaaagtcaggtctctttttcagtcaacacacaaaaatagaaatgtaacaaagtagtgcgggctctagccgagcttggctcgaangccattgtgttgccagtcctattattgatgtaatccc

SEQ ID NO: 14138 - DNA, 682 bp, Zea mays
  Clone ID: LIB3279-175-Q1-K6-E11
gtctcctcttctcttcacccacacgctggtcatagagatgtcggctgcagaggcgaaggcggcggcggtcccggagtctgtgctgcggaagcgcaagcgggaggagcaatgggcagcggacaagaaggagaaggcgctcgcggacaggaagaaggcgctcgagagccgcaagatcatcttcgcccgcgccaagcagtacgccgaggagtaccacgcccaggagaaggagcttgtgcagctcaagcgtgaggcccggttgaagggtgggttctatgtgagcccagaggccaagcttctgtttgtggttcgcatccgtggtatcaatgccatgcaccccaagacccgcaagatcttgcagctcctgcgattgaggcagatcttcaacggtgtcttcctcaaggttaacaaggcaaccattaacatgctgcgcagggtggagccatatgttgcgtacggataccccaacctgaagagcgttagggagttgatctacaagagaggttacgggaagctgaacaagcagaggattccacttagcaacaacagtgtcatcgaggagggcctcgggaagcacaatatcatctgcattgaggaccttgtccacgagatcatgacggtgggcccgcacttcaaggagccaacacttcctctgggccgtcagctgaagcacccctcgcgcctc

SEQ ID NO: 14139 - DNA, 625 bp, Zea mays
  Clone ID: LIB3279-175-Q1-K6-E12
tcaacagtacgctcctccggctccaggagccggaggtgctgctgccctaggcctctaccagaagcgaccaggcgacaagacgcagcagcagcaacagcagcaggcatcgcaccagcagaacgccatgtcagctgccggcggcaataacgtgaaagcactccatccttcatccggcgggtttatgcatctcgcagcccagtctgcaggtggcatggcgcacacccacgtgtcggcggggcaactgactttcggaacaatgccgacgcctttaaaaccgtcaagcgaccagaagcctgctgccggaaaataaacagtccagacgaccatgcatcggagtggtaaacctgaactggtttttgcctgttcagcggaagcccaaatggcagaatcgcaacaacagtagcagcggcagctcaaaagaacccgcgtggaagctcaaatggcccgcttggttgctggtgatgaggaaggaaggaggggtgccgtgcaccagttcgttccgagcaagaagcagatgtctcgttaacttaaaacagagtattcagattccggaatggttgaggggggagtggtacttcttttgtgtagttggggctggttatcctcccatggtgtaaaggccgcg

SEQ ID NO: 14140 - DNA, 576 bp, Zea mays
  Clone ID: LIB3279-175-Q1-K6-E7
cccagcaccagtccccaattatttggcctccgtcagagaggggagaaagacccgttcgaggcggcggcgatgtcggggcgcggcaagggcggcaagggtctaggcaagggtggagccaagcgccaccggaaggtgctccgcgacaacatccagggcatcaccaagccggcgatccggaggctggctcggaggggcggcgtgaagcgcatctcggggctcatctacgaggagacccgcggcgtgctcaagatcttcctcgagaacgtcatacgcgacgccgtcacctacaccgagcacgcgcgccgcaagaccgtcaccgccatggatgtcgtctacgcgctcaagcgccagggccgcaccctctacggcttcggaggctaggcgcctcttcgtagctggggaatgcttagggtgatacgtctctgtcgctgtgggtcgtagtgttgctgcgttcctggatgtaatccatttttttttctgcaatgaagagatgctggcaagcatactacctgcatatgttgcgcctgggtgattgttctccttagaaatggtagtaacagtgaatcttgttcacga

SEQ ID NO: 14141 - DNA, 520 bp, Zea mays
  Clone ID: LIB3279-175-Q1-K6-E8
tggcagtactactactggtatctcaccaacgatggcattgagcacctacgcaactacctgaacctcccgtctgagatcgtgcctgccacgctcaagaagtctgccaagccacctggccgcccatttggctctggccctcctggtgaccgcccaaggggcccaggccgttttgacggcgacaggccaaggtttggtgacagggatgggtaccgtggtggtcctcgtggtgctcctggtgactttggtggcgataagagtggagctcctgctgagttccagccatcattcaggaggcctggctttgggcgtggtggcggcagcggcttcggcgcgggcccaacctcttcttccatggagtgaagttgcccttggtttggacatggtgtttcccttcgcatgtggcctttagttttgaaggacagttattatgtactagtaatattactcggatcggccagtgctgacatatgcaaaaaaatgttctgtcgttatacattggttccagtattattgtcttcgc

SEQ ID NO: 14142 - DNA, 667 bp, Zea mays
  unsure (1)..(667): unsure at all n locations; Clone ID: LIB3279-175-Q1-K6-E9
gcgactgcngaaggaggataaggggatggccgggatcggaccgatcaggcaggactgggagccggtcgttgtgncggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctcaacaccaagcgcctcgacgacgacaccgaaaacctcgcccatgagcgagttccaagtgatctgaagaagaatctcatgcaagcaaggctcgataagaagctgacacaggcacaacttgctcagatgataaatgagaagccacaggtgattcaggagtatgaatcaggcaaggcaatccccaaccagcagatcattagcaagctcgagagggccctgggaaccaagttgcgtggcaagaaatagctttcctacgagtttgtgtcccggagcatcataatagggggaagacaaggcaagctgtctgcttatttgtctatgtttggtatctcaagtcctgcggactgtttctgttggcacaagagggaataaatgtgttcacggacctgtaatgcttgctccttgtcatatgaccttgctcttaacatttgtgatgaagctgtcaaggtaatatattt

SEQ ID NO: 14143 - DNA, 433 bp, Zea mays
  Clone ID: LIB3279-175-Q1-K6-F10
cggtcgcgtgggtctgagtggtgataaggagggccttcttcagctcccaagtgacaaagccctgctgagtgaccctgttttccgccctcttgtcgagaaatatgctgcggatgagaaggctttctttgatgactacaaagaggcccacctcaagctctccgaactggggtttgctgatgcttaaatagaccctatcctggagtgatacattctgctgcatgtggtcttttgcatctggagtcaatgtgaacaagcagattgtcgtattgtctttctcgtaataaatttgtcaatgttgagcccttaggcttgaattgtgggaccctttgttcgttttcctagactctgatgctgtatgcaactgaaacgagtaaatctatgatcttaaggctgcagtatgttcttgtgttgaaaaaaaagttctagatcgcga

SEQ ID NO: 14144 - DNA, 632 bp, Zea mays
  Clone ID: LIB3279-175-Q1-K6-F12
gttcctcgctccgcggccatggtgaggatgaagcaggtaaagatctcggtaaagaaggacgtggattcgtacacaatccgcggcaccaacaaggtcgtccatgtgggcgactgcgtgctgatgcgggcgtcggactcggacaagcagccgtatgtggcgcgggtgtgaaaagttggaggccgatggacgcggcagcgtgtgggtgcaggtgcgctggtactaccgccccgaggaatccaagggcggtcgccggcagttccacggcgccaaggagcttttcctttccgatcatttcgacctacagagcgcccacaccatcgaggggaaatgtgttgtccactctttcaagaactacaccaagcttgataatgtcgggcctgaggacttcttctcccgatttgagtacaaggcggccaccggttcgttcacccctgaccgcgtggcagtgtattgcaaatgtgagatgccatacaacccggatgacctcatggtgcagtgcgaagcttgcaaggactggttccatccatcttgcatggctatgaccattgaacaggccaaaaaactagatcactttgtttgctcagactgtttgaaagaaaaggttcaaagagactttcaaatgtatatgccac

SEQ ID NO: 14145 - DNA, 586 bp, Zea mays
  Clone ID: LIB3279-175-Q1-K6-F7
ggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcacccaagcgcgactcgagtgaggggcagtaaagccggctttatgtgcctagaaactagtagctagtgtttgctgctgtcgaatgacactatgcaatgtgatctggaacctggtttcttgggtgcgacgcttgttatgactgtcgtcagtaaaatttgggggctccccgtatgagatgctgccgggcaaggcctcggtgtcccacctcgtttgtggcggggggcgctggagcccggtctggttgggttgggaagccctttaaactgttgtcacttgcattttaccttttccatcgctgtttattgtgagtggtccta

SEQ ID NO: 14146 - DNA, 661 bp, Zea mays
  Clone ID: LIB3279-175-Q1-K6-F8
ggggctttgataaaaatctttcagaggatgagatccggagctctctcgaacaacattttagtgattgtggtgagatgacaagggtctctatcccgactgatcatgaatctggtgcaataaaaggaatggcttacatagacttcaaggatcaggactctgtgtctaaagcccttgagctcagtggctctgacattggtggtggctatgagctttatgttgatgaagccaaaccaagaggcgatggccagcgtggtggtggtagatctggtggccgttctggtgggagatttggtgaccgttctggtggccggcgtggtggtggtagatttggtgaaagatctgggggcagggatggtggcggcagattcggtggccgacgtggtggtagggatggcggccgaggacgtggtggccgtggctttggtaacaagcacagcgctggcactcccagtgcaggaaagaagactacttttggtgatgattgatgatgaacgcggaggatgcggcaaaaggatccaatgaaattgtgtttttttggtcttgttgtggtaccgtaactggaatttggtattttttgtctactatttactgtagtggtttctggattttccttgtgttgcctatgctgcaatacaccgttttgttgttgcgatacatctgt

SEQ ID NO: 14147 - DNA, 487 bp, Zea mays
  Clone ID: LIB3279-175-Q1-K6-F9
ttgttaacgccctccttgccagctggggcgagcgggccgattatgcacttgctggaggcgcaccacgcacctttccttgcttaaccgtgcacttgctgcctctgacactaaggctacaggcacggagactgatgacagccgtgactggaccacctcatatagcgaggagattgttccccaggaggatgctcgcaatggagggacctaaaaacagcatccactgaacactggatgacgactcttgtgactattgccctctgcgactaagaatctgggagcctgctgctgttgcttcctgacagagtgacataaacatgcaaagcaggctgcacatacacataacgtttattgtgcttaatgactatactcaaacactcatgtaacatgctatggctgtaactcggcactcgatgatctcattcaggaagcctgtgactgatggaaatgtagacgcacactatagtcgaccaatgtctcttttcaatct

SEQ ID NO: 14148 - DNA, 651 bp, Zea mays
  unsure (1)..(651): unsure at all n locations; Clone ID: LIB3279-175-Q1-K6-G10
cggtcgcgtgggcccagctccgcacgcgcctcaacccttcctctcgggcggcggcgccggcaaggcggcagccaaccggagcgggagctgcgatgaagaagatcttcggcgccaagaaggacaaggggccgcccccctccatccaggacgccaccgagcgaataaacaagcggggtgagacggtggacgagaagatcaagaagctggacgaggagctagccaggtacaaggagcagatccgcaagacccgccccggcccgtcccaggaagccatcaaggcacgcgccatccgactcctcaagcacaagcgcatgtacgaggagcaacgcaacatgttgtacaaccaaacctacaatctcgaccaagttggctttgctgccgatggcctcaaggatgctcagcagactatgaatgcaatgaaggcagcaaacaaggagctcaagggaatgatgaaaactgtcaaaattgatgaaattgataatatgcaagatgaaatgacagatctgatggacgtgagcaatgagatacaagaaactcttggtagaagctacaacatccctgatgacgttgacgaggaagaactgatgggcgagctagatgctntggagtctgatatggaatttgactcagctgcagtcccctcatatcttc

SEQ ID NO: 14149 - DNA, 623 bp, Zea mays
  Clone ID: LIB3279-175-Q1-K6-G11
cccacgcgtccgcggacgcgtgggcggacgcgtgggtttcaaatcaaacatatgtgcatacaacttcaatctaattcataatacagtagataatgtgttcgctagttagggagagtccctcccctccttgtatagttctctttatatagtccataggtgagggttacaagagtcctaggcgagtgagtcaagagtcataattcgactacaattacaaataaaaagtcattaattggggtttgacttagttgaccaagtacaaatttctacatggaaaaaagaattagatgtgggagagagagctgacctggacaaatatctccatcttaaataaggaaagaccatgtcacttgtcaagagatgtcggttaggttcataaaccttgaaaatgcatttataggtccttgaacttgttaagagatgtaccacacatccatggtgcattcaggtccatttctaaaaccataccaaccattgtattgtgccacttaacaagttcaggaccctaaaaatatattttcaaattttgtggacctatgtgacaaactctacaagttcaaaggtcactcatgcatttaactccttttctaataacccacaagcggatctaatggtgacgagca

SEQ ID NO: 14150 - DNA, 657 bp, Zea mays
  Clone ID: LIB3279-175-Q1-K6-G12
tttcgcgtccgccaaaaccccaatcgcacaggagagaccgagagagaggttttccatccatggctcccggcgtcgcttccgtgctggtcccgcaggagcccgtcctcctcaaggacatcctcgcctcaccgtccccctgcgggaacaccgctgtctccgcccgccacctcttcggcaacggagtcgcgccgccacgctcctcggacgacggcatcaaggacgccgctgccgaccgccacggtgaccgcgacctctccatccccaagatcttcaccggagacgtgctggacctgctcgacgatgctgcgaggctggacctgatgctggcgctgacgggggacggcggtgcggcgtccatggccggcttctccgcgcgcgggtggtgggtctcgaaggaggatggcgacgcggtgcatttaatggtgccgatgccggggctggggaaggagcacgtgaagatgcgggtggagaaggacgccctggtgatcaagggggaggccggcaaggacctcgagggcgacgacgacaagggcccggcgcggtacagctaccgcatcggcctctcctcccaggcttttaagatggaccagatcaaggctgacatgaagaacggcgtgctcagggtcaccgtccccgaagatcaagacgaggagcgca

SEQ ID NO: 14151 - DNA, 432 bp, Zea mays
  Clone ID: LIB3279-175-Q1-K6-G8
ctttcttgtttgaccaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtaggctgcagatgggacgaatgtgcttgtatgtgtatgtgtcctgctgcaagttgtcctttgctatttagaatggaagaagaaatgccttgtttctctg

SEQ ID NO: 14152 - DNA, 603 bp, Zea mays
  Clone ID: LIB3279-175-Q1-K6-G9
tacctctctccctcggcctcgccggcggcacagcgcagcgcagcgcttccactgttgggtgtggtggatttcctccgcccccgaacgatcgatcttttgcatggcagcagcggctagctccaaggggcgggcgatcgctgggagcttcgtcagccgcgtcctggccggcaaggccgcctccccgaggagggccgtgcacgcctcgtcgtacgacaagaacccggaggagcaggtgcgcccggcgttcgtgccggacgatgtgatcggcggcgcggggagccccgacaagtactggagcccccaccccaagaccggcgtgttcggcccggcggcggtggacaccaaccagctgggcgtcgccgctgacgctgccgccgcgaatgcggctgcagcaggaggcacggtgctggaccagaaggtgtggttccgcccgctcgaggacgtcgagaagccgccccccgtcgcctgaaccgcgccacgcccacgcgacgcgacgctgccagcccacactgctgatacaagggcggcggccgggagggagagtcctggcaacgtcatgctcgtgcctgtaataagaacaagcaggagatgtgtgtgcctgtg

SEQ ID NO: 14153 - DNA, 673 bp, Zea mays
  Clone ID: LIB3279-175-Q1-K6-H10
gtcaaagaatgcatcggatcaacagttccacaagaagaaaacccagaaccaggaaatgccatagtagaaatggtgaaatctgtggagcttgccaccctggaatgaaatctagtacaagaaatcatctctgtggcttgtcaggtgctacaatatgggcaagacctcagcagatgccacatccaagtgcaagtgtgctagcaaagggtggagattatgaacttcctatattctgtgtggcggcaatcttgataattaaccgccagaagataataagagggactcactcaatagatgatgcgatcaagatgttcaatgataatgtgctcaaaataaatgtaaaaagatgtgtacgcttggccatcaagctaaggaagaagtacttgtacaagtcattgaaaggaggctctagtgatgataaagaaagctgaagaacctgcacttcccttgtagaaaaaaactagatatttctccatcatgcattgctatctaggtgtgctggatcagtattgacctgaagatccggcattattcaggattgcaaggcaatctgtacatattatacttgaaaacacagatgaagctgtggaattaaagaaaagaaatcaagtccaccgaatggttgtatttctggtggtgtcattgcttttttattcccatttggcagggtatcatg

SEQ ID NO: 14154 - DNA, 555 bp, Zea mays
  Clone ID: LIB3279-175-Q1-K6-H11
tttatccccaaacctccgacccccttcctctctccctccgccgccgctgcgcacgcagggaacaagcgacatgggcgtctacacctttgtgtgccgcaacaacggcggcgagtggaccgccaagcagcactccggcgagatcgaggcttccgccgctaccccatacgagctgcagcgccgcctcgtcgctgccgcctccgcggccgactctgcctacggcgtccagtcgtccttctccatggtcacccccagctccgccgtgttccaggtgatcgtcggtgctgtcggtggtggtgcaatgatggtgagcggaggtggcggcggcggtgctgctgcatctggtggtgctgctgccgaggctcccaaggaggagaagaaggaagaggagaaggaagagagcgacgacgacatgggattctccctgttcgactagagttgtgtgtgtcatctggatctcagaagtggtggtttggtcctgttgccgtagttaattttgctgtcctgtctgtgaacctgaagaactcttggtaattgttacaagcgacctgttccagt

SEQ ID NO: 14155 - DNA, 620 bp, Zea mays
  unsure (1)..(620): unsure at all n locations; Clone ID: LIB3279-175-Q1-K6-H12
tctattcgttccccgcctcaccccgagccagccgtctcgctagggtttcgccgccgccgccgccgccgccgccgctatgcctcgccgcagctcaggaaggtctgccccacgcccagctccccgtgctgctccagtgaggaacccgccacagccagcacgccaggctcctccnttttctcctgttcgagatggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgacgcttgcagcatccattctaaggctttccaagattgtctcaacaactatggcagcgagatcagcaagtgccagttctacctagacatgctgaacgagtgccgccgtggtggtgtgtctgcctaagctgcttctggggttattcgtggattttctttcggtgatgctatctcattaataagataccgtgaaacttttgtctccacagcttgaagctaaacttcctgggattaatacattttgttatcct

SEQ ID NO: 14156 - DNA, 574 bp, Zea mays
  Clone ID: LIB3279-175-Q1-K6-H7
ggacattcctgtcttggtggaaagactgaggagggtcacagatagcttcaaatccaaacgttgaaacgctagaatagtttattttttggaacccctgcggtatcgaaataaccatatctcaccaggtgctctatagtggattgcagggggcactcaggaaaaggttggacaatctatttattttagaccatagatattcaggggcttcttgctatacagctgcataacaattgctggaagcccctgggctggtggaaggataagtgggggatttgggggacttgtccatgactccatgctggtcagctgtcttcggtttcttacgggccatgatgccgtagcattctggatgtttatgtcctgttggtctggcgatgaggctgatgtgctgagcattcttttcatccagatccgaccatgttctacttttcctttttactcttccttttttttctttggtcacataagctagtgttcaggttcagggattgtaaagcagtggatcctgcatgtgctgccagggttttggacgctgtccatacgtggagtgaatgaacatgcagtcatcatgttt

SEQ ID NO: 14157 - DNA, 653 bp, Zea mays
  unsure (1)..(653): unsure at all n locations; Clone ID: LIB3279-175-Q1-K6-H8
cattatacttggnttatttaacgtttcagggcgctaatataattaagctgtcgatcaggtgagtccctggggcagaaatctctcgctccacccttcctggctccgaactcgagtgctgcgatcaccagcagcgggatcaactatggctctggttcttctggcatatttgacgataccggttccttctatatcggaaggattccgctagggcagcaagtcagctacttcgcaaacaccaggtcacagatgctggagaccatggacgaggaagccgtagccgatttcttcagcaaggctctctttgttatagtagcagggtccaacgacatcttggagtttctttcgccgtcagtaccgttcctcggacgagagaagcctgatgacccatcgcacttccaggacgcactggtttccaacctgacattctatctcaaggtcctacgtactagctaccattaccaactttctcagcctcagtcgcagctaaacgcgtcgatctgctgaaaactttcagtcgagtgctcttacttattccgaaactgacatgcattattattccttttcctctcgatgaaggagctgagtgagctgggggctaggaagttcgtcgtgtccgacgtcgggccgctcggctgtataccctacgtccgtgc

SEQ ID NO: 14158 - DNA, 642 bp, Zea mays
  Clone ID: LIB3279-176-Q1-K6-A10
gcgaattcgccgcaagtccaaaggcaaagggcaaagcagaagttgcggttggcctcgtcctcctcttctccgtcgcggctcagatctctgcgtgcgtcgatggcgtcgttctcggaggctccccccgggaacccgaaagccggcgagaagatctttaagaccaagtgcgcgcagtgccacacggtcgacaagggcgccggccacaagcaaggtccaaacttgaacggtctttttgggagacagtcgggtaccactgcaggctactcctactctgcgggaaacaaaaacaaggctgtagtctgggaagaagacactttgtatgagtacctgcttaaccctaaaaagtacattcctggaaccaagatggtcttccctgggctgaagaagccgcaggagcgtgctgatctcatcgcgtacctgaaggaagcaactgcatagttcattgacatgccttttgccatgaagagaaaaattgttttgcagtttaataaaaaacattttagacaatttgggtcaccctgtttgaacagggtgcaaccacgtctcattattttcgttcttatggtgtcggtatggaatgcctaggtgtttagctgtgcacaaataacagttaaactttgacggctcctatttcaactgctg

SEQ ID NO: 14159 - DNA, 478 bp, Zea mays
  unsure (1)..(478): unsure at all n locations; Clone ID: LIB3279-176-Q1-K6-A11
cagggacgncggcgacggccaggcgcaccacgcggcggcccggccagcccacccagagaccaccnagccanggcgnccaggngcnncnnccccagggacgcgnccggcgccgacggccggcaccagcagncgaagggcgcggcggaggcccgcgagcagcggcgccacggcgggcgccnccngncccgggaggacgngggcggcgcggngcgcgncaggancgncgncagcaggcgcgagcnncaagcagaggncgcggcgcncggcgacgacgacggcgcnggcgcggcggcggcggcggccaccagcgagcgccgccaccggcagcgnggcgcgggcgcgggcgcgggagcggggccgggcgccgagcagaggcngcagncgcngcggcggcgcagcgcgcggagggcggccgaggcggcgcgccggacgaagcaggcgggcggngagggggagcccggccggcagagcanccccg

SEQ ID NO: 14160 - DNA, 357 bp, Zea mays
  Clone ID: LIB3279-176-Q1-K6-A12
ttttgtcaataatagaaaggtatatgttcggagcttatggtaatgcttgagttaagttttaggaacaataaattcagtctttatcatttaatcaatatgatctgtattgttgttaaaaaaaaaaaaaaaaaaaaaaaaaaaaaaaataaaaaaaaaaaaaaaaaaaaaaaaaaaaaaatttaaaaagaaaaaaaaatagaaaaaaaaaaaaaaaaaaaaagataggagaaggcggcatctggatgttctccatgctctacacgcctcctgccttcgcttctccggcttcgtcgcttgcagtgtggaatccgtatcagcttcgtttccccttctttaggggctccgatttgggtgccc

SEQ ID NO: 14161 - DNA, 671 bp, Zea mays
  unsure (1)..(671): unsure at all n locations; Clone ID: LIB3279-176-Q1-K6-A7
ngagacaagnagggcatccctccagaccagcagcggctcatttttgccggcaagcagctcgaggacgggcgcacgctggccgactacaacattcagaaggagagcaccctccacttggtgctgcgtctcaggggcggcatgcagatcttcgtgaagactctgaccggcaagactatcacccttgaggtcgagtcttctgataccattgataatgtcaaggccaagatccaggacaaggagggcatccctccggaccagcagcggctcatttttgccggcaagcagctcgaggacgggcgcacgctggccgactacaacattcagaaggagagcaccctccacttggtgctgcgtctcaggggtggcatgcagatcttcgtgaagacacttactggcaagacgatcacccttgaggtggagtcctcagacaccattgacaacgtcaaggccaagatccaggacaaggagggcattccaccggaccagcagcggctgatcttcgccggcaagcagctggaggatggtcgcaccttggctgactacaacatccagaaggagagcaccctccacctggtgctccgcctcaggggtggtatgcagatttttgtgaagacattgactggcaagacatcaccttggaggtggagtcgtctgacacaatcgataatgtc

SEQ ID NO: 14162 - DNA, 580 bp, Zea mays
  Clone ID: LIB3279-176-Q1-K6-A9
tttgtcctgtgaggggctgaggaggaggaggaggaggaggaggaggagggatggggcggcggcagaagcggcaggctttgatggcggcattcgcgttggcgctgctcatgggcaccgccgtctacttccgcatctgggcccgccagtccagcgacccctacttcaccgctgacgaccgcgaggagctccggaggcaatttgaacaagcaaacctagaagccatggatgaatctgccgaatggaggatgcaatatgacaaagaagtagagaaaaacaggcagttgcatgatgagctttcaaaggttaaggcctcattagctggcacagcccggcgtcttgagttgctgcagaaggataacgagttgcagaagaggcagactgaatcgctgaggcagcatatgcagattgcactctccattcaaagttatgcacgattaaggacatgtgaagagtttttcagcttctttggcggattagctatttttttccaacaccaagggaggaaaaccagtatgagttctaggaatgagaactggcatatgaaaatgattgagaacatatatagtgtttagaccatagt

SEQ ID NO: 14163 - DNA, 345 bp, Zea mays
  Clone ID: LIB3279-176-Q1-K6-B10
cccacgcgtccgccagcccgaggccggtcgtctcctggcggggatcctggcgtgggcggctgacgtggtcggtggggccggcggcagcgacgacgaggcggacgacgacgcgcgcgccgcggcgtcggccgccatgaccccggcccagcggctccgcgccgccgacctggacgcgcgggcgggttcgctgcgccgcgccatccaggacctccgcctccgggtgcccccgccgtacgtcgcgcagcgcctgcccctcctcctcgctcgctctctcgcgtcgtccgccgcgctcgccctgccgcttttcgctctctcctcgcccatggcgctgactctgcggggggt

SEQ ID NO: 14164 - DNA, 177 bp, Zea mays
  unsure (1)..(177): unsure at all n locations; Clone ID: LIB3279-176-Q1-K6-B11
cgtccggcagcannaacntgcttttgtttggtcatactttggattttactacgcaaagagcgaagtctgcaatatgtaatatgttgtggaacagacatgaacggtaggatttttttggttggaatttgtggtgcgcatgttgctgatcataattatgataagttttcttaagcttat

SEQ ID NO: 14165 - DNA, 574 bp, Zea mays
  unsure (1)..(574): unsure at all n locations; Clone ID: LIB3279-176-Q1-K6-B12
gcnnnnnnnnnnnnnnnnagccacgccagacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccgntggtgggaaacctgttccaggtgatcctncagcgacggcccttcatgtacgtggtgcgcgaccttcgggagaagtacgggcccatcttnaccatgcggatggggcagcccaccctcatcgtggtcacctcggcggagcttcatccacgaggcgctggtgaagcagggccccatgttcccgaagccgncccgaggacagccccacccgnctccttttccncgtcggcaantgcaccggcaaactcggncccctaccgccccctgtggccttgctctgccgccgnaactttcgcgccggagatttgtgcccccgccaccggcgtcaaaggccttcttcctggatcc

SEQ ID NO: 14166 - DNA, 630 bp, Zea mays
  Clone ID: LIB3279-176-Q1-K6-B7
cggacgcgtgggcggacgcgtgggcggacgcgtgggggcaagcatcatgatggtgtcgttgaagatgttgcttggcacttgaggcatgagtacttatttgggtcagttggtgacgattatcatcttttgatttgggacctgcggtctcccgcccctactaaacctgttcagtcagtggtggcgcaccagggtgaggtgaactgcctggcttttaacccgttcaacgaatgggttgttgcaactggttctactgacaagactgtcaaattatttgatcttaggaagattgatacttctctgcacacctttgactgtcacaaagaggaagtttttcaagttggatggagtccaaagaatgaaactgtacttgcatcctgttgtctgggcagaaggctcatggtctgggatctaagcaggatcgaccaagaacaaacaccagaggatgctgaagatggtcctccagagctcatgttcatccatggaggccataccagcaagatctctgatttctcctggaacccctgcgaggactgggtggttgctagcgtcgctgaggacaacatcctccagatatggcagatggctgagaacatctaccatgacgaagatgatctgccaattagcgatgag

SEQ ID NO: 14167 - DNA, 555 bp, Zea mays
  Clone ID: LIB3279-176-Q1-K6-B8
ccagcgtccggttggctgccttttcactgaaagtgtttgcccaatcaatcagatgattctgttggtgttcaatgtcaagtgttgtagcttagtttctttgaacaaggtgtgtggaggattttgatggacaatgataaaactgatgacaatttagttgcttcatatggattccagcataaacatttctcggtcagagatgctttaaccatttgacgatgaggaattcgacgaggacgacgacgacctcgatgacgaagccgccgcggacgacggcgaaccctccgcgtccccatccgaggcggctcgcctcgaggccgtgctccggcggctcaccgcggacgaggtctggatccgggtgcactagatattgcggctgcaaatgaagatgaacaaacgactgctacttcgccacctagaagtgtcaaatgggtagttaagaaaattacccctcgaaagaaactgaagaatcgtgcttatcacggacagtagatctgaaaaatatgtgtaataaactgtgatgttcccagatctgaatgtgaaccgtgcttatcaccg

SEQ ID NO: 14168 - DNA, 641 bp, Zea mays
  unsure (1)..(641): unsure at all n locations; Clone ID: LIB3279-176-Q1-K6-C10
cgcacagctctcggcttctctctctcatcggcacacccgagctcgcgccctccttccacgtcgaggtccgagtcctgctttgatggcgaccgacgtgactgagactcccgcgccgttggtggatgcggccccagaggcgcccgccgacgccccggcggcgcctgctgccgacgcgaagccggccaaggccaagaaggccaccgcgccgaagaagcgcgccagcccgacccacccgccgtacgccgagatggtctcggaggcgatcacgtcgctcaaggagaggacggggtccagcagctacgcgattgccaagttcgtggaggacaagcacaaggccaagctcccgcccaacttccgcaagcttctgaacgttcagctcaagaagctcgtcgccggcggcaagctgaccaaggtgaagaactcgtacaagctgtcgtccgccaccaagccgaatcccaagcccaaggccgccccgaagaagcccaagaccggcgctaagaagcccaaggccgctgccaagcccaaagctaagacccccgccaaggcgaagcccgccacaaagcccaagcccgccgcgaagccgaaagccgtagtgaaaccgaagaccccgncaagcccaagccaagccagctgccaaggcg

SEQ ID NO: 14169 - DNA, 78 bp, Zea mays
  unsure (1)..(78): unsure at all n locations; Clone ID: LIB3279-176-Q1-K6-C11
tcggcccccccnccccccccccccncccccccncccccccccacccccccccaaccccccagggcgggcccgcggagc

SEQ ID NO: 14170 - DNA, 479 bp, Zea mays
  Clone ID: LIB3279-176-Q1-K6-C12
tttttgactccacccacccgcccgctgcctccgccggatctcggcggactcggatccgcccgaccaccccgcgccgccgccgcgcagcagcagcagcagatcagagaagatggccggactcgacaccttcctcttcacctcggagtccgcgaacgagggacaccctgacaagctcagccagcaggtctcagatgctgttctggacgcttgccttgctgaggaccctgacagcacggtcgctcgcgagacctgcaccaagaccaacatggccatggtcttaggtgagatcaccaccaaggccaatgtccactaccagaagattgtcagggagacatgccgcaccattggttccatgacaaacgatgggcggcttgacgctgaccactgcaaggggcttgtgaccatggtcccacacctgccctggctatattgagcgtagcgcacggccactgcaccacacgccccgaagagatcggaga

SEQ ID NO: 14171 - DNA, 669 bp, Zea mays
  Clone ID: LIB3279-176-Q1-K6-C7
gacaacatctggattgctcctggtacccgtgtgctgtatcttggtgctgcttctggcacaactgtatctcatgtgtctgatattgtagggccggatggtctggtctacgctgttgagttctctcacaggagtggaagagaccttgtcaacatggcaaagaagaggaccaatgtgatccccattattgaggatgccaggcatccggcaaggtaccggatgttggttggcatggttgatgttatcttctctgatgttgcacagccagaccaggctaggatcttagcacttaatgcttcatacttcttgaagaacggtggccactttgtcatttcaatcaaggctaactgcatcgactccaccctgcctgctgaggccgtgtttgcagcggaagtggagaagctcaaggcggatcagttcaagcccgcggagcaggtgacgttggagccctacgagcgtgaccatgcatgtgttgtgggtgggtacagggtgcccaagaagcagaaggccacctcttaggatcggaatccgtgctcgtcttgcctaccaaagatgcttcgttgtattgtggtttattaagaaactttgaaggattagtcaaagtatgtgaaccttctgcagtgaaggctggtttagcagcgacagctgttagggtctgatgcagtgtttgct

SEQ ID NO: 14172 - DNA, 493 bp, Zea mays
  unsure (1)..(493): unsure at all n locations; Clone ID: LIB3279-176-Q1-K6-C9
gttttgcgtgtgcacgcgttcgtcgtgcagcgttcaggtacaacgccaaggcgcacaacgtggtgcccgtgagcgcggcggggtacaggtcgtgcagcgcgcccaagggcgtgagggcgctcaccaccgggaacgaccgcgtcacgctgaagcgcggcgccaactacttcatctgcagcttcccaggccactgccaggccggcatgaagatcgctgtcaccgccgcgtgaggcccccggccgatcagccgcgccggcgacgacgaccgccggacacacgggcttcgatcggtggccagcttattattatntttatttccctctcaaagtaaaagcgtcgcgtccttaacctgcgngttggtaggcggtgttaggtgtgtggagaccggccggcctatagagaactaaatcgaatgattggtgtactantacgtactgacgtgtatgagtttgtgttgattgtgacaacnataaaagcatgtgttcgggttngt

SEQ ID NO: 14173 - DNA, 534 bp, Zea mays
  unsure (1)..(534): unsure at all n locations; Clone ID: LIB3279-176-Q1-K6-D10
atgaacaccaaaggacatagggtgttatatggttcgaacctgtctaaatcttcgaatctcttatatatttaccttcatttctcgatctcgcaatccaccctataaattcactaccgtaatattgctcgataccacgtacgttcaacgactatttacagatcagtgctggagtcacctctcggtgtggtatacatacaaaactacaataagatggctgccaggtcagcccacaagcaatttgtcactgagctccttgcggtacacatggatgagacctgcactgtcgatcgtgtagagcttctccttcaagatcttcctatagtggttatcatcatcctccaagtttctcatcacttcgatctgataaacaaagacatgtgcaggatatgagaatctcacttccgccctcaaggccagtttcacaattattatgtatctagatgagcatattgcacatatgtaactaaaactacctgtctctggaatgactcgaattcgtcagaaaaaaaaaaaaaaaaaaaaaaaannnnnnaa

SEQ ID NO: 14174 - DNA, 617 bp, Zea mays
  Clone ID: LIB3279-176-Q1-K6-D11
cccagcgtccgctcccctcccactcggccactcccagtgccagccgccgtgcgctcgctcgcgcgcgctctctttctgggacgaccagtgggatatctccaccgccgccttacgccaggtgcggaccttcgccgatctcttcgccagcgaagagcgtccatcagtaaaaatggtggcccttgcaaatgaagaggccttggcccatgatgaagatatcatggatgatgttgattctgatgttgaagaatcggactcagaagacgattcaggtgaagaagctcaggataagccttcagacaaagctatatacaacaaggaggccatccttgaaaaacttgaagatattgcctggcccaagtatgtggactggatacacaagctcaccattgagcatgatcagggggaaaaggttgatgtgaatgatgatcttgctcgtgaacttgcgttttacacccaagctttggatggcacaaggcaagcctttgagaagctgcagtcgatgaaggtcaggttcctcaggccaacagattactatgctgagatggtgaagactgatgcgcacatgcacaagatcaaggggaggctgctgtcagagaagaagaggatcgaggaggctg

SEQ ID NO: 14175 - DNA, 665 bp, Zea mays
  unsure (1)..(665): unsure at all n locations; Clone ID: LIB3279-176-Q1-K6-D7
cgacagtccagagtcatgtagacagccaattcaggactgctagttcctaccttgaagatggccctcgcagcaatcttgatagtgtccgatatgctgagtgtattcattacttgcaagattatgctcggccacaaatgcttgctttcatgttcaggcatggccattacactgaagcatgctctctgttcttcccattcagtcaaccaaccacggaaggggaaacatctttgtcttcagctccatggagtgatcctttaacaactgattatgggacaattgatgacttgtgtgatctctgtcttggatatggtgccatggctgttttggagaatacaatacggacaataacacaatcgcccacatatcatgaggcacacatgattcagtacatgaacactattatcacccgcatttgcaactattgtgaaacacacaggcattttaattatctctacaacttcctggttctaaaagatgaccatgttgcttctggcctttgttgtattcaattatttatgaattcaatgtctcaagaggaggctttgaggcatttgggacatgccaagacacatttcgaagaagccttatctgtacgagatagaacaatcgaggctactnaagttggtattgcggtctgctcggaatagggtgcacctggaaaatga

SEQ ID NO: 14176 - DNA, 498 bp, Zea mays
  unsure (1)..(498): unsure at all n locations; Clone ID: LIB3279-176-Q1-K6-D8
gcgcgttctcaaactggacctagtgagtggggataaactcgagtttgttctcatcattgcaccagtngaaagagtcatatgagattgcccgtgccaccctcaagatagcagatgagcttacgctatcagccagagtatgtgtaatgtggccacgaggttcgactgatgctgaagtggaagagagcagatccgagttgacaccctggacaaactacatcgatgtcgaggaagtgcctagggtgtcgggtggttcatggtgggagatgtgtcgtattagtaggaagagtgtccttttggttaggcctgatgagcacatagcatggctaacagaactggacagggtgagggatgctgagtcagaaattaggagggtcttctctcatgttctgtgcctaaatagccaccgggtgtaagaatttataaatttccttccatttaggctttgtttagatactttggtattcactttaatccacatgtatggaagcggattaggtt

SEQ ID NO: 14177 - DNA, 313 bp, Zea mays
  Clone ID: LIB3279-176-Q1-K6-E10
caagtgttcaacccaagtatcaactattccctctgcacactctgatgggggagataagtaaacccttgctgttggattggtccatctcggtggagtttttgtatgtgtgaagtaccggttgtttcatgctggatattgcgctacttgtggccatagtatgtcattgaagctagatgcgcctcacttgagagttttgttgcaaacctattccaattgtggtctgatgacccctggcaaagagcttttgcaagctgacgttgaaactgtggcttggtgaccgctaataaattttccatcttgtgaacttgttctc

SEQ ID NO: 14178 - DNA, 636 bp, Zea mays
  Clone ID: LIB3279-176-Q1-K6-E11
cttccctcccactcggccactcccagtgccagccgccgtgcgctcgctcgcgcgcgctctctttctgggacgaccagtgggatatctccaccgccgccttacgccaggtgcggaccttcgccgatctcttcgccagcgaagagcgtccatcagtaaaaatggtggcccttgcaaatgaagaggccttggcccatgatgaagatatcatggatgatgttgattctgatgttgaagaatcggactcagaagacgattcaggtgaagaagctcaggataagccttcagacaaagctatatacaacaaggaggccatccttgaaaaacttgaagatattgcctggcccaagtatgtggactggatacacaagctcaccattgagcatgatcagggggaaaaggttgatgtgaatgatgatcttgctcgtgaacttgcgttttacacccaagctttggatggcacaaggcaggcctttgagaagctgcagtcgatgaaggtcaggttcctcaggccaacagattactatgctgagatggtgaagactgatgcgcacatgcacaagatcaaggggaggctgctgtcagagaagaagaggatcgaggaggctgaggaacggaggaaggctagagattccagga

SEQ ID NO: 14179 - DNA, 617 bp, Zea mays
  unsure (1)..(617): unsure at all n locations; Clone ID: LIB3279-176-Q1-K6-E12
ttcggattctcctcaaccaaatcaagtcacagcggcgacactctcggcgatgtctgcccccggcaagggcgggaagggtctgtgcaagggcggcgccaagcgccaccccttcgtgctgcctcaccccatataggccatcaccaagccggcgatcacgcagatgaggacgaggggcgcgagtcaccgcatctacgcactaatcctcgaggaggcccgcggaatactccatatccatctgctagcatccccttcacccaccctccctcctatanctgccacccctcccctcagtacttgaccgccaggcacgagcgtttccctctcctacgacactgcgatacccaatcgggtctcttcaaagcacgggcacgctgtccgcacgaggaatgacatatgagccaagccgatcacttcgactccgagctccagcatcccatccccatccctaatccctaagtctaccctgtggccagtgccgtgctcgtgacccccaccaatccttctgccttcaccagtgatgatgatatactagagctcgctcccagccgtcacatctacaattgactatatcacggtgactaaaacaccacaacagttctgccaatcaagccatccat

SEQ ID NO: 14180 - DNA, 674 bp, Zea mays
  unsure (1)..(674): unsure at all n locations; Clone ID: LIB3279-176-Q1-K6-E7
atttctcttgtatcggacccttgaattttaagtgttgttttaaactaatcaatcttctctacacttggccttgtatgaagtatccatgatatatagcagagcctaattgggctggaaggtaagtttcttttaatgtttgagttctcatctttagatgaaagacaaatgggacaccgttgcgttttcaagattataaggatgtaaaacttttaaatccgatttactagctcaatgaatatttcactttctttcccttgtcaaaatctcttatcctgggtgttaagcactgcgaactttggcttattttgccttcttgtttttactggatcatacacgcttccattttgtacctgttcgttggagcatagttcttgatttatgcattaatgacatatgatatatgaattatggaagagtaaaaaatgagtgcatgatcatacgattcagaaatgaacttttgagctgtaatacatagcatatgatttgtctggaaatctgggtactgattgaattcttgatcccattagcttgactattcttcgtaggatatacactatgagtaggacttctcatcttcatctatcagccttaacagtaaacatgggcatgctntggatcaatgtccatgactatagctntggaagtgttgtataccagcggatcatccagttgct

SEQ ID NO: 14181 - DNA, 670 bp, Zea mays
  Clone ID: LIB3279-176-Q1-K6-E8
cacatatctacagaactctgggagagaacttcaatgagagagttttgccttcaatcatccatgaaacactgaaagctgttgttgctcaatataatgctagtcagctgatcacacagagagagactgtgagtagggagattaggaagatactgactgagagggctagattcttcaacattgctcttgatgacgtctccatcacaagcctgagctttgggaaggagtttactcatgccattgaagcgaagcaggttgctgcacaggaagctgagcgtgctaagatcattgtcgagaaagctgaacaagataagagaagtgcaattatcagggctcagggagaggctaagagtgcggagctgattggtcaagccatagcgaacaaccctgccttccttgccctgaggcagattgaagctgcaagggagatctcccacaccatttcggcctcagccaacaaggtgttcctggactccaacgacctgctgctcaacctccagcagctgaatgtatcgagcaagcagaagaaatgatgtcacaacgttatcccctttcttctgagtttgcagtcagtagtggatgcctttgtaccagacattgtgaggaacgctcggttttggatgtagtttcgccaatcttcctgtgatgtggaacttgcgagtatttgctcaaa

SEQ ID NO: 14182 - DNA, 561 bp, Zea mays
  Clone ID: LIB3279-176-Q1-K6-E9
agagctacttcaacaagtccgccgggagggcggcgagcaacaacaacaacaacagcagccacgccggcggcggcaacaagaagggcggcgccggggagtacggcaggaagaagcacgccaagagcgagggcgcggcggcggcggcggccacggacaagcagcgggtcaagacgctcccggcgtcggaggcgctgccgcggggccaggccatcggcgggtacatcttcgtctgcaccaacgacaccatggacgagaacctcaggagggagctgttccggctgccgtccagctacagggactctgtgcgtgctatccgcccgggactgtccctcttcctctacaactactccacgcaccagctccacggcatcttcgaggccgtgagcttcggcgggaccaacatcgacccgacggagtgggaggacaagaagtgccccggcgagtcgcgctttcctgcgcaagggcgggttgcaaccgcggaagacgacgacccgctagaggaggacgccttacgccccatcctgcaccactacgacgggcccaaagtccggcttgagctct

SEQ ID NO: 14183 - DNA, 637 bp, Zea mays
  unsure (1)..(637): unsure at all n locations; Clone ID: LIB3279-176-Q1-K6-F10
tctagatcgcgagcggtcgcccttttttttttttttttatttgcaaaggttttcgactgttttcccggctgttgcagattgttgacagcaatacttttgttttggtaccgtatccagaactacaactaccacagtaaccaattcatgtgaaagacgtggacgcgagcaagcgaccacccccaacacggtaggaatattgggacaacaaaggcatttcacacctgcgacacaccacacaaaatcatccctcacgatccgctacgagccctagggctgggacagggaggggctctcacaatatcacttcatctactgtgcaccccaggaacctgatggagctccccatgactgctggggctgcgaattcatccctgtttcctccggtggtggtctgggtttagcgtattccgcaaaaataacccatccatcaaggaactttccatcctttccctctattcccttggctgcctcttcggtcgtagcataccttacaaagccaaatcccttagaaaacccactgacacgatcggtcacaactcgagcatgcaaaacttcaccaaactccgcaaaggcttctctaagtccttcacttgtggtacgcttgcttaagccggagacnaagagttgggggatgggt

SEQ ID NO: 14184 - DNA, 638 bp, Zea mays
  Clone ID: LIB3279-176-Q1-K6-F11
gcttgggcagaatcatttgtgggaggggaaacttcatatgggttatatgcttatacgtgagagattgtctgaactgcaggaagagaagaacaaaaaacggaagctagaccgagctgagtatgacagaaggtccagggaaaggagcggggaacgtgccagggattcgagcagggatcgctacatagaccgcagcagcagccgtgacagggagtatgaccgcagaagaagccatgatcgctaccatgacagggaaagagagagagattccaggcagtctcgtagttatgattccagaagccaccgcaggtcatattcaccaaggggaagttctagggattatgatcgatctgggcgtcatgaacgccgtgatcggtactaggagcaaggaagcctccttgaaatttagggtactagattgcgttgcctcagggctagtttggccacctcatttttccaaggattgacaaccttatttttttaagggatttctattttcctaagaaaaattagttcattttcccctgggagggaataccttggggaaatggaggtgccaaactagcctaagtgttgttcgggaattctaagagggggcttaggtccaactggagaaagcatcagctctttgcattataact

SEQ ID NO: 14185 - DNA, 666 bp, Zea mays
  Clone ID: LIB3279-176-Q1-K6-F7
cgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtaggctgcagatgggacgaatgtgcttgtatgtgtatgtgtcctgctgcaagtgtcctttgc

SEQ ID NO: 14186 - DNA, 645 bp, Zea mays
  unsure (1)..(645): unsure at all n locations; Clone ID: LIB3279-176-Q1-K6-F8
cgacccagcgtccgcaggnaagcatgagccgcctcngtgcctaaactatttaacatcacctcatgttcttatctggagtgcagtaacagcttcctgcgcttttcctggactttttgaggcccaagaattgatggcaaaagatagatttggtcaaaccattcctttccatgctccattcttattaggcatggaggaacgaactgttgctccaacccgccgctggagagatgggagcttagaaagcgatttacccatgaagcaattgaaggaactattcaatgtgaatcatttcatagtaagtcaagccaatcctcacatagctccactattgagactaaaggaaatcatcagggcttatggaggcagctttgctgccaagcttgctgaacttgccgagatggaagttaaacataggtgtaatcaagttctggaacttggatttcctttaggaggattagctaaactatttgctcaagattgggaaggtgatgttacagttgttatgccagccactcttgcgcagtattccaagatgatacaaaacccgtcttatgctgagcttcagaaggctgcgaatcaaggtaggagatgcacttggngaaagttatcagccatcagggcaaattgtgctattgagcttgcact

SEQ ID NO: 14187 - DNA, 654 bp, Zea mays
  unsure (1)..(654): unsure at all n locations; Clone ID: LIB3279-176-Q1-K6-G10
cccagcgtccgagnagcttaccttggcaagacagtctcgaaggctgttattactgtcccagcttattttaatgatgctcaacgccaggctaccaaggatgctggtaggattgctggactggaagttatgaggattatcaatgagcccactgctgcagctttgtcctatggaatgaacaacaaggagggccttattgcagtgtttgacctgggtggtggcacatttgatgtgtcaatccttgagatatcaaatggggttttcgaggtcaaggcaaccaatggtgatactttccttggtggtgaggattttgatggtgcactgcttgaatatctggttagcgagttcaagaagtcagacaacattgatctgagcaaggacaagttagcactgcaaaggctcagggaagctgctgagaaggccaaggttgagctttcgtccactatgcagactgaaatcaacctcccatttatcactgctgatgcatctggtgcaaagcacttcaacattaccttgaccagatctaagtttgagtctcttgtgagcaatctcattgagaggactcgcatcccttgtgtgaactgcctcaaggatgctggcatctctgctaaggagattgatgaggtcctactggttggtggtatgactagagtacca

SEQ ID NO: 14188 - DNA, 71 bp, Zea mays
  unsure (1)..(71): unsure at all n locations; Clone ID: LIB3279-176-Q1-K6-G11
cccccccaccccccccccccgnccccccggggggggggggggggggnncccccccccccccccgggggggg

SEQ ID NO: 14189 - DNA, 465 bp, Zea mays
  unsure (1)..(465): unsure at all n locations; Clone ID: LIB3279-176-Q1-K6-G12
ctagcgtccggacgaganncgagcgccngaccgcagactacaaccgagccagggaagaaagacgtacgccgaatagcaaatctgggggaagacctggcggtgcaaagctcagcctaactgtgcagagcaatgcccccagtgcctacgctaatgcccatgtccacctcaagtgaagggtttctgatcatcacgccctctgatgttctattggcacatacgtgcaatgatggacgctctctgtgctgactacaacattcaatttgagtcacccattcattggtaactgaggctaccttgtgaaaccgtcatcaaggagataactctcactgtgcaataggacatgaatactatattgaaactacaggctgtattgacaagatcaatgacttgcttgtaacataaatactgcatctctcccgtgcagtataagctcgactatgctgttcattcacatcgcttatgact

SEQ ID NO: 14190 - DNA, 592 bp, Zea mays
  Clone ID: LIB3279-176-Q1-K6-G7
cagatatcttggccatcaggactatttggaccatgcaacggcatcaatttcggattgggcactccggtacagctcgagcctctttgcaagcattgaaatatttacatattggagatgtggtaaagactatcatcagcccacaaacaacgaccaacaaggaagctacagtatattgaatgatcgaacaaacaaggcaagcgctacaatacaatgaaattaaaggtacagtaatacaaaaccatgaccaataattcctttcaaatgatgacaaatctcacctctcttgctccaagttcagtgaagaagtgatcgagcagcgagcgcttggcctctcgcacttgacaataaacaatagattttgggatggagttcctcaaggtcgaacacaccatattaacatatgacagaacagtttgtcctgttgatcgtttagtacagtgagatgttaagcagtaaataatcaactatcaagcaaaaatgcagagatcatataggccttaccaattcgtctaagataagagtcattatatctatcaaaaatagagtggcttggatttccacccttctcaacatcctgaggaagcttcctgaa

SEQ ID NO: 14191 - DNA, 642 bp, Zea mays
  Clone ID: LIB3279-176-Q1-K6-G8
cggccgcgtgggcggacgcgtgggaaaaacccacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgggcggcggcgggcccacgcgcacctacgtccgcgacgcgcgcgccatggcggtcaccccggccgacgtcaaggagctcccgggcgcgtacgcgttcgtggtggacatgccggggctgggcacgggcgacatcaaggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacatggacaagatctcggcggtgtgcagggacggcgtgctcaccgtgaccgtcgagaagctgcccccgcccgagcccaagaagcccaagaccatcgaggtcaaggtcgcctgaggtgggactaggtcgaccgatcgtggctcttgaaatgtggggagcagtgccagcgagttgtga

SEQ ID NO: 14192 - DNA, 603 bp, Zea mays
  Clone ID: LIB3279-176-Q1-K6-G9
ccccgcgtccggcgccacttcttgctttcttgcaatggggacggaggatccacttcatcctggctgttgtccggctaattcccgaggttcagcagcagtccatctgtgttcataacatttgtagcttggagcatatctgaggtcatccgttactctcactatgctctgactaccttaaaagtttgtccagcatggctgacttatctcaggtacactgcttttatcccgctgtatccaatcggggttggcccaggagaaatgtggacaatgtaccaagccctcccgtttgtgaagaagagggacctttactcaggtttcttcgagaagttctccatgagctaccgttcctttctagtgggtgtgctggtgctctacccgttcctgtggctgaagctgtaccagcacgtgttcaaacagcgcaagtccaagctggggaaggggagcaggaagaaacgggcctgagaaaatctggctctgctcagctcagctcagctgccacttgttgctgtcatgtgaaacgctaacgggtcattgtggattatgctttggaagataacctttgtgagttgttgtctgatgcgcacggtgaagttttgctgaatc

SEQ ID NO: 14193 - DNA, 636 bp, Zea mays
  unsure (1)..(636): unsure at all n locations; Clone ID: LIB3279-176-Q1-K6-H7
ctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgntcgtctcgtgttt

SEQ ID NO: 14194 - DNA, 320 bp, Zea mays
  Clone ID: LIB3279-177-Q1-K6-A10
cccacgcgtccgccccgcgtccggtgaaactgacacccgactacgatgcccttgatgtggccaacaaaattggcatcatctaagttaataggcaactggattcgacatctatgtcctactagttctgagcataccaacagatttttctatgttactagtaattttgtttgtcatattgggttgtttttttgcaactaagtcttgttcgcagtcgcagactacatatgcctgtattgagttcctggttgccaaattaaccatcttgaactggcattattccactttacgtataatggctgaatctgttgtggcgttgtgcg

SEQ ID NO: 14195 - DNA, 685 bp, Zea mays
  unsure (1)..(685): unsure at all n locations; Clone ID: LIB3279-177-Q1-K6-A11
ccggngtcgacccacgtcgtccgtctccgcgtccgctcgacgatgctgcgaggctggacctgatgctggcgctgacgggggacggcggtgcggcgtccatggccggcttctccgcgcgcgggtggtgggtctcgaaggaggatggcgacgcggtgcagctgaaggtgccgatgccggggctggggaaggagcacgtgaagatgcgggtggagaaggacgccctggtgatcaagggggaggccggcaaggacctcgagggcgacgacgacaagggcccggcgcggtacagctaccgcatcggcctctcctcccaggctttcaagatggaccagatcaaggctgacatgaagaacggcgtgctcagggtcaccgtcccgaagatcaaggacgaggagcgcaaggacgtcttcgagatcaagatcgagtagggtgtgtgcatcggatgggtcctcccaggtctcctagttgcagtccatatccataccgtagttgcagtccatatccatatcgtagttgccatgagctagtcgtattagtagtttcaattactggagtgcagtagtcgtttctgttgcagagcagtcgtagtactagtagctttctggtggtgctccgtctctgcctgatctgaggcagcgtttacctttctgttggtcttgcaaagttcagttccctgggtggcgaa

SEQ ID NO: 14196 - DNA, 459 bp, Zea mays
  Clone ID: LIB3279-177-Q1-K6-A12
ttttcggtcccggctcccgctatctttggttctgaagaaatatttggaacttccaaagtttacttgtttgctaatttaggttgtgagtattttttttgatacatctattcaacccctctctagacattgttaattctttcgccactggtagcttactaattaagaataccctttttattttatttttattttgtctatatataaatcaagcaaagaaaggaatatactcaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaagggtccaaattttattccccggtcttggcaaggaaatactttttttttggggcccccaaattcaattcccgggcccgttttt

SEQ ID NO: 14197 - DNA, 502 bp, Zea mays
  Clone ID: LIB3279-177-Q1-K6-A7
gtgccccagcccccaacagcctccaggtctagctagggtttcgtctccgccgcttgctctaatcctctcccggcacgcgacacgcgagggcgcagcgtttatggcggcgacaccggcggacgcgaagaccgaggccgccaagatggacctcctcgaggacgacgacgagttcgaagagttcgagatcgaccaagaatgggatgagaaggaagaaggcaatgaagctgtccagcagtgggaggatgattgggatgacgatgatgtgaatgatgatttctcgctgcagctgaggaaagaactggagggaagcaacgcccagaagagctgaagtattatttctccagtttacaaatgatccttctatgccagctacttctggaaatcggaacctttatgtgatttgtgctgctgggagcaatcgaactctggagtaagaaagtaaccataccagtgatttctaagtatgaacggcaggaagttgacggacatcagtcggctattt

SEQ ID NO: 14198 - DNA, 485 bp, Zea mays
  unsure (1)..(485): unsure at all n locations; Clone ID: LIB3279-177-Q1-K6-A8
ccaggcgagccccccggcgcaaccaaaaccccaacgcgccccgcnnacgaggcgcccaaggccgagaagaaacccgcggcgaagaagccggcggaggaggagcccgcggccgagaaggcgcccgccgggaagaagccgaaggcggagaagcgggggccggggggcaagnccgcngccaaggaaggcggcgagggcaagaggggcaagaagaagggcaagaagagcgnggagaccnacaagancnacancnncaaggggcngaagcaggggcacccggacangggcancnccnccaaggccagggccancangaacnccnncannaacganancnncgagaagcncgcngcngaggccgccaagcncgcgcgcnanaacaagaagccnaccancaccncccgggagaaccagaccnccgggcgccncgnccnncccggggagcncgccaagcacgccgncnccgagggcaccaaggccggcaccaa

SEQ ID NO: 14199 - DNA, 651 bp, Zea mays
  Clone ID: LIB3279-177-Q1-K6-A9
catatccgtatcccgagtccggcgacggcagtatccgagctcgcactcgcgcacccgtccatcgcatcgcatctgtcctcccatcccctcagcgccaccgcaccgcaatcacacgcgcgccacccgcgatgacgccggcggcggcgatctccggctccagcagccacgtcgtcgtctcctccgcccgcctcaggcagccgttcacgctccctccgcgcaccgcttgcccaatcgccgccgccgcctcgcccgtgacccgccgcggggtcgcggtcgccgccgtgtcgagccccgttgtgtccgccgccgcggggaaggatgccaaacaggctcctaaggatttccttcaaatcattgattttgacaaggatacaataatgaagattcttaatcgagccatcgaggttaaggcattgataaagtctggagacaagagcttccaaccgttcaaagggaaaacaatggccatgatttttgccaagccatcaatgaggacccgtgtttcatttgagacgggattctttttacttggtgggcatgctatttatttgggtccagatgatatccagatgggcaaacgtgaggagactcgtgatgttgctagagtactttctggctataatgacatcattatggctagggtctttgctc

SEQ ID NO: 14200 - DNA, 646 bp, Zea mays
  Clone ID: LIB3279-177-Q1-K6-B10
cttcgcccactcgctccagccgcttcaccgcgccgccaccgccaccgcgaggatgccgttcaagaggttcgtggagatcgggcgcgtggccctggtgaactacggggaggactatggccgtctcgttgtcatcgtcgatgtggtcgaccagaacagggcacttgtggatgcccctgatatggtcaggtgccaggtgaacttcaagcggctctcacttactgacatcaagattgacatcaaacgtgtccccaagaagacagccctgatcaaggcgatggaggaagctgatgtgaagaccaagtgggagaacagctcatggggcaagaagctgattgtccagaagaggagagcatcgctcaatgactttgataggttcaaagtcatgctggcgaagattaagaggggcggtgctatcaggcaagagctcgccaagctgaagaaggcgtccacggcttaaggagtctctttccgtgaatgtcatgttagagtttttggttatgagttggatcagcaattcgattgagcgttgtcaaagccagaattaccaatatgttccctgtaaacccatttcaaactttatcaagcacgggcgtgctcaggatacttttgccatgaatgatatggaatatctatggtagcttgtggc

SEQ ID NO: 14201 - DNA, 146 bp, Zea mays
  unsure (1)..(146): unsure at all n locations; Clone ID: LIB3279-177-Q1-K6-B11
gtttttgagtctattttgtagtcctcgcttcccaagtgtgggttgcaggattgggtccgatcagtggagaattcattcatgatgacatgttgncgaggnagnaggnaggcagnngtcagtctttcttgtcagaatcccggcggttc

SEQ ID NO: 14202 - DNA, 413 bp, Zea mays
  Clone ID: LIB3279-177-Q1-K6-B12
ccgtcccaagctcaccacagagccgacggcgccaccgcgccgcggagaagagcggtccaaagtgcaaaacctggtggaagacccggcggtccagacctaaccctagctgggcagagcattgcccccggtgcctacgctcatgcccatgtccacctcggttacagggttgtctcctcatacaacgccctctgatgttctcttgggacatcacgtgcaatgatggacgctctctgtctgtctacaacaacccttttgcaggaccccttccttgtacactcctgcttccctgggtgaccgtcttccaggagaaagctctcactgtgaatgccatgcggatctgtcaggacactactatcttggttaacaagatcatagcttatccttgaggcataagtaggcgtactgtcccatgc

SEQ ID NO: 14203 - DNA, 646 bp, Zea mays
  Clone ID: LIB3279-177-Q1-K6-B7
cccggaccagacgcccaagtcgatcgccatggcgatgaagccggcggcggcggctccccctaccccggccgcggcgcacagcgtgttcgtctacggcagcctgatggcggacgaggtggtccgcaccatcctcaagcgcgtcccgcccgccgccccggccctcctcccaaactaccaccggttcaacatcaagggccgcatttacccggcgatcctgcccgttgagagcaagagagttgctgggagggttatcatgggtgttactgatgaagagctccagcttcttgacgcgtttgaagacgtggagtacacgaggacaagagttgagatatcattggctgactcttccgagaacatgctggctgacacttacgtgtggagtgatgcagaggatctcaatctttatggagaatgggactttgaggagtggaagaaactgcacatgaaggatttccttgcgatgacgaacggtttcatgcacgagctcgagcagcctgaatcgaagacccgggtggagacctaccaggaattcatgcaacaacaggaacagcctgcgccggggacccaggtggagggttgagagctgcaatccgctggctgctgatctacatctagtcaattcccatggaggaattgcattggcatt

SEQ ID NO: 14204 - DNA, 660 bp, Zea mays
  Clone ID: LIB3279-177-Q1-K6-B8
acccagcgtccgtcatattccataatgctaatgcttgggaagagggtgatgaagttgttctcattacctgccgccttgagaatccagatttggacaaggtgaatggatatcaaagtgacaagctcgaaacttcgggaatgagctgtacgagatgagattcaacatgaaaacgggtgctgcttcacaaaagcaattgtctgtttctgctgtggattttcctcgtgttaatgagagctatactggcagaaagcagcggtatgtctactgcactatacttgacagcattgcgaaggtgactggcatcataaagtttgatctgcatgctgaaccggaaagtggtgtgaaagaacttgaagtgggaggaaatgtacaaggcatatatgacctgggacctggtagatttggttcagaggcgatttttgttcccaagcatccaggtgtgtctggagaagaagatgacggctatttgataatctttgtacacgacgagaacacagggaaatctgaagtaaatgttatcgatgcaaagacaatgtctgctgatccagttgcggtggttgagcttcctaatagggttccttatggattccatgccttctttgtaactgaggatcaactggctcgacaggcggaggggcagtgaagatcggcacctgcaaa

SEQ ID NO: 14205 - DNA, 601 bp, Zea mays
  unsure (1)..(601): unsure at all n locations; Clone ID: LIB3279-177-Q1-K6-B9
atccacacgcccgcccacccgnccggcgccacttgttgctttcttgcaatggggagggaggatccacttcatcctggctgttgtccggcaaattcccgcaggttcaaagcagtccatctgtgttcataacatttgtagcttggagcatatctgaggtcatccgttactctcactatgctctgactaccttaaaagtttgtccagcatggctgtcttatgtcaggtacactgcttttattccgttgtttccaatcggggttggcccaggagaaatgtggacaatgtaccaagccctcccgtttgtgaagaagagggacctttactcaggtttcttcaagaagttctccatgagctaccgttcctttctagtgggtgtgctgatgctctacccgcacctgtggctgaagtctgaccaggacgggtgcagacagcgcatgcacaagctgaggaaggggagcaagaagaagcgagcctgagaaaatatcgctctattcaggtcatctcatctaccactcggtgctgagataaaaaacgctaactgatcattgaaaatgactggttcaaggtatacctcgaggagctggcttctgactctactgag

SEQ ID NO: 14206 - DNA, 541 bp, Zea mays
  Clone ID: LIB3279-177-Q1-K6-C10
attagctgacatcatacatactctggcactatcctccgatgactgtggctcacctgaaggcctctacatggtgttgctgactatggatgtctaggctttgcctgcttattatagtatggatttaaacgtgttcggtgattgtctgccgactgagctcttgagtcacatcctcctatgggtgtggctgatgcttttgacaatctgcagagtagcggaacgaccttctatacatactcacctacaggacactcatggtggattagttattggaagcctaaccactcttgtatcttgtgggaaatctctgcacaagcgtaaaggtgtgctggaggttactcatgagttgcttgaaagattagaagctcacctaagagcaactgcagaattaatggtcaccgcaaacatgatgggcaacagcgcagaataagtggcagagagagttcttagccaaacatcaatatggggattgcagggcccgactgtgagtcctgtctatcgcagacgtgatggaaaagctgatgtggaatactatgccattaat

SEQ ID NO: 14207 - DNA, 291 bp, Zea mays
  Clone ID: LIB3279-177-Q1-K6-C12
tttgttcggtctcaccgcgtgaagctcagcaatactctgatagtagcgttaattagtgcgtgtggcgttcgcgtacgtgcgcggggcagtcggttactctgttgccgcgcgcggcagctcagtggcgcgttcatggcgtgcatgatgcgggtgacgtgcgggatgggcacgtcgctgcctgagaagctcgcgccgttggcgttcgtgtggctgcagaaaggtcatcttggattgtaattctctctacttatttttgtaaattgacccagaaaagctgctgcttgcagcgcc

SEQ ID NO: 14208 - DNA, 498 bp, Zea mays
  Clone ID: LIB3279-177-Q1-K6-C7
ctcctgctcatgctatccttgcaccatgtatactcaaggaagcaggctgaggatcttgacgtgcattcttcaaaactcagcagccggaagacatatgccaatggcacatgcaactatacgctcacgtaatctgcacggaggatcgatgagcttatctggcactgagactacaaagctcgtggctacgcagtgcactctgtttgcaatggccgctctggctgaacatcgaatccccaggtctttccggtggcaactcactacaaatctctagagcatcaccaacacatcttgcttgcttcttagggcctggctcgatcaatatttaaatacttttacactgtcaagccacaggggccaagctatcaagagatcgcgactaggtgcatgacacgacaataactgacaatcaccttccacttacttgtacacatgtatttcgatcccgtggcacttttttcctgcggaggttctatttccagaattgccgttccatgtgcc

SEQ ID NO: 14209 - DNA, 643 bp, Zea mays
  Clone ID: LIB3279-177-Q1-K6-C8
gtaaaatgtctcaactcgtagtgtcatcctctcgatgagagtaaagtcatgttgcttacacatatgagggtttttatctgtcttaagagaagtacattctggatcttcttgatcgggcctctcttcggacagttgagactcctatggaactcaatattcatctatgtgccacggatggtgagcatcttgaagaccctaatcattattgtcacattgttgggagtcttgtttaccttggtgtgactcgtcctgactacttgggctagtgattcctcttatcgacgttctctttctgcctattgtgtttttcttggtggttccctcattgcttggaagactataaataggcaatggtttcttgttcgagtgtagaggctgagttgcgtgatatggcccttatgactacagaggttacttggttgcggtggttgcttgaggattttggtgtctctatctgtatgtcgactcctcttttgtctgacagtacaggtgctattagtattgctcgtggtccaatgaagcatgagcttaccaagcatattggtattgatgctcattatacacgagcataggtttaggatggtgttgtttctcttcgatgtgtcgtcggagcttcaactagcagattccttcaccaaggctc

SEQ ID NO: 14210 - DNA, 667 bp, Zea mays
  Clone ID: LIB3279-177-Q1-K6-C9
gtcgaccccgcgtccggtaactgccgcatctcaagtctcaaccctcgcctccaatcgcaacgctcccgaggagagccaggaggaagtgacggcggcgccgcgaggaaggagggatcgatcgaggatggtggacgtctcgcgcgtgcagaaggagctcaccgagtgcaaccgcgaccgggaggtatcgggcgtctccatcgcgctccacgacggcgccaacatctcccacctcaccggcaccatcgccgggcccgccgacagcccctacgagggcggcacgttcgtcatcgatatccgcctgcccggtggatatccctttgagcctccgaagatgcagttcatcaccaaagtatggcaccctaacatcagcagccaaaatggagcaatttgcttggacattctgaaagatcagtggagcccagcccttaccttgaagactgcgctcctttcccttcaagctctgctttcttctcctgcacctgatgatcctcaggatgctgttgttgcacaacagtacctgcgtgactatccaacatttgccgctacggctcgctactggacagaggccttcgcgaagagtgcatcaacgggcatggaagaagaagtgcagaagctggttgagatgggcttccaagaggattcaggtgagaagtgccctgaaaagcgt

SEQ ID NO: 14211 - DNA, 656 bp, Zea mays
  unsure (1)..(656): unsure at all n locations; Clone ID: LIB3279-177-Q1-K6-D7
cggacgcgtgggctttccatcttcccctggctcctctcgacctttccggtggttggaggaccagaagctgagctagccgcccaccttccggacgctgatgtgattgacccagtcggctggttaggaatttagcatcgcgatacctccagcggtccagcccagcttccagcacggcagtcggttgagtcaccgtccgccactccgttagcagctgccggtcgatcttgccgcgcaagcagcagaaaggccggcccagcggcgctttcttcagccatggcgtgcgcggcggcgcacatgttcgtgtacaacgccactctctgcgcctgcgaccccgggtactacctcttcaccaactccagcggcggcggcaacggaggcagcgccagcaccagctgcgtgtcattgccccgcagcggcgacgggttcggcgactggcaggtcggatccgtaggcgcgtcccggaaccagagcttctacttcctgaccccggtcctctctctcgacgtcgtccgccgcctcacccagtcccaggccgtcatcctctgggtcgcgctcctcacgctgctctcctggctcgccttctgcgccgccgccaggttcgccggccaggaccccgagcgccacaagaagctcttncgcgcccggntctgggtcag

SEQ ID NO: 14212 - DNA, 671 bp, Zea mays
  unsure (1)..(671): unsure at all n locations; Clone ID: LIB3279-177-Q1-K6-E10
cccacgcgtccgccaagaacacaagagccagccagccgcttgcgaggctcaagcgccgcagtaatgtctctggccccgtccatcccttccatcaaggtgaaggtggggcccgtctcggtggcgcccccgcaccgcgcatgccgatccttcgcggtggtcaggagctccaaggcggagggccccatccggagacccgcggcgcccccgctgtcgccaccgccaaagacgccggctctgtccactcctcccacgctgtcgcagcctcccaagcccgctgctccacccacgtcgtcggaatcgacaccaccgtctcctcagccgaaggcggctgtggccacagcccccgcggcagcgctgcagaggccgctggctggggctgtgacgctggagtaccagaggaaggtggccaaggacctgcaagactacttcaagaagaagaagctggacgaggccgaccagggcccattctttgggttcgtgcccaagaatgagatttccaacggaaggtgggccatgtttgggtttgcagtagggatgctaacagagtacgcaacaggctcggattttgttcagcaattgaagatccttctctccaatttcggaattgtggacttggattaataatgccggncttggtgttttcgttatgcataagtcttttaatggtatgt

SEQ ID NO: 14213 - DNA, 655 bp, Zea mays
  Clone ID: LIB3279-177-Q1-K6-E11
tttctttttttttcttcatatagcaaagtcacctgacgcatgtgctccattgattgccaccctgccattggaggtccgcacaaagataggtggtttcattagagctgtattttctgttttccaagacttggatttctcatttcttgagatgaacccattcaccttggtaaatggtgaaccgtatcctctggatatgagaggagaactagatgacacagctgctttcaaaaacttcaataagtggggcaacattgtgtttcccctaccatttggaagagttctcagtccctccgaaagttttatccatgaactggatgagaagacaagtgcgtctctgaaattcacggtactgaacccaaaaggacgcatctggacaatggttgcaggtggtggtgctagtgtcatatacgcagacactgttggtgatttgggatatgcttcggagctaggaaattatgcagagtacagtggagctcccaaggaggaggaggttctgcagtatgctagagtgcttttggattgcgctacctctgatcctgatggtcgtaagagagcccttctaatcggaggaggaatcgctaacttcacagatgttgcttctacatttagtggcatcattcgggctttaagagagaaggagtccaaattaaagctg

SEQ ID NO: 14214 - DNA, 609 bp, Zea mays
  Clone ID: LIB3279-177-Q1-K6-E12
ctctgactccacccacccgcccgctgcctccgccggatctcgtcggactcggatccgcccgaccaccccgcgccgccgccgcgcagcagcagcagcagatcagagaagatggccggactcgacaccttcctcttcacctcggagtccgtgaacgagggacaccctgacaagctctgcgaccaggtctcagatgctgttctggacgcttgccttgctgaggaccctgacagcaaggttgcttgcgagacctgcaccaagaccaacatggtcatggtctttggtgagatcaccaccaaggccaatgtcgactacgagaagattgtcagggagacatgccgcaacattggtttcgtgtcgaacgatgtcgggcttgacgctgaccactgcaaggtgcttgtgaacattgagcagcagtcccctgatattgctcagggtgtgcacggccacttcaccaagcgccccgaggagattggagctggtgaccaggggcacatgtttgggtatgcgactgacgagacccctgagctgatgcccctcagccatgtccttgccaccaagcttggtgctcgtctcacagaggttcgcaagaatggaacctgcccctggctc

SEQ ID NO: 14215 - DNA, 627 bp, Zea mays
  unsure (1)..(627): unsure at all n locations; Clone ID: LIB3279-177-Q1-K6-E7
aagagaagacaagcagctccagtccaatcaagaacaacaaccgcagcaagaggagaggagaggaggctcaccggtcgcgaccaaattctcccagagacggtcggaaatgaggagccaagcgctgttcttcctcacgatcgcccttctcaccgtgctcgcgcgatccagcaacaggcaccaccaccaccaccactcccacgttcaaagcagagggcagggagcagcatcaggaggaggaggaggaggaggggagctggcgagccgggcgccggcgccggcgcgcgcgtggccgtgctgcgacagctgcggcggctgcaccaggtcggagccgcggctgtgccggtgcctggacgcggcgccccgcgggtgccacccggcctgcagggactgcgtcaagtccagcctcagcgccgacccgccggtgtaccagtgcatggaccgcgtccccgacttctgcctgcgccgctgcaccgcgcctgccgccgccgccgcgcggtgaccacgcggccgacgccgacccggcgactggtctctggttgctcttgagtcttgacccacccacccaccaccaaccgttccagcctttcgcccaccccaccgncggcgaatcgtgtcgtctggactctg

SEQ ID NO: 14216 - DNA, 633 bp, Zea mays
  Clone ID: LIB3279-177-Q1-K6-E8
cggtgatccaccggcacggcaccgaacacctcgtctcgatttcgaaccaaaccctccagtgtccagccccgtctcgttcgccgcggcaggagcgagcgagcgaccgagcgagcagccatgacgccggtcgatccccactcctacaccgacggcgcgcacccggtggtctcgcgcgcggcgctcgccttctacctcgacttcgccgcctccaccatacacgcctccgtggtgctcaccctctccgcgccgcactccggcgacctcctcctcgacacccgcgctctcgccgtccactccgcctccaccgacgccgacccgccggagcccatccccttctccctcgccgcggcgcccgacccggtcctcggcacggcgctgaccctcgccctgccccgcgacaccgcctccttccggctcaccttctccacctcccccgccgcctccgcgctgcagtggttggccccgccgcagaccgcctccgcgcagcccttcgtcttctcgcagtgccagtccatccacgcccgctccgtcttcccctgccacgacacccccgccgcgcgcatcaccttctcgctcctcctcaacgtccccgagcagctctccggcgtcgccgccgcgcgccacgtcgcgcgc

SEQ ID NO: 14217 - DNA, 576 bp, Zea mays
  Clone ID: LIB3279-177-Q1-K6-E9
gttttgcgtgtgcacgcgttcgtcgtgcagcgttcaggtacaacgccaaggcgcacaacgtggtgcccgtgagcgcggcggggtacaggtcgtgcagcgcgcccaagggcgtgagggcgctcaccaccggggaacgaccgcgtcacgctgaagcgcggcgccaactacttcatctgcagcttcccaggccactgccaggccggcatgaagatcgctgtcaccgccgcgtgaggcccccggccgatcagccgcgccggcgacgacgaccgccggacacacgggctcgatcggtggccagcttattattatttttatttccctctccaaagtaaaagcgtcgcgtccttaacctgcgtgttggtaggcggtgttaggtgtgtggagaccggccggcactatagagaactaaatcgaatgatggtgtactcagtacgtactgacgtgtatgagtttgtgttgatgtggacaacaataaaggcatgtgtacgcgtttgtgaacaaaaaaaataaaaaaaagaaattaatatatgtaaatgtactacaaaaattaatatattaaattcaaaattaaaacaa

SEQ ID NO: 14218 - DNA, 597 bp, Zea mays
  Clone ID: LIB3279-177-Q1-K6-F10
ccccgcgtccgcaattatgttgttatctatttaattgttttcatgccccatgcagctcaaagttatgtgctatgagatgtcaactataactcaaactattgattacacatgttggctcttgagatgtcaaactggtgttctgtgctgatattgtctttgcagtggaccacgtgaggatgccacccgtattggttcagctggtgttgtgagaaggcaggctgtggatatctcacccctgagaagggtgaaccaggccatctacctcctcaccactggtgccagggagagcgctttcaggaacatcaaaaccattgctgagtgccttgcagatgagttgatcaacgctgccaagggctcttccaacagctacgccatcaagaagaaggacgagattgagcgtgttgccaaggccaaccgttgagtggagcttgtatcctggtgcacttgcactagaactacgtttctggcagtcgtatttttttcttgtgtttttacccatgtttagactttgagacctatatctaaggttttggttctcagtgaacaatgaaaattactgtgaaatgcagttgttttggtgcagaaatgcgcactgag

SEQ ID NO: 14219 - DNA, 658 bp, Zea mays
  Clone ID: LIB3279-177-Q1-K6-F11
tcgacccagcgtccgctaccattgaccattcgcagctgccgccgccagtgccggtgagaagagtagggaggcgcagcgcggggatggacggcggcctcgacgacgagtgggaagctagcttcctcgacgaggtgatacgcgcgacggatgaggctgaggctgtcgtctcccgcaaccctaaccccactcccacccccgcgcccgctcccatccccacgtattatcccttggccgccgcccccgtctcctacctcccagcctcttcggtctcctacatccctgccgcttcgcacctcctctccgcgatcagcttctcccctccacgggacctctcccagaggccgccgctcccgccgccgaccgctgccaccagcaccagggatgcgctggcgacgggggccgacgtcggtcgcgacttctctcctccgccccagctctcccagcgcccggcggctgatgagggcagcctcgtggccttcgcggcgtcgagctcagccagcgaccgccgcttcattagcacgggctgtggagaagcgggcgcgaagagggaagcgagggagatcgagaggctcaaaagagagctggaccgtgtctccaaggaaaggaatgaattggtgcgtaccttgtgttatcattcgtggcagtattatgtatttct

SEQ ID NO: 14220 - DNA, 656 bp, Zea mays
  Clone ID: LIB3279-177-Q1-K6-F7
gatcctcccatctgcgcacccgcaagcctattcgccgcacctcctcaggtgaccgggaagatgatgccgttgagccaaaccgacttctcgccgtcgcagttcacctcctcccagaatgccgccgccgactccaccacgccttccaagatgcgcggcgcgtccagcaccatgccgctcaccgtgaagcaggtcgtcgacgcgcagcagtctggcacgggcgacaagggcgctccgttcatcgtcaatggcgtcgagatggctaacattcgacttgtggggatggtcaatgccaaggtggagcggacgaccgatgtgaccttcacgctcgacgatggcaccggccgcctcgatttcatcagatgggtgaatgatgcttcagattcttttgaaactgctgctattcagaatggtatgtacattgcggtcattggaagcctcaagggactgcaagagaggaagcgtgctactgctttctcaatcaggcctataaccgatttcaatgaggttacgctgcatttcattcagtgtgttcggatgcatatagagaacattgaattaaaggctggcagtcctgcacgaatcagttcttctatggggagtgtcattctcaaatggattcagtgaatcaagcacaccgacatctttgaaatccagtc

SEQ ID NO: 14221 - DNA, 669 bp, Zea mays
  Clone ID: LIB3279-177-Q1-K6-F8
ccggtccggtttttctggtttcgacccagcgtccggaagctccggcctagacccgggagaagtgttggggatcaaggagtggttgattggatccatcccctcacgtgcttccctcatcaagtttcaaatccccatctgcgcgaggaactcctctctcagggaggggaaatcgctcgtaactgtgcaaacacttgttcctcgatcccccctcaatcaatcgagccgtggtgtttgttgtctctctctctctttaagatggttgcacggaggaatccatccattattgaagaaggtagtagatctgaagaaatccaggtggagctggagcgtcctcgccgctcccagaccggtcatggtagaggccaagctcggggagatgttggtgggagtagttctcaacaacctgaaatcgtccatgccgctcgagaagaacctgtccctcagccacctctccatccatcttcatcacgggctgctgcagctgccgcctctcgccccatgagccgtggtaagagaagcaggaagagaggtgttcgtgcgctcatcaggggtttaaatggaatctatgctatctgtcgtgagagttatgttcaaatcgccgagctaaaaaggaaaaatgtcgagtacaatgagaactttaggagatttatgttagagtcggacaacttt

SEQ ID NO: 14222 - DNA, 627 bp, Zea mays
  Clone ID: LIB3279-177-Q1-K6-G10
ttcatatttactttctacttaattttaaattgttggtatgctcgtaggttaactttatctctagggctaagcttcaattcgacatccgcccattcttcagtcttaatgtcgttgccgccgagtacaatagtgattccccggtgcatccacaccaaggatttcatcaccaccagccccattaacgactacaatggtgaagagtttgtcttctactctacaaggaagtactgtgccaaaaaactcaataatagagtaccacaccaaccaaaatggctaattgttgccactagagagaatgtatagcctattatgtctggcacttagtgaatcgatagctttaagggcaagttatgcactcgagtgactacaatagggaagggaggccttccaaggcaagaaagtgctcgttgtcggttgtgataacacctttccaaaaataatgttcatggctacattgtttgttcgtcattgggtaaaaactttgctatatttatttatttttattatcgtatatattattaatacttttgtttgcaatttgattatatgttctttcactttatgtacatataataattgttttatcatgcatcaattgtatctcattgtaaacttgaataatttgaa

SEQ ID NO: 14223 - DNA, 607 bp, Zea mays
  unsure (1)..(607): unsure at all n locations; Clone ID: LIB3279-177-Q1-K6-G11
cctacgcgtgggttatgtccttatctgactactacctcgaagttatagcctactgatggctgcttctgttggcgtgaagctcggtgctcctaaatggtcgacgtcttagctgatacgacatctacccgttgcaataggatcattttgtcaacacgcgtgattccaaaattgctggctttgggtcggaccaggtcatgcaatgaagtgtattttatcacttctgactgcgaccttttttttattattatcccgatcttatgtctcttgcatatgttgtaaattctcaccgagaagggagtactacctttacctgatatctatgctaatcaatgtggtgtgggcgttagctactttaattgagtgggttcagaacattcaaggcttcttgtgtgctcgtggnagaatgtggacgatgaactagagaaggacatgatcagtgcttctcaacacatgaaggccatgtgcaaatctttggtgctgccgaagtgtgtcctgacattggaattgcaggtctagaaaaacaagctcattaaatttctgaaaaaacattagaagtattaaattggtagcatttttttaagatttaaaatttatggcaagtcatcat

SEQ ID NO: 14224 - DNA, 602 bp, Zea mays
  Clone ID: LIB3279-177-Q1-K6-G7
gtcaccgcaagctcaagtgtcttcttccttgcttgcttgcctgctgcttacctctcagttccccactcacgtcccttgccgtacgtacgtgcgtccaacacaccaggtgaaaatgggctcggagacggagacggtcaacgtggaaggcatcccgttcccggcggagatcaccgtcggcaaccctctctccctcctaggcacaggtatcacggacatcgagatccacttcctgcagatcaagtacaacgccatcggagtctacctccacaacgccggcggcggcgacagcaccacgcccacgctgctgggccacctcggggcctggaagggcaagacggcggaggagctcctagcggacgccgccttctgggccgcgctggtcgcggcccccgtcgagaagctgttccgcgtcgtggtcatcaaggagatcaagggctcgcagtacggcgtgcagcttgagagctccgtccgcgaccgcctcgccgccgccgacctctacgaggacgacgaagaggaggcgctcgagaaggtcgccgacttcttccagtccaagtacttcaagccgggctccgtcgtcaccttccacttcccggcaccggcct

SEQ ID NO: 14225 - DNA, 645 bp, Zea mays
  unsure (1)..(645): unsure at all n locations; Clone ID: LIB3279-177-Q1-K6-G8
cggtcgcgtgggcggcgngacacggaggcgaaggaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccctaagacaatggagaactacaggctgctttatgacaccaagggccgcttccgtcttcacccaatcagggatgaggatgccaagttcaagctctgcaaggtgaggtccgttcagtttggccagaagggcatcccctacctgaacacctacgacggccgtaccatccgctaccccgacccgctcatcaaggccaacgacaccatcaagatcgatctggagaccaacaagatcatggacttcatcaagtttgacgtcggcaacgtggtcatggtgac

SEQ ID NO: 14226 - DNA, 623 bp, Zea mays
  Clone ID: LIB3279-177-Q1-K6-G9
cttccctataggagaaccccacatttttcgaaggaggacatgcaacaacaccgcaagtgaaccatcttgcacctgcattactggcgatgctgcttataccttcccttctacgcaggttctcccaccagactcgttaacgttaattcaatcatgcccagcgtaggttttgtagatgctgaagatttgaacttgagaaaacataactatacaagttggttggcgtattcaaatagcaagtcggcacaggtaaaatttagcagcatgcttcataagagaattcctgcagaagctggcatcagcataatttgtgcttctcctggaattgccgacacgaatgttacaagagaccttcctaagattgctgtcgctgcataccattttcttccctacttcatattccatggtcaagaaggttctaggagtgcactgtttgcagcatgtgacccccaagttccagagtactgtgagatgctcaagtcggaagactagccagtctgtgcttgcattaactacgactgtaatccgatgaacgcgtctgaagaagcgcacagccttgaaacctcgcagctggtctcggagaagacgctcgagatgatcggccttccgccggatgccctgcacag

SEQ ID NO: 14227 - DNA, 668 bp, Zea mays
  unsure (1)..(668): unsure at all n locations; Clone ID: LIB3279-177-Q1-K6-H10
ggtaagaagaagctctaagacaactgaggaagaacttggtcgtccgagcaaaacccatgccaagcttctaccaagagggacccccaccaaaggttgaacttaagaaggtgcctccaactcgtgccaagtcaccaaaattgacacggagaaagagctgcagtgaaacccctcatacaccagagggaggaaatggcagtgcagtatgctgccggttgcatcgccacagcattgggaacgccagagatgttagcagcaaggcacaatgttctccaaagagcgcctcaaaggctggatcagctactagatccagggtcaccaaatccagggaagacctgaaggcttccgtgaagaaagtgggactgccaagcgccgcgaacttcgctgtacaaacctaactcatcaggcattcactcccatatgccatttttcattttaatttatacctcacatcaccaaaaagatggcctcgtgttatttttgcattgtccttgtaagaacctggctaccagagacctgcgctgttcccgtcctgtaaatttgttgaaggttttgtaagggggtaaccgagtcagtcctgtgagaaccaagcgggtgggcagctgatgggatattggagtgacatattgtcgttgtgtggcggcattcgcgcgttctatgtattgnatctg

SEQ ID NO: 14228 - DNA, 668 bp, Zea mays
  unsure (1)..(668): unsure at all n locations; Clone ID: LIB3279-177-Q1-K6-H11
accggtccgtttttttttttttgtcccagcgtccgccccgcgtccgtcaaaacctgtcacctgaaattttgaagttgtatataactcaagaaggtgttcggtcaccattttcctcaaagccctcagagaagcctgttccaaatgcgactcttcaagtcactggcgctgttggttggagaagagagggacttgtgtacaagaagaatgaggttttcttggacatagttgagagtgtaaaccttcttatgtcttcgaaagggagtgttctaagatgtgatgtgacgggaaagattcttatgaaatgcttcctttctggaatgcctgatctgaagctgggattaaatgacaagattggacttgaaaaagaggcccaactaaagtccagaccagcaaagagtgggaagactatagaacttgatgatgtcacattccaccagtgtgtcaacttaacaagatttaactcagaaaagacagtcagtttcgtgccacctgacggtgaatttgagttgatgaagtatcgaatcacagagggtgtaaaccttccattccgtgttctgccgacaatcaaggaattgggccgaacacgcatggagatcaacgtgaaagtcaagagtgttttcggtgctaagatgtttgcacttggtgtcgntgntaaggttccagttccg

SEQ ID NO: 14229 - DNA, 666 bp, Zea mays
  unsure (1)..(666): unsure at all n locations; Clone ID: LIB3279-177-Q1-K6-H7
gaaaagccttgcctgcaatatctgatccagagatcgaagctgcatttaaggatttgttggctgctagttggaatgaacttccagattctctcgtagcggaagcaaagaaagcagtatctaaagcgaccgatgataatgctggtcaagaggctttgaaaaagtattttgtgcagctgaggcatgtgaagatttcagtggaaccttggttaccctaagaatggctcttgatgatctgtgtggcctgactggcgaaaatgtgggtcctttacctggttatattgaagatgctgttaaagctgcatataatcgctacatgacatatctggagtcctttggccctgaggaaaattatctaagaaagaaggtggagactgagttgggcacaaaaatgatacacctcaaaatgagatgcagtggcataggttccgagtggggaaagatctccctgattggcacctcggggatctcaggctcctatgttgagctaagggcatgatgggaagcctgcagatcagaaccatggaaattatggatgagctgaggaagtctgtagatcagaatatgccgttctacattnntcctttccctttgtagctaccatgngcataacaatgagaccatcaaacagctgtgcattttagtatggaaatactcccgtctgtgtct

SEQ ID NO: 14230 - DNA, 683 bp, Zea mays
  unsure (1)..(683): unsure at all n locations; Clone ID: LIB3279-178-Q1-K6-A10
ctttcatatttattcgcatatggattggttttctgaatatgttcagtctcatgctggtgaggttgttatcgaagatagatccacatgtgagattattggaatcaactctatttatatccaagttcatgatggcagtattagaaaacttatcgatgtccgttttgttccaaaattgaagataaatcttatttctttgagcactttagaagcaatgagattcaattttgctgctattgatggtgttcttaaggtttcacgtggcaaccgtattatcttgaagggcaaccgtttgaataatctctattacttgcaatattcaacaattgatgctaaagctgtttctattgcgttccagaagagaggttattttgatgatacgaagtcgtgctccaattccaagtctaatgattccttagacttggttgatattcaaatttaacatcctagtggtgtttgggaaaacagttttatagatttagcgtcaaggggagatttgttggataagatcatatgaccatatctctatcttctttgccttgttggataagatcatgtgaccctatctctatctcctttgcctatataaataggcccctcttataccctgtacttgaacacacataatagatctttttcctgtggtttttttctccttcacattgngggagttttttccacgttaa

SEQ ID NO: 14231 - DNA, 672 bp, Zea mays
  unsure (1)..(672): unsure at all n locations; Clone ID: LIB3279-178-Q1-K6-A11
cccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggctnttgctatggcaaacacaagtgc

SEQ ID NO: 14232 - DNA, 557 bp, Zea mays
  unsure (1)..(557): unsure at all n locations; Clone ID: LIB3279-178-Q1-K6-A12
cacgataggggcgcacacacgcgatcgctgtgcgcggcatggcgctgctctggggcgcctcgctcgaccggatcgatcggaacactgcctaaccctctgctacggatgataggcatgtccgcctcaggctctgcacccgaaacggcactactgcccagggcagccggcgtacaacttctctctacctgtccgcagaccccaaccaccaccgcnggcggtgtgcgaccatggcatgccgggaaagaacaagacgatctccacaggaaagaagggcggcacgaaaaagaccgtcgaccctttctctaagaaggattgctgtgacatcaaggcaccgtcggtgttcagggtgcgcaacatcggaaagactctattgtccaggacacagggtaccaggattgctcctgagggtctgaagcacactacctatgaggttggccttactgatcttcagggcgacgaggatcaagcttacacgaaaatcaggctccgtgctgaagatgaccatgcatgaatgagctcaaaacttttggggtatgaattntaccactgacaaactc

SEQ ID NO: 14233 - DNA, 586 bp, Zea mays
  Clone ID: LIB3279-178-Q1-K6-A7
ggtgtaattgcctacatcttgctctgtgggagtaggcctttctgggcgcgcacggagtcgggaatcttccgagctgtcttgaaggcggaaccgagttttgatgaggccccatggcccactctcacggctgaagctaaagattttgtaaaaaggcttcttaacaaggattaccgcaagagaatgacggctgcacaagctctcagtcatccatggatccgtaattctcaacaagtgaaggttcctttggatatgataatctataagctaatgagagcgtacatcagctcgtcttcgctgcggaagtctgctttgagggccctagccaagacgctgacgacggaccaactcttttatgtgagggagcattttgaattgctgggcccgaacaagaatggttacatctcattgcaaaatctgaaatcggctctagcgaagaacttcacggatgcaatgaaggactccagggttgtcgattttgttaacaccgaaactggatttcgaagagttcgccgcttacgccatcagcgtctaccagatggaagccctggagacctgcgagcagcacgcgaggcgcgcgtacgagctg

SEQ ID NO: 14234 - DNA, 646 bp, Zea mays
  unsure (1)..(646): unsure at all n locations; Clone ID: LIB3279-178-Q1-K6-A8
gttcttgtgaccctccctcagccgcgtcgcgtcgcatcctacgatccaaagctctctctgctcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcgggagttgtggccgtggaggtcaccggtgggcctgagattcccttccaccccggtagggaggacaagcctcagcccccacctgagggccgccttcctgatgccactaagggttctgaccacctgaggcaagtttttggcaagcagatgggcttgagcgatcaggacattgttgccctctctggtggccacaccttgngaaggtgccacaaagagcggtctggtttcgagggggcctggactacaaaccctntggtctttgacaactcttac

SEQ ID NO: 14235 - DNA, 639 bp, Zea mays
  Clone ID: LIB3279-178-Q1-K6-A9
ttcggagggtatctgagggtgtgaagcttgagctgtgcaccaacgacaaggtcgggctgctatccgaggtcacccgcatcttccgcgagaacagcctgacggttacgagggcggaggtgaccacgcggggcaggatggccgtgaacacgttctacgtgcgcggctccgcgggagaggccgtcgaccagaaggcgatcgactccatcagggaggccataggccacagcctccaggtgaaaggccaggccgagccaccggagccgcagaagaaagagtcccccacgtggttcctcttcgccaacctgtttcgcccgaggtcgctctacagctttgggttcatgcgctgatcgagccgtcgcttccaagaaccgctgcccgtgcagtaagttcaccaccgttcacgaagcaatccaggacatggggggatcttcttcagaaggtggaaaagccttcgttgtgtcctagcagtgcaggtttggcatgtaggtagagcatggcatgggtggtgttcatatatatatctgccgtcgtcgtcatcagcatcatcatctgtgtcatcatcatcagcgtctgtaaatatgacagcatttgaccatttgtacatataacgtgtaaactaaaggacgtaaatataagctg

SEQ ID NO: 14236 - DNA, 393 bp, Zea mays
  Clone ID: LIB3279-178-Q1-K6-B10
ctagatcgcgagcggccgcccgcgatctagaactagtgtattgttcccccctatctactacgtggcataggttgtattctagtatgttgaaagctcatggtgccgtgctgtatcaataaggtgttatgcgcatagagtggctcaggaccagggctgcgtttgcgctttgccactggctgtgttgtatgtttcttctgctgctatgccattagggtttagggatggtgtgtggatggcgtcgtgcttgtagtgttagctggatttgaagcggactacatgtaggtttgttcaatgtctagtatctattagctgaaggtgtttgcctgtaagttgtaactctctgtgaactgtgatgcgggataatgctaagaagaatagatgatcgttggagtc

SEQ ID NO: 14237 - DNA, 505 bp, Zea mays
  unsure (1)..(505): unsure at all n locations; Clone ID: LIB3279-178-Q1-K6-B11
ctccaccggaccttttgattctttcaagtctgcctactctgctgccgcggaggaattcaaggacaaggaaatcaagttccttattggtgacatcgaagccagccagggtgccttccagtactttggcctgaaagaggaccagacaccccttatcctcatccaggatggtgactccaagaagttcttgaaggttcacgttgaggctgaccagatcgtctcttggttgaaggagtactttgacggcaaattgactccgttcaggaagtctgagcctattcctgaggtcaacaatgagcctgttaaggtggttgttgctgacaacgtccacgacttcgtcttcaaatctggcaaaaatgtccttattgaattctatgccccctggtgcggacactgcaagaagctggcgcccatcttggacgaggcagccaccactctccagagcgacgaggaagtcgtgattgctaagatggacgcgactgccaatgacngtcccagtgagtttgac

SEQ ID NO: 14238 - DNA, 631 bp, Zea mays
  unsure (1)..(631): unsure at all n locations; Clone ID: LIB3279-178-Q1-K6-B7
ccccgcgtccggcgcccacctcctctgctctctcctctcccccacctctgcgtccgtgcgttgtgtttgtttaggcggcaaccgcgaggcgcaatggcggccgggcgagagctggtggtgagtttcggcgagatgttgatagacttcgtgcccaccgtggcgggggtctcgctggcggaggcgccggccttcctcaaggcgcccgggggcgcgcccgccaacgtcgccatcgcggtctcgcgcctcggcggcggggccgcctttgtcggcaagctcggcgacgacgagttcggccgcatgctcgccgccatcctccgcgacaacggcgtcgacgacggcggcgtcgtcttcgactccggcgcgcgcaccgcgctcgccttcgtcaccctgcgcgccgacggggagcgcgagttcatgttctaccgcaaccccagcgctgacatgctcctcaccgccgacgagctcaacgtcgagctcatcaagagggctgcggtcttccactacggatcaataagcttgattgctgagccttgccggacagcacatctccgtgccatggagattgccaaagaggcaggtgcactgctctcttatgacccannacctgaggaggcactatggccatcccgtg

SEQ ID NO: 14239 - DNA, 354 bp, Zea mays
  unsure (1)..(354): unsure at all n locations; Clone ID: LIB3279-178-Q1-K6-B8
caggatcatgnaccaaaagataatgcaatgtccaccgagtgttttctggagttgactaacacacccacctggcgcgccgcaactgaatcagagataggaagtcaatcagtgcaagtttgtaagataagctagcttgcccgttattctggtttggaagtcaaaatagttcgttcaacttagcctaggcagttgacggttttgttgtgtttctgagggactctgatacgaaaatcaaattccctttgttctgtgtttggcgctgcaacctgtaaatggagtgctttttttttgcgtaccgtgatatctgcgttttggaatactataatatcagaatttggagcgtgtttcgccnaa

SEQ ID NO: 14240 - DNA, 500 bp, Zea mays
  unsure (1)..(500): unsure at all n locations; Clone ID: LIB3279-178-Q1-K6-B9
ctttggtgaccattgtgacacaaaagatggggcttcggtttcagtactggttgggagaggcatgatttttttgtcaacgaacaatgtcatagaagaggtgttcgggaagggctccagtgaagatggaagtgacactggtactggccaggaccttatctgagccagaggcggaggcttcttttcagctgcgaaacctttagcagctcccccttgttctctgaatctgtacagcagtagtagttgcctattttgatttgatgcctcacttgttcgtataggaatctctcatccctgtccttgaacatcatctgcttgcgatattggtcgcatggctaatgtaaatccgacgatgatatcatctgtcgatgatctgttgttaggctgtagcatgtacgtatcatctttgtagtgacggtgtgtcttgaccgtgtgtcttgacctgagcatttttcccaaannaaaaaannnnaaaaaaaaaaaaaanaanaaaaanannnana

SEQ ID NO: 14241 - DNA, 654 bp, Zea mays
  unsure (1)..(654): unsure at all n locations; Clone ID: LIB3279-178-Q1-K6-C10
gttcttcttccctcaatccattgcaagcaacaggaggagaaaaaacaggagcgagacctcgcagctgacgcgcacaaggcaaaacccaatcggagccgtggaccgggccggagatagggctcgaggccatggcaagcggaggcgagggcgcagggagcggcgagtccccacccgctgcctcagtggaggcggcagcgggggaggcgacgctgcacatccggtgcgcgaacggctctaagttcacggtgcagacggacctgggcgccacggtgggcgggttcaaggaggtcgtagccgggagctgcgacgtgccggcgccgcagcagcgtctgatctacaagggccgcatcctcaaggacgagcaaaccctagaaagctacggcgttgagacagatcacacaattcacttggtgcgtggtgttgccccaccagctgcatccagtgcacctgctgctgccagctcccttgcttcatctactcctagtagcgtcccggcaggtggcctgngagatctatttccaggtgttggtgctccaggaagtggcaggtcatcaggtatatttgggccaggatttccagagttagagcaagttgagcagcatttaagccagaatcccaacttgatgagggagataatgaatatgccagcgatgc

SEQ ID NO: 14242 - DNA, 501 bp, Zea mays
  unsure (1)..(501): unsure at all n locations; Clone ID: LIB3279-178-Q1-K6-C11
cagggtgagaaggtgctatcaacttaattgtgttgtcctattgtggatctttacaagagccttgataggtgaccaacattaccccatacgtatttccatgccaaaaattagtttcttgggattttttgtggagatatttcttcatngaaaaattcataggtgttaagccttcattattgtcgaaaatgattgtatatggccatttttagcaaaaaaatacaggacgtatacccatgaatctttggtgagagactttattacttatcacatacatctttacttctagaaattagttttttatttttggtggagtatactacatcatgaaaaaattgtatgtgttagccttcaatagtgttgaaaatggtcatccatgcccattttccgctgaaaatactggttgtatacccatggatatttagtgagaggctcctacttatttggacttttgtggatgcttatttattcatgaaaaattcatannggtggtagccttcnnna

SEQ ID NO: 14243 - DNA, 633 bp, Zea mays
  unsure (1)..(633): unsure at all n locations; Clone ID: LIB3279-178-Q1-K6-C12
ttttgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctccgggagaagtacgggcccatcttcaccatgcggatggggcagcgcaccctcatcgtggtcacctcggcaggagctcatccacgaggcgctggtgaagcagggccccatgttcgcgagccggcccgaggacagccccacccgcctcctcttcagcgtcggcaagtgcaccgtcaactcggcgccctacggccccctgtggcgtgctctgcgccgcaacttcgtcgccgagatcgtgtccccgcaccgcgtcaagggcttctcctggatccggnagtgggccgtggacgcgcacttgcgccgcctccgcgccgagctcgcggcggacggtgccgtg

SEQ ID NO: 14244 - DNA, 675 bp, Zea mays
  Clone ID: LIB3279-178-Q1-K6-C7
cgccgccactcaccagcaaattcccgagccgccccttccccatctctttcgcgacccatttgatcgattcctgatggcgcccaaggccgagaagaagcccgcggagaagaagccggcggaggagaaggccgagaagaagccaagggcggagaagcgcgtgccgagcaaggagggcggcgagaagaagggaaagaagaaggcgaagaagagcgtcgagacgtacaagatctacatcttcaaggtgctcaagcaggtgcacccggacattggcatctcgtccaaggccatgtccatcatgaactccttcatcaacgacatcttcgagaagctcgccgccgaggccgccaagctcgcccgctacaacaagaagcccaccatcacctcccgggagatccagacctcggtgcgcctcgtcctccccggcgagctcgccaagcacgccgtatccgaagggaccaaggcggttaccaagtttacatcctcttagggtgccgccgcacgttgctacgatcctgtttaattctcatatttaggcctgtgctaggttgcttctgcaacaatgtagaatttgttataattgctgaatgaatcagttacccctgttgaagtttctaatatattgtaatcttgctagtataatttgcttcaacctggatggggttccattcgtcgttt

SEQ ID NO: 14245 - DNA, 617 bp, Zea mays
  Clone ID: LIB3279-178-Q1-K6-C8
ccccgctccgcctccactcctcgcgccgctgccgcatctcctctacaggtaagaaggagagaaagagggcgaaatggtgaagcacaacaacgtcatccccacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaggctgcgggcattccaaaaaggcttgctccaaccattggcatttctgtggatcaccgccgcaagaacaaatcccttgaggggctgcaggccaatgtccagaggcttaagacatacaaggccaagctggttatcttcccaaggcgtgctcgcaaggtcaaggctggtgactctactctggaggagcttaccactgctacccaggtacagggtgactacatgccaattactcgcggtgagaagcgctctgtagaggttgtgaaggtcacagatgagatgaaggcgtttgcggcctatggcaagct

SEQ ID NO: 14246 - DNA, 628 bp, Zea mays
  unsure (1)..(628): unsure at all n locations; Clone ID: LIB3279-178-Q1-K6-C9
gttctgggtctcaaaaactcgagtgtgattttagaagagaatggtcctgaggcgaaggcattattcacgtggacccggagtccanacctgcagaaaatccacaagcgaaattggctgccagctttaattctgtgtctggaacttcgtttccttcctaaacagaaagaggcgtaaagaaaacgaaagcaaatttcgcaggtggaaagaagaggaagcgaacgagaggcaacggtggccggtcgcgggacgggtggggccacgcctggcctgacgcgggaagccggccggaaccatccaactccgccgcgtcgtcgtcgccttcgtctcgcgtgctcaccaagagaacaaaacgcgagcagccaagaattcaacgtccacggtccgcccaccctccgtttccgcttcctccctccacgtcgtctcggtcttcctctcctgtaatcccgtgacacgggtggctgcgacggcgaatcagatccctacccgtggcgttggtcgtgaattggcgccgtctccccctgccagccggattccctgctttgttctcaggcaacattttgttcactagtgtggtagctttgttgattggagtgcgcaatgggaggctgtgcgggaaaagtacgtcgtg

SEQ ID NO: 14247 - DNA, 630 bp, Zea mays
  Clone ID: LIB3279-178-Q1-K6-D10
ttctcatgaaactaggacatgccaatttggatcagcttgtgagttttatcacccaaaagatcggtgctcaggcagagggggagtgattgatggtactgactatggacatgattttgccacgaagtcacggaatgttctgcaggaactggcaatatatcctgaaaggcctgatgaacttgagtgttctcactacatgaagcatggctactgtaaatataagatgaactgcaaatttcatcatccaagagatcgtcttccaaagaaataggaccatttgctacaaccactgttgtaactggctgtcgttgatgagtggaccaagtactgatgatgggatgatgatgggacagaaatgcaggaaggaagccatagtcttcctttttgaagagatcgattctactcatgtctagtgtcgttagagttctcgtaccagatgcgaactgcctggtggcttcccaactaccgttcattcatatactaccaaacattgctgtgatctaggccgatgcggcgctaacctgagattgtgggttactgtagctcagtatgcagctcaggtacctgcacttgctcaagattgcgataacgatcagattaaaatagcagaccacgcatattctgcaacttgcg

SEQ ID NO: 14248 - DNA, 660 bp, Zea mays
  Clone ID: LIB3279-178-Q1-K6-D11
aactgatgggttattattattttgttaagtatttttttaaagtgctataatataatcagtatagctgacctgcgttttttctaaggtagtatttactatgaagtgcagtttgcaacccattttattgtctataatattatatatgtctaatagtatctttaattctatgctatcaggcaaacctaaaaagttggcatactgctcgttttcttcgacactataaatatggtgaaggcaaatgttatactgctaaaaccgtaagggtctgagaacctacacttgagtggtccctggaaaaagttgacagtacctcttacgcaggtaattgaggggttataattatttcgttaagtatttgttttcagtgctataatgtaatgagtatagctgacctgtgttttttccaaggtagtatttactatgtagtgcagtttgcaacccggtttattgtctataataatattatatccatctaactgtatgcttatttttatgctatcaagcaaaccaaaaaagttgccatacagctagttttcttcgacactataaatcttgtattgttaatctcttttggttatgaaataatgatagagattgatgtcctacaaaagcttacaagaaatgatattgcaggcaaatagtaaagtatacattctcgca

SEQ ID NO: 14249 - DNA, 616 bp, Zea mays
  unsure (1)..(616): unsure at all n locations; Clone ID: LIB3279-178-Q1-K6-D12
agtcgcttggcnatagctcggaagttacaatctcaagttcctcgacgaccattatagcagatgctgctagcaaagacgatatccaggccagaatcgcgcagctgaagagagagctttctcagacggactcgacgtatgactctgagaagttggcagagagaattgcaaagctttctggtggagttgctgtggttaaggttggagcatcgaccgaggcagagctagaggaccgcaagctccgcatagaggacgcgaagaatgcgacttttgcagcaatagaggaaggtattgttccaggaggcggtgcagcgtatgttcatctatcgacattcgtgccggctatcaaggagacgttggatgatcctgaggagcgcctaggagctgatatcattcagaaggctttggtggcacctgcagcgctgatagcccataatgctggggtggaaggtcaggtgattgtggataaaatccgggaaagcgagtgggagttcggttacaacgccatggcggacaagcacgagaacctggtggaggctggtgtgatcgaccctgccaaagtgacaaggtgcgccctgcagaacgccgcctccgtggctgggaaggtgctgactaccca

SEQ ID NO: 14250 - DNA, 667 bp, Zea mays
  unsure (1)..(667): unsure at all n locations; Clone ID: LIB3279-178-Q1-K6-D7
ccccgcgtccgctgtngaatacgacaagaaattttggagacaatcgggaagaagctgaaaaagaacaatgttgctcttgacattgttgactttggtgaatccgatgatgaaaagcctgaaaaactggaagcattgatcgctgctgttaacagcagtgatagcagtcacattgttcatgtccctcctggtgaaaatgctctctctgatgtcctcctaagcactcctatatttactggtgaagaaggtggaagtggttttgctgcttctgcagcagctgccgtagctactggagcatctggatttgaatttggtgtggacccaaatgtagatccagagttggcactcgccctgcggttgtctatggaagaagaacgagcaaggcaagaggctattgcaaaaaaggctgcagaagatacatctaataccgaaaatatcaatgcctcaagctcaaacagcgattctgttatggctgaagcagaacttgcctcaaatgctgctgctggtgacaagcaagaacagccaaaggatgatgacgatctactacagcaggcacttgcaatgtcaatggagggtggcgcttcaggatctgcagctgtgactgactccgctatggcagaagctggtgcagttgaccctgacttagcgttggctcttcaaatgtctgtcc

SEQ ID NO: 14251 - DNA, 608 bp, Zea mays
  Clone ID: LIB3279-178-Q1-K6-D8
tgccgctccagcctttcgctagggtttatccaccggcggcgcgcgcgacggcggcaagatggtgcagcgtctgacctaccgcaagcggcacagctatgccacgaagtccaaccagacgcgggtcgtcaagacccctggtggcaagctcgtgtaccagtacaccaagaagagagccagcgggcccaagtgtcccgtgaccgggaagaagatccagggcattccccatctgaggccagctgagtacaaaaggtccaggttgtctaggaaccgcagaactgtgaaccgtccctatgggggagtactatctggaactgcagttagagaaaggatcatccgtgctttcctggttgaagagcagaagattgtcaagaaggtgttgaaattacagaagaccaaagacaagacttcctcaaaaaagtaactctgaaacagaagtgagccactcttctgcagcaagggaagacatttttgtcgacagttattatcaatggcttagtctcttctagctgttctattgttcttgtatcttgagcggacaactggtttctagggcaccttgaaatctgtctacgagatctctaagattatgagatgacatatgaccccct

SEQ ID NO: 14252 - DNA, 434 bp, Zea mays
  unsure (1)..(434): unsure at all n locations; Clone ID: LIB3279-178-Q1-K6-D9
actccgctgcacgcccagcccgttcgagcgcgcgtgcgagggncttgagagatctcatatggcgttgggtctgacaccaccacgggatccagcccggtgccccggcagttccgcccgaaacactgggttaaaatcttctgccgggccaacaatgaactgctgcctgggcggccgcgatggagatacctggctgggccgaggcgaccccgacgccaatgaccagcgctgctccaaggatctgcccgttgatactccggccagggacgaggaaagactgccggaggtcccgctcgttgacgagatccggaccatggtactccagcactatctccggcggcaccacttgcataaactattgcccttcaaaccagggccactcagtacagagcccttctggggacttgcagcagggacatcgacgacggcttcttgtg

SEQ ID NO: 14253 - DNA, 578 bp, Zea mays
  unsure (1)..(578): unsure at all n locations; Clone ID: LIB3279-178-Q1-K6-E10
ccccgcgtccgatccgttcaggcagtccccgacatcgacatcgccgccgccgctctccatcataaacaatctactcctcatcgtcgcctcaccgtccccttctcctacttgtaattcccctcctgcttgtgtggcaggggcctctcccgcgcgatggggaagcacgagttcctgacgccgaaggcgatcgcgaatcggatcaaggcgaaggggctgcagaagctgcggtggtactgccagatgtgtcagaagcagtgccgcgacgagaacgggttcaagtgccactgcatgtcggagtcgcaccagcggcagatgcaggtgttcggcatggcgcccgaccgcgtcgtcgagggcttctccgaggaattcctcgagtccttcctctccctcatccgccgcgcgcaccgccactcccgcgtcgccgccaccgttgtctacaacgagtacatcgccgaccggcaccacgtccacatgaactctacgcggtgggccacgctcaccgagttcgtcaagctcctgnggcgcgaagggtactgcaaggttgaggacacgcccaaggggtggttcatgacctacat

SEQ ID NO: 14254 - DNA, 677 bp, Zea mays
  unsure (1)..(677): unsure at all n locations; Clone ID: LIB3279-178-Q1-K6-E11
gcttgaagcacctcaacctatccaagaacaagatcctgtcgctgccgatggagctgggcaacctgagccagctcgagtacttctacctgcgcgacaactactacatccagatcaccataccaccggggctgatctcgcggcttgggaagctgcaggtgctggaggttttcaccgcgagcatcgtctccgtcgcggacaactacgtcgcgccagtcattgacgacctcgagagcagcggcgcgcgcatggcgtcgctcggcatctggctcgacaccacccgcgacgtggagcgcctcgcgcggctagcgccgggcgtgcgcgcccggtcgctgcacctgcgcaagttagaagggacgcgcgccctgccgctgctgtccgcggagcacgcgccggagcttgccggcgtgcaggagagcctgcgggagctggtggtctactcctccgacgtcgaggaggtcacggccgacgcgcacgtgcccatgctggaggtcatcaagtttgggttccttacgaagctgcgcgtcatgngcgtggtcccacgccgccgggtccaacctccgcgaggtcgccatgggcgcgtgccacagtctaactcacctgacgtgggtgcagaacctnccctgcctagaatcgctgaacctcagcgggtgcaacgggctgacgagactgctgggtgg

SEQ ID NO: 14255 - DNA, 589 bp, Zea mays
  unsure (1)..(589): unsure at all n locations; Clone ID: LIB3279-178-Q1-K6-E7
agcaactctacaaatttgctttagtataatatccttatatttattgtttggtttttactatgttttttcctggtttttgcagtatgtcatttagaatttcctggagttgttcttcgaacattcatagaccttgtagtcttgatgtgaaattatggcagtaacatgatgtaccgactactgtctgcatttttcaggagcatttgttatctctattctctcatcaccgactaacattgagttgtgttactttgacgagtttgagacttctcagagctcagatactctaaggaggagcaaattcccgttgaagaatttgagagaaggaatttcacctatctactgaagtgaaagaacccaaggtgtttgcacctgggaacttgagagaccctgacattctttcactgaattggcctggttgtccttgaggacaggacagcgagacacccaggttcctgtcgcaagcaggaccacaaaccgccaacggtgaagatgtgcagtcgtctgtgtgatacggagtagtatgggtcttgccatgaagctacctgcnaaatctaggatgggggttcggttctcccccagatctcaacgc

SEQ ID NO: 14256 - DNA, 598 bp, Zea mays
  Clone ID: LIB3279-178-Q1-K6-E8
ctcccctgttcggttttaggagacctgcgccgacccttcggccacgcgagctcgccgacatggtcgcccacaggttccatcagtaccaggtggtgggtcagcgcgctggcgaccccgatcgatgagcaccccaagatctaccgcatgaagctctgggccactaactaggttagtgccaaggcgaagttctggtacttcctgagaaagctgatgaaggtgaagaagagcaatggccagatgctcgccatcaacgagatcttcgagcgcaacccaaccaccatcaagaactacggcatctggttgcggttccagatcaggacggggtaccacaacatgtacaaggagtaccgcgacacgaccctgaacggcgccgtggagcagatgtacaacgagatggcctagcgccaccgcgtgaggtacccctgcatgcagatcatcatgacggtgatggtccacttcaagctgcgctagagggacaacacgaagcacttccacaactcggtgatcaagttcccgatcgtgtaccgcatggtgaggccgaccaccaggaagctcacgaccaccttcaagacgtccaggcccaagctgttcatgtgat

SEQ ID NO: 14257 - DNA, 343 bp, Zea mays
  Clone ID: LIB3279-178-Q1-K6-E9
cacatgacatttatatgtggcgacattcaattcgacccgatgctccaatcgacataaaaggtcttaatactggtcattttgctctgcacattatgtagtggtgggatagtggtataaaagcacaacttagtatggatggtgcgactctgcgtaggaatttatttattaatctgttgacatacgaggggaacacatatcgatttaacattcctggacatatacaagagtaccttgaccgcattatggaaaaaattagatgaaatagatagttatgtttatgtttattttgtatttattgatttgaattttcgccattaaaatttctttttaaaatgtatataat

SEQ ID NO: 14258 - DNA, 650 bp, Zea mays
  unsure (1)..(650): unsure at all n locations; Clone ID: LIB3279-178-Q1-K6-F10
cccacgcgtccggctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgaaatgtgcatgactggtctggacaagaagaaagcttctgtctttttcaagactaatgctgatgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatgccactgctctgtcttatggtgaccttgtcaagagggtccttcggtgctttggcccctcgnagttttccgttgccgtgaccattcttcgcgggcgtggccatgccgggacatgnngaaaggcacnnttgtgcagagtctatgact

SEQ ID NO: 14259 - DNA, 659 bp, Zea mays
  Clone ID: LIB3279-178-Q1-K6-F11
cggtcgcgtgggcatccggcggccaaggggagttacacgctagccggcggtcggccagccgccgccaaccgcctcagccccaacagtcgcaccgccgccgccgaggcaaactcgaagccacccccgccgccgcagccacagccgcgccgagcttgagccgtcgttgctccgctgaatcgcccccatcgtctctcctgaagagagaggacatttattgagacagcatgcctaagataaagacaagtcgtgtcaagtatcctgaaggatgggagcttattgaaccaaccatccgtgagttggatgccaaaatgagagaagctgaaaatgatccacatgatggaaagagaaagtgtgaagctctctggcctatttttcgtatttctcatcaaaggagccgctacatatatgatctttactacagaaggaaggagatatcacgggagctttatgagttttgcctggaccagagctatgcagatcgtaacctgatcgcaaagtggaaaaagccaggatacgagcgcctttgctgcctccggtgcatacagacacgtgaccacaactttgcaacgacttgtgtctgccgagtccccaagcatctgagggaggagcaagtgatagaatgtgtccattgcggctgcaggggttgtgccagcggtgac

SEQ ID NO: 14260 - DNA, 458 bp, Zea mays
  Clone ID: LIB3279-178-Q1-K6-F12
cgtcgcagcgtcttccgcccgggctaccacaatgccgaagcagatccacgagatcaaggacttcctgctgacggcacggcggaaggacgcgcggtcggtgcggatcaagcgggccaaggacgccgtcaagttcaaggtgcgctgctccaggtacctctacaccctctgcgtccacgactccgacaaggccaacaagctcaagcagtcgctcccgccaggtctgactgtccaggagatttaaggtatcaagccgcaaactgtgcctttttttgcggtgtcagggacgtttgctccagtgtttactttagtatgtaggtgggctccattgctgtgtttgaatgaattatgaagtttgagtttgggatgtgaatgatgtgtcgaacctatgagcatgtggtgtaatggtaccccagaacgcaaaagatggcaatctatcataagttaaactgatttctgtg

SEQ ID NO: 14261 - DNA, 639 bp, Zea mays
  unsure (1)..(639): unsure at all n locations; Clone ID: LIB3279-178-Q1-K6-F7
cccacgcgtccgctcccgggtctccagcattcctatcctctccccgcccgcccgtgccgccgccgccgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagcgtcaattggtgctaatacatgggtggtcagtggaactccacagacaaagaagctgcaagatctgcttccgtcgattatcaaccagcttggtcctgacaacctggacaatctgcggaggctcgcagagcaattccagaagcaggcctctggtgcttctggtgcagaggctggtgccagcgctggggctgttcaggacgatgatgatgacgttcctgagcttgtccctggagagacatttgaggaggccgcggaagagaaaaagagtcctcatgattntgctacatgcctgctgttgntaaaccatgccatta

SEQ ID NO: 14262 - DNA, 672 bp, Zea mays
  unsure (1)..(672): unsure at all n locations; Clone ID: LIB3279-178-Q1-K6-F8
ccggattcgccggcccccgccgccgcttcgtcttctctctccctcgtccacggcaaccaactaaccgtcgagatattggcggggcgccgatgctccctgactccccgtagcgcgttgcggatgctgtgggcctgtgaggctcgctgccgccgctttgggatctgggctgctgccggagcggcagcggcggttgtgactggcgccggcgatggcgatgtcggcgaaggagagaaagctgagcaggctcgggagttgtaagggcggtgcggcggctggaagtggcggcggcggcggcggctgcggttcgcctgctgccagggcccaccggtcggtggcggcggcgccgcagcggcgtgtcttcgcggcgctcttcgcgttcctgtgcgccggcgtagtcgtcctcggcggcgtgcacgtcattggaggtgagctcagccttcccctccccatttgcctcctcactgaactttctgccttcttccggcgtggactctcggatcttggtggggtttaggcgggtcgccggaattgtattgtcacgagaatcttgtgcttggagcgtggtggtattggggcgacaaatttctcgttttttagatacgattttggtatgtgtnttggtgttcgttgttgggaagacgaggaaaaaggcgttcctttttttgtggggcg

SEQ ID NO: 14263 - DNA, 641 bp, Zea mays
  Clone ID: LIB3279-178-Q1-K6-F9
caactctcaagttcacagctccaatcctggtgcaagcgcacagtagcggagcaagatgcggggaggagaccggccatcggcgtcgctccagctcctctcgctgggcctcgtgctcctctacttcttcacctcaggcagcaccgttggtctcgtggagggacagaagacgtggtgcatcgcgaagccgtcggcgtcgaacgagatcctggcgcagaacctggactacgcgtgctcccaggtgagctgcgccgtgatccagaagggcgggccgtgctactacccggacagccccgtgtcccgcgccgccgtcgccatgaacctctactacgcctacagcggcaggcacccctggaactgctacttcaacaactccgcgctcgtcgtgcagtccgacccaagctatggctcctgcacatactgaggaggagtgtgaggaggagtggagagacgaggagaggagagagatccattcgtgcctggcggtggcggctccactgcatctgtatgcagagtcttggttttctagtctcgactgccaatttaccaaatgcacattgttgtgttgtgttgtgttgtgtagccgtgctgcagctgacatttcgcagcgaactcgtggatactccgtttcgcattcatgtgct

SEQ ID NO: 14264 - DNA, 451 bp, Zea mays
  Clone ID: LIB3279-178-Q1-K6-G10
caagttcgaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggtcgcccgcccgcatggcaactccggcgtcgtccgcgccaagttcaggtccaacctgccgccggaatccatgggccgtaaggtcagggtgttcatgtaccccagcagcatctaaagataatctgaatgtgtggaggacccttttcttctagattttatcttcagctgtccttgtaagggttgtgttcaggttgagagttagcaggttgagctgtctatctgagaaccatttaaagttctctgagttttggtgttatggatcactggaagtattatatgaagtttaagttagaactaa

SEQ ID NO: 14265 - DNA, 602 bp, Zea mays
  Clone ID: LIB3279-178-Q1-K6-G11
gtcttcttccgccgccgccgccgtcgtcttcgtccgtagagcagcagatcagagagcggggaggaagaaaaaccgatcgatggcgtccaactacgtggacacgacgggcgaggagggacggttccacggccctcacagccacagcaccagcacgaccccgacgggcggcgcggcggcggcggcggcatcgccgcgcaacttccggcgcagcttctcctccgcgtcctccgcgggccacagccacggcggcggcggcggggccaagtgcgtgtgcgcgcccgcgacccacgccgggtcgttcaagtgccggctccaccgcaccaactcccagggccacggtcacccgcacccgtccccgccggcctcccccgccgcgccggcgcagggcgtctcgtattccgcttcctcccgcaccgtcgaggccctgtgagtgttccaggccaaagacgggcgagacgcggggaaagtgagaagatgatgggatatacttgtcgtgtcagtctgtcagaaggaaaggagggaagctattattccctccctcttgttgtgatccgcgctgtattgcctcttccccctacccgtttcctatcttcgtgctggtt

SEQ ID NO: 14266 - DNA, 651 bp, Zea mays
  Clone ID: LIB3279-178-Q1-K6-G12
gtgttgaacttgacaccatatgagtacattgtctgtaggcagggtgcaccaggatctgagtcagtatcagaggtgggtgggccaaagaagagcatgctggttgtgtcagagtttattggctgctcgccgtcactgagtggtgctattagggtcaatccatggaatatagaggcaacagcagaggcgatgaatgaggccatttcaatgccagaacaggaaaaacagttgaggcatgagaaacattaccgttatgtcagcagccatgatgttgcttattggtcaaagagcttcatcctagacttggaaagggcttgtagggaccactttaagaggacatgttggggcatagggttgggttttggtttcagggtggtggccttggacgctcatttcagaaagcttaacatggattcaattgttaatgcttatgagatttcagggagcagggctatattgcttgattatgatggaacactggttcctcaaacttcaatcaacaaggaacctaattcagaggttttgaacatcatcaataccctttgctcagatagtagaaacatcgtttttcttgtcagtggtagagacaaagaatgttaggaaagtggttctcctcatgtccaaaattggggattgcagctgaacatggttact

SEQ ID NO: 14267 - DNA, 659 bp, Zea mays
  Clone ID: LIB3279-178-Q1-K6-G7
cgcattcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtaggctgcagatgggacgaatgtgcttgtatgtgtatgtgtcctgctgc

SEQ ID NO: 14268 - DNA, 661 bp, Zea mays
  unsure (1)..(661): unsure at all n locations; Clone ID: LIB3279-178-Q1-K6-G8
ctcccccgccccgctcccgctcgcccacgcgaaccctaggcagctaggctttgctgctagaagagctccagcgaccgacgaggagaggagaataaagctcaaatcttggatgcgcccgaaccgatggcgacacctgccgcagagaagccggaagatgtagagatccgtgaggtttgggcggacaacctcgagacagagttcgccgtgatccgcgacatcgtcgacgactatccgtatgtggctatggacactgagtttccgggcgttgtgtgtcgtccgctcggcacttacaagtcggcggccgagttcaactacgccactcttaaagctaacgtggacatgctgaagcttattcagctcgggctcaccttgtccgacgagcatggtgggctgccggcgctaggcccagacggtcgtccctgcgtctggcagttcaactttcgaggatttgaccctcggactgatgtggctgcagcggactccatcgatcttctacgccgtagtggtattgacttctctcgccatgctgctgatggagtcgactctcgctgctttgctgaactgctcatgtcctccggcgtagtattgaattcagatgtgcattgngtgactnttcatagcggctacgactttggctacctgctcagctactcactggcac

SEQ ID NO: 14269 - DNA, 500 bp, Zea mays
  unsure (1)..(500): unsure at all n locations; Clone ID: LIB3279-178-Q1-K6-G9
ggtgcaagttcattgcgcaagttcgtgcttgccggnacaacgccgacgtggnacaaggggtcgccgccgtgntgcagggnaccggcgtgctttcacggtgnnaccgtcgagnaagcttgcnnccccgccggnagccccaagnnaagcccaagnaccattcgagnaattaaggggtcgcctggagggggagaactcgtnntgtcggnagnncagtgggccagtgnanngctggnngtggcnnaacctttgcgggnacttcttggnntgaggnnaagaagcaanatgngnntagaaaaagcanngtagctttgtgctttcttttgaacattgtngnntgtgtnnttgtttccntttttgttaccggcaattcattccttacctgatnngtgtcgtctgggnngtttcgtttgaaccatgcntgggttntggagcttttgtgatgcaaagcagaacgtcctgatgctttctttctccatagaataaatctctcctgttaccta

SEQ ID NO: 14270 - DNA, 624 bp, Zea mays
  Clone ID: LIB3279-178-Q1-K6-H10
cctcagggaccccgagcttgccttggcctcactctctgtctgcatgtcaattacagggtgggtgttcatgatatcagttgggttcaatgcagcagccagcgtaagagtgagcaacgagcttggcgccggcaacccaaagtccgcggcgttctctgtggtggtagtgacgctgctctccttcgtcctgtcggtcataatctccgtcgtcatcctgctgtgccgggactacatcagctacatcttcaccgagggcgacgacgtgtcgcgggcggtcgcccagctcagcccgctgctggcggtcaccctcatcctcaacggcatccagcccgtcctctctggggtagctgtggggtgtggatggcaagcgttggtcgcatacgtcaatgtcggctgctactacatcgtcggcatcccccttgggtgcctcctgggattctacttcgacctaggagcagcgggtatctggagcggtatgatcgggggcaccctgatgcagaccatgatcctggtgtgggttacattcaggacgaactggaacaaggaggttgaagaagcgcagaaaagactgaacaaatgggaagacagtaaagcgcctgtccagtgagcccaagaactaaataggct

SEQ ID NO: 14271 - DNA, 666 bp, Zea mays
  Clone ID: LIB3279-178-Q1-K6-H11
gttcttgacgcggtctgcgatccgattgtttcggctcccttgcacaccattgggactcgttacccatctcgtggactcttctgtttcttctccttttctccccccgtttattggaccagcggcggcttgctcctcttcgtgtaacgggatttggttttctgcggatgagtgtttattgttcgatgcggagcttcgatctggattcgtgcttgtcctcttggtctctgctcgctttgtaatgcttgggtacggtgcgctgaaggtgtttggggggtatgattgttgttgcacctgaataactgagtcaggttgatggcgatggagggaccagttttatgccgccctgcaatgcaagccaaatcgcctgctgctgcgctggtcaacaactccctgaccagattcgggcagcttgggaccatttcaaaatacaggaacgtttcaagattcatttctcccatctctcagccatctacgaagaacataggtccatgctgtagcttcagctcgtcttctgatggcaatggatacatggctggaaactttagcgacagtgatgaagattatgttaattctactgtgctagaagcagttgaggtgagaagtggatcggaaggatatgtgataaagatgcgagatgggaaaaacttgcgttgtgtccataacaat

SEQ ID NO: 14272 - DNA, 599 bp, Zea mays
  Clone ID: LIB3279-178-Q1-K6-H7
cggccgcgtgggcatcgattttgtagtgattgatgatatattgtaagataaattggtgttcaactatatctctaaagacttcctcagatcctaacatgcctacaaaagacaaacagaggtagtggtttacaagagagaatgaaaaaaacatttgtgcatacattcataaaaccctgagtgtgtttgtgaagctttcataagagaatttggtacgtggatatagctcttgggaatcaccattccatcaagcagcataaaccataagcacacgtccagcaatgtcaatgaagaagaaaaaaacagctgtttctatacccccaatgttcatctattgatgtttcaatataaataaatctgggactggaaactgttatacaaagttacaaactgatgaagcaaacatttccacaagatatcaaattcaaataaattaggttctagttgctcctttttgccttactgtacataactttgttagtttgcttccacttattcattataaatatatagtaatcaatagacttgccacccctgactattaagaaaatagggtcacatagttcagtggtatagcaaggaacagtactgtagttcactgg

SEQ ID NO: 14273 - DNA, 664 bp, Zea mays
  unsure (1)..(664): unsure at all n locations; Clone ID: LIB3279-178-Q1-K6-H8
cggacgcgtgggcggacgcgtgggcgcagcgccgctgctccatcccctccccagcgcccccttttcttctacctctggccggtcttttctgcgcagcaagatgcgcgctgcagcaacaccgttcttcgccttgcgtcgtcgtcgagtttcactattcccctcccccaaaacagcaagaccacaacagcccggattccctccgtgtcgcttgcatgccacccgcttgatgtattgcgcatccacattgtcactgctcgttgtccgtcaacgcgcagcccctctgttttccccgttggcgcagcagccccgacgcctccgcgctctgcgggctcgctgttttataaagcgcggtgaacagcacgccgtcgatactcgccggttgtttgctgtttttgcgcagccccatcgtcgtcgtcgttcaccccggtgagaccgcgacgctccgtgttcgattccgcatcgacattattttcctatgattaattatgtatgtgtgctgctttgttttatttttgtggaggagagaaccccgtgttttgcgtggagaagaggcaagccgctcgacgctcgtcgatgtgcggagcgatgcacaaaaccgaatcgccatcgtcctcnacaaacaccgtttgggttttgtttatggaccgagagatgctgatcgtgc

SEQ ID NO: 14274 - DNA, 641 bp, Zea mays
  unsure (1)..(641): unsure at all n locations; Clone ID: LIB3279-178-Q1-K6-H9
cagnagttagcatcngaagttgaatataatccaaagaagatatgcggagacagagttgaagttgagggaatacttgcaatcatttttggaaacggttaaatccttcaacacaatatatactaaggaaatccatccttggacccacatgatggaagtgccacaattgcatggcttcggtccagctgctaatcgcctcttggaggcatataatacccttttaaagactgtgacaagcttaacccaatgacagtgtaaccaacaggaataaaacagaatgtgtttctgctggaagttgagaactaatttaacctgctttgataactacagcttctgtgcagttactgagcattgagcaccatatctttacaatacgatatctcttgaaataccatgtcttgaaattttcttgggaaatctgaggagcctccgagattcatacactgcaatggctgctggttcactgtcggcttctaatgagccttcatctgtgaccaagattatttcagactgcgaatctgcactcaccttcttgaatcacagcctttccatcctttcaacttccgtggcacgtgagcaggggggaacgctatgattttacagtatttggatagtaagatatagtcagtggacttatgtatgta

SEQ ID NO: 14275 - DNA, 286 bp, Zea mays
  Clone ID: LIB3279-206-Q1-N6-A1
aaaataaatcaactaagggcctgggagattttatttcacatgtcacccttctcactttgctcgttgacatcaagggtccattgggttaccccctgaatgtcatctagcgtaatgtctaattgaaagggaaaacaatcttgttttgcatgttggctctgattatggggtaaatggggtaacttgacccccatccatgggcatttggatgcccaaggggagccccaccaacattttcatgacaaccttaacagggccccaaattttgtcgttgtcaaactccttaaag

SEQ ID NO: 14276 - DNA, 189 bp, Zea mays
  Clone ID: LIB3279-206-Q1-N6-A10
aagataaatgtatattggaaaaaaactggcaccactcaacaataaactcagaccaagatgtttataatagactcagctccgaacaacatttctgtaatagactagaagggataaactggcatcccagcacaaacttgacgagctgagccgctgccgttgcccaatctcagaaactgaactctagatctt

SEQ ID NO: 14277 - DNA, 508 bp, Zea mays
  Clone ID: LIB3279-206-Q1-N6-A11
gagaacatgttcagttcgaagtaactgaaattgataacaaaatatccggttgccaaattgcagactctttttggacagatgcacatacccccacgctaacctgaaacacacgcacattctgctacatgattgtggccgcaagaaggcaacctaaacagaactttttaagttacaactggctaagcactacagggacttacaagaaaattcagctatagccaagttaaggttccacagcttctaatcaaaaaccaaagaaaccaagctcagtcgccctttccttttcaaaggtttcgaagtattggtatatgattgtcacagcgagcaatataccagttcctgaaccaatcgcacccatgaaatcagccaggacggtcaatgcgccaatgcatacaccaccaaatgcagcggcagtggggatgtatcggttaagttccttctgcaagtttgactcacgatggcctggcatcaccatttgttgttccttgagctgcttaacaacatcctt

SEQ ID NO: 14278 - DNA, 595 bp, Zea mays
  Clone ID: LIB3279-206-Q1-N6-A12
ggagatagatggttcgtgtttattacatgttccattgattagtatagagaagagaactactatcgacacttcatcattgcgacgaacctactctatttttttgcaccgccgcagtagccatacgggttcttcttggcccagttccattggtccctgcacatctcctcgattccatattgggccctccatgcaagctctctttcagccttctcagtggacgcgtaaacctccgtcgcgtcacccggtctcctggggcacaacttggtgggaatctccttgccggaggccttcttgaacgccgccaccatctccagaacggatgtgccgcgccctgtacccagattgtaggccacacaacctatatcaggagagtcgaagagcttcttgagcgctgcgatgtgcccatcggcgaggtcgacgacgtgtatgtagtccctgatcgcggtgccgtcccgggtggggtaatcgtggccgtagacgttgagctcggggagcctgccgacggcgacctgctggatgtagggcagcaggttgttcggtatccccttggggtcctctccgatctcgccggagctgtgcgcgccgatggggttga

SEQ ID NO: 14279 - DNA, 577 bp, Zea mays
  Clone ID: LIB3279-206-Q1-N6-A3
aaaaagaaatttaatggcgaaaattcaaatcaataaatacaaaataaacataaacataactatctatttcatctaattttttccataatgcggtcaaggtactcttgtatatgtccaggaatgttaaatcgatatgtgttcccctcgtatgtcaacagattaataaataaattcctacgcagagtcgcaccatccatactaagttgtgcttttataccactatcccaccactacataatgtgcagagcaaaatgaccagtattaagaccttttatgtcgattggagcatcgggtcgaattgaatgtcgccacatataaatgtcatgtgaccatctaatacgtttgacaccgtatgctgccttatatttcttcgaaataagaagaatagcttcccaaaatctttttagtagtatatctttgcaccattctggagttggtgtgaaattaaacacagacatagatttgtttgcatgattaataacgaaaagtacatagcctgtagagtatttcaatggcataagaacaaatttgcaaagtgtgatgtaataattcatttgaggccaattatttaatgttt

SEQ ID NO: 14280 - DNA, 567 bp, Zea mays
  Clone ID: LIB3279-206-Q1-N6-A4
gttcttgtagaacattatccatgtattcgtgcaaggtatcacttctgtacagtacagcaaacatgtccaggtgtcatggattttcctctccccctcgaaactaccataggaaaagaatctaaaagaaacttacgcagattctagacattctcctgtatttctgatggcagacacctgtgcataatcatcttccagatcaattccaggaatcgttcgtccatggcccatattgtgaactctagcttgtccatctgcagcctcatctaaaaatttgcccatccttcaaatggtgtatacctcctgcatcattatacagaagtatttgcttgctactcaaatagtagttatccagatcatgaacgcccaaagaaaaagccatgggatttggttccatttggtgatgatcatctgcagcatgacctaccagcaactgttcattgtgcacatggtgactatccaaaacttgaacactagtgacctgatctataagcatctgctcgttctccatctgttgctcatccacattttgctttagaagcttttctcattgttcatatggcaattata

SEQ ID NO: 14281 - DNA, 364 bp, Zea mays
  Clone ID: LIB3279-206-Q1-N6-A5
gttgcaggaagcagttatcgctaaaaaaaaaatagaagtagctatggccggccaaggtgtcagcgtgccagctgctgcaggagggatcgccgtgggcgtctttggcactgctgcagcctgcaggctggcagcgtgtgtacgtgcctctgctttgtcccagctgcacgtaaccgctggatgcttgtctgacaacggtcctggtggtcggccgatttggctgctgtgctgagcagcaaagatacgatctccgctgctccgctgctatgtgcctgttgactcttgtgcagtcgtgctgctgtgttctgcccgcagtgcgcaggtggaggcagatcgattttcgcatcgtctctttctgttgggaaac

SEQ ID NO: 14282 - DNA, 580 bp, Zea mays
  Clone ID: LIB3279-206-Q1-N6-A6
gtaacattaagctgtctgccattacacatcatatacgtttgcttacagaagtgcaccctagacacacgaggagagcagcagtaaactaacagctgcattcttgttatattttttggtcatttcttacgtgcatgctatacaaaagaaacttctacagtagtacaactactcacgtttttttacttcgactttgacagacagaccacgacgccgacggcagctgcagccagtagcagatgctgctagagaggcagcagccttccatgtgagtcaccgagtccccatcaggggccggccagcgaacctagcgaggctggtggatcacgcgaggagcgctgctcttggggctgccggcgtacttggtcggcttctcggagtgcctgggtttctcccggaacccccgcggggcgtcgccgctcttcggggagcccaagttcagcgccttgagcaccgaatctgtcttaagggcggcggcggcggcgggggcctgctcgccgtagaagaggtcctcatcctcatcgtaggcaaggagggcgaccaactcgagctgctcggctatctcaatccaggtgggcgtgct

SEQ ID NO: 14283 - DNA, 489 bp, Zea mays
  Clone ID: LIB3279-206-Q1-N6-A7
ggggaaaaaaaaggttcaagctccacaaaaccggttcatgtcacattttgttcaggggttacaactgaaagtttgaaacgactaatcatttttttcataattacccacaggccgggcaagaaatttttttggcctttaatttgaaaacctgagaacaagtccaagacataaaaaaagggtaaatgtaattaagtactttttacattttttttttttttgaacccttttgcccttatttttcgttcctgtagcctccattaggaaacttgttgtcgcgtgttggcacccattttttttttttgtaataaaacacattcttttgcaggctgtgggtttgttcattctttaaaccacccacccagcaaccttaccgttttctgtcccatattttcttcagcttcctggccaggtccttttggcgtcccacaaccatggtgacctggtccttgccgtcgatgacccttacctgggcgcccgggaccttggcct

SEQ ID NO: 14284 - DNA, 551 bp, Zea mays
  unsure (1)..(551): unsure at all n locations; Clone ID: LIB3279-206-Q1-N6-A8
gaatggcatgacacaatcgcagctccaatagagtaaaaatcaagatttaagactacatgcacagaggggaaagcaggatagtgatttaacatcagatgtcaaattttcctacactacgataccatgacaagcaacaagctacattgatcccaaagctgtccatgatctaaacaacacaactaacagcatggagaagctgaggtaaatccatggatgagcaaatcatttcttcttcttggaaggtggctggtcttcgtcatcttcatcatcgtcctcgtcttcgtcgtcctcatcaccttcgtcgtcctcatcgccatcatcatcaccatcttcgtcgtcatcattgtcgttgtcacttcctccttcaccattagcttcaggatcatcatcttcatcatcgtcatcacccccatcttcttctccagagaattcctcctcagcatcatcatcgtcgtcaccaccctcatcgtcattgtcttcatcgtcgtcgtcatcgtcgtcgtcgtctgacccatccttattttcaggnacattttcagatttgattcttc

SEQ ID NO: 14285 - DNA, 596 bp, Zea mays
  Clone ID: LIB3279-206-Q1-N6-A9
gtaaagtaataaagattattagaggggggcattaaccaaacataatattggctactactagcctacagaaaacttaccaacatcagaaaaaagaatgtgctccaagacaccgaaatgtcaagatgaaacctgaagggctacagcataatcaatttgtcgaaacgaaagtaacagcacaggaagcatttacaccatgctctacacatctgtgaaacagatatttcatgtaaccaaacacaggcaaaactgttccctcaatcagcaggttcctgcctccacctgcggcttttatttcacactttatttatgggctgaatcgacaaagagacccctagatccatcacaaatgtcactacattgagaaccaggtcgctagccctgggaacatggagcctgccactgccattgtgggtcaaacggtgtgttgaccttgcctcagttatgcgcagctgccaagttgcggatgacataagggaggatgcctccatggttgaagtacgccagctccacctcagtgtcaaagcgaacgatgcaagtgaaagatttcccattgtcggtagtaacagtcacatcctggccgggacggatctcactga

SEQ ID NO: 14286 - DNA, 230 bp, Zea mays
  Clone ID: LIB3279-206-Q1-N6-B1
agtcttcaaaatctctcatatttcaatgccaaaggcgtccgacacaagggcttaaaaagtccaaatatgaaggtacaacagcacaagttgaaggtaaaacagcatctagttatagaaccacataagtagctccgatgatagaaaattaagccacgggtacaggcatcgatctggcaagttgggacaacacaggcaactgtccggcaagagcgggcagccgagcgctcaac

SEQ ID NO: 14287 - DNA, 601 bp, Zea mays
  Clone ID: LIB3279-206-Q1-N6-B10
aagccaactttctttttatttagaaaaaaacacatcaggtgcgtttacaatgcaggattaggtctgatcaaatagataagatgacggtatcatattgtcccttaactctggtcctccattgttattcttgagcatcatgattcgttccaattccatcaaggcagaacaaatgcatgcatccatccagccagccatggagtcaaatcaaggccgcaaacaagtcagtcagttccattgtattttcctgtggattgtccactccgacgggttcacggtggcgtcaccgctggaggagacaagatcgaagggggagtcctcggcgaactccgtcggcattgccttccagtgcagggatggttcccactctgcctctttcaacaccttcaggatctcttccaccacaatgttgctcccttcttcagacagatgcagcccatccgtgaagcacgcagtcttccagtcctccctcttctgcatggcatgccagagatcaaccaccttcaggtgcatctccttgcacagagctacgcacgcgtcagagtacagacggcaggtttcgttggtccggacgatctcactcagtatagtactggttgagttt

SEQ ID NO: 14288 - DNA, 550 bp, Zea mays
  Clone ID: LIB3279-206-Q1-N6-B11
gcatggttcctgaatctagacattttattttattctattttattcatgggacctgactccacacatcatcacgcggcacataatcaagcagatccgaggaaccggcccatccaagaagagaagcgagaccaggccaggtcgacggcttcctggttctcatcagtcagacccatccccttcttcctcttgagtgcctcaggcgaagtgttcatgaaggcatgcgaacatccagggtatatgtgaacttcatatggtatcccggaagatttgagcttctcctccagggacttggctgcagtgacatttgaaaaaccaacaaaactgtcatgctccccgaaatgagcctgtataggagccttagccttagaaggatcagcaagctcagaagatggtgtcccatagaaagcaacaacagcatcaacctctgggactaaaactccacttgcaattgataaagcaccttccatgcaatagccagtaacaccaaccttgggtgatccatttgacttcagccatttaactgaagcctggatatccttgactgcaccct

SEQ ID NO: 14289 - DNA, 474 bp, Zea mays
  Clone ID: LIB3279-206-Q1-N6-B12
aagcactcacaatctccccccttcgacagctacttcagcaagtaattacatcacaattcagtggtccttgacccctcaaaaggaagccattgtgggagaactatacaactcgccctccgtggaatacaaatccagtccaacacactggactttcacagcacccgtagagtagaaactctaggaagctagaaccacaccggcgtgtaaaataccggttacatctacaaattaccaatcaatacataataaactcacgaaaacttggaggtgttcagcctgccccaccacttccgcttcacagagttgggcgatgactcgttgccattgccgagcttgttcaggatcaccttcgtctccctcatccgtccactgaaatctttcttccacgagtcgaagttctgcttcaacctccggagctccatgtctgggtttaggctggcgtccgcctgcccagacttgacctcgaccaggaac

SEQ ID NO: 14290 - DNA, 467 bp, Zea mays
  Clone ID: LIB3279-206-Q1-N6-B2
gcccccaatttgtttcaaatcaatttaatccgttttacccgagggtcccgaatagacatgtaaatgaaacccttctgaactaataccccaaaaaccgaaacctttgtcctatccaagaattggccccccccaatcaagtaattccttccatcccatgataggcacagcctccgaaccaaagcctaatgaatcaatctgaatcatagggcaaaacgaacaaaaatttgctcccccccctattcactggcttcacccccttgctgctgctgctcctgctgcaatctggagtataccgcccctcccctcactgtcctgtacaacccaaggcggcagctggcttgcggcaacaactgtggcggcagcccgcagtgggaatgcatcgcaaggcaattccattaccggccaaaaaccaccggccccccaaaacaaaaaattattgggtatatgaacttttaccatgccaccaa

SEQ ID NO: 14291 - DNA, 592 bp, Zea mays
  unsure (1)..(592): unsure at all n locations; Clone ID: LIB3279-206-Q1-N6-B3
agttgtggcaaaacatatatagaagtgttttctggtccaattggttgacaaaggtcaatgagtgttgtagcagccacggttcatcaaccaatgaagcaacccggacccgacgcagcgtgccctgccgccgtccgtcccccttcgtataatggacgccgacgaggcaccggagcccgttgtatccgcacgcctctgccgccgattccgaaggtaggatttcgccctcccgcgcggcaatggggtgcacgacctcccacgacgtcgtcgccgccgctgtcacctcctccaattcccggccccatgcgcgccgctcgtccgcgtccgagccctcaccgcggcgcggagaccccgccgcgctgtgccgcgagcgcgtggcgctcatccgcgccgcggccgaccgccgatacgcgctcgccgccgcgcacgctgcctacttccgctcgctcgccgtcgtcggtgacgcgctgcggtgcttcgtggcgtncgcgctcgcgcccgccacgcccgggtcctcgccggtgctcacgcttccgccttcccccgccaagctggtcgctgccgcgtccgccagcctcccgccgtggtcgtcgtc

SEQ ID NO: 14292 - DNA, 587 bp, Zea mays
  Clone ID: LIB3279-206-Q1-N6-B4
gaccttaattaaataaaaaaaaaaaaaaaaaataataataaaataattataatttaaattttatttttttttattttttttattatagtattattttattatttttggggggtccagagaaaaaaaaaaatattggctgaaataccatggagaggaacccctttaaaacccccggagggaaaaaaccccaagaataaaaaagacaaaggaaaaaaaattattttaattggaaaaaaacaaatttaatttttttgagaaaaatcaaaattgggggcgggagttttaaaaaaaaaattttattaaagggctttaaccaaaaaaaaaggggggaacttaaaaaagaataaaagaaaaatcgaaaaaaaaatttgaaaacaagaaaaacactggaaaatggaaaaaactaaaaccgaggtttttggggaagagggatgtaaaaagggggaaaaataattgggggaaaaaaaaaaaacaacggaagggtttaaaaaaccaagggggaactggaaaattttttttgaagatgtggcacctgttgccaaaaaccccacaaaaaacattcgggcgaaagtgtaagaagaatattt

SEQ ID NO: 14293 - DNA, 571 bp, Zea mays
  Clone ID: LIB3279-206-Q1-N6-B5
cacgaagtccttccatttctttctcaacgagcatacaaccctgagattcacagccacgttcccatcccattcaaaaaaactgatactaatctaattttccttcccaacaaacccgactcctccccgaagacaacatcatcctattcctacaaaacaaggcggtggtcggatcatttctgcaggaagcagtctcagttgtcgtcgtcgtcgacactggccttggaggaggcagccttcttggggagcagatgctgatggatgttaggcataacacctccgctcgcgatggtggcaccacccaacagtttggtcagctcctcgtcgttgcgcacagcaagctggatgtggcgcggcacaatgcgggtcttcttgttgtccctcgcggcgttcccggcaagttcgagaacctcagccgcgaggtactcgaggacggcggcgaggtacacgggggcgccggcgccgacgcgctccgcgtacttgcccgccttgaggaacctggcaatcctgccgacggggaactggagtccggccttggagctcctcgacgttgccttcttcgcggcgccagcgc

SEQ ID NO: 14294 - DNA, 579 bp, Zea mays
  unsure (1)..(579): unsure at all n locations; Clone ID: LIB3279-206-Q1-N6-B6
gaaacccaatgctgngaaaactgcacagcaatgtctaagcaaatgcagttgggttcagaaagaaactgccggaaaatgagtatctacaatgtcaaaccaaaaagaaaaagaaaaaaccctcactgcatggatgaaacaggccagattgcataacccggtgcatgaaagggaaataacaccatataatgtcgtacaaggcaacggagtaccagtggtccttcactaccgtccattctcaggaggtaaggttgtcttgctcactatgcccttgctaaaatagtctgcaatgacagagaaaccgtccttggaacccctcaactgcctgaaaaagagatcatggtccctggcgttttgctctagcttctgctttgcctccatgacggatctgtattcaggcgcgcattctgggcattctttttcgttgtcaccaaggcagcgaaggtggaacgagtgcatgcacaggaaatggacagcaggtagatcaagggtgaaagtgcacgcgctacacttgctcagttggaaaaccttcgcgttcgtcttgagatcttgtatctcccttttcatcaactctgtctctgc

SEQ ID NO: 14295 - DNA, 542 bp, Zea mays
  Clone ID: LIB3279-206-Q1-N6-B7
cggggggaattacgcgaacatgttgcgtccaggtgaactggaaggcatcgatgtgtatgtattcttgatgcaagttgtacatgcaatcaaaaaatagcaactgtctagagccaaagccaaggattgaaggttttttttgacctgcccaacgggccatggctcaggcccgtgcaggggccggggccgggacggcggtttttgctggaggcagtgacaccgagcgcagcagctccagggagctcgccaccccaaggaaatgcaacaggatggtgttcgctgaagcctgaactaggaaaacatttaaagccaaaacagggctttggccagcagcctgataatagggtactgcaaaggttgtgaaagcttttgctaccaaagcaccaacagtagcttgcatgccgagaacagcagcgcccatcccaagaatattaaccacgatgccatttttaaggctcttaacaacatcagcacgtggaggagccttagcaggttctttggatgtttttctaagcctttcagagagacggttgtaaccaaatgac

SEQ ID NO: 14296 - DNA, 574 bp, Zea mays
  Clone ID: LIB3279-206-Q1-N6-B8
ggaagaaagagcaagctttactgataaataaatgaactactgaaaggcttccagaatgtctacagggcaaatgtaccaacatcaagttcatgtcctacagttcctctgcccaaaagagggggcaaaaatgaactccctaaaattctttcctgcacacaaatacaagaggagcagagcatcctgtttcagagcatatcaatgtctggaatttggtgctgtatacattaatatgaatcgagtcattttgaaagctagccataaatagagcccagaatcacatctccaccctccgttttcattccttcttgacccggttccgtgccgccttggctgagctcgaccgctcagcctgggagaacatgatgaagacgtgcatgacccctgtcacgagcgccatccctgcggcagtgaatgccactcctctccatgtcgataggagctgcgtccacttgaagaactcgatggcaccaaacaacagcaggcacgaccaaaacagggtcaccagcaatgatttcactgggcggccgataggtctaatctcctcatcgaaagtgcctgttgccaaatgtttgtc

SEQ ID NO: 14297 - DNA, 585 bp, Zea mays
  Clone ID: LIB3279-206-Q1-N6-B9
gagaaaagtctataaatcgaattcgaatacatccatttgacaaacatattgaaatcgaatacggatacggatatccatattagcagttttagtgagtacgaatacgaataattcggatcaccaaacatccatttccaaccctaatttaaatttatagtacttctaaaataaaatgcacctcgctgaccaggaaacccaaggttttctctctttctctgtcgcacctcgctgcaatcccgtacttaagcgctccttgctgcagactactgccgctgcggcgtctcgtgggtctcgtggcctcttcgcctcttccgctgacatcgtctcttttgtggcctcttcgcctcgtgttcgtctcgtgcatcgttattcacttatgcctctttcttcctgcaccggtgttgcagctatgagaggtccaactgcaatgccactgacaagagaacaatcaccacaagcaagagtcgcagataagcacccaaatccaggactatcaaatgtcaaaatggatccaaacacacgaatgatttctaaaggacccttgtgatttaagatgacagcagagtggagcagatagcaatcctg

SEQ ID NO: 14298 - DNA, 537 bp, Zea mays
  Clone ID: LIB3279-206-Q1-N6-C10
agcatcccatattattgagaacgaatgaaccagaaaagtggagcgaaagccatctcatgctgtaggcaactcatcaaaccgcgtccattccaaaagcaactccaaataattgtacaaacatgctgaccccagccatcccagataaacatgcgacttaaaataacagtctatcaaccaagaaaagctatgtagatgactgacgactctgatttcaccgaacacaaacattcatctcggagaaaacacaatgaaaatttgcggggaagctgaaccttggaaacgaaatgaatggaatggcatccatttgacccttgtttgccttcaaccttcactctttatcatccttcttatcatcggatgcaggagcctcctctttctctgcattttcctccttgctgggctctgccactgttaacttctgtgccaaatcagaagcggcagtggagacttcatcattttctttctcctcgctctttccttgctgttcagctatctcttcaacagtgtccttgacggacgcgtgggcggacgcgtggg

SEQ ID NO: 14299 - DNA, 608 bp, Zea mays
  Clone ID: LIB3279-206-Q1-N6-C12
ggtgccaccacttcgttgtaagaaaaaaaggttcatctagatttacaagacagaatacaacttcgccaaggatctgaagaatcggtatacacctcataagaccatgaggagccgccagcattcaatagtatcctttccctctgcttacccggtgtacaacattatattatcactatttcaatggtacaaactaggactgaacgaattaaacactccagcatcaaatgttacatttgtcgtatccgtaaaaccacgagttgaggtctgtgctcttggagacctcaaatgatcctccttgttgcaaggtattgaactccttccaattctgcctactgtggctaccagctgtgtcatacataggaggctcaagattgttcggttcttgtggctgtaccatatcgtccttgcacggagagggctcagcgagacgctgctttagagcgaggatttcctggtcgtagttctttttcaagttatcaatctcctgataagctttctccgtctcttgctctgccactaaagcttgcttcttggctagtgtttctgcttcctctgcatccttcaaccgattaagcaattcaccagctgcctgaacagcttcagcagta

SEQ ID NO: 14300 - DNA, 579 bp, Zea mays
  Clone ID: LIB3279-206-Q1-N6-C3
catcgggaaacatatataagtatcttgtctccgcaaaacttagcttaaacaaaagtgccacagaagcaacacatagcatctgtccataaagattaaggtaaccaactgccttagcattgtccttatcgtaagatagaaacctatctaggacccgatcaaactgccatttcaaggacacagttgggaccttacacctcaggaggtgccaagaccggagggcgcggctcgtcctcgtccttcggggtgtggatggtcaccaggtccggaagaggagtgatcgggccaaccttgcccttcgggtcccagtcaagcatgatcttcaccttgatgccaagaacaccctgtctgagaagaacgtgtctcacagccgagtcaatgtactcgttcactggctgaccagatgagatcatgtagccatccttgaacttcatggacttggctctttgggccctgagctttccactcacaatcacctcacaacccttggcaccactctccataacataacgaagaacaccatagcaagccctgcggacggcaaggcctccgaggagcttgtaacggagggactcggcctgc

SEQ ID NO: 14301 - DNA, 565 bp, Zea mays
  Clone ID: LIB3279-206-Q1-N6-C4
gtgttataataatttcgatgctttactcccaaaattatacggtaatacaacgtaatagcaagcatatagatatataggctatggtcgataatacatgtttttgttacttgagcatcttcttgtagtccttgaaagtgcccgagaacggggtcaccctgccttccgacaccacccaaagctcgtccacgcttccagtgataagatgctcatcgtgactcaccatcagcacccctccctgaaaaatgagtaaaccctggatgagcgcctcaacagcgtccagatcaagatggttagaaggctcgtcaaggagaatgatgtgcggcttcttgaaggttattttcgcgaatgcaaccctactcttctgaccacctgataaagtgtacatagattggagggcaaggcttcccgaaacaccaaacgaacccagatgtgccctcaacttctgctccggcacacccggatagcacttcatcatgtacaaaaggggattcaccgtcaaaatcaaggccatcaacatgatgctgattgaatacagccatgcgaaccttgggagagcgaaatactg

SEQ ID NO: 14302 - DNA, 558 bp, Zea mays
  Clone ID: LIB3279-206-Q1-N6-C6
gggatgcagcatacaagtacgctaccataatgtttcatcaatcaacaagcgcaactttcaggccactaattcagtaacaaaacacggcatttgcatcatcagtataatatctaccgtgagacatgggtatagatcgccgcttctttctctgggtacagcatgtcgtgacacaaaccgattggaccgttacatcatcacatgcaggtaacacacacacacacacaccttatctacctggtcgcataggtacatctccgcagggttaatagcaagcttgatgagtggttggttaatcacaagaatatcggagccatgaccagcgtgattgtggcgagcatcttgataagaacatgcagcgacggtccagcagtgtctttgaatgggtctccaaccgtgtcgccagtaaccgcagccttgtgggactcgctgcccttgccaccaagagcgccagtctcaatgtacttctttgcattatcccaggcgccgccagcagtgttcaagaagagtgccatgagaatcccagcgaccgtcgcaaacatcagcatggaggctacaact

SEQ ID NO: 14303 - DNA, 584 bp, Zea mays
  unsure (1)..(584): unsure at all n locations; Clone ID: LIB3279-206-Q1-N6-C7
attccgaaggacccattttattccgngaacagatgcccaggctttctccgggtcctctgatagaagcaaacataggttcacagttcagacttgacttacaaacagtcgcacaaaacatacagcactctgttctaactcgggacacgaaatcctctctttctctctccctctccctctccgctcactgcctcaatctaggaagactgccggagctccgggcgcacaaagtcggcgttggcaggcacagagatgtcgacggtgggcctcagctcggcgcagacctcaatggcaccatggacagggtccgacaagaagttgctgatgaggtcctggttgatcggggcgtccttgtccaccgccacaaaggcctgctgcgtcaggatgtagtcgaagcgaggcgcccacttcctggatcccaggcgagccgttgtggagcagttgtccaccatgaaggcgaccccacgggcgtgcatgaacgggttcagcgagtccaccgactcaatcacgctctcgttgatgatctcagagtaggagtgccccttcttcctcaggatctcaatctgagccatcatcagggcaatgta

SEQ ID NO: 14304 - DNA, 497 bp, Zea mays
  Clone ID: LIB3279-206-Q1-N6-C8
ggggggaacacctgaatttggtgaattttaaaaaaaaaatttatacccccaaattcagggggttacattagttcaaatgactcaacctgaaacactacacgttgataattacttattaaaaaccgaactacaagaaataaatcaactttgggctttcatgtttttaaaaactttgttttattgagggttttgtttaaagggttttttggcccccaataaaaattgtaccaagttcccaaaataaaccactccaaaaaaaaaccctttgggggtaaattttttgttgggtaccctttgtcgagtgtatttgccgctgattccaatagggattaaaggttttggaaaaacttattatttttctcatgaaatttgatgcaaaatggacctcccataagggtttgtttggaaaaaagggatcggacgggattaaatgagctaaaatttttactattcaaaattaaatagggagggattttagtcccttcaatttttccaaa

SEQ ID NO: 14305 - DNA, 425 bp, Zea mays
  Clone ID: LIB3279-206-Q1-N6-C9
gggggggaaaaaagtttcccatgggggggggcccgggggaaaacctgtaacccattcaattaaggccccccgtttggggtgggcccccccctttttgggggggaaaaaaaagagggtccaattcggggaacccttgtttttttggggttccctttaaggggggggggaccccccccccaaaaaaccattttaaaaggttttccccgggtaatttggggggaaaaaaaaaggccttttccaaaaaagggaaaaaaaaaaccccccgttttaaaaaaaaaaaccccggaaaaaaaccccccggggaattttttttggggggggggggggggaaaaaaaaaaaaagctggggggggccccccttgggggggggaaaaaaccccccccgggggcctgggggggaaaaacttttggcaaaaaaggttttc

SEQ ID NO: 14306 - DNA, 578 bp, Zea mays
  Clone ID: LIB3279-206-Q1-N6-D1
acctgaaaatacaatgcattttgagaggacataccacaagtttaaggacttcggaatgatcaccaaacaagaaaatctgaattaggccattggtaatggtgtaattcctttgaactatgcctctttatgtatctgtggtgtagccacagggcttcaacatgagcaagctatacaacatgccacatcacgtttagctaacaatatttctctactctagttgttgcaagtggttgccgcggcctcggtctcctttccagtcgcgaaagatttgccgcacccacaggtttttgttgcgtttggattctggaacaagaagccgccaccaatgagggcgtcgctgtagtccagctccattccaaacatgaaaagaaggcttttggggtcacagactggaggcgtgggggcgcggagagagacggccgctctgctggcgccgccgtcggcgccgcgggggaagcggatcgaggaggcgggggaggatgaggaaacggcgaggtggggccgcgcggtgccggcggggcgaccgaggagggggcgggacgtggcggaggcgagcgccatggctgattcgtgtcttt

SEQ ID NO: 14307 - DNA, 537 bp, Zea mays
  Clone ID: LIB3279-206-Q1-N6-D10
catccgccgactcgattttactgatgacaaaagatgaacaagggggtaaatgtaaagcatctccgagatgaagcaacaacgtaaacagccataattattctcaataacccggtagcaatgcaggggaattaacaacttttacaacatcaggtgttgtaaaccacacaatacttcagaacagacacacataacacgatagcaggagcaactttcggcagatcacgggataagggcagcacactggcctgatgctgcgtcatcagcaaacttttttagtactcgtaaccctcgtcgccatcctcgccctcatcgaactcagcaccgacctcctcgtagtccttttcgagcgccgccaggtcctcacgggcctcaaagaactcaccttcctccataccctcaccgacgtaccagtgcacgaaggcacgcttggcgtacatgaggtcaaacttgtggtcgatgcgggagaacacctccacaacactggtggagttggagatcatgcacacggcacgctgcaccttggccaggtcgccacca

SEQ ID NO: 14308 - DNA, 591 bp, Zea mays
  unsure (1)..(591): unsure at all n locations; Clone ID: LIB3279-206-Q1-N6-D11
gcagagaatcaaanatcgatagacaaatttgtcagaacatacagactgcaacatggtgccactttgttcattcccgcgcacgcgcattctgtaacagataaaaccatcgcctgaaactactctcatccacgatggcctggggacgaccgcttcacttcttttgcttggcccccacgttcagctgctgaagaccaagcagaaggtccctggaatcaaggaacaccttgttgctggaggccgccatggtgtgggagatctccctggcagcttcaatctgtctcagagccaggaaggcggggttgttggcaatggcttggccaatcaactcagcgctcttagcctcaccctgtgccctgataactgcactgcgcttgtcctgctcagccttctcaacaatgaacttggcacgctcagcttcttgtgcagcaacctgcttggcttcaatggcatgagtaaactcttttccaaagctgaggcttgtgatggacacatcatccagagcaatattgaagttgttggccctctcagtcagaatcttcctaatctccctgctcacagcctctctctgggtgatcagctggctggcattgt

SEQ ID NO: 14309 - DNA, 547 bp, Zea mays
  Clone ID: LIB3279-206-Q1-N6-D12
aattcaaatttctggttccattataaaatattccacagagacatcacatgccctatatatatttcttttgcaggtaatccatagttgttgcgattagcaaaatgtatgtctcacctcgggaccagccgcccgatctcacgtatttctaattaagcattacatttaggcactcctcttgtacaggtaacctcgaagagggtcatttttggcatgttttaccgtgctgttattcagctaacatgctaattactcctgttcctgagagcagaaataaactgtatcgagggcacttatatgcttcacttgtgccacacagcatatctgtcaccagagactgccagcctccactctggatcacttgggcaccacgagccgtccccgatcttcatgcacaacttatcgtcgatgattgctgagtacagatctgacccaacctccagaattttgattgatgaacggctatgtatatcttggcattttctgatttgcatcagtttagcaattttcgtcatggagaggcacaccctggtcatagaaatgatcatag

SEQ ID NO: 14310 - DNA, 504 bp, Zea mays
  Clone ID: LIB3279-206-Q1-N6-D2
ggacagaagctattaagaatgagatttcacatcaacactcctaaaggttgcagtttattttagaaaccacgaccgagatacaatatagcaaactaaatagtgataacaataggctaaccctaggacttcttttgcagtgtagtacatacatactacgaagttagcctccacagaggtgatgtgcacggcaggaaagggggcggcaaacaagcacctggagcaacagcggtcacgatgctaaatattctacaactctcgccttatttacagagccgggctgctgatgagatctcgttagcggtcaaatgggaactcattgtcatcctctaccaccttgaatggctccgggtggcgactggagcagtaaaggttccacatcttgtagtatgccctttcaaggttgcgcacccatcgagctgtatcaaacaacgggcaggtcatacgaacttccttgagcttgttagtcagcgcttgaagcttcaccggattcagcgctagttctac

SEQ ID NO: 14311 - DNA, 293 bp, Zea mays
  Clone ID: LIB3279-206-Q1-N6-D3
atgaggtaaatatataagtgtgttgtatttgaaaaattattttaaataaagtgctttagaagaaatatatagtatttgttcataaagataaggtaattaattgtttttaggattgtctttatcgtaagattgaaaggtatgtaggaacaggtcaaactgattttttatggacacagttgggactttagaaatgaggaggtgaaaagagcggagggagcggttggtagttgtattttggggtgtggatggtgactatgtgtgggagaggagtgattggggaaactttgtttttg

SEQ ID NO: 14312 - DNA, 541 bp, Zea mays
  Clone ID: LIB3279-206-Q1-N6-D4
attaaatagcatacattaccacaatggattatatcattatcagagtacaacatcatcgacacacagagcctgcacaggtcaccgtacgtttggcacgggcccggccacgtacagggattacacatccgataatcgaaccaccatacccatacgcacaattaattacgctatatatagcagcgccctgcttaattgcctgcaggttacgttacatttaactactagtaggcttcgtggcagatcagcgtacgcacgcctccggttccggtcggtgcacatatagataagcacattacttacaggaggtgatgtgctagctagctgtggactgccatcagattaaagttagcacgcagtagtagcagcagtacgtgtaggtcgtagaaccatatactacgcaacactgcaggacaggggtaggcggcgagcggacgcgtgggattgatctccaggggaactcatgctctcgtgcccctagctaaatggatgaattgaactgccaataaataaattgtcgaactgtatgtacagtaccgtcaaa

SEQ ID NO: 14313 - DNA, 576 bp, Zea mays
  Clone ID: LIB3279-206-Q1-N6-D5
aaaaaaggatctcctaaagccatagcccttatcagttttacaaaatccatctcgttctgaaccttcacagggtacactgcatgtgcttcagtagtataaattgttgaaagagttgtatctgatggaagatctgccctgtagacaagttttgtcaaagctttggactcaaagttgctcggtgaatcgatcgcaaggaataacatggggactgcaaaactgtgatgaatgtctaagctcccaataacttttacaagatctgagaaatcacgggtgtaccgttgaggtacgtaaaatatctcactgctgcaacgaatcagattattttcacctacacttctcctgtaattatcttgatattgagatggaaaattgctgaccgcctttttaatcatatccccttggttcacaaaccactcaatgttgttaccatgtagaggcacatccgaccaagattccttcacctggttggttatccagagcttagccttatcagcattcaagaggttccagtaattgaagaccatacgatcttgaaagaacagaaatccttgggcacctccaaaccgatcaaacacc

SEQ ID NO: 14314 - DNA, 589 bp, Zea mays
  Clone ID: LIB3279-206-Q1-N6-D6
caaaaggatgcattaccgatttccattccacaccctggtggtcaaaaatagggcactggcatttctccagcagttgaaataggagccgtcaaagtttaactgttatttgtgcacagctaaacacctaggcattccataccgacaccataagaacgaaaataatgagacgtggttgcaccctgttcaaacagggtgacccaaattgtctaaaatgttttttattaaactgcaaaacaatttttctcttcatggcaaaaggcatgtcaatgaactatgcagttgcttccttcaggtacgcgatgagatcagcacgctcctgcggcttcttcagcccagggaagaccatcttggttccaggaatgtactttttagggttaagcaggtactcatacaaagtgtcttcttcccagactacagccttgtttttgtttcccgcagagtaggagtagcctgcagtggtacccgactgtctcccaaaaagaccgttcaagtttggaccttgcttgtggccggcgcccttgtcgaccgtgtggcactgcgcgcacttggtcttaaagatcttctcgccggctttcgggttcccgggggg

SEQ ID NO: 14315 - DNA, 552 bp, Zea mays
  Clone ID: LIB3279-206-Q1-N6-D7
gctgaaaatttataattatatcgccgctgttccacaaccatcacccatcagcaggcataacgctgtcgcttcagctggaagtggtaccagtactcaaactgaaatcctacatcaccagaacatagctggggaaaacaccagggtcaagacctactagcattctagactagacaactccagactccagagcaagcagcaaggaaacagagctttctgtccagctggcacagattcttcaatacactcccagctgcgggatcgctggctcgtctctcagctcaaaaataattggattgttctccaaagaatggtactggtcaagctcatcatcggtaagacggccttcagcaatctttgctttaccatctactgaactagagagacgccaactgatgtccgggagaatctcaggttccacctccagcacgttttgttcataaaaaaagctcagcaacctccatagatggatacattagagaatcaaatactgtatctggccaaccacacaaggctgagtttactgccgccactttcttcttgacacgtttgtct

SEQ ID NO: 14316 - DNA, 563 bp, Zea mays
  Clone ID: LIB3279-206-Q1-N6-D8
gattaagaaagagggtagtattcatcttgaaaaacagttccagttcaatggcggatgacagacgacctctacctctcgctctaccctgacttcgacgacgctaacttaagacgacgacgcgacgctaacttaagacgacgacactaacttaattattaataaccatgaccttgacgacaatcgagaacgatctcctctcccccgtcttggagagctggtgcttcagttggagctgggaggcgcgaaaaagactccgagtcgagcctcttggagcggaacagcttctccatctccggagtggtgttgaaggacgcctgcagcacctccggcgagatggccttccacaccgacgtcttccccgccaggtggctgaacaccgggttcggggtggtgatgatggagaaccactccatcccggacgcgtcggcgatcttggacacgacatggaagcggggcacgatgaagagggacccgccctcgatgcgggtctccagcacgcgcctcccgtcgggcccgaccacctgcacccggccgctgccgcgcacgatgtacgtgacctggta

SEQ ID NO: 14317 - DNA, 583 bp, Zea mays
  Clone ID: LIB3279-206-Q1-N6-D9
cgcagcagtttattaccccttctttattcaccattcacaaatgtacatacagccagttgtgttcgagcatcctggtccagaatgctcttgctaacagttctggaaggtgaaagaaacaaataactgaaatttaaccatagtccacagatgacacaatatcacaaatattgccgtgaccgcgagtcatctacgaaaaacttgcgctcatcaacagaaaagaattggacctgactacacataaatacagggaaaaggccatgaagccaatctgttcaatttattcaacacttgccaaactattggaacactgatcaacgatcagtgattcagtgggaggcatctctgctatagtactggtccaaggtcttcgccgggatacggtggagaagttcgcgagggaagatccgaagcaatgtccatgcaagatctagtgactggaagatgttccgtgtgtcgtatgctccttgtgtcacaaacttcctctcaaacttgtcaaggaactctaagtaaagcagatcctcagacgagagtgcctcctctccaacgactgccttcatggcctgaacatcctttccaattgcgt

SEQ ID NO: 14318 - DNA, 562 bp, Zea mays
  Clone ID: LIB3279-206-Q1-N6-E10
cgccacgagtaatcttaattttaaacttgtttcaagacaaaatcttagggccagatgaaaacacgtagccaagacaactcaataagttcacgtcataagcaacctcatgtccagactcgcctagatacagaagtagcaaacaaactactcggcagcagcaacctcctgcccagcctcatttccctcgacaggcctttcaagcttcacaccaacatcctttttgtagtcgccatgaacctccatgagtttcccaagatcgaacttgggggccttgagtatcttcaccttgcggatgaagacgttttgaagtgggaagatgctggaggtagacttctcaatctctttaccaataacttctggaatgaacttcgaaacaagttctttcaggtcacatgtagaagcctggttgatcataatctcaaccatcttacggcggatctgacggatctgggatgcctgagcatagcaggttctcttgacttggtttgggcgcctcttggtgaagccgatgcagaacaaacgcaacatgtagttgtcggttgtcttgacatcaacatgggct

SEQ ID NO: 14319 - DNA, 569 bp, Zea mays
  Clone ID: LIB3279-206-Q1-N6-E11
aattcaacaagatgatgaattgcaaaatcagaacaaggaacacaacacggcaaacatgccagtgaacatatcaggagccacaaggcaaagaggaaattaggctggaacacataagttccacagatctaaacacgaacatgctacagcagagcgctagtgaagtgactaatttctaagccttcttcggggacttggctgccttctttggggacttggcggccttcttaggggacttgctctccttgctgccgccgctggacgccttctccgccaccttcttgggcaggagaaccgggttgatgttggggaggacaccgccgtgcgcgatggtgacgccagacagcagcttgccgagctcaacgtcgttacgaatcgccaggagcaagtgtcgcgggacgatgcgcgtcttcttgttgtccttcgccgcgttcccggccagctccagcaccttggcggcgaggtactcaagcacggcggcgagatagacgggggcgccggtgcccacgcgctgcgcgtaccgccccttcttgaagtagcgcccgatccggccgacggggaactgcaacccg

SEQ ID NO: 14320 - DNA, 513 bp, Zea mays
  Clone ID: LIB3279-206-Q1-N6-E12
aggtctaacttaaacttcatataatacttccaggggtccataacaccaaaactcagagaactttaaatgggtctcaaatagacaggtcaacctgctaacttttaacctgaacacaacccttacaaggacagctgaagataaaatctaaaaaaaaagggtcctccacacattcaaattatttttaaatgctgctggggtacatgaacaccctgaccttacggcccatggattccggcggcaggttggacctgaacttggcgcggaccaccccggagttgccatgcgggcgggcgaccttgccccaaatgcaacggtagtgggtgcccctgctcttggtcttggccttgtaaatgtaggccatccgcttcccgcagtaccacgcgacgtcctccttggggttcaccccctcgatctgcaccaacgacgtaatctcgtactggttcgacttggaccccttgtatccaaagacggggccccggacgtaaagccttacgcgctgccccgtgcgcccct

SEQ ID NO: 14321 - DNA, 578 bp, Zea mays
  Clone ID: LIB3279-206-Q1-N6-E2
gtgcttgaaccttaacttgtggtttctattaggtttcaactctagctaaccacaacataataagagttgggactaaaagaccatgttttacatccaccaatatgcagtacaacaccgtttgagtgaggcacgtaacagcaagccaatgcatgaatcatcggatgggcgtgtacgagtggccgccagaagacgggccagagcccttgtgatgctcctcggcggccatcttctccttggtcatcgtcccgacgtccgtggcggtcttggcgaccttgttgaacgcgctggtgacccatgacgcgccggtgaagacgtacctgttcttcatgatggcagacccggcactgctcaccttctgctcggcggcagcgagtgcagacttggtcttgtcggagacctggaacttctggtccatctccttcaccttcccgctaaccaaggaagtgcctgtcgtgatcttatcagtcagcccaatcttcttgtcaattgaggccactgtagcaccggctgtggatgtgaagccatgcttctcatcgaatgctttggccttgccaaccgcgtctttgcctagcacgaaa

SEQ ID NO: 14322 - DNA, 470 bp, Zea mays
  Clone ID: LIB3279-206-Q1-N6-E3
attccaacataacagggtcgtttaaatttttttgatcaagagacaaaagtttgctccaacagctttgggtaacaaaatgttttaatcccaggaagtttagcttcaagctggggaaacaaaagtttcacggtttttttttaatgagatagcctccccgaaagaaaatccacgaataaccccaaaagcagtttagggagacacaccaccacggggggactttttcaaaatgtttagggaaaactggcacttggtgatctcgctgccatagttggtgaaacaattttggaaagccttaaaatggatgctgcaagcgttaacatttattactgggggggcaggggcaacaacaacagtttttgggggaacaattttatgcttaatggtccggggacctaatacaggattaacagccctgtgggccatgggactacccgggccaaaagcctaccttggggaatgggggacccaat

SEQ ID NO: 14323 - DNA, 569 bp, Zea mays
  Clone ID: LIB3279-206-Q1-N6-E4
gatataaatgcttcaaatacgaggatgggctctgataccatggtttgttaaaactacaacattcaaacaggacaatcgcccaaataattcgggcatgttccaaaaagctgctgcttcaggaacgcaaatgtgcaggacacgtggaactacagctccctagttaacagccatactgatttgtcaaacaggaagccattgctataccaagaaacaatagatggaccattatcagcacaggtccagaagcaataaattccattttcccagtttcccactgtcaggtaagactgataatttgataaaaagtaccaggtacaaattgcaaaattcttcacgtcccaatcattttcaaccttcaaagagggttctatctgatgatgtcaaccacaacatcacaaatgagttcaatggctacctcatttcatgtctatttacattgcatccatgtatgaagcaaaactggatcacttatagtattaatccctgcgcaacttctggctttttagaaactcagctgctgagatggccgcgctgggctgctcatctgttacagcggggacagtcacggt

SEQ ID NO: 14324 - DNA, 584 bp, Zea mays
  Clone ID: LIB3279-206-Q1-N6-E6
ttttttttttttttttttttttttttttttttttttttttttttttttttttttttttttttttttttttttttttttttttttttttttttttttttttttttttttttttttttttttttttttggggaaaaacccaaaccgggtttttgggggggtaaaaaaaagggggcccataaagggcccaagggtccattacaggggttaagggactttgtttttttgggggggtaaaccccggaaaaaaacgttttagtggaacccaacccccccaaaaaaggttccaggggcccaaattcttgaaaggctttggaaacaaagggggccccacaaaaataaaaaccagggggggggggccttttgggcccaggtttggacccttttagttgggccccaaaaaacccttgtttaaccccaaaaaaagggagttaaattccttgtgggggccccccacaatttttatttaaaacgggggggacccccggggggaaaaacccggcacccttttgtggggggaaaaaaaaaaaaccccgggccttggggagaagggttttcccaaaaatggggggtttcccagggcccct

SEQ ID NO: 14325 - DNA, 557 bp, Zea mays
  Clone ID: LIB3279-206-Q1-N6-E7
acaatgttcaacatgtcttttttccaaagaaattacactgacaccgtgtggagagagagagagaagggaaaaggcttctgtgttatgtgtacttgctgtatgaaacagccaaccagctgcttttatgtattcattcagtccatgagtttgtacctcttctcttccacacccgtgacgcccatttgtatctcgattatggtgtgtagtggcatctctatctctggaacttctctcaaaggacggtccgcgaaatatgcatacagtgctcgcagtacagcctgatgagatatgacaaccactggtgcacgctggcgttctagctcgatgatgacgggttccagcctctgtatcacatcgaggtaagattctccacgggggtagcggtatcttagcttgtccttctttcgtgactcaaattcctcgggcatgattttctttatctcttcataagtcatcccatcacacactccagaattgatctcatcaagagcacgccattgtatctacaaataacacaagtcgagcaatcttgctgtacttacatagcaacagttctt

SEQ ID NO: 14326 - DNA, 335 bp, Zea mays
  Clone ID: LIB3279-206-Q1-N6-E8
gaagaatgttttgtatatttcatcttttcaaggctgcttatattgcatcttctcatgtcaacgtcaacttttcctacttctcttaccaggatccatgatgcctctggagaacttcattttcatgtcaactatctggatgtcttcattttcatgtcaactctggccttccctatctttcaggatcccatcaaacactagtgctacactggaaaacttcatacactattcacatactccatttctatgaactaaaagcatgaactaagtttttcctctgttttttctatgaaccaaaggaggcctcggtgccaacttcgaatacaaatggtaaattt

SEQ ID NO: 14327 - DNA, 596 bp, Zea mays
  Clone ID: LIB3279-206-Q1-N6-E9
cacattcgaacccacgatcacaattaacatgacccaagtctgctacaccaaaaaggtaaggaaagcatgacaaggtgtcagcactcgtacatatgctgctctcagcaaaccaccatgacttacactgtacaagttacaagaattctgttgggcatcacctttgtggccaaatgcggcacaaaccaacacattatatatcacattaccatgatccctacagctaccttcacccataattcagcctagaacgaagggacgggcttatgtgtgacgtcttggtattccaatctcacaagcattcacccttgaagcaaacctcaacgagcatatcgtctcaccaacggaggatgcctcaggtgaaatgttgacaaacatgagagctttcgagtcacctccaaggcaaggctgcaataggtatgtaagttttgaatttctgaacggaacgtggtcatctccttttgcgatcgcgaagattacatcgctcaaagccgacaagcttttattgattgactgagtttccttcaagcgatcacctgtggagccacttttagcaagacgctcactcccagctaaatcaatcaagttaaggactcctt

SEQ ID NO: 14328 - DNA, 589 bp, Zea mays
  Clone ID: LIB3279-206-Q1-N6-F10
gataaaatgacatttaattctgaaatagctatgcgcataaacatcatagccatcatagaagatgattcacatgaactagatggtacagaaccaaaactttgaattcttacatgatgtctttctgtcatggtcggtgactcggtctttctcaagcaaaactctcaaaaactagatctgacaaccaccgtgattgcacacgatcgcaagtacaagaaaattttaatttaacagggcaagacttaggtcatccgctgggcagcttccttggcaagcagcttttccctggccttggttttcgcctgtgatttggagcccatgataccaccaccccacttcttcctgacctcatcaaacttgtcgttgaagttagccttgatagcctccaagattttgctgaactcaagcttgtcctcgttcttgacggtggtcaagcaaagaacagatgcagtcttcttgtgaacgatcgatccaaggcgtgcttttcccttgacaatgcagtatggaacctccattttcctgcaaagggccgggagccacacgaccagctcgatcggatcaacatcatgagctatgacaaccagctgggcct

SEQ ID NO: 14329 - DNA, 590 bp, Zea mays
  Clone ID: LIB3279-206-Q1-N6-F11
agcaaaaactattatagcttagcttgttcatagagactggaggagcatgacggctgatcacacgcgatcaactatcccaagtttttacaggcacagaactaccaccgacactcatgctggagctaccgacgaatctagagctactgacaatattacgattggatcaaaatccatgaaagaggggaatctataggcggaattgagggggggatctcgccagcgacaaggcaggcagactacttcttggccttcctggccacgcccttcctggccggggcggcagcagcagcagccttcttcggggttgccaccttcttaggagccgccgctgcctttcccttcttggcaggagcagccgccttcttggctgccttggcgggggaggccttggcggaggtcttggcgaccttgggagggcgcccgcggggcttgggcgacgcggcggcaggagcgacaggcttggccttggccttggccttgggtttgggcgacgccgccttgggcttcgcagcggtcttggccttcgccttcggcgagggcttgggcttgggcgcggccttgggtgccttgggcttggcggccttgggctt

SEQ ID NO: 14330 - DNA, 575 bp, Zea mays
  Clone ID: LIB3279-206-Q1-N6-F12
caactattaattcatgatcttggaataatagagtaatattggtgccaaacgcacctgaacacacaaaaaaagttgatgagcaagatatagttatcaattgctttggatcttacttatgcaagaaatgcacttctgcacacatatctggtaaaaccatgtgccgtatcttgatcttgactgaagggttgcatatcttcccacaaacatatctgacattatttggcttctggaaatggtttgtcaacccatataatctcgatagcatggactcagagaagcacaaggaagaacttcatcacacaatttgaataccagatgagatgcatagcttggaatcagctccgccacttatcacactgtcccctttccaccagtccgcacataaaaccttatcttcatgcgagtccacagacgccagcggccatgctgtccttagatcccacaacatcactttcccgtcgaaagaagatgacaccaaatggaaacaagaactcggatgccatttacaagcagtgatccagcttgaatgagaggagaactgaaaacaggcgctaatgttccaggcttgcgagggt

SEQ ID NO: 14331 - DNA, 535 bp, Zea mays
  Clone ID: LIB3279-206-Q1-N6-F2
agtctcattggcacagcctgttttattggcagctcattgcaaagcaacttctcggtcttgattaggtcaaatggtattttctacatcaattttgctgtcacaacgtttcggaaacggaatccaaagtgtagcatggtcctcgtatcgacacaggttggagaagctgaaaaggacaggaccttcggaaaaaaaacagcagatcaagtgatctgtgttgagtagaaaacccacatcaaagtcaaagggcagagacccgccacaacaaaatacgtagccatgcagatagctctgttaccgcttgacccactggaagctctttcttgctttcgcttttccaggctttttcctttcgaccacacgtgaatctctcgtcaaatatccagctgctttgagatatggacgccatcctggttcccaattctccaaggccctgcttatccctaagcggatagctccaacttgtcctgatacgccaccacctttcacagtacaggtcacatccaaacgccccaaagtatcggtcacattaaatgga

SEQ ID NO: 14332 - DNA, 536 bp, Zea mays
  Clone ID: LIB3279-206-Q1-N6-F3
ccaaaaacccacgcctggggctatgctctcaaacaaactcgatttatgcactgattcgaggagttattgtacataaatacacctcctgtggcatgactctcccggtcaagaaacaacatgacatacagagtaagtccatggccactggagctagaaactctcgtccctttggaacagtatggagccaaccataactgctattccagtgacagcgattgtgaagaggagccgcttgtgtggtgaagcatgagcaggacgtgctggtcgtgccggccgcaccggcggcggcggtcgtagctctctctatggaattgctctggatgtgtctgcagaaccatttgagcttgaatggcactgaatttggtgccctatccattcacacaatctaatatacttgctgcatggagggcaaaattctgatgggattccacatacatgctgatgctcatggagatcaactgcaggcaattgaaacttcttatattcacaaacaactattctttgagggcacttattcagcttttttaagatcccac

SEQ ID NO: 14333 - DNA, 573 bp, Zea mays
  Clone ID: LIB3279-206-Q1-N6-F5
ggcaacgaaatcaacgtcttcgatgaacattaaccaaacagcaccgacccgaaggaaggcaagcacaggtgcatataggcgaagcatgtccaaccacctcactatggtggatggcaacgatggtaggccgacgacatacatacactacaatacaatacgatgatcctagatggatcagggatacatacgaccaacaacaaatccaagggaacaatggcgcccagacgagcaggaaagcgttcgtcagcccatcgcgtacttctgcgtccagctgcgggccgtcgactcgtacttcggccggtccgtcttgtacatgtgggcaatctccgggacaagagggtcgtccgggttggggtcggtcagcagggagcagatggagagcaggaccttagaaattgtcaaagcagggctccactgctctttgagaatgtcaaggcatatacttccattgctgttgatattaggatggaagacctttgtcttgaaagaaactttggaggtttgaaggggtaatctggcgggaaatgaatgttcactaagaaaacaccaccagcatagggactgtcaggtggt

SEQ ID NO: 14334 - DNA, 521 bp, Zea mays
  Clone ID: LIB3279-206-Q1-N6-F6
gagaagaatatttagtcgcagaacatttaatttttagcagaacaaaagataagtacttccatgcataacgatgttcagcacgagataagcaggttcacacaaggcactgtaataccccatacacttaaaattcatgttgcacaaagcaaaataagataggctaaaccaaaacgtctggattcgcattccaactgtagattggacttaagcaacggcctcgaggaaagccttcccaggagcacgcttctcaagtcttccatggttaccgagcagctttgcgttgacaccatcaggaacaattctaccctcactcttgtacttcaggtagtcggcacggctgaacttggtgaagccccactttctgctctcaataatcttttggcggccagggaacttgaacttggcgcgacgcaaagcttcactggcatgtgcagcattgttgtccttgcatcgaacagaaaggaggacctgaccaatgtccaccctagcacaggtgccctgaggcttgccaaaggcacccc

SEQ ID NO: 14335 - DNA, 458 bp, Zea mays
  Clone ID: LIB3279-206-Q1-N6-F7
ggataccagcatattaaaacgttttaccactgataaaaaaaaacaaaccggtatcggtactatttacgttacatttgggaaaccaaacgggaccaaagggttttaaccccagggggttggcctaaccccgggaggattttgttcctttgttaaggaagggactccaaataattttgacatttaataaaattttatataaattaaataatcaatctgtctaggaaggataaaatagccattgttccgggccataaatccggaaaaaccaaacagggttttaaagaaaaaaaaaaccacccggttttaatggggcccctatttttttaaaaaaaaggtttgacctttaaatttccttggacaaaaaagggacccagtttcaaaaaaaaagggccaaaactcgctttgcaaaaaataaaacaagcctaagtttggaataaaaatttccaaaggcccacctt

SEQ ID NO: 14336 - DNA, 594 bp, Zea mays
  Clone ID: LIB3279-206-Q1-N6-F8
agttcagtatttcaaggttaaaaaggactcaccacgacgcaacagacctgagacctgttttaaccaaattcagagttcatgcaaatcttgcatatgtttcaaaggatgttgatactggtctatgtggttgataaaagagcaatcacctctcaagctagtaactttgctagttcatctactcttaaggtaccttgatgaacaacatcagaaagaaactcttgtccatggtctgtctgcattgcagatcctccattaacgataaatttattttcaacagaactgctcaacattttattttctacaagatgtgttttagttcttgcatgattgtctggcacatttctcctggcactggacttccttcgagtattctcaaaaaccagtcttcgcggaattgactttgtaaaagcaacagacttttcatagaccagatctgaatcagcaagctcatcttcactcagaacaagtgccctgccactgtgaatggcctgttccaaaagacataacaatccctctactttagaaccgctatttagaacaactgtaccttttgtaccatcgtttcttttcctcttcatttccaaattataatca

SEQ ID NO: 14337 - DNA, 582 bp, Zea mays
  Clone ID: LIB3279-206-Q1-N6-G10
attcaggcaaggcaatcaccattcgactgcaaacacacacacacagagagagagagagacatgtcatggcttcgccttcgctcaggctactgcttgtatggaacggggatcctgtcgggaccggacttcatgtcctcccacagcagatcagacagcgccggcatcagcttcccaaccttcccgtctccgatgggtttgccgtcccactcgacgacgggcagcacggggaggccgctgccgacgaacgccatctcggcgctgcgcttggcgtcctcggctgtgatgtccctggtgctgacgcccgcgagcaggccggcgtccacgaggcgaggcgccagcgcgagcatcctcttggccgtgcacccgctgaggatcttgtcgaaggccgggagcacgagctcccgctcgggcgtcacgaacgccacgttcaccatggggccctcggccacgtacccttggtcgtccacccacacggacgcgaaggcgccgcggtcctcggcgtccatgatggacagcacgttgggaaggtagttcacgttcttcacggtcgcgaactgcggcggcttcatgggcaccgtggcc

SEQ ID NO: 14338 - DNA, 602 bp, Zea mays
  unsure (1)..(602): unsure at all n locations; Clone ID: LIB3279-206-Q1-N6-G11
gccgctaagtcatctgcctctgcggtggccacgccggnagaagaatccggcggcgccggtaaagtgggcggtcgacagctggaagtcgaagaaggcactgcagctcccagagtacccgaaccaggaggagctggacacggtgctcaggaccatcgagacgttcccgccggtggtgttcgccggagaggcgcgccacctcgaggagcgcatggccgaggccgccatgggccgcgccttcatcctccagggcggcgactgcgccgagagctttaaggagttccacgccaacaacatccgtgacaccttccgtatcctgctccagatgggcgccgtgctcatgttcggtggtcaggtgccggtcgtcaaggtggggaggatggctggccagtttgccaagccaaggtccgaagcgttggaggagagggacggcgtcaagctgccaagctacaggggcgacaacgtcaacggcgacgacttcaccgagaagagccgcgtgccagacccgcagaggatgatccgcgcctactcgcagtcggtggcgacgctcaacctgctccgcgcgttggcgaccggaggttacgctgccatgcagcgcgtcacac

SEQ ID NO: 14339 - DNA, 553 bp, Zea mays
  Clone ID: LIB3279-206-Q1-N6-G12
gcatcaagtaagtttattgcagccgcctacaagtcacaatggaagccatcagattacaatctttgacgagaacttgacttgaggcgccacacaaggaactccataaactcgacatccacggttacagaatgctaaagtttcacaggatttaactcgtaacaccaatctgctgtatgtagcatgaggtgacaacggaattatttcattacttgaaaagcatggccaacgtttccatagctgacagatgcgaattactgggcactgaggacttcaatctcgaacacaagcactgagtttggttgaattccccaggctgggaacccgccggctccataagcataatcaggcgtgcactggataccagcaacttcacccacttgcatgggcataactccctcgtcccatcctttgatcactgaaccctgaccaatgctgaaactgaatggctgctgcccagggtccttggtgctccaaaatttcttggacagatcacgatccttcccgtaaccggtgcagtgaacggtgaccttctggccctttatcggcttggggc

SEQ ID NO: 14340 - DNA, 425 bp, Zea mays
  Clone ID: LIB3279-206-Q1-N6-G2
acaaaacaagtttttgccagcttaaatgggatatactcactggaaaagtaaactcaggggctttttacccaggccccctttttttggtttggccccacctacaatcctataaaaacatttcatccctcaaaaataagtcctaaaaataaagccggggcgaccggggctaaaaaagcattggaggcctttgggggtctcgtttaaaccttttgatcgagctcggactgggaaaacagccccccatgcttttgacttttttcgctcggggggggggaaacctgccgctttttgcctccaaatttcgacgacgcgttcccgtaccaaataatgccgatcacagccagaagcatgccaagggcgacatggaagttgaccccctttttcccaaaaaaaaggaaccccaagggcaacaccaaaactgtttt

SEQ ID NO: 14341 - DNA, 558 bp, Zea mays
  Clone ID: LIB3279-206-Q1-N6-G3
ggcaggaacagcaacctttcttggtcatgagcactcctacataatatgatttcgtttaacctttgtgtcggctaattgcccatgctatttcagctaagatactacaacttagttggcgcatatataaatagaaaaagacatacaggggcaaattctatgttataactgtaaagagacggcgactgagcttggctccaatctaccactgcattgagttcgttcttctaagatctcctgatggttttttcctcaaaatgactggcgtcacccgttccaagagctctttaagccgcttctggtgccgctcttcctgttctttcaacaactcggcattctcctcctcgaggtgcgttaccagcgattctagctcggcgatataagcctgcttcctctcccgtgaccgggcagcagactcgcggtttttgatcattcgtttctgtcgctgcatcgcggcgcgatccactggatccatgaggtgccggttccttccccttccgcctccggcgccaggcacacccacgccctccgttccgcccaggaaccccatggccggcgcaa

SEQ ID NO: 14342 - DNA, 579 bp, Zea mays
  Clone ID: LIB3279-206-Q1-N6-G4
atatgtaactgagcaatacttgcacttaaaaacagtatagaccagaataacacgtgaggcgggaagaaaagcccgaaagggtcgtaatattgttggttgcagcaatctattaggaacaagtaggcttttgtgaaattcaacaggaactctgatccacggtaaccgccaggttcaggagctaagattgcaagtcaactctgacggtaacaacatcggatctgctccgtagaccactcgaagactcaggcttggaatcagaaacttacggcacgagcctctgcgggtcgcgcgggaacagggaggtcttcctgatgttgttcagggcacagaacagcatcaccaccctctccaaacccaccccgaaaccgccgtgtggcggcacgccatagctgaaggattcaatgtaggccgagatagtgctcacgtcgattccacactctgtcgcgcgcttggccagcagctcaggagtgtgtatcctttgtgctccagatattatctcctcgcctcgaatgaagacatcaaaagaattggtgtacgctgggttgtcataacaaggcatggtgtagaacggacgtacag

SEQ ID NO: 14343 - DNA, 577 bp, Zea mays
  Clone ID: LIB3279-206-Q1-N6-G6
aaccagaaaaaaaacataatgagcagacttttaagttcaaacatcaaacttcacaaggattcaagccatactgctgcagaagagttttgggtacaacacagaggacacaacaggtccattaaaccaacgaagccacaaccacgattcatgacacacaaaccacagatgtttattagacgacgacgacgcagatacccaggtacagcagcagcttaaatgaaccatggcttactgaccaccacggaggcggagcaccaggtggagagtgctctccttctggatgttgtagtctgctagggtgcgaccatcctccagctgcttgccagcgaagatcagacgctgctggtctggggggatgccctctttgtcctggatctttgccttcacgttgtcgatggtgtcggagctctcaacctccagggttatggtcttgccagtcaaggtcttcacaaagatctgcataccacctcgcaagcggagcaccaggtggagggtgctctccttctggatgttgtagtcggcgagggtacggtcatcctccaactgcttgccagcaaagacaggcgctgctggtccg

SEQ ID NO: 14344 - DNA, 573 bp, Zea mays
  Clone ID: LIB3279-206-Q1-N6-G7
cagaccctcaatagcaatatagcatcgtcgaaactgtccacagtcttctcgtgcaaagttacacaaagtcctgcatctatgctgtaaacatgaactgctgctgataagctacccttaacaaccatatagcatcgctgctcaagcaaagtttttgcaactagggcaaaagcttgatttgccacatagcgcgacagatctacctcctcacagggggtgcaccacctcgtccaacaggaccaccgccacgaccagcagcagccctagcccgcatggcgaccgcgcggcctcggccgacaccaacagctgagcctttacccctaatcctggcctcaaggcgcttgaacattggggcgttcttgagcatgtcgggtataatcatgaacctgaccctgctccccctgatgaagacgtgctccagctgcgacaccttgccgtcctttgccgtgaaggtgatgttttcgagctggcagttccagttgtcctcgcactcgaccatggagccgcggtagacctcgccggtcttgagctcgaccgtgacgacgtggcccgccgcctcatgcagcagcttcaccg

SEQ ID NO: 14345 - DNA, 514 bp, Zea mays
  Clone ID: LIB3279-206-Q1-N6-G8
acattccattactcatgtgcatatatcaggagcaagaaaaaaaatgggtccagatcgaaccatccaagatttattccatcaccacccacccgaatcccgaaaccatggttaaactgcggggacaagattaaccaaccaaaaaagcggggttccccaaggccacagcccattctcttataagaacgactcacttcgcccaggcaagggaccgacctaggggtcgacaccaagcagaaaaaacgccaaaccagccataacgttactatactgagaggcaacaaaactacgatgacctaggggcactagctaccactggggaggaaactactactacggccaaagggggaactagaaaacgagtggcactacgacttttgctgctggtacgggctctaaccaaacaccggcaatggttgggggccggccgggccggggccgtgaggctcattcgaggagggggataacggggatgaccaagatgacaatcggggaggagacgacaacgcaccccttg

SEQ ID NO: 14346 - DNA, 520 bp, Zea mays
  Clone ID: LIB3279-206-Q1-N6-G9
tccaccgccgcctccaccgtacccaccgccatagccgccgcctcccccgtagccacggtcgccgccgtagccgcggtcgccacctccaccgtaaccacggtcgccgccgccgtagccacggtcgcctcctcccccgtagccgcggtcaccgccgccgccgtaaccgcggtcgccgccgccgtatccgcctcgcccaccgccgttgccgccgtcgggacgttccccgccggcaagcgggccgccgccgggcgcggtgacatcgagggccttggcgcggccgtcgttgccgctgccgacggtgtattcgacggcatcgccgtcgttaagactgcggtagccgtcggacttgatggaggactggtggacgaataggtcctcgctaccgtcgtcgggggtgatgaaaccgaagcccttggttccgttgaaccacttcacagtcccgagcaccctatcagacgccatttcctcctcctcgaaaaccctagaaaccctagatggtaggggaggcggacgcggtgag

SEQ ID NO: 14347 - DNA, 393 bp, Zea mays
  Clone ID: LIB3279-206-Q1-N6-H10
ggacaactctcccttacctacatagaactattgcaacaacagcccatcgcctacaaaaaaaaaagagggagttttatctttcggcccaggacggttataagcccatcacctccgaatgcgaagagatcgtgactccgcctccggtccgaagcatgcacatgtcagcatggaatttcaggcgccgcgcggggaccaccaccagagatctcgagaagcctccttgcagaaggccgaagcgtcgcccactccctggctagtcccaaacccgatcgaacagaagatctggacacaagtaggagcagctagctacagggagaagaagtgttcgttctctaagactctgaccggacgcgtgggcggacgcgtgggcggacgcgtgggcggacgcgtggg

SEQ ID NO: 14348 - DNA, 578 bp, Zea mays
  Clone ID: LIB3279-206-Q1-N6-H12
gaagcaggatattcagttttgcatatactgaaattttgaagtgtcacagaatgtatatacacacacatttatgtctacatctttattgtgataattccatcaccttcttctccgtcaataaagagacatgaatatcttatctccatgtggtaacagccaatcttggcaactgcatacgctgtacatttcatttgcactagttttctggaattggatcataaccctgtggttcttcaaggcgaactggagctatagcagccaccacaacagaggcaccaaataacacgacaaccaatgctgtgaagttcactaagaatgcctctgtgccatatttgtcgagacctgagctctcgaggaaagtgagcttctcaagaaagccgagttctgcattagccagtgctaagatgtagacaaagagcccaaagagtacgtgccaaggaagaacacccttcttcacgtttggcgcagcaccagggaagaagaacgtgacgaatccaattatccactgaataccatacaaagtaattgttcctatcccaatccaagagtgcaggctgtaaagattggcaatcccactc

SEQ ID NO: 14349 - DNA, 510 bp, Zea mays
  Clone ID: LIB3279-206-Q1-N6-H2
ccagcaccaatctccatcgatcatatcgggcccatttaaaattctaaactcttttatggcagttcaacaggcaacaagttactagtaaggccagcatcagggcgaattttactactactgcaaaagggtaacaccgccggggacattcacaaagggggcaggaattttgcgagaatcgagcgtgatctgaggtcgggggcaaactgtcgggggccccggcatgcggggggcatcccttaaaataacccaacggcccccgttgaggatgtcaagcgcgggaagggcggccttttggactttttcccgttcgtcgggcagcgctcgggcattttccgccacggaatccctggcgcgctccagctccgggtgaatctcgccgtcgaaccgggcgatctcgctgttcgttttgagcatgctttggaaaccgtcctgcacctgttgggacacgtaaaaaaagaccccggaaagcttggaatttccgccgtcctaagccaccgggtcggggaaggc

SEQ ID NO: 14350 - DNA, 564 bp, Zea mays
  Clone ID: LIB3279-206-Q1-N6-H3
ctagtccttgttgtacatgcaatacaggttactctaaaacatgaaaaacgaagcatctaggtactcctttacattattccttggattgaatgctaggtttacaatgtttcgccttctggttctggcctgcactagatcttctgcttgagcacctggcggagctggaccttatggctctccaaccgtgcctccatgagcttcgccttcaagctgtgcttctgggacatccgcgggtactctatacagcccttgaatccccggttgaattggacgttcatcgagtctggtgagctccactgctcaacacacggtggactgagccctatttcttggatgccactttcaacagtggaataggtcccgactgagagccgcacgtttgacgatcttgcatttaccgtttcaactgcgtctttcttgcatatctcgctgttctttgggcgggacgacttccagagctttgaaatggccgattctttcttcttgggctggttcatgtttgtcaggcaggcatcagctgactcatccttcagcttctcactctccatacgctcgaatccattt

SEQ ID NO: 14351 - DNA, 578 bp, Zea mays
  unsure (1)..(578): unsure at all n locations; Clone ID: LIB3279-206-Q1-N6-H4
atattcaaactgcacactataaataatacgatctacaatataaaaaatacagtagttcacccatatatgatcactacaaatacaatgtaaaaaggtacaatgtacacccatatatggtcactacanaactccttttggactatttttgtagtgtagattatattattcataggtcactatgaacaccttttgcactattttgtagtgtagattatagtttaaatatgggaaagagtaagctactgatggtctaattctcaacccaccggtatcagcttacccatcgcctttactgcaatcaattcccacaccaccatggatttgaaacccttttggaaacttcattttcccaaaaaaaaaaaaaaatgaactaattttccttaggaaaccttggaagaataagttcccaaactagccctaatcaaattgaaaatagaaaatggaacttcgcaaaaaaaacaacatgaaattgatctccaggggaactcatgctctcgtgcccctagctaaatggatgaattgaactgccaataaataaattgtcgaactgtatgtacagtaccgtcaaaaacagtaag

SEQ ID NO: 14352 - DNA, 604 bp, Zea mays
  unsure (1)..(604): unsure at all n locations; Clone ID: LIB3279-206-Q1-N6-H5
gctgaactgattctngagaaaggtactaaccagcatcatctgcgctgtgtttctgacacggatatctagggctacaactgcatatttacaatcagttttgaatcaagaaactaacgatgtcgctatagaaattatacgaatcgcctgcctcaaaataaacggccgctctagcacccccgcccccctagcgctcctccgaagtgaatttgttccaagcatccttaagaagatcaaaaaccttctcacatatgtatttctgtctgatcgtagcgcccctctgctgtagtttatctggatggacacatagggttgccttcctgtaagctttcttcacagcaaccgctgtaatgagatctgttagtggcaccggttgccagccactatcggcaccaagaatatattgcaatgtggatagcagggccctcagatttccttcctttccatttgaccatctcttgatctcaggatccaggaattcagacagcctatgtttctctgcttgctctctttgagccagcaggtcccgcatgttcttctcggcaagagcttttgtcacacgctcagttgtgcgttgatgcctctctaatcttgctttatgtcttaa

SEQ ID NO: 14353 - DNA, 581 bp, Zea mays
  Clone ID: LIB3279-206-Q1-N6-H6
ataattctatcataatcactcagttccttgtatctctccttgaaactctagcataacgttgaacttcctcttctgtcttaccctccatttcagatgatatacttttaatatcattgcgaccgtatttctcacatgcacgaataaatgtgttgaagtctctccttgtccatgacgcaaaaccctcctctaataattgttccttctcttcctgctcctctgctgtcaaaggctccaactgatcttcgtcttcaccatcaatggtatctttcttctggttcgcttgcataaggtaccgcacttccttttcatataattcatttagcctttggttattgaaaaactggaaatcatgtaagtgcggcattcttggaatccttggttccctaggctttgctggtgcaccttggcgaagtgcttgcttaaagtagtcagactcagagtagtttctcttcctttctcttctaggtggctcaatccagttatcactaacaagttttcttgaaatcaaccttgttttcatccttctcatcatcgaagtcatacaattcagcattatcatccatcttaaatttgatggcatc

SEQ ID NO: 14354 - DNA, 562 bp, Zea mays
  Clone ID: LIB3279-206-Q1-N6-H7
cagtaattcttctccggtcaacatatcaaacccttaacgcagtataccgttaaaacaaaccatccaatcaaaagaacagagaatgctgccatccctaccaggaaagaccagccagccattaaaataccgatgcatgtcacagttaggaaaggcaagaaagaccgagcgaaagacattttgtccacccattggccatgaaaccaaacaagggaagccacattcaaaacattccactccacagagccattgtaagcgagccggttcaggcagtttgccacaaacgagtggcaattgcaggtgaacagattgtagtacttgtgctggaagcgtctcatgcccgatcgcagagcatcatcccatgatatcgctgctccaacttctgaatggctgtaggactgcttgcatacatgtgctgcaagattaacaggaaggcagcacttttttctgtcaagctggaggtatctggcaactgaaccataagcaaaattatccatgctcaccaaatttgaaccagcaaaatccaagatagccccatcctcctgacagattccaacatgtccta

SEQ ID NO: 14355 - DNA, 584 bp, Zea mays
  Clone ID: LIB3279-206-Q1-N6-H8
gtcggtacaatgatacagtaacaatgtcacaatgacagtgatatgtccatgctccagtcgccaacctggtgactgcagctaacttgctccagttcgagaaaagaacattacaaaatttctagaatcataacagaagatgacgcctaatctaaggttgttagaaacatcacatgttgcagacatgggtgagattttctttcatttccctatcggctaaatgatcagtaggcaggcaacaataaacataactctatagttaaattagtgtcggatcaggtgctgttagagctcagacgcccttgatatgcaagctccaatcgtacgattctttagccctgttaatttgcctgtgaaccaagtcaacaggacggtgtaaacacgcgctgtcgttagagattatcgacagctatctcatctttgacagggacctgctggacatgccatgcaacaacttgacaaatccaagaaaacttaatttcccatccgtatgcctgatccaatcttgcagaacgacatgcagtggcactgaaggactgaggcccaattcagaagctaattcatctattacaatagctcggttgcct

SEQ ID NO: 14356 - DNA, 475 bp, Zea mays
  Clone ID: LIB3279-206-Q1-N6-H9
ggccaaagaaacaaatgaagctgtcaaaattgggagaaaccagcatccatccatcaatccatgggtttgcagacattgccctggcaatgtagatgagcgagaacgcatgccagcttttatgcccctgggattaaattaagcaaaactaacagaccacaacaaccgccgcttggcggcgggactggtttttttttttttaaagcctgcttttcgcctttttaaacttctccccttttttgggggggagcagccatcaacttatcgaatttggcactttttcccaagattatttaaatcttggccttttggaatggaccccctcgggattcgtcgtttatgtcaacaggagatgtcctgatctttttttcaacagcaaatccattttttttcaaaatttttgccacgggcacaactgtgggtatgggcatttccacccgtccgcggaagcttgggcggacccctgggtccacccggg

SEQ ID NO: 14357 - DNA, 565 bp, Zea mays
  Clone ID: LIB3279-215-Q6-N6-A1
agttaaattacactactattatgtgatatacactcttaatttgtcagattgaggcatgtgtggtcactgattccatgtgacacgaaaatacaacatgtaaaacagagacgaagaactgaagcaccacaactacattccctatagcctacactgttattgttccactcaataatatggactacatgatttccggggggtgtgtggagaagaaactacacatgacaggatcagaacagcagcaggggcaaaagaaagaatagaaacactgttagctcccaagcccgccggcaggccagcctctggcatcaattcgttgcgccctggccaggtgaggagcaacacctgtgtgtggcttcggctgcacttcagagaggtcggttaatctgtacagggcgccctcttccaacttctatgactgccggcatctttcaatgacttcggtgacagctgaatgtgtttcccttgtcatcatgttgagctgcaggtgaaatgacacaaacttctctagcactggtacaagaacttttaagttgttgtccggaaggcagctggaaatggctcctcg

SEQ ID NO: 14358 - DNA, 511 bp, Zea mays
  Clone ID: LIB3279-215-Q6-N6-A10
catgtacaaattacacatcatgtagacacatgtacaccagtctcaggacaaaattacaagagcgtaaaggaaaaaaaaaacccgcaaccatccacaaatctccacaaaccacaattggaaggagataggtcgtgtcttgtgactctcaaacaaatattagcccttgtaaccctaaaaccccagcctacgctgatcaaacagcgagttcggcgtcgtttcggtgatcgaaccatgtcggagacgaactccacgtacccaaagaggccacacagagcatatggtgtgccctactgtccccttcagcctagcaagtccttgaaaagattggggttgttcactgttggtgtcactcctacttgtcgtgcagccgcatccttttgcaaggcatcttggaggctcgggcccttcattgaagccactgcagctgctcctttgcgggagcccatcgaattaacatcacctagagtgggatcgggggacacactagtcactccggttggtacatcatctg

SEQ ID NO: 14359 - DNA, 549 bp, Zea mays
  Clone ID: LIB3279-215-Q6-N6-A11
gcatatgacaatacatgtaataaatatataatcatcatttgttattactaccggcatattgaacacttcattcatttcaacatacacattggcttgtaaccgctttgatcgatcaggtattcattcacattcgcaggaacagtgcttgaaggcactactctttttgctagtgtagcacctacattctcctcagattgtctagccttgcctgcaaatcagcgtcgataccactgtcagcattcccagcactttcagcctgggcgacccttcccacagaagcaggttgagcaacagtggccgacggagctccaacaagctcttggttgatatcaatgccaatttcatcaagtacttgattcacaagctcctcagtttcttcttcttcctcatctccttccaaagcatcatctatggcatctcccatcacttcactcaccatctccatcctctcgttctgtcgctcaaactcttgcattatcctctgcaatcctggtagatttagctgcctgttcatttgggacattgcctttgtgacacccttcatggcat

SEQ ID NO: 14360 - DNA, 579 bp, Zea mays
  Clone ID: LIB3279-215-Q6-N6-A2
gcatgtaatctttgatgctgtcattgaccaacatgcagtcatcaaactgtactcagtactcaacaacaagaccttagaatagaagcattcaaatttcctatagcccctgacaggataattcaaccggccgttttaaactgtagttaatcggtatgcaaaaattgatgtccagttgctttctctacagatcagtctaagcttttgtttacaggaaatacgagtgcaacacaaacaatcagaattggcagctgcatgtctctctaaatggtgtcagggactactagagctgtgttctttaacattttccaacctgacgcctgttttgctttttgcgaaacaacgacctgcccccggcatgtcatagctcatcatcaatctggatggtagcacttgtagatcggcagtgtttgctaatatcttcacaaagggccttgcttacatattctgattctgtggaggttgttttgatccactcagagagctcatcctccgtttcctccagtagccttccacagaaggtggacaattttttggagtgagctcttgctgctgccttattttcagtttgaaagctattcc

SEQ ID NO: 14361 - DNA, 564 bp, Zea mays
  Clone ID: LIB3279-215-Q6-N6-A3
gcaaaaaaaaaaatccagactcctgtgcggaaacaagttcaagatacttggggtacaatcaagtacatgagccagatgtcacatggcagataattctgtctcgggtacaaatcacaagccagtgagcccaccaggcatgttaagcagatccactggaagcattgccgtagggttcttttatcttctcctcaaaccaacacttgatctgagtcaggggataaaaggctttacctgccggatacacaatgcaacgggttccttctacctgccacgtctaggggaaggagaactgctgcttcggctgtcactagagatgcttcttcctctgggaggccttctagggctgcgactccttgatacccttcttggcccctttcttggcggtggagtaggtgatcgagaatatgatgagcctgacctaccacgcctcaagagaggccctcgtccccttcttggagaaatcgatctggagcgaaggggtcggcgaggaggagatcgactatagcgacgtggaggtggtggccttcttggtgggctcctcaaacgccttgggagtggcgagcg

SEQ ID NO: 14362 - DNA, 494 bp, Zea mays
  Clone ID: LIB3279-215-Q6-N6-A4
acaataatctgaagcaaactagtgcattattatcacagcttatccttctgcttgtttattcattcaacatgttttacatcaatttatgctgtccagtcactattcaacatcccgagaactcaaacagcatagtatgcttatacttctcaccgggccgaacaaccacagagggaaactcaggctggttgatggcattcgggaacccctgggtttccaagcacactccagcatgcttcgcgtagacagcgcccgccttgccaccgatgccatccacgtagttggcagtgtacagctgcatgccgggtgcgtcagtccacaggtccagggtccgcaagctcgacggatctttcagcctggccgcacgcttcaggccgtccttctcgtcgccacagtccagcacgtagttatgatcataccctccaggaacaccgtcgatgcgctcgccaatcctgcgctccgtcgtgaagtcaaaaggggtgccatcgacgggcatt

SEQ ID NO: 14363 - DNA, 371 bp, Zea mays
  Clone ID: LIB3279-215-Q6-N6-A5
gatcaaaggatgcatatataataattaccttgtttacaccaaattggggggcgggggcaaaccaagcatcatactacacactcaacatatccatgtcgggtcaaatatcgagcgatacaagtgaatatgaaaccattccgcgagaatgccggcaggtagctatttcttgctgcgaccaccacgcctaggaggcacaacagtccacccatcggcgtctggagtaggcttggggggccttggcctgtccactgccatcttttctggcccagccttttcatcagccatcgatgtgtcatcaccgtcatctgagctatcactgtcatcgtcgtcatcgcccactatctgtctactttgagaaacagcattccccg

SEQ ID NO: 14364 - DNA, 383 bp, Zea mays
  Clone ID: LIB3279-215-Q6-N6-A8
aacaaaacatatccttttcagggttatggttcgcgtacaaatctgtagaagcaaacattaccagataactggctgctaagcctgaattcagctgcatcaagtaaacagctcaggaatcatcagatcaactgccacataaacccacagaacattaaatagtttcatataagggcccttccacttgaaaatagaaactcaaatgtgtcacaaaaaatttctcagtctagttggtgatggctttctttgctctaagagattcaagggccttctcacggagttcaatttctagtttcttctgatcagactcttctcttccagcgtttgaaactcttttcctaacatcaccatctgaatcaaaatcccgatccttctcaaagtctgaa

SEQ ID NO: 14365 - DNA, 607 bp, Zea mays
  unsure (1)..(607): unsure at all n locations; Clone ID: LIB3279-215-Q6-N6-A9
aaagtagctacacttaaaaacacaaaacccaccaataaacagggtagctaagcaaattttcaagcaaatacttcatgtggtagtcctgtattcactcaatgggaatagatgcgtcttgcatttgcacttctcgaaggaaccaaaaccaatacgtaagattctgcatctaggagttccaacaattcagcataacacgaatagcaaaacctgacaacgcttaacataaaacgtcataccaagtcctaaagttcattatttcaaatatcttggttgataatgcacctaataggatcctgcccccctcaagcatcatagctttggctgccaccaccatagccaccacctccgtagccgccgccacctccgtagccaccacctccatagccgccgccgccatagccaccaccaccacggttcccagcaggtctctcattagccatgttgacacgtacctgccgcccatcaatttccttgccatccattgcagaaatagcttccttggcagcatcactgtcggagtagttcacaaagccaaagcctcttgacctcccagtctccctgtctgtgatcaccctcgcttcagtaacctctncaaagctgctaaatg

SEQ ID NO: 14366 - DNA, 510 bp, Zea mays
  Clone ID: LIB3279-215-Q6-N6-B1
gatgtggaacagtgttgtagaaagatcagcacaattctttaattcaattacacgcagatcatcatcatccatcgctagcagtatcacataaactgagccacgcctaccgccgacgcccacatgaccattacaaggatcctaagacgaggtgaacttcgtaacggccttagtgccctcggagacggcgtgcttggcgagctcgccggggaggacgaggcgcaccgaggtctggatctcgcgggaggtgatggtgggcttcttgttgtagcgcgccagcttggcggactcggccgcgagcttctcgaagatgtcgttgatgaaggagttcatgatggacatggccttggacgagatgccgatgtcggggtgcacctgcttcagcaccttgaagatgtagatcttgtaggtctccacggacttcttcgccttctttttccccttcttgccctcgccgccctccttggacttgcccgccgggaggcgcttctcggccttgggcttcttccccgc

SEQ ID NO: 14367 - DNA, 481 bp, Zea mays
  Clone ID: LIB3279-215-Q6-N6-B10
ccctgggaattgaggagattccaagatttgtgtctcagcccaaagactgacaaaatccagggataaaaagagcaaggtcaaccggcagcacatcgtgaactccatatatccagctctaaactcaaacaaaaaaaaatgcctgttacaggagtaaagggaacaacaaatgccattgcgcaagttctgatcgccaaataggatagcactactgtgccgcgactagcacttcattcgtcatcctcatcatcatcgacaccacccgaggaattgagggcattgagcctttccacgagtctggccttcctctgctcataggtcaacttcttggggttgtgcctcttgtgctcctttggttgcgcctttgttgacttggccatgctaggatcagcacggatggcagcatggaccttcttgtacagagcttccatgtcatcggcctcaatccccttcttgatgtactcgctgaagtgagcctggtact

SEQ ID NO: 14368 - DNA, 528 bp, Zea mays
  Clone ID: LIB3279-215-Q6-N6-B11
agatctatcagtctgtcattggctaatattcaacaaacaatccaaaaaggtaacaactggcgaagcagccgtttcacaacatgattctcctcgaacatccctccctacatcagcagttgagcactctcatcctcgtcatctcgtgatgaatttgtatgatggaaggatcagtgggacaaaaataggtacgccattacacattgggatcagaaaatctatggcagtaaaaatctgcaagctgtttgttaaaagaaatcacgtgattaagctcattgaagcaaaccccacatttcccttgattacgcatggtcaggatgcaacctcctcagtagcttgtacaggccgaacacattgttttgttgccatcggtatggtatgaagaaggaccgatataatgcaggggaaagctctctgtccaggaacggcagtgcggccaatgcctcccatgtcgacaagtcactcccgcgcgaggggtaaggccgtcttagatcaagttccaccagtaagttacatgctccaatgtctttc

SEQ ID NO: 14369 - DNA, 527 bp, Zea mays
  Clone ID: LIB3279-215-Q6-N6-B2
gctggctaatatcagaaatcatataatgtgactgattcaacacaatgaagtactgggtagaactgaaaccatagtactttgggcagtagcagagaacccaatcacatgcatgatccaacataacaaagtagatactagtaatagctagaacgaacaacaaaggttgatactagtagctacaacggacaccattgtaggcacccggccgatcacatcaagacttgagctagggcagtagtaagagcactgtggcagagatccaatcacttggagacttgaggctagtgactgcaaatctcgatcgtgtagacacgtaggtagctaggtgacgatggctaataaggagtggaagcagcagagaccatggcatcgatgtccgacttgacgttgctgaagacgctgtccatcagcacgaagatcaccactgataagttgctcccgaggccgtggccggcgagcgcctcgccgtcgacaccggtgaggtccaccttcctggcgaacaccatgcttctgtcaacaggggcgcc

SEQ ID NO: 14370 - DNA, 606 bp, Zea mays
  Clone ID: LIB3279-215-Q6-N6-B3
tcgcgatctagagcgacatgacggcaataaaagccgatgacatcttgagcacgctgcagagcctggacctaatccagtatcgcaaagggcagcacgtcatctgcgcggacccgaaggtcctcgaccgccacctgaaggcggcgggtcggggaggcctggacgtggacgttagcaagctgatctggactccctacaaggagcaaggctaaaagcgcagctgctcccagccccagattagagtccctgtacataacgtttggtactaggatctcccctcagctctcacttcactcgtgtaccgtgaaaactgtacactgtaacaaccacattgctgtgtttgtgctgtctgccgctgagttcctttatagatatgttacccttatgtttctttagaatttccagaagcactctagtccaataacctctatagctgagcaggccaagatcagaaagagggcgctccggtgtcccaactttaccttccttcttggaaagttcatatgagaaagcaatcaggaacttcccatatcctttttctttggtatggggggagagtgaggatggcagcccaaattataagattcttcagagtgtttttccttagag

SEQ ID NO: 14371 - DNA, 455 bp, Zea mays
  Clone ID: LIB3279-215-Q6-N6-B4
tgggcagcagcgacggcggcctctgccaccgccgccgtcgccgcggcaaccgcgatagcacgcttgctctgctcgtcgtccgcctcatccgtcgccgccgcaaatccccggcgaggcgtcgccgtgggctgcaccgaaggcgtccgaggccgttccgacgctggcgcggggtccttttcccggaaggacttcccgaatccccagagcttcttctccttcgccggcttcgtcacggcggccttcctgccgccgccgagcagcccgcgcagccacctaggcgcccagcccatctccgcctctctaccgcccgtcggccggctgccccatgaggctttcttggttccagcacttggccggagcacggggtaaagaaagagcgggagatgaaaccaaaacagtgaaatgaacacacgcttcaccgagaagagagaaaggcagcaggagaggaagggact

SEQ ID NO: 14372 - DNA, 424 bp, Zea mays
  Clone ID: LIB3279-215-Q6-N6-B5
gccactggagcaacactgactccttgctggtgcacatttatcgcgcgtaagcaacactgaacatcatgggtaggtacaatatggggcaaaatcgtcggctacgtgtcaaagacaggacccagttttttttttagtcccgtacgccaaatgcaacagcaacctttttataccaacgcatgcaagtgatgacttcaaacaaagcacggaacccttgcgaaaccagggagccaaaaagggtgcagaaaaacacaaaccattggcaatttattggtactggtattatcaggaaagtgaaagcctgcaaaaggatggattccatcctaaatagggacttgttctggtagggacccaggaatcttgtgaaatttccaagggctattgctcccttgagataccaaagaagctaacgcttagcttcggccca

SEQ ID NO: 14373 - DNA, 495 bp, Zea mays
  Clone ID: LIB3279-215-Q6-N6-B6
aggatagcaaaatactattatagcttaacttgttcataaaaactggaggagcatgacggctgatcacacccgaacaactatcccaagtttttacaggcacaaaactaccaccgacacttatgctggagctaccgacgaatctagagctactgacaatattacgattggatcaaaatccatgaaagaggggaatctataggcggaattgagggggggatctcgccagcgacaagggaggcaaactactttttggccttcctggccaccccctttctggccggggcgggaacaacaacaaccttttttggggttgccacctttttaggagccgccgctgcctttccctttttggaaggaacaacccccttcttggctgccttggcgggggaggccttggcggaggtcttggccaccttgggagggcgcccccggggcttgggcgacaccggggcaggaaccacaggcttggccttggccttggccttgggtttgggc

SEQ ID NO: 14374 - DNA, 414 bp, Zea mays
  Clone ID: LIB3279-215-Q6-N6-B8
aaaacattgaaacctcttttattgttctttttttttttcttaaaattgtacttttaaaggcaagggaaaaaaaatcgtaattaaagtgcaacggataacccatgacgaagcaatactgatgaataagggatgggctattccctctgctcctgttcctctcctgtcgcggcagctagcgactcaaccgtccaacccggtggcagggtagagggccatatcccaccatcaaccatatcctgaaccgtacccggaattggcttgatgaccatactgtgcacagagtggtgggacttaaccacggaaaggaatgtgcataaaggaattgccgttgattagagaacttccgaggggataccttacccgcaccctatgttaccccttctatttttcctcagtctggaaacacaagcgcaa

SEQ ID NO: 14375 - DNA, 535 bp, Zea mays
  unsure (1)..(535): unsure at all n locations; Clone ID: LIB3279-215-Q6-N6-B9
gcgagattagacacggatataagaagccaacgacggcatcacacgattacaggcgaacacaccaatcagcacaaacatcaccaaatcctttattctagtcactcagtgcagatgcagcctactgctagcagggcactgaacatcaccatcccgtcgtatggattctggtaagggaacagtatcccttcattcgatcttgtcgcagtcgatgtcgggggtgatgttgtaggacagcgagaggccgcagtcgccgggcagctcctgcgccgcggagagcacagcgtggacctgaacgtaggccgccttgaggcaccggcacgtggcctgcctgtcgggcctggtgtccgccgccgcgtacagggtcctcacgccgtcgcagcactggttgttgctctcgctgggtttggctgccttgccctgcaggaagggcaggcacggcgacaggtcgttgagcacgtcggagcacgagatgtcggccaccgcggactggactgccagcatcgncaccaggaggacgactgcaatgcccgagcta

SEQ ID NO: 14376 - DNA, 544 bp, Zea mays
  Clone ID: LIB3279-215-Q6-N6-C1
aaaaacaatgtaaatggattttccgatttgtatccaaaatctcgaagttacatggttcactactgaatccaaaaggactcccagcaaaggcaatcagtagctgcggccccaaaacgaccacttctttgctggctttccagatgcaaagcacagggtaccttctggaagttctggctgctcaaatggagtacacaatgttttcgcagctccgagttccccttttgtccgagctttcacatctttctcaacttcctcctcatcgcaccaaggagccaagatcaaccttttgttattcagagcagttgtgaattcatcccaagagttgacgacctgaacacatgcatctctcctttcttgagctgttttgaacagatttttttgaatctcatccaataacactttaacatcttcaaccaaattggtcaccggaatgtcaacctttgcaccgttgtcccggcggacaatgcgtacctgtttgtttgccagatcttttggaccaatctcaattctcaatggaacacctttcatttcccagtgagaatac

SEQ ID NO: 14377 - DNA, 439 bp, Zea mays
  Clone ID: LIB3279-215-Q6-N6-C10
agcccaggaagaaggcgcccggtaaatttcaagaaccaccaccacaaacgcagaaaaacaaattagggttactgggttattattggggggaacgaaatatttacttaagggtaaacgccatagcaggttaattctcaaaagcttgggcctaaaaaagagtctaaaaatgggtctggggatcaactggctgctgccccaagttggcacatactaggaacaaaagaagccgccattccacggatatagcttggaatgacttcttttgttaccgggcaatgtagccaccgcaacacccgccaccttttttttcaatttaaggatcagctcgacgggcagcactgcaatatgtacatggggtccaggggccacaaagcttgttaccttttatacagcgctttgatatccttgcggattgctttagtatccaacaggtcgtccc

SEQ ID NO: 14378 - DNA, 449 bp, Zea mays
  Clone ID: LIB3279-215-Q6-N6-C11
agcgcaaccaacaaccatgctagcattacgggtccagagttcaaggcaaccacagacgttaagttaacatagcatcatttcgtcttggttcattcgctacaggatccactcataggggcaacgaaaacttgtaactaccggaaagacccactggaccacataccctttccatgccaagtagatccgggttttcagtctccaccaacctggcgtttccaggagtcctccacaatgagctcgtctactccccagtcttcatagcttccatcaggtaagtaccgtctgatcgtgaagggtattttgcgcgctctcagctccttcattgcaatctcaagaggggcagtttcaccctcaagctcaaccatgactggagcattcatgcttatctgcaaggctcgtgtacccaggatgcgcgcacgttcgtacttcggcatgtattttggtggttt

SEQ ID NO: 14379 - DNA, 592 bp, Zea mays
  Clone ID: LIB3279-215-Q6-N6-C2
aaacgggcaagaatgcgtagaagtgtccacttcagttaataaaaacgaggcatgattttctaatgagtcattatgttatcagccctaacgagcaaaggacaacaacacaggtaataatcttaaggtaaacagtgagtggcatagcagaaactgactccagcttgttccatatgaatcacggcgaggctgcctgcgtgactgcttccagctccccttcctatccttcaaaactgtcgttcgactggattcctcactgcatccggtgcatcgaggcaagccagccaaagcagacgttggagcaatggagccaatagccggtctgccttccatgtaatgtacaggggttttctttcatcatttagcttactataggatgatgaactgatgatcttcaaggaaccaccactttggtcctttttttacatgacatagggtcgatcgatgaaggcccactggaagatttgttcgtattgttcagcggcatggtcccacgtgaagtcttttgacatgcctcgcttcattagcccttcccaggaggacttgtgttccctgtatgtagatattgcagttcgcaatgtccaacaacatgttt

SEQ ID NO: 14380 - DNA, 364 bp, Zea mays
  Clone ID: LIB3279-215-Q6-N6-C3
ttctccgcctccggcggcggcgccacgacgcggctgctctccacctcgcgcacggacgcgtccaggtccgagtggtcggactccgacttggccggcgcgcccgtgcctgccgacggccgcgcggtcggcgccgacgagaaggacagcatgccctcgttcgccgccgccgccgggtggtggttggtgttgctcgccagggaggtggcttccatcgaacgcttgttgttgttgttgttgttcttcgcgtcgttcgccgcggcggtcgccgtgtgctgcgactgcgagaataggctgccgggagcggtggtgaggctggcgggaggcgccggcgacgggttcctctgggcgttgccggacgcgtggg

SEQ ID NO: 14381 - DNA, 549 bp, Zea mays
  Clone ID: LIB3279-215-Q6-N6-C4
aacaatatgattatgacaattatattaggatttgattacacttccaatttcacttgtgggctagaagtcttcaatagtgttttgtctctatggattacagctgcggcagtttgaacagcttgctttaatctgaagctagcagctcgggtgttagttgttcgtacattttacaccacactcgctaatcaaagtagcacagcaagtcaagattgtgcagtggcatgctgcaaggtataaacccaaaacaataatctcaatctaatagaagcttacatggtgagaatgaataaacttaaactatgtgattggtactcagaccttattagggataaaacaaaaaatgacggctattataggatgatctcctcttggacactgacattgagagttttatttgggagcacgatgctgttaactatcactacttcatcttcaacatcaacggcttcaccaagaatagtaatgccaagtttggcattttgatcaccttcgccctgtacacgtgaccattttccaatggatgacttccaccccacaattgaatgtata

SEQ ID NO: 14382 - DNA, 479 bp, Zea mays
  Clone ID: LIB3279-215-Q6-N6-C5
ttttttttttttttttttttttttttttttttttttttttttttttttttttttttttttttttttttttttttttccgaccaacaatcccgcatataggacgaggcaaattggccccctttacaactaaaacacagggcatgaatgggattccagtttggggcgggttccaagggtcccaacattggggcttttattccaaacaacagctaaaaaaaaaggggcggaaaaactgcagccttttatttaggctactacggggacggggggaacgagtccaaacatcagggctgggggctcacaaaagccatgggagcgatcaaatccaaaacccggggggtggagccccactcgttggcataccaagacacgagcttcatgaaggaagagctcagtccaataccagccttggaataaaagatgcttgaccttgaatcaccaacaaaatcattggaaacaacatcctcgtctgtgtagcc

SEQ ID NO: 14383 - DNA, 264 bp, Zea mays
  Clone ID: LIB3279-215-Q6-N6-C6
cttcggtaataataaccatattacacaaagttacaagtaatacaagctacgtacagctcaagcagttaaatatgctcgtaaagcatctgacgtcagattggaataaaatcgcatcatgggagcaagcccccagtagatatatacgtgttcggctggctgcaagccgacactgttgcagctgtttggactgctgcagctgcaatccatagagagaaaaatactgtaaaagccgcagccgcagccggattgcagcccacgcgtccg

SEQ ID NO: 14384 - DNA, 525 bp, Zea mays
  Clone ID: LIB3279-215-Q6-N6-C7
atcctgaaatttgctctctttttagaaatgcagaacaaacagatgacaacggttcccaaagttgcaacaaactaagttcactcgtccgcggggcagagtaccagcacaagcatcccaactttcaacattcgaagcattcaatattctgttaacatcaaccattttgactagaaaaaaacaccaggtggcactttccgccaacggattcaaccatcacaaccccaaccgagcgtaaccatcagtccagcattgagcggcaacacttcttcagtttctggagctcggatggtccacttcatcccaccgccagatggtgccgtcttcaccagctccaaggattgtgcttccatcgaaggacactgcagtttgtcttatcggcgatttacactgctgattatacagccgagcaatgaggacaggagggctggactgtacttcccacacgtagattttgccttcacggttgcctatcgccaactgattgaagtgaaaacacatgaaaatttgataaaccaaatgtcacat

SEQ ID NO: 14385 - DNA, 542 bp, Zea mays
  Clone ID: LIB3279-215-Q6-N6-C8
aggatgggagctatattaacgagtaaataatccgacaaaaaaaaaactagagcagtctcacgccatccacctacttcctctttccgaaccaagaaacaaaccagcgtccaatctccaagaagttcaagcagtttgctgcttccaagtggcaaatacggtctttaggaacgtaattcccatatgaaaacatgcgaagctacaacaattgcactacagaaaactcaaagctcattcttaacaagggacaaagcagaccgagtttatttagcaaaataaagagtagaatcaaactggatcctccgaggaaccagtacagagcatgttctaccgctaattggccgacgtcggtttgtagtcgattatgaggaccttctccagcacaggcaagaacacacttgcgaattcgacgtgtgcagggtgctcaatgtactccttgattccttccgtgctttcaaacgtggactcgaagacgtgcgtgaacccttgatgcatgttttctatgctcacatcagttccccagtggaacgccttcatggagggga

SEQ ID NO: 14386 - DNA, 581 bp, Zea mays
  Clone ID: LIB3279-215-Q6-N6-C9
aaaataaaacccacttcgatgaaaaaggaaggatccgagtacagtacagagttcctacactccgggtatgaaaactctcctcatgacaagtacagtgttcaccgaagagcgaagtacccctctcactcaaacataactgacttcctcacagacgactggaactaaacacaaacacacagatagggacactcatcaccacagatcgatcgatcgccaccaactttattctaacaacacggcagcagctgctgaccacaggtggctatgccttcaaagctccagatcatggtgatgaccagtgcagccacagaacagcacatttaccaggggacgatcttccagcgctggttgtcgccctcgcaccacttccagagcacgatgttggtgccgtcgcgcacgccgccgtggtccttgtcgccgtggaaggcgtcgaagttgaggtagatgttgttgaccatgcggacgcagcggaagccgtggccgacgtcgcggctctccgtccacagcaccgactcgtcctggtagccggggttgtagggcaccagcttgaccgggtggccctcgccctgggagtgcttgat

SEQ ID NO: 14387 - DNA, 524 bp, Zea mays
  Clone ID: LIB3279-215-Q6-N6-D1
caattcaccacaagatcatcagaaattgtggaaaagccaatttatagtcatataaactaatacccggaatctcatttctcgtattgtacaccggatttaatgggaagaaaggggggcagtgcactacatattgttcaactcattatacatcaggagcagcctgttgaactgctgcgcctggaaaattttcgcctgcaggaaaactggggaatgcagcatcagtcccctgcaaaggttggccagttggtatgccgccaaagctgttgtcattcccgccgcatatcaacggtgcagcagctggctggactacgccaccaggagacattggtgacattgaagatgtatcggccagtgattgttgagctgcgagagcaggaacaggtggagctgctggtccaggtacgggggcaggggcaggggcaggtccagcagctccaggtgcaggaggcagcacatcaaaaccagatcttgcccgaggcctgcgctctggtgccgcaccatggtcacggctattgcttctgctg

SEQ ID NO: 14388 - DNA, 550 bp, Zea mays
  Clone ID: LIB3279-215-Q6-N6-D10
agatgaacatactgaaagcatccggcatggttcatacgaaaccgaagcccatacatcagataggaattggtagacagacaccgcgaccgaaggaagcaaacacgcacaccagaagcacccccactacagactacgattattcctcgccacattccacacaggtagaggtcctcacaactcgctggcactgctcccacatcttcagagccacgatcggtcgacctagtcccacctcaggcgaccttgacctcgatggtcttgggcttcttgggctcgggcgggggcagcttctcgacggtcacggtgagcacgccgtccctgcacaccgccgagatcttgtccatgtcggcgttgtccggcagcacgaacttgcgcatgaacttgcccatccgccgctccatgcgcaggtacttggcgtcctcgcgctcctcccggcgccgctcgccgctgatcaccagcacccgctcgtcctccacctgcaccttgatgtcgcccgtgcccagccccggcatgtccaccacgaacgcgtacgcgcccgggagcttcttga

SEQ ID NO: 14389 - DNA, 452 bp, Zea mays
  Clone ID: LIB3279-215-Q6-N6-D11
cgttactgtattaacaataacaaattacaaatataccttcggctcgaaggaaagcaagggtacaagcgtgacgcgaaagcagatgccaagtcagcgtgaacagtacgggaatactgttcacctatttataggcacgggtcgcagcccatgcaaaattacatccaggccctttgcctatgacaacaactctatagtaatttatctgggtctagatagtcttttcctctttaagtcggtttcctcttttctgccatcatgccgaagctcccttctgcgcagcttcggctctgctccatctttcgtattatttccgtgcttcttcataccgtgggctcttgttcgaagatccctgtccacacattatactccagaggcattgttaaatcatgtttttgaggaccttcggaagccgaaggcgcccaacatttccgacaccacctaaaccagtctgc

SEQ ID NO: 14390 - DNA, 388 bp, Zea mays
  Clone ID: LIB3279-215-Q6-N6-D2
gccaaacataccctcaaccggatcataaaaaccaaactgcaattttaccaccaggcttacaaataatcatacagggcaggtgttttaaaggtcataccaaagtggggcaaacatagcacacttggatgacatccaactgcatacgaaaactaccacgacagtctcccgtctcaacgcaggctctctagcctaccttttagactccagcaacgtgaggatgtccccctgccgaaccgggcccttgaccttccttatgatgagacggatctggacatgcaagaactttactctgacctgggtaacctgacccctggagccggtccttcccatcaccttcaccacaacatcaagcttcacttgggtgtacatactctcacttcttgcgcag

SEQ ID NO: 14391 - DNA, 533 bp, Zea mays
  Clone ID: LIB3279-215-Q6-N6-D3
gcaagaacaagtccattgataaatttcagaaatgagcaaacacagtccattgcactgaagccaagacatctagaacattactcctacaggataaggaagccacgaaacgaaagccaccatctacttctagtaacactacaacgacgagcagcacgacgggcgctcaagccctctcgcccctgatgcgccgcgcgagctggatgtccttgggcatgatagtgacgcgcttggcgtggatggcgcaaaggttggtgtcctcgaagagacccaccaggtacgcctcggcggcctcctgcagcgccgcgacggcggaggactggaacctcagatcagtcttgaagtcctgcgcgatctcgcggacgaggcgctggaaggggagcttgcggatgagcagctcagtgctcttctggtacttgcggatctcgcggagcgcgacggtgccggggcggaagcggtggggcttcttcacgccgccggtggccggggccgacttgcgcgcagccttagtggccagctgcttccggggggccttg

SEQ ID NO: 14392 - DNA, 467 bp, Zea mays
  Clone ID: LIB3279-215-Q6-N6-D4
gactcgcacaaaagatccaaacccccctgaaaatatgagcttacaacaaatcctaaaagctccagcaggagcaataatgcaagataacatcacaatcaaaagagaccaggtttctgatgtcgagttcccatgactacaccacctaaaccgaccactactagacattacctcctgcatgatactgatgtgtactcaaaagggacatggcaaagtacagcttgggtgcctgatatttaacttcaattcatagataacggggacggctcctcacttggccatcatgaccttgacgaactcctcgtagttgatctggccgtcgccgtcaacatcggcctcacggatcatctcgtcgacctcctcgtcagtcagcttctcgccgaggttggtcatgacatggcggagctcagcagccgagatgaaaccattctggtccttgtcgaagacgcgaaaggcctccttaagctcct

SEQ ID NO: 14393 - DNA, 518 bp, Zea mays
  Clone ID: LIB3279-215-Q6-N6-D5
agacatacaattgggcatgttattaatacaaatccttcaacagtctggagccttgttgtacaagttttcgataccggaacctagagctactggcaagcgacctcaaaaatgtggaaatacggggcaaggggtaaacactgttgaatgagaaattcggggtaagacgtaaaacactgggatgctaccatcttcatacattcttcacttcttcccgccaccagacacgttgaatttgaaaaagatgatgtccccgtcctggaccacataggttttcccctcctgcttgtattttccagcagcctttacagcagattcactgcccagttctttcagatcttcaaacttcattacctcagcgcatatgaaacccctttcaaaatcagtgtgaattgcaccagcagcttgaggagctttagtctggcgtctgatctgccaacattttacctcatcaggaccagcagtgaaaaatatatcagatgaattgctgcaaaacagtcttgaaatttttgggatcatgc

SEQ ID NO: 14394 - DNA, 274 bp, Zea mays
  Clone ID: LIB3279-215-Q6-N6-D6
ctggggaattccttaacgaatcagggagtacatcgcgagtaacagcatctattttgttcccctcaattcccactctccagcccagggcaaataatccgcaaaatgaaacaaaaaataaaataaaacttgtatcatgctgaaccatttcttctaagttcttaagtaaggcgagcgaatccggtattagagggtcatcagacccgtttttttagctgccagacgacattacacgaaaactgtcttcctgtccttttacctccggaactaaatcctg

SEQ ID NO: 14395 - DNA, 537 bp, Zea mays
  Clone ID: LIB3279-215-Q6-N6-D7
gagacaaacatgtccaagttcgttcataaacatggcgcttctacaattcatggttcatggatacatgcggctccgctcaaggttttctcagcaacaggtttaagcagaagcagtaggcgcatcggccatctcctgttcaaccggagttttctgaaccgggtagtagtggtagtgcagctccccgacatcatccccagaaagcttcgtccaaccatcagggccaacgtggtaaacactaacacaaccaccacttgctgcatcacggaatgttgccccataaatagcccgtcgcgctaattcggcggcttcctcaactgacatgctgaagcggtaaccatcatccaagataccataagcatacagtgaaccagagccaacagagaacctgttccccacgagccgcgcaccctcactgtcaacatagtacaagccaggacccttctcatcccatccagcgatcattgtaccaatcgacagtcccatcccacgatatgaataaaggatgttagccaacagtttgggaagcaccagcaatag

SEQ ID NO: 14396 - DNA, 497 bp, Zea mays
  unsure (1)..(497): unsure at all n locations; Clone ID: LIB3279-215-Q6-N6-D8
gccagcaacacaaaccaattgaaattaacaagctgaaaaaatagcgattcttacataacgatgctaataagaacaacactgcataatccacactcgaggtctagtggttgatggaccaaagatcgattttttttttcagtatggttttggattggatcctacagctagctacccttctccctccgccttgcacgctccggctactggttgtcaccgccggggttgagcatctccttgtagttgagcagcgagttcagtcgctgcagctgtagctgctgcctgaacttgttgatgaagtcgtccgcgcgcgcgttcacgcactgatgcgcctccgcctccgccttcgccttagccacgacgccgctcgagctcgacttgttcatcctcgcgtcctgcttcttgccctgctcccgcgccggctcggaccggctccgcccgtagtgcgcctcctgctgcttctccttcttgtccgtctccntggcggcggcggcggcggc

SEQ ID NO: 14397 - DNA, 605 bp, Zea mays
  Clone ID: LIB3279-215-Q6-N6-D9
gatcaaggccagtacgaccacttcaggtacttcaatattgacgggcactccagtgtatggtacacatgcattaaactcccttattctacgccacaatctgatttttgctccaggaacagtgtcagatgacactacagcctctttagcaattgcggccaaatgttttgtgtgcatggaagctgactccatgtcaacagaaccatgatagggcatctcaagatgtgctaccccacaaggcggatctatgcgatgaccagacattgttaaccttggtagcactggaattgcacactgtctctgggtttctaaaacatcaagaactgttgcaagtagattatcacgggaagtgcttgcatatacatgaattgggcagccatcattgaattcaaatgcaaatatctgtggttcttctacaaatcgaacaagagcacttactgctgagagtggtcgtactatgacagcctcatagttctctggacgtctttcaacaagtgaagtgcttgtaagaacaagcagacaagagacagaatcgccctgttcttcaagcccaccccttggtccaacacccaaacttaagctctcaatataagcagtgccatgtgcag

SEQ ID NO: 14398 - DNA, 386 bp, Zea mays
  Clone ID: LIB3279-215-Q6-N6-E1
aaacaaccaaggaaacgtttagttaaacctaaacaggaaaaaaaagcatccaggggcacaacacgggttggggcccccggaacaacgaccccattttggacactttttggaggaccaagcgcccccgcacaaacacccaaagcaaggtggctttgaaaaagggcaaaatggcccccggaagaagctgttgccgttttcaccctcaaaaaacaacaactgggatttgcagaaggacaacccccccttgcaacacgaggactggcacttgaaacactgtttgcaggaacaacacccaaacagggtggagcacttgaaggacttgaaacaaccgaagcaactgaaacagtttgagcacaaacagaatcccgcgcagttgaaacattggg

SEQ ID NO: 14399 - DNA, 328 bp, Zea mays
  Clone ID: LIB3279-215-Q6-N6-E10
gctccgccttgcgccgctgcgccgtcaccgtccggagctgctcctccagctccacaacccgcttggcaaggtggtcggcccgctccttggcggcgcgggagacggagcgctcggagaggaggcgcgcgcggaggaagtcgatggtcatggccgtcgtcgcgtccgccgccatccccatttgccgaacccgcgtggtgtagtctagcggactccgaagccgcgcacccgcgccgcgcgtccagtcctcagtcctcagtcctcaccgcggcatcccactctgctttagtgctttcttctcatctcaggactcaggtctcgggagactcgt

SEQ ID NO: 14400 - DNA, 435 bp, Zea mays
  Clone ID: LIB3279-215-Q6-N6-E11
aggcattcacattgactccaagcatgtccatggctctgaaacgtcttattggaaatgagctcattggaaggggatccaggtgaagaggccatcttccaaacagaaggcacgtaaaaaaagggagcctcattagttttgtttgaggccatggaaggaattgctcgcaattgcccatgagcatcaaaatgcgggttctcaatgtctccatcgtctattctaccattccacgctgcttgaagatttcaaacatgggagagccaatcttcgctggtgactcgacaacggtaacacctgcctctctgagtgccttgattttgtcctgggcagtaccctttcctcctgccacgatagctccagcatgacccatgcgacggcccgggggtgccgtaagtccaccaatgaatgcaacaacaggcttttgtgttttgctttcct

SEQ ID NO: 14401 - DNA, 572 bp, Zea mays
  Clone ID: LIB3279-215-Q6-N6-E2
gaagcagaaatagcaatagcatataaatcgagcatgtctgatactgaaaaatgtttctacggaagaacagaaagggagcaaaagagagcacctcaggctcacaagagcgagggtgcctataccactaccaaaatagcctgttagcgcatcccacaagtgtggcaaaaccgaacgagagtaatcagatctccccttcagatcgtaggactgcttgctttattctataccttagattgcttagtaatactactgtgtattgggagataagtcttgtcaaacgatcttgaagtgttcaaccatgcagccacaggtggtgcaggatttcagtagtgtcactgaggcaaggaagcaaccccggcaagcgatggtgtgcatacatggtgagcatctgactattgcctcagctccacggcagaccaccatcaactggcatctcagatctaaaacacgctcggtgagtcccatgtatctgtatgtcgcatccactgcaggggatgacttaactccacttacagaagtgccacaaaccatacatgctctgacattgcacctcatcatgcacgcaacacata

SEQ ID NO: 14402 - DNA, 580 bp, Zea mays
  Clone ID: LIB3279-215-Q6-N6-E3
cttcataaatacactggattcaagacgtacaactagtgcatgcaacataaagccttctgtcacagctgatggtttccccatattgggatcaccatacaaaaaaatgggcctgctcatcacacaggccatgggatggcgtgtcacacgaaggaccagttgacgaagcagaacgccaggcagtggacgctgctgtcctcgccgagcaccttccacgctacagcttggtcgaaagagacatgccgacccattcctgacatgcacacgcccgacggcaggtacgcgtagccctgttccattagttttgagatatctgagaatattgctttccttcctgactcgtcgaagatcttgtctagcgtcaggtcttgcagagcaataagagatgtttctaacatgtcgagccctgccttgtttgcaaacgtaaacataggtttctccttaaaagagcagcacagaacagcatctggatgatgccagagcattttcaacaatgcttcaccagcttcatctgattggttaagtaattccacacctagatggtagtgataactctggcaaacccatctagcaagtgtggcag

SEQ ID NO: 14403 - DNA, 489 bp, Zea mays
  unsure (1)..(489): unsure at all n locations; Clone ID: LIB3279-215-Q6-N6-E4
gaaaatgcataaatcacgatggtctcatagggcacttgttttgttcacagtatatcaaaatataaagtacaacgatattttgccaatattgtcgcaatcatacacgattttttgacatgacaaaaaacgaggagccaaccctgtcttcggtacttcatacatttggaaccattagcctttagctaggtcgtggcccgaaatggaagcatcgctgctcggctcttgtcaaaacaggtatgtgtaagcctttgcaagaagttccattcaatcttccttcgacttctcagcacaccagtagtaaaacactttagattctgaaattctgattaggaaagagcgtccagaattatcagctgatatttcttcaatcataacttccgaaaattcaaagtcgttgctcaagagagctagttgctctggataaccatcatcacaaacaaaggtaagccgcatgctagatgatggcagaagaacaagcgnacgcgtggg

SEQ ID NO: 14404 - DNA, 524 bp, Zea mays
  Clone ID: LIB3279-215-Q6-N6-E5
agcagttctggaactgaaattataaggttgtagattcttgactacatgagctgacattcactagctgtgactacaagacagcttatatgggtttacatgaactagcagaaactgcgctacggattacaggccacaactatttttacagtttacagactaggattggatgtcggcaaattttggcatgcagtatgcacaactgcccaagcctacaagctaatgtaaacgctacattcacatctgcttaaactatgccgcttcaacgctttgcgaggatcactagcgccagcatcgacatagaggcaatgaacctgaagccctggctctcccagaaattatccttgtttccatggcacatgctgttgggctgcttcatggccacctggtccatgagctccttgagagccttgtctcttttctcccccatcctctttaattttcgcatctgggactgagattcttgaaggcaaaattcaagcttcaggaccctcttcttcagctcctgatcagttcttcgctgcttt

SEQ ID NO: 14405 - DNA, 449 bp, Zea mays
  Clone ID: LIB3279-215-Q6-N6-E6
ggatgggccccacttgggctataaaagggaagacacataatattacaagggagactcaattcacagacccaacttggactctcaaactctcaaacatattcaatacaacatacaatggggggggggttttaccccccgggggcctgaaccactctaaaccttcgggggctctcgggttttcatccaccatttagcaaacaagcaaaccggtaaggcccctcctcattttaggatttaggacgggggcattcccccacccggccggaaaatttcctctccgacatataaatataggtcattaatcattagtttaactcataggccaagcaccccacatacatatagttcaaaaattattccgaaaataatatgcatatagtttcgttttgctgaaatggggtagctcgtttagcttgcgagctaactcgttaatgaatcgagctagctcg

SEQ ID NO: 14406 - DNA, 510 bp, Zea mays
  unsure (1)..(510): unsure at all n locations; Clone ID: LIB3279-215-Q6-N6-E7
acaggaaggtcatatagatgtcgattattaactgcagattccattaccatttgaagttcatcacaagatcgtcagtgatcgtcgccatccagggaactgaactttgcaagaccaacagaaaggtaaacgctgcctcagatcaggcagagacggagcaccaccagaaagctactagtactacgactgctctgcaacagaaacgactactgcactccagtaattgaaactactaatacgactagctcatggcaactacgatatggatatggactgcaactacggtatggatatggactgcaactaggagacctgggaggacccatccgatgcacacaccctactcgatcttgatctcgaagacgtccttgcgctcctcgtccttgatcttcgggacggtgaccctgagcacgccgttcttcatgtcagccttgatctggtccatcttgaaagcctgngaggagaggccgatgcggtagctgtaccgcgccgggcccttgtcgtcgtcgccct

SEQ ID NO: 14407 - DNA, 505 bp, Zea mays
  Clone ID: LIB3279-215-Q6-N6-E8
gacaagcatgataagttgacattataaatggtatagttgcaaacacgagcacttgcgagattagacacggatataagaagccaacgacggcatcacacgattacaggcgaacacaccaatcagcacaaacatcaccaaatcctttattctagtcactcagtgcagatgcagcctactgctagcagggcactgaacatcaccatcccgtcgtatggattctggtaagggaacagtatcccttcattcgatcttgtcgcagtcgatgtcgggggtgatgttgtaggacagcgagaggccgcagtcgccgggcagctcctgcgccgcggagagcacagcgtggacctgaacgtaggccgccttgaggcaccggcacgtggcctgcctgtcgggcctggtgtccgccgccgcgtacagggtcctcacgccgtcgcagcactggttgttgctctcgctgggtttggctgccttgccctgcaggaagggcaggcacggcgacaggtcgttg

SEQ ID NO: 14408 - DNA, 512 bp, Zea mays
  Clone ID: LIB3279-215-Q6-N6-E9
aacacaacaactcgatctttattccaagctaattcgtcaaagaggttattcatcaacttcgaccaagcaaaacacaactgaccacgacagagttctaacgaccaagtcacgaaccgtacaccaaggttttccacacgaccagacaagcatagcgattctgcttcggcggcagacaaacacaaatgaaaacacacagcagttacttcgctctaagctcagtcttgcacaagtttcagattgccttgtccgaaccaccatgcaatcaagcccgctcgaccatgtattccacgagaggtttctgcagtctcccctccgtgccctctataatggtgagcctccgtgctactttcatgaagtcattgaacggcacttcaccagtatgcctgacagcaccagcagcatcacggtagcaaaggtgcctcattatttccgccttctcaattccaaacatgtccgctaactggccgtacagcttcttcgtacgaaccaaagacagataggtcaatggtgcg

SEQ ID NO: 14409 - DNA, 529 bp, Zea mays
  Clone ID: LIB3279-215-Q6-N6-F1
gcagtaaaccgatatacgaacttcgtgttcaagcataaaatcgtacagtttttagcgtaaataatacatgtggtagacataaaacacaataatcgaaaagaaaactgcgccggatcggaggatgtcacgcgcgatcatcgctgcgcgcatctcgcgccttccgtgacgccgctcgctcgaacatcgtgcctcatgcgtcgccatcgctactcgcacatcgacgggcgtcgcttgctcgtcgaccttggaagtgtcgcctcctcagggcttcggagacgccgtcgcttgcccgcacaagggcctcgccatcgctcgccctctggatcggggagccgccgccaccgacctcggaaccgccgccactactccggatcgaggaacctccgccaccgcgtgtcaaggtaatggagttgcgaccaccggccggggaaccgccgccaccgcacaagggcactgccgtcgctcgccctctggatcgggagccaccgcatatcgaggtcggggagccacggccactgcagccactggc

SEQ ID NO: 14410 - DNA, 548 bp, Zea mays
  Clone ID: LIB3279-215-Q6-N6-F10
gacaaaccaaacacccctccaaactagccctgtttatatttttcggcaaggtaaactgaaaacagattttactaggggtacatttattatagagtactccaacaggggccgtgcagccgtgcaggcaatggtacacagagctagactgcattactagtagtagtagcaagcatgcattattgtactggtaaaatagctaatgcttgctttaacaacctagctcgccagatatatacacaaaacacaccagctagctgttgcagtgcagtactgccctgcccccacagtcatgactcatgagccgtagatgagatcacagcatgagcgtccactgctgggtgggactcccagtggcgggcgacacgatgacttggctagcagtagcattagcccccgcagatggcctggcgtccaagaccatcccggtgccggtgttgaagatggtgccgtcgttgcggaacacccagcgctcgcaagacgatccagccccgtcgcagagtttcaccgtcacacccccgctggcatcagcagccaggcactgccattga

SEQ ID NO: 14411 - DNA, 532 bp, Zea mays
  Clone ID: LIB3279-215-Q6-N6-F11
gcgacatcgaaccacttcttttatacaaaagcacgcagcagagagctaaatggaacacagcgtcatcatcatggtccgtaaccatcgtcccatcacgcatctagtacaacgccgctaccataccataccaccatctttaactggcccccggattcacgcttccttattttcagttcagttcggaaggggatccaaatccagagtcaccaccggcaaagacgagctcgcgcgcgcgcgcacacacacacacactactggccctttgccagcggctcggcctctggcgccgacgaaaacaccttggcgatgcgttcggtggggatggcggggaggtacttggcccccgcgtagccgtgctccgcggcggctgcgaccgccctgttgtacttgtcggcccagtgcgcggcggtgggcacgacgatctccgcgacgtgcgggaacaccggcaggccgttcagcgagcgccaggcggagacggccaggtgctccgccgcgggctcgtaccgcacgtagaggtccttggccacgggct

SEQ ID NO: 14412 - DNA, 620 bp, Zea mays
  Clone ID: LIB3279-215-Q6-N6-F2
ggtcaaacacagaagattatactactaagaaccttggctttatgtatccagaaatacacaattatatagctagcatagacaggacatgttacttagatgggtcttaaaaagatagggaaaaaaggtcctagtaatgacttcatctactatatgtataggggtatagtaaggggcatcatccattcatcctcgccttcctcttgaagggataggtagctgggtgcctcatggagtagtagtactctagtagtacatgagctgctgctgctgctgctgctggacggaagttgtgccggtggcagtattgatgccctggaagccgccatcatagatggactggctggctccgccgccaatccccaatgcagcgacctgcttcaaggcgtgctgacccattagggctgggttcgaggccatcttgctcagagtcaggcgctggtaggccagcaagtcggtggccgacactccagtggagaatggtgccagtgctgggggaggcagaggcaaggatgctgtcccttgtggagtcggcttgcttccccaggaacactttatctgcctcccgccaataagttggccattacccatctgaattgcaatgcagcctcctcatgggtgct

SEQ ID NO: 14413 - DNA, 635 bp, Zea mays
  Clone ID: LIB3279-215-Q6-N6-F5
tcgcgatctaaaacccactaaaccctagatctctctctctagaatgccgacgccttcggctctcagcaagcgcggcggcgacggcggggacggcatcctggccgccctctcccgttcgcaggtggcggcgcacgggcgagaggcggcggccgtggcgaagaagctgctgcggagcacggggaaggcggcgtggatcgcggggacaaccttcctggtgctggtggtgccgctgatcatcgagatggaccgggagcagcagctcaacgacctcgagctgcagcagcagacgcttctgggcggggccccgccgccgccgccgaccaagtagatagatccgtgcatcgaccctttcgtccccccccctctccctctctagaggtatctgttactatcaagttcatcattcgagttactatcaagttcatcattcgagttactatcaagttcatcattcgagtcgagttgaggctaagggagttaccgagtcgacctgttgtcggttggtcgtaatcaaagaggtcaaaactgctttgttgatgttcgttctcgatgcaacactagtttagtttcccttccatcaattgaaacggattgatcagataagttgagctcgttcgctgctgctgctgctgctg

SEQ ID NO: 14414 - DNA, 523 bp, Zea mays
  Clone ID: LIB3279-215-Q6-N6-F6
aaagatgcagacttgcggagtaaattgtaagccacaaaatatgttcaccaaacaacttataaaaaagagtctaggctcctgccggattggcgttttcttctacatcaagcacgacaacagctttcttcagaagagcctcaacaggcaggtgtgagttttcaacagccttggttattgcttgccatttttcgccatgctttggttctgctgcaacacatcttttcagaacatccttttgtgtgtccacatttccatgctgaagttcaaatttgtagtacaatgcccaaaaatcaccaatatcaggagcaagagtaacagccctgtttaaccaactcctagccttatcaaccttcctgtcaagccagaaaagtttggccacagttgcaatgacatgtggatcatgatcacttcgcttaatagcatctgtgctctttcctttacgctgtgggcgtggtgccatctcaatagctgcagcccacaaaataccacttgttggacactcttgcaatcggacgcgtgggtc

SEQ ID NO: 14415 - DNA, 600 bp, Zea mays
  Clone ID: LIB3279-215-Q6-N6-F7
gcatgaaaagataattgcataacagttttttttcttacattcaccagtaaaagtggtattaagaatgcatttcaccgaatgaatatgacaggcccccacaaataagagctgacagaacagagaaaataaaaggttacactccgtgtgggcggacaccatttacagctgaaggtcatcaagtgtcaattcttctactgacatcaactttaattttgtgatgaactggggaggatcatcaaggctagatgaaccaaggatgatgtctcgcttcagcttggatgaaagcttgtgtgcagcacgtaactctgatcgagtagcaccgcctattacaaaaacaaatatacgctgaccaagtttcctgaagtcactggaggcatgcttcaacacagaatcacttgaatatccatcatcagagccacgaggtcttgcccatgtgccacctgttcgtctggatcgcattgagtgagcggggcttgttcgggcagagctactggttggcagtccatgaacagtaggactagggtcattcatacagttatattcatcttttggcagctcacctttgctaagatttcaatcaattgctccaaatagggtaaa

SEQ ID NO: 14416 - DNA, 470 bp, Zea mays
  Clone ID: LIB3279-215-Q6-N6-F8
accacaacaacttaagatgaaggttcaggcccacgacttgccgggaaatttaaagacaggttacaaccccatgcaggacgggaagtttgccacagagaaatcaaccatgcccacaaagcattggacggggtacacacatgaaatgacaacgggtgttcacgattcaaacatagcacgcagcaggcaggggaggataactttggggagcgcaccagcacgggcattagttgccaccgaacaggtagcccagggaagagccaccgccaggagcagcgtggaccttggttgaaggacggtccctaaggaaattgccagtgttctgaccatcaaccctggggtagttattggtttggctggaaaccccagcagcaacctgcttggccgcattagtctttgcagcagatggtttctcaacaggtggagcacttgcagctggtgccactgctggtttggggggctcaccgcttcca

SEQ ID NO: 14417 - DNA, 289 bp, Zea mays
  Clone ID: LIB3279-215-Q6-N6-F9
aatggaagctaacatgtcttaatccagaaaatgtaacaatgtaagtgtagaagaagcaacaccggcatcttggagaagcctaggtccttaatttgcacggaggaaattacaatcttcaatgcaggatctcaaactccaaaatatacgcaagatttcaaactcccaaaatgtaacagctcaagatcatgtcattggacgttatcgtaatcttcaatgcaggatccaaaactccaaaacatcacacaactcgaaatcatttcattggaaggccttttctggacaactgcca

SEQ ID NO: 14418 - DNA, 453 bp, Zea mays
  Clone ID: LIB3279-215-Q6-N6-G1
ggaaacaaacatgtgaacattcaccaaatcactgggccatgagcacagggttctgtttcattgtatacaaaataaggggggactgaaaacagctcagggctacagaaggaattttcccatcaaagaacatttggggccacctttagcagggcaatgaacaaaacacacagatggggccaagggacaaaaacatcgtacctaagttatgatacatcgtttgcttattcatcagctagttgagcaaaatatggaaaatggaagaacccagtttatcaaccataatggaagacagattcagcgatagaggctctcaaatctcaagttctcagcaatctcagtctcccagcgatcaccattttcaagcaatttctccttgtcgaacagtagttcctcgtgtgtctcaggggcaaactcaaagttaggcccctcaacaatagcatcgactgggcaagc

SEQ ID NO: 14419 - DNA, 479 bp, Zea mays
  Clone ID: LIB3279-215-Q6-N6-G10
tttttttttttttttttttttttttttttttttttttttttttttttttttttttttttttttttttttttatttttttttttttttttttttttttttttttttttttttttttttttttttttttttttttttttttttttttttttttggggggtttttttgggggggcaaaaaaacccggccaaaaaatgggggggggggaaaaaggggggcccccaaaaataaaaaaggaaaaagggggttgggacccccaaaaaaaaagggggggggggggggccccccccaattttacaccaaaaaaacgggggggaggtttacccaaaaaaaaaccgggggaaacccagggggggggaaaaaaaaaaaaaaatttaaggggggaaaacctccggggggggggggggggggggccccccccggggggttttgggggggaaaccccttttaaaagggggggggcggctcaaaaacaatttttt

SEQ ID NO: 14420 - DNA, 530 bp, Zea mays
  Clone ID: LIB3279-215-Q6-N6-G11
aaatggtgacaggtcgttcagtacttatatcaggtagaacaattggattacatctgtacatctacaattctagaatgacctaagctaaactattgttcaaaatatttcagaggatttgactcagcagctgataggaatggattttctatttttttctaactaggtagcaacattgattacctgtattggattcaacaacatgttcagccttcttctaagagaaggtccatttcgacctccactcttgccattgatgaataccagcagtggtcttgaatcttgtggcaaatcaacaagttcatactttctgactcgtccattaggaataacagatcgatatgtttgctttacagaatgttgagataaaggctttgctagtgcatacttcccatccaggcccttcaatctagcaaatccttcaagcactgaatcaatgactgagaattttgtgggaatggaatttatcttgccaccaggatggttattcatgcgcttcttgttgcgtgacctcctacggttcccaactgttg

SEQ ID NO: 14421 - DNA, 556 bp, Zea mays
  Clone ID: LIB3279-215-Q6-N6-G3
gatagaatggtagttgatacggcaaattatcacgagcacagggtgcaatcttaagccatcagaatacaataacagcttttgataattgtgatgccgtttcctgacaccgggcaacaccaacttaaaggtgaccatatatggcgtggacggcaaagaaaaatagacaagccggtaacagctaacacagttaaaacctcactgtcaatacaagagtttggtcattcttatttcttgttgcagcaaataggtctcaagggaaaaggaaaatcactgaaacaaccatataactcttttaagcgtgcaccagctcctgaaggtgtgctaatcagggctcagtggtggtccttcgtctcaaacaagccatcagggccccatgggaactccttgttgcggatgtgaagataggggtacgccggcggctcatcgaagtgggggtggcccttggacaggttgtacgccgccaggagggtgcaggtcacgatcccggcgtaggtgatcttctcccacttggccgtctcataggcgtcgtcgtggacggaggaggacatgcggcgcc

SEQ ID NO: 14422 - DNA, 564 bp, Zea mays
  Clone ID: LIB3279-215-Q6-N6-G4
gttcagaaatcacacatccagatgcccgtcagccggcgcatcggcgtggcttttattcggacacgacgctgatggatcgcatcagacccacccgacacccgagagacctcgacgagacgacccacaataatccaattcgcaaatcacaacacagaccacgtacacatagcactggaccgttctggacgaagcaaaacggggcttatttattggtacacacagacacagcacgtacgaccgcggacacgtcgtggccgtgcgttacgcggcggaggaggaggacgacgagggcgtgcgtgacacggccggacaatgtctcgcgcccgcggccagtgtgcgtcgtcagcggcggaagctgcgctgcgtgcgcggcgtctcaccgttctcgtccctgagcttcaccgccgtgtacacgctggcccccgccaacgcgcccagcgtcggggccagcaggtagatccagagctgccggtagttccccgccgccacggccggccccagcgtcctcaccgggttcatggacccgcccgtcgtcggcccggcgacgaggatgttcagcgttac

SEQ ID NO: 14423 - DNA, 592 bp, Zea mays
  Clone ID: LIB3279-215-Q6-N6-G5
taccgtgccctctggaactgactgtcatttgtttttttcatccctagtaattctctctgttttcgtttattggccccatgccgcgcgttctgtactgtatggtgtaacgctgagtcgctgacgctgtcgattgatcgcagaagaagcgcagcggcggcggagggcagcagcagaagccggcggcggaggcatcggcgaccgcggaggagggcgaggagcaggcgggcgacgcgcccccagcggcggagggcaacaaggacagggagcacgagaaggggaaggacaaggaccaggaggagaaggggagcaaggggaaggacaaggacgacaagaagccgccgccgcagccgcccgtggtgacggcggtgctcaaggtggacatgcactgcgacggctgcgccaagcgcatccgcggctccgtccgccgctacccaggcaagcaacgcaacgcaatgaaagccccatgtcccttgcctgtctatgtgtctctctggcggcgcgccatcttgtgatgtccagcagacacagacagacaggaggctctggtgacgccaactgatggccgatggctgcgctcgttcgttggcttgac

SEQ ID NO: 14424 - DNA, 308 bp, Zea mays
  Clone ID: LIB3279-215-Q6-N6-G6
ggaacacaataattacttaatctaacattacccaaactgacattatgacaatgttagccgatgaccacgacaatggaaacagtaatctagggacaagcaggcccctttgctagctggcaagggtgaccacccacaaacacaccagaccaggggcagaaccacccgccaggggcgccaacgaggagcgctatccgttttagcccgacaaaagtaaaaataaaacatcacgatggggagggaaactgaataattctagtacatggatataggctccttttttttgatcgccacggggccttgtgtacccg

SEQ ID NO: 14425 - DNA, 561 bp, Zea mays
  Clone ID: LIB3279-215-Q6-N6-G7
agctcaatctaacatttattctgcttccaatatacgtagtacattattagaactaggagcgcaaccctaaaaaaagcatagctgcattattccaatttccaactaccgcgcatagctactcacaaaaaagctgattgattcatgagacagctaggcggccggcaagacagccctcggcgttgccgagatagaacgccaagacaacaaagcgcctttcagtcaagttgacggggccaggccgggtcactaccgcttgccagcagcccccaggactcggcaccggtactctcccagagcccagatcgggaaggtgttcctgtactgggagtaactgatcatgcagttcttgttgaacactcctatgatctcttgctggggaaattctccgtcctctgactgcaagtttatcaaaacccttgctgctcggtgtagaggcgcgggatctctctgggcctgtcctgcatcaatcagcgccagcatggcccaaccagtgttcgctgcatgagctcggttgcctttgagattggtgtaaacctggtcttgagacgataaatagctttc

SEQ ID NO: 14426 - DNA, 514 bp, Zea mays
  Clone ID: LIB3279-215-Q6-N6-G9
aagcactaggatgctgctcttatttcaggaaaagggctccaaggccactacgattattattcaaggggcaacatcccatccaggaaacaaagggagcaccacgcctgactggacacacaccaccaccaccaacgttccctttcaaccgacgcaacgcaaactactaacagtccatcagactactaaaaaagcgacacccggatcaatgatggaacaagaccttgacaagggaggtaaatttaactcttgaagcaaagagcagcaacgaacgcccgccgcctagcaaaagcagactctttttttcgcctccgggaagggaaaaaaagaaagaaatggcaagggaaaagacacgacactccgagtgctccctctcgctcatcgatcgatcaggtctgtggccgccgtcgcgcatcacttgctggagggctctccctcccggccagcggcacggtgctcgccatggtgcggtacttgagcgcgtacagcatctccaggtaccgccgggtctcgcgcc

SEQ ID NO: 14427 - DNA, 570 bp, Zea mays
  Clone ID: LIB3279-215-Q6-N6-H1
gcgctatcagtccagctttattaccccaccatcgaacgccgcactgcatcaaaaattgcaactcggtgacagttctgcacctcgtttcgaatgaactccgtagacgtatccgactatcctctaggggagcaaagttcgtccccaacctcccaattcctagccttacaggtcacaggtcagaatcatacacggcgactgaatttcctcagaagtccatcccgctcatctgcggcatacggctggctattctggacttggttgccgggagctcggagacagcggcctccgtggttgccatcagcagggaaacacttgcagcgtcttgaagtgcggtgcggatcaccttcaccggatcgatgatgccggccttaatcatgtctacgtactccccttttgctgcatcatagcccaaactgaggtcctcttgttcaatcagcttccctatgactatagctccatcaatgccagcatttgcagctatggtcatcaagggagccttcaaagaattcttgataatttgaactccaatcttttcgtcctcgtttgctgtgctaatcttgtcaagctcct

SEQ ID NO: 14428 - DNA, 547 bp, Zea mays
  unsure (1)..(547): unsure at all n locations; Clone ID: LIB3279-215-Q6-N6-H10
acagccttcgatcgctcatacaaatgaaaacaaactgctagctaagatcttatatacacgcttcatacatctttctcccttttgggttcagaaagaaacatgtctttgtacaacactggagagctcaagccacactgctcctccctccttcctcgtcaagtacgatccgtgtgtgctcttggatccgcgttcccaggtggcgtgtctgtagcctctgtttatgtatggatcagcgatcacctggcctcagaggcagagcccttcattatcctgagcttcttgcacgaagagatgaacatatcccagggcacgtctccggcgagcatgaggtcgccgtccttgtcttcgtaggcgatggcgtgctggtggtggtcgccgccgccctctgccgccgcggagaaggagttggtgaagagcgcgtccagagcctccctgagctccctgtaccccttgtacatccggaggtccaccttcctgaggtacggngcgccgtccatgctcaccttcacgtacaggcctncctgctgctgctgcttctgcttctgct

SEQ ID NO: 14429 - DNA, 396 bp, Zea mays
  Clone ID: LIB3279-215-Q6-N6-H11
aaatcaaacattacccaaactggcattttgacaatgttagccggggacccccacaatggaaacagtaatctggggccaagccggcccctttgttagctgggaaggggggccacccacaaacccaccagaccagggggggaacccccccccagggggcccaacgaggggcgctttccgtttttgcccgacaaaaggaaaaataaaacatcccgagggggggggaaactgaataattttaggacatggatataggccccttttttttgaccgccacggggccttttgtaacccctccattggtggaggaaacaccgtccattggcttgagggagctctccataactgggaattatattaatcctcctgggtaccctttttggcatcctcggaattgac

SEQ ID NO: 14430 - DNA, 617 bp, Zea mays
  unsure (1)..(617): unsure at all n locations; Clone ID: LIB3279-215-Q6-N6-H12
cccccccccccccccccccccnnnngnncnnngcccccccccccccccccccccccccccccccccccccccccccccccccacacaaaaaaccccccccnccccacaaaaacacggagcgcgcgggcccnnccccnccccccccccnnnncncccccccaccccccccccccccccccccccccccccccccccccncccccccccccccccccccccccccccccnccccccccccccccccccccccccccccccccccccccccccacacacacccccccccccccccccccccaccccccccccccccccccccccnnccccccccaacccaccacaaccccccccccaccccccccccccacaaccccacacccccaaacaccccccccccccccccccccccccacaaaaaaaccccacccccccccacccccccaacaacaaaacccccacccccccaccaccccccacccccccacacccaacgccccccccccccaaaaccaaaaccaacacccaacaaacccccacccgacaaaaacgcaaaacccccacccacccaacaaaccaaccccaaaaaccaacaacaacaacaccccacccccccacac

SEQ ID NO: 14431 - DNA, 237 bp, Zea mays
  unsure (1)..(237): unsure at all n locations; Clone ID: LIB3279-215-Q6-N6-H2
ttttacaaactggaatgaatgtcttctacacaccctaaccaaccatcccgctacataacattattccctgctgaaccattatcttcacattcctgtttccttgcccttcaacccacaacacacactctgtccttctacctgtcccttcccctcaactttggtttgcttcctcggtcctgttacctttctgcttttgtgtcctctaaatttccaatttccctgtcgcccnttcgtttc

SEQ ID NO: 14432 - DNA, 588 bp, Zea mays
  Clone ID: LIB3279-215-Q6-N6-H3
ggcgcaacacatgccattgattttcaactgtgtaaaacaaaacaagttgaagttttaacatggctatctgttttacatgaaggaaaacaaacaaaaatgccagagagactactaatttcagacataagagggactacacataggacatagccctccagcagcacagacccactcacctccctgtgctcaagtccttcaacgtttaggattggctgctacaaaatgcttggttgctcgttattgcgcccttcgcttgcaagccaaaaaggcaggacctccaccacaaccttctacaccagcttatcctcccggaagccattcaaaaaagcgaagcggagctttctctatcctctctgaaatgtgaaatccaccaacacgctgcacaaccctcactttaaagttagaggttagactcctaaggatgcaagttagagtcacctcgcaggagcttgcatttttggcctctatattgaacattacatttttttacaatttacaccttggccataaggatgcaagttagtatccattaagatattgaagttgataatatatttgagcaagcttttttgtcagctgtggcttcct

SEQ ID NO: 14433 - DNA, 537 bp, Zea mays
  Clone ID: LIB3279-215-Q6-N6-H4
atatacacgcactgtaacacaattcttgacattaacgaacaaatcggccacagcattgcgcgcaaggtccagcagcgcacataacactgctagtccagactgtcagcgcatagttaacttaagtattcgaccctagcaataacaccagcaaaggtagcagcaacagtagcagaagagaaacttgcgatccacaaaacaaaccctactcatatgtccttacaatggcaccagattaacaataaccccaggacttcatgtttttgtcacgatgtttgaggtggcgattaggccctctcgccgcggatcctccttgccagctgaatgtcctttggcatgatggtcacacgcttagcatggatggcgcacaggttggtgtcctcaaacaggccaacaaggtatgcctcagcagcctcctggagggcaagcaccgcatggctctggaaacgcaaatcagttttgaagtcctgtgcaatttccctgacgagcctctggagggcagcttcctgatcagcagctcagtgctcttctgatacttgc

SEQ ID NO: 14434 - DNA, 522 bp, Zea mays
  Clone ID: LIB3279-215-Q6-N6-H5
ggtagtagtttctgtttcatggaaaaaacacaaatgacatgaagagcttctcaaggacttaagatgtcagagcatccaacacggtatcctacattagacgaacaatagattacatggtcatatatatatgctacaatttccacattgtcttgttggaacgactggccaacctagactgcgatgtcatgctggatgtgccggagtaagacaggggttacgatgtctggagagctaagctggggaagatggccttcagagggcatcacctccacgatggagtcgccaccaaggtgcctgtgcaggtactcagacaccacaactggcaccgcgagatccttggtgctctgaacaatgtggcatgggacactaacgtgcgggaggaggctgcgcacatcgctctggaagatcgtctgggcaacatttagtgcaatgtccggacgtatattgaagagtgtcctgctaaactcctgaactgccactgattccatatctcctccacacacaggggtgcaaaacctaagc

SEQ ID NO: 14435 - DNA, 561 bp, Zea mays
  Clone ID: LIB3279-215-Q6-N6-H6
cgcagtaaagaggtctttgatatttcaatactgtaagcgagaaatacagttgggttactgtaatcacccatacactgctcttccaacagcccaactgacaaagcagtagttaatcctacggctacacaacacccgggatcatatcctacagctacacaacacccgggatcttcgccctccgcatcggcgtcgatgaagtcgacccctgtttccaacgccacactcgggagctggcactcgtcatcgccggccgcctttttggttggtaccggcaccaagttggtggcttcacattgctcgtcgagcacttcaatccagtcgccctcttcggaatcccagtccggcaggaccgagcaggggcaggccagtgccttgattctctgggcggggctctctgacgcatcgccctcgtcatcggagtcgggctcccagaccgcggcgtccagcgtgctcgtgggagacgccgccgcagcctcctccgccttgacgccgcggccggctgacgccaggaacgggtgctccaggagctgcgccgccgtgcaccggtcgcgcgggttcctg

SEQ ID NO: 14436 - DNA, 548 bp, Zea mays
  unsure (1)..(548): unsure at all n locations; Clone ID: LIB3279-215-Q6-N6-H8
gagagataacaggtatttttcgtctgttgtacaagctccatcggcatcgtatctttaatctttttttgaaaaagaaactggtgacttacatttgcaagtctgcacttcatgacttcatctgaccaatagagagagagagtatggaagccaatagaaatctctcagcacgtgttgaattacaaacataagaacaacaatgacaggcagtctcttgttcccgtggtactatccagaggaacaccagcttaagctgctaaacgtcgtcagccaatcctggtgttgtccctgccaaacacaagcgtcgttccccagttcaccgccacgtagaacctgttcctccagctcaccacccgcgtcaggtacgctgaccgccacatcagccagctgaggaagccagccatcgacacccccttggcatccttgttctccctgaggtcgacgagcgccttgtaccggccgacggacgccatgctgccgatgtgcttgtacacgaacggctccccgaggtcggccttgccggcgcagtgcgccttgccgncgttctgtgc

SEQ ID NO: 14437 - DNA, 569 bp, Zea mays
  Clone ID: LIB3279-215-Q6-N6-H9
aaaacataatgagcacaggcttcaatttcaaacaacaaacttattcatgatttgtcatagttctgggtagtacgcacacacaacacaaccggtccattattaaaccaacactgacacgactcatgacacgaacagcagatactttgacaacctccatatggagagggcaccagacgacgcaggcacatcggcagcttaaacgacccatgacttactgaccaccacggagacggagcacaaggtggagggtgctctccttttggatgttgtagtctgctaaggtgcggccatcctccagctgtttgccggcgaagatcagacgctgctggtccggggggatgccctccttgtcctggatcttcgccttcacattgtcgatggtgtccgagctctcaacctccagggttatggtttttccagtcagggtcttcacaaagatctgcataccacccctgaggcggagaacaaggtgaagggtactctccttctggatgttgtagtccgcgagggtgcgaccatcctccagctgcttgccagcaaagatcagacgctgctggtctgggggaatg

SEQ ID NO: 14438 - DNA, 524 bp, Zea mays
  Clone ID: LIB3279-216-Q6-N6-A1
cggtctaattattattcttcagatgctaccaacagagattattgtgctagcaattctacatgagctttcctgcgcctttttatcttgttctcaggagcttaactgttactcttcctaacccacaatatacaggtaaagtcaatgtctaacccaataagaattagaatgtgttcctttcatatgacacaatataatacatgtacaagcactatatctacttcaatcttctgaatggcatgtcataatttcaccaggcccccacaatctcaactgcaagataccttccgtttgtttactcttgccaagttctctgaaaccgccctagttaaattttgatcctcaaaactagcatcaagattgaacttgggatcaagggttattctctgaatttctctaacagcagaacttgctgcatataaggagatcttttttacctcaagcatcttcagttttgcaagatgaccatttggcaggcaacggatctcttgggacagccggactgactctggcaaactctcaggtga

SEQ ID NO: 14439 - DNA, 542 bp, Zea mays
  Clone ID: LIB3279-216-Q6-N6-A10
gcattccaaaaggcacaaaactagactttgaatttattttaacacacagcaatttctttgcagtaatgatctgtgaaggtttcgttcaaacaacacgctacaacatatctgaaacaaaaaacagaaacaccatgtgtgaactatataatgcaactactatccatctctcatttatgctgagtccatgacacattcaattgcgtgtttgcagatcccaaactacccagagctacgctctgattacgctgcagccatgatgcattcaattgcttgtttgcagattccagtcatagtcgcttctggcccatacacctcaattggaacgccgagttctgcaccaagcttacgcattttagccagtccagattggtaatttggaccacctcggcggacataaatgtgcattcttgaagccttcaacttggattccttctcccttaaggctcggatgatgccattgaatgtggtagcaacatcagtgaagttagctatgccacctccaatgagaagggctctcttgcggccatcaggatcagcagttg

SEQ ID NO: 14440 - DNA, 440 bp, Zea mays
  Clone ID: LIB3279-216-Q6-N6-A11
aaaaggaatgacaggggaaaccataaaaactagtagagattagatgggtcgggtttattacatgttccattgattagtatagaaaagagaactactatcgacactttattattgggacgaacctactttatttttttgcaccgccgcagtagccatacgggttctttttggcccagttccattgggccctgcacatttcctcgattccatattgggccctccatgcaagctttttttcagccttttaaggggacgcgtaaacctccgtcgggtcacccggtctcctggggcacaacttggggggaatctccttgccggaggcctttttgaacgccgccaccatttccaaaacggatgtgccgcgccctgtacccagattgtgggccacacaacctatatcaggagagtcgaagagcttcttgagcgctgcgatgtgccca

SEQ ID NO: 14441 - DNA, 790 bp, Zea mays
  unsure (1)..(790): unsure at all n locations; Clone ID: LIB3279-216-Q6-N6-A12
aaaaaaaaaaccaaagggaaacgaggaaaaaaaaaaaaaaaaaacaaaaaaaaaaaaggggggggggggggagggaggaaaaaaaaaaaaaaaaaaagaaagaaaaaaaaacaagagaaaaaaaaaaaaaaaaaaaaaaaaaaaaaaaaaaaaaaagagaaaaaaagaaaaaaaaaaaaaaaaaaaaaaaacacagaaaaaaaaaaaaaaaaaaaaaaaaaaaaaaaaaaancaaaagaggggggggagggaacaaaaaaaaaaaaaaaaaaaaaaagaaaaaaaaaaaaaaaaaaaaaaaaaaaaaacaaaaaaaaaacaaaaacaagaaaaaaaaaaaaaaaaacaaagaaaaaaaaaaaaaaaaaaaaaagaaaaaaaaaaaaaaaaaaaaaaagcaaaaaagaagcaaaaaaaaaaagaaaaaaaaaaaaaaaaaaaaaaaaaaaaacaagagaaaaaaaaaaaaagaaaaaaaaaaaaaaaaaaaaaaaaaaaaaaaaagaaaaaaaaaaaagaaaaaaaaaaaaaaaaaaaaaaaaaaaaaaaaaaaaaaaaacaaaaaagaaaaaaaaaaaaaaaaaaaaaaaaggaaaaaagaaaaaaaaaaaaacaaaaaaaaagaaaaaaaaaaaaaagaaaaaaaaagaaaaaaaaaaaaaaaaaacaaaaaaaaaaaaaaaaaaaaaaaagagaaaaaaaaaaaaagaaaaaaagaaaaaaaaaagaaaaagaaaaaaaaaaaaaaaaagaaaaaaaaaaaagaaaaaaaaaaaagaaagaagaaaaa

SEQ ID NO: 14442 - DNA, 552 bp, Zea mays
  unsure (1)..(552): unsure at all n locations; Clone ID: LIB3279-216-Q6-N6-A2
gaaaaatagcaacttgaaaacccaagagttttgcgaagacaataatactggaaccaatgtataacgacagaacatttttttgcatatgtcagcactggccgatccgagtaatattactagtacataataactgtccttcaaaactaaaggccacatgcgaagggaaacaccatgtccaaaccaagggcaacttcactccatggaagaagaggttgggcccgcgccgaagccgctgccgccaccacgcccaaagccaggcctcctgaatgatggctggaactcagcaggagctccactcttatcgccaccaaagtcaccaggagcaccacgaggaccaccacggtacccatccctgtcaccaaaccttggcctgtcgccgtcaaaacggcctgngccccttgggcggtcaccaggagggccagagccaaatgggcggccaggtggcttggcagacttcttgagcgtggcaggcacgatctcagacgggaggttcaggtagttgcgtaggtgctcaatgccatcgttggtgagataccagtagtagtactgcca

SEQ ID NO: 14443 - DNA, 363 bp, Zea mays
  Clone ID: LIB3279-216-Q6-N6-A3
aggcatgaacattatttttggaaaggtgttattacaaccgacaacgagcactttcttgccttggaaggcctcccttccctattgtagtcactcgagtgcataacttgcccttaaagctatcgattcactaagtgccagacaaaataggctatacattctctctagtggcaacaattagccattttggttggtgtggtactctattattgagtttttggcacggtccttccttgtagagtagaagacaaactcttcaccattgtagtcgttgatggggctagtggtgatgaaatccttggtgtggatgcaccggggaatcactattgtactcggcggcaatgacattaagactgaagaatgggc

SEQ ID NO: 14444 - DNA, 515 bp, Zea mays
  unsure (1)..(515): unsure at all n locations; Clone ID: LIB3279-216-Q6-N6-A4
gaaacaaggcatttcttcttccattctaaatagcaaaggacaacttgcagcaggacacatacacatacaagcacattcgtcccatctgcagcctacgcatcaccgcatactggtaacaaggtactgctaaacatcagatcactccggacagtcagtctatgccttcttaggggacttggcggccttcttgggcgactttgcctccttgctcccgccactggacgccttctccgccgtcttcttgggcagcagaacagggttgatattggggagcacaccgccgtgagcgatggtcacgccgcccaacagcttcccaagctcctcgtcgttccggatcgccagaagcacgtggcgcggaataatgcgagtcttcttgttgtccctggcagcattaccggcgagctccagaacctcagcggcgaggtattcgaggacagcggcgaggtagacggnggcgccggtgccgacacgctgcgcgtagcggcccttcttcaagtagcgcccgatgcggccga

SEQ ID NO: 14445 - DNA, 618 bp, Zea mays
  unsure (1)..(618): unsure at all n locations; Clone ID: LIB3279-216-Q6-N6-A5
gaacgaaattaccgacatggtaaaatcccttgggagaaaacaaacggatatgtccattgatgcagcgagaggaacaaggcggaccaaatgcagtcagtctccaacactagactagctactaccatcaagagaggaactagcttcaaaacaggcacatcatctcacttggccatcatcaccttcacgaactcctcgtagttgatctggccatcaccgtccacgtcggcttcacgaatcatctcatccacctcctcgtccgtcagcttctcacctaggttggtcatgacatgtcgaagctcagcagcagagatgaagccgttctggtccttgtcgaacacgcggaaggcctccttgagctcctcctcagagtcggtgtccttcatcttgcgtgccatcaggttgagaaactcagggaagtcgatggttccattgccatcagcatcaacctcgttgatcatgtcctgaagctcagcctcagtagggttctgccccaacgagcgcatcacagttccaagttccttggtggtgatgcagccgtcgccgtccttgtcgaaaggctgaatgcttncttgaactcggcgatctggtcgtcggtgagctggtccgcatggcatctga

SEQ ID NO: 14446 - DNA, 492 bp, Zea mays
  Clone ID: LIB3279-216-Q6-N6-A7
gacgctaaagactcaacatgttcaacaatgttaagcactgtttttccttttcataccctccatgatactttcctagcgaccatcgttcgttctcgtcacgaaccaaccggaacgaacaaggcaaaaaaattcgccgggctgagcatgcgcctcggcgagggccctacttgatgtactgggagacccacttgaaaccatcaccgtagcccatcttgcgaacaacactgcacatgaagacctcaagtggacggacattggagtcgccaaggttgaccttgcccttcccggttgtgaagttgctaaggcctaggtgataccgtagctcctcttcagaggcagcatatgggatatcaatcttgttgccaaggatgagaaatggaacattggccaaagaatcatcagacaggagagcatcgagctccttctttgattcagcaaatcgctccttatcatatgcatctaccaggtatactacagcatcaacctttgcgt

SEQ ID NO: 14447 - DNA, 518 bp, Zea mays
  unsure (1)..(518): unsure at all n locations; Clone ID: LIB3279-216-Q6-N6-A8
aagcagaactagcaaatagtaatactgcaacctgcaacagtgatcaatgtcgccggcgacaggccggggagacgagaccacgaccaggcacgcatacagctgttgtagttgtttgtcacgcgcacacacacaaacaaacagagtcagttctcgatcatccacacagtacacaaattcttaacataggcggcacaacggaaaagcaactaatgatacgtagtaaggcaaaaggcggcatccggtctggcgctgccgagcgatgttgcgagcctcagatgaaggtccagttggcgagcatgagcgccaggcactgcggggcgccgtcgtcgcccaccaccttccacgccactgcctgctcgtacgacgcctgccgccccatgctcgacctgcacacgccgccggggaggtacgccaggccctgctgcatgatcgcggggagctgcgcggacagggccttctggccctcgtcgtcgaggaccgcctccagcggcaggtcctgggatgttcanccatcgtcg

SEQ ID NO: 14448 - DNA, 371 bp, Zea mays
  Clone ID: LIB3279-216-Q6-N6-B1
cctgcttcaaatttcttgcatcaaagcaacacgagcagtacaaagatggataacaatctcatagatgcaagggcaattcatcttaatttatccaaagttctaacacaggccatacagccttgacctttatctaccccaccgtagcaaataaactcgcttcgcttcaagaggctttataatgttcattcatggtacttccttcttatggcacgaaataaagggggcagaaacgcttggattggacagttactcagccacattaaccaattcatactctattagagacaggttgttgtcttccttcaccgtgaaactggctggctctacagcctcaatccgcccccacttgtccactgcaacccacgcgtccg

SEQ ID NO: 14449 - DNA, 388 bp, Zea mays
  Clone ID: LIB3279-216-Q6-N6-B10
cttcgccaaaaggggacccactttattaaatccaaagggggggttccatattttcagtacaaataaacaagaaagttttttcgtcttatttctttctgcgaccctatttttatcatctaagttccttcttttttcatctttggccttcttccacccttctccatttaaccttgggatggaactggaccccccaaatctgggacgggggcccctccagcggggcgacggatgcccccgtgtcgacgtcaaaaacccggataaagctgtcaagcaacacgggggcggcaacccccccggcggggtgggcggcaagggaaacaactccaagcgcgtggccccgcgtgggggaccccaaggcagcgaggtcgtcggggagccaagcccggac

SEQ ID NO: 14450 - DNA, 407 bp, Zea mays
  Clone ID: LIB3279-216-Q6-N6-B11
gaaaaatccaagataaatgaaccaagttttggtggtaaagaaaaactcggacagaaaccacccgggacaatgggacgcgcaccggcttggcagaccaacaacgcaaaaatttgtttaccaggatcctacgactggcgctacatatatattgggggccttttttccaaaactttactatttttccaatggacgggtcaggatcaccatgcttaaatagatagacacaggcaaacagggaatacttcacattggccaatgggaagggcccaaaaaactggggatccattttaacaccaccttttccttgacgcttggcccatgaaaaatggatcggttaaacattcccatccatttttgggccgacaggggttggctcgctcgctcgcctttaggggagcaagcaaggg

SEQ ID NO: 14451 - DNA, 336 bp, Zea mays
  Clone ID: LIB3279-216-Q6-N6-B2
gcggcatcaacatcgggcatcacgaagtccttccatttctttctcaacgagcatacaaccctgagattcacagccacgttcccatcccattcaaaaaaactgatactaatctaattttccttcccaacaaacccgactcctccccgaagacaacatcatcctattcctacaaaacaaggcgggggtcggatcatttctgcaggaagcagtctcagttgtcgtcgtcgtcgacactggccttggaggaggcagccttcttggggagcagatgctgatggatgttaggcataacacctccgctcgcgatggtggcaccacccaacagtttggtcagct

SEQ ID NO: 14452 - DNA, 401 bp, Zea mays
  Clone ID: LIB3279-216-Q6-N6-B3
gggaaaaaaggggggtatttggcaaaggcccccccgaattttttttaaaaaaacacgggccttttttttgaggcccccggggtccccaacgggggggccctttcccccccccaaaaaaaaaaaacggggggggaaaccttgggggggaacagggctttaaaattttgggtttccccgggccccaaggaaagggcttttttaagggggcccccccctttttgggggtttaaggggggggaaagttttcccccccccctttttattttgggggtttttgtggtctgggcccttcggcccaatttggggggggggtccccgggggctccttccaccactttgggggctgggggcctttttgggagaggggccgggcaaccaagggggggttcccgggtgggggg

SEQ ID NO: 14453 - DNA, 555 bp, Zea mays
  Clone ID: LIB3279-216-Q6-N6-B4
gaagctgaaaaccgaacgttacatttacccaagttatggtttccactttcagtgaaactcaaaagaaagcagcggcaacggcaacacagagcagtctgcaggcaaaccttgtatcctagagtatcattcatttacagttctttctaaacctgtacatatattacaggcagttgtgtcgagtttgagaaacacactgcttgttcataacatcatggcatcgcatccatgtacttcttgcagctgtcctcagatgtctgcattgattccaaatatgcggaccttgtgcatgttcggcaattttgccacgaccagcacgaaaactgcaatcgtgttgagaaaaaacatcggctgcttgtagtcggtcaagtgcgacgcaatcagatacagcaccacaggtaccacagttaaaaacttcctgttccgagtaagctgctgaccattgtcaatttgctcccaccatgtcaatctgctgtagatgccttggtcatcagcagcaaaaggggttcctttcttccaaggaagaagtggtaagtgatggcgaaatgcgcgaggttg

SEQ ID NO: 14454 - DNA, 585 bp, Zea mays
  unsure (1)..(585): unsure at all n locations; Clone ID: LIB3279-216-Q6-N6-B5
gccgattgtatcccctgtgattagcaataactaaaatagtgcaccaacagtaaggtacatacagcttcatagctgcaacagtcgtgcagacggcagctgcatttctgtgctgaatctaaaacagtgatgagaaactagactatgtacaacgaggcgaaaagctgccatgatacaaggccacgctcaagctcttcacagtggaagattattttgtggcccaaagggctgcagtgtttttagcagcaccatatagcactcggcggcggcttaagtcactcattcacctgtggcccaacctccgcgggcactacaggctctggcgatttcctcagccccaacctctgcaggtgcttcaggtgcttctctgcagctgccttatctgcagcttctcgcttctgcgccctcttcgcccgccttccagcgacatccttggatacagaccccgatcctgaccccgaaccagacactgacaccgacgccgaagacgatgcggctntctctttcttcttcggagtcctggatggaccagcagccacatcagtattcactggcctcgcctctttcctgcctcccctgatgtaccca

SEQ ID NO: 14455 - DNA, 570 bp, Zea mays
  Clone ID: LIB3279-216-Q6-N6-B7
gaagcagaataccaccgcttaatgatttgtattaacaccagatgacatcacttaaaacaagaattgagataatctcctagaaaagcccaagaaccagcacaaatttaaattcaggtcttaaagctagtgtagagcacaagttccagataccgatgcactgtatctagtgtgacttgacgtactcctgaactatgttaaggccctcagattcttcgccatagtccttgacgacaacacaggagcaacccacaaccttcctcgccttgccctcagaatcaatcttgcaaagcccagaccattcgccaagagttttagcgctaggcacagtaaccaggtgaacgttgtgctcagagcaaagagccttcaccagcttgacataatcaggctggtcacagtcctccgcaagcacgcaaagctgagcagcatgcttctcaatggctttggcagcctcacgaagacccttaacaaggccatcatgagcacccgacttcttcatgacaagctgcagagcagtcatcaggtccatcggctccccaagaccggggtaggggcctcaactgcactggggtc

SEQ ID NO: 14456 - DNA, 368 bp, Zea mays
  Clone ID: LIB3279-216-Q6-N6-B8
ttttttttttttttttttttttttttttttttttttttttttttttttttttttttttttttttttttttttttttttttttttttttttttttttttttttttttttttttttttggggccccggggaaaaaccaaattaatgggatggggccgggggggaaactgggttaaaaaggcattaaaaacacaaatggacaaggggaaaccggggggaaattcggggaaaccctaaaggggtcccgggggggccatttaaaaaaaaaaaagcttttaaaaagtttagggaacccaaaaaaagaacccctgggggtttaaaaatttaaaaacccaaaagccacctgatttaaaaggggggggggcgttcgg

SEQ ID NO: 14457 - DNA, 540 bp, Zea mays
  Clone ID: LIB3279-216-Q6-N6-B9
ggacaacagcagaaattatcaatacattggactagagctcaatcgcttttagaaaacagtgtactaatcaggactgaaaacatggcataacgctctgaacttgagacgactaaccaaaaaagtgtactcatcaggacacacatttcggtgcaagacaatccatgagaatgctctaagctacagcgctcttgcccttcttcctctgtagcttcttcatgtagaactcaagctctttaccctcaaggatgtacccatcagctcggccacactgtccagggcgggaagaaatgcatgccagcaaccgtccactgccaaattgctcctcaatgtgtgggtcaagggtacgtccctccttgcgcttctcaagcttcctcgtgacatgggtgctctttttcgtttcctcagctgctgcctcaacctcttgtccctcagcattatccttctttgcagcaggggttttcttcttcctaccaatgtcaactccatagtgagtgaggtaccactgcttgaatggggcagcatcaacttgcacaatggcac

SEQ ID NO: 14458 - DNA, 62 bp, Zea mays
  Clone ID: LIB3279-216-Q6-N6-C1
attaaagtaatcctgcaatcattgcatagtacaggggaacaacactacaacaggctgtatag

SEQ ID NO: 14459 - DNA, 588 bp, Zea mays
  Clone ID: LIB3279-216-Q6-N6-C10
gcaattcaaccgtcccaaacaaatttattgataattaatactaaacagtagggggcataaaaccatagaaaaacagggtccagaatgtaaccacagataatgcagacacggtgcaacacccagcgatccctgcacttgtgtttgccatagcaaaagccagctcaagccagatggatgtctctgtagcaatccttgatacacttcttttttcgatttaggttttgagatacagtattccaaggcagggaagttacttggggccaacatccttcagcgcgcagatctgctcctcccccatagcagactggacagtcacaacaagatccttgccgctttcgaacccttccttgatctgggccacaagagtctcatcagttgggagtctaagatcatccttagtgttgccatctgaagtaagaaggctcacaaatccatcctctgatatatcaatcagctggtactcagtacggttcacatgcggaatatcacagttgtgtgacgaaggaacaatatcttcgagctttttcccgttgaatatgtctatggcaacaaagtggcatttggcatggccatgcttaccagtctttg

SEQ ID NO: 14460 - DNA, 413 bp, Zea mays
  Clone ID: LIB3279-216-Q6-N6-C11
ctgttcgacaggctcaatttattgttgtgctgttacatacatgcatggctgcacattgggcagcagttagctcacaatcagactttgctgtctccaagaagcagtgcctccttttaaactggcatgatttggtttgcatattaccagcaggcaaatacaatattttgcagaagctaggaacccttgctgattttctactgaccctgtggttagtttggggtcgtcggcagcagcggcatatgcatatgcgtgcacactctctctggctctcccctcgcccacaggttctgcagctcccctctcttccatccaagcgcgatcaaggtgccaagagtgaagggcacgatgtacaaaagggcaggttgtccatgcccatccatcaggttcagcgcaacatatgtgattagaagtcc

SEQ ID NO: 14461 - DNA, 568 bp, Zea mays
  Clone ID: LIB3279-216-Q6-N6-C2
ggcaaagaaagaaatttggtccattgaaataaggttccaagatacagatcataatcttttcgaaaacattgctaaagcacaaatggtgacatgcttcctctggctctcaaggtttgatgtgaaactttccatgtttacttctcgtagatccaggggtgctggctgctctgccaatcagcagggccctcggggaaccacagggcaatctccttattagcactctcaatgctgtcacttccatgaatgacattcctgccaatgtcgacagcaaagtcgccacggatggtgccgggctcagaagccagggggttggtggcgccaatgatcttgcggccagttgtgacgacgctcttgccctcccagaccatggccaccacagggccagagatgatgtagtccacgaggccctggaagaagggcttggaggcgagatcggcgtagtgcttctcagcaaacgacctctccacgttcacaagcttcaaggccttgaggtagaagcccttcttctcaaacggctgatgatctcaccaatgaggcccctctggaccccgtcagcttgatcatgatg

SEQ ID NO: 14462 - DNA, 477 bp, Zea mays
  Clone ID: LIB3279-216-Q6-N6-C3
gaagcccaaatggatttatggattagcgtaccaatgaggtcacaagaacacaacaatcgtttggtacacgcggattcagaaaggtaaagaaatgacttcctatctactgcggcaagctagagaaaactagtcccgtgtcgcataagttctggatgcaaaacacactttgaaatacgaaaaaaaagaaatcctcttattttgcttgaggatgcgaagcaatgaaatcaaccgctgtcttgatggagtcaatcttctctgcttcgttgtcaggaatctcaaaggaaaattcttcctcaaacgccatcacgatctccacagtgtccaagctatcaagtccaaggtccttctgaaaatgagcactaggtgtcacctttgagggttcgaccttctggaagttcttgacgacggagacgacacggtcagcgacctctcccttgttgaggaacgagccctttctctccgtcgtcaacgacagga

SEQ ID NO: 14463 - DNA, 495 bp, Zea mays
  Clone ID: LIB3279-216-Q6-N6-C4
gcctagcaacatactacaggttcacaataaaaacatggctatcatttaaggtacaataaagtgcagatattagttctcctccctcgagtgtcagcaaagcacacggatataaacttctcctagacgatacacggatagatatggagctttcatcaggattcaatcctgccagtaacaaggggggggggcatcacttcacttgccttcctcgatgatcctgatggctttgttcacagcagcggttttctcatcggggatggctccaccctctgggagatcaaatttcctgcggctcagtgatcgctgcttccctgggggctgagggtccacaacctccagcattgcttcgagctcctctagcatagatttcttcgcggtcctcaccatgtagtcaggtccctcgagcgcatctacggtgatgagcagcacgatgatcttctcagagaacctctggcgctcttcgtggtcatgcgcaatgcggcggacgcgtgggtc

SEQ ID NO: 14464 - DNA, 631 bp, Zea mays
  unsure (1)..(631): unsure at all n locations; Clone ID: LIB3279-216-Q6-N6-C5
gaagtaaccatgagaggacagatctagaatagcgcagttcaattatgcagttccaaagggtacacaaggatgattcaggtaaatgactactctgtgcacatacgcaggagatgatgatatacaaacgatgcactggagctagaataccaaaacgagatggtaaaatggcaatagctttaaaagatcaacagcattcagtacgacaagcatccaggtgcattgaaagtcaaaacactaggcagatgaagacttgacagtggcagacttgatgatgtccacgaattcaggcttcaatgaggctccaccaacaaggaatccatcaacatctggttgagctgcaagttctttgcagttagctccatttacagaccctccataaattatccttgtcaattcagcaactgcagggctaacattggagtggagccactttctcagaccatcatgaacctcctgagcctgagcaggagttgcaaccttgccggtaccaatagcccaaactggttcatatgccaacacaatatttgtccaatctgatattttttcagcaatagcctttgtttgtgcagcaacacatncattgttgttcctgcctctctctgctcagggtctcaccaatgcagcattacct

SEQ ID NO: 14465 - DNA, 572 bp, Zea mays
  Clone ID: LIB3279-216-Q6-N6-C7
aaaaagtatagtatttaaattcatggctccgagaaacattgttaacaaccagacctaaaagttctttgcgcatgaacaggtagaaagcgtgttcaggaggctctgaatcaagaagctgaaagaaaagaaacagaagctagacatgtcttgcactcaatcacggagtggaaggatagggctagccgtgcatcgtcgcagtcttcttgaagtcgattttgtccaccttcacctcgccgtcaatcagctcgtagacgtacaccaccacacggagcccgtcgatgtccatcagcacaaagcttgggttcacgtcgtaagtgatgctgctgtaggcgcccgtggcagagccagggttgatcaccacgcctccctcgtgcttatatgccttgaactggtgcgtgtgcccggtcaccaggatgtccacgtccagctgccgctggagcatcgccagggagtccaggtcgccccatggaacaacctgatggccatggcacagcccaagcttaaactgaccaattgtaagtgtcttagtctctgggtatcgagcatcctcatcatgttcacctctggtaata

SEQ ID NO: 14466 - DNA, 517 bp, Zea mays
  Clone ID: LIB3279-216-Q6-N6-C8
gattggggggggaagggggaaaaaaaaaaaaaaaagaaaaaaaaaagggaaaaaaggaaaaaaaaaaaaaaaaaaagaagaaaaagggggggggaaagggggggagaaggggggagaaaggagaaaaaagggggggaaaagggaaaaaagagaaaggacgcgggggggggagggaaaaaaaaaaaaaaagaaaagggggggggaaaaagaggaagggaaaaaaagaaaaaaagggggggggggggggggggaaaaaagggaaaaaaaaaaagcggaaaaagagcgaacaagaaaaaaaaaaaacgatggaggggggggaaagagaaaaaaaaaaccacaggcggggggagggggaaaaaaaaaaaagcaaggaaagagaattcaaggggacggggggggcggaaaaggaagggaacaggggagaagggggggggggggggggggagaggaaaaaaaaagatgtgggagggggaaaaaagaaaggaaaagagaaaggggggggggggggggggagggg

SEQ ID NO: 14467 - DNA, 602 bp, Zea mays
  Clone ID: LIB3279-216-Q6-N6-C9
gaacagaaatctgtcatttgataggcatgacgctccagaactacctcaggatcaagaagtggtctacagctttgaaggtcggtgttccaacgatgaaggcctcaagtatttttttaggggactggaacacggtgaggcaaacaaaaaaaaactagtcaccacaatcaaggttacctgtggtgatacagaatacttcactttaatgaacgcaaacacggtacctaaactacccaactcttgtttatttttgacgctacaattgctatgttctatcaaagcgagggccccatccaaaaacccaccaccatttgcttgcttgtttttccccagtggatgatgactcatgaagccaggatacccttggatcgcagacatgatgactccgcagagggaaactgaatgaccactgcagctctgatggcaatctcctcgcaataagaaccacaagcaccacaaaacacatgagatcctacccctcggtctgcccctccttgggaatgtggaagccttcgatcttggttgtaacttcgtttaccccagcagttgtcttgccatttgcattggtcacctcattgtcatcagcattagccgggctaagctgc

SEQ ID NO: 14468 - DNA, 252 bp, Zea mays
  Clone ID: LIB3279-216-Q6-N6-D10
accggaaacagccaaaaaaaatttaagataccccaacataccgggctagggggctacgaccctagtttaaagcttttttacaaaggcataaacaattcctaataggggcttccaaaattggcctaaaaaaaaaggagtatcgggcaaacgggattaaaaagaatcccggggcccggcactggatcaccagacgggactcaaatagccggtggggggggaactgtttaccaaaaaccaatgcaatggggaaac

SEQ ID NO: 14469 - DNA, 578 bp, Zea mays
  unsure (1)..(578): unsure at all n locations; Clone ID: LIB3279-216-Q6-N6-D11
agaataaaaacagacggcgggccatcatcatggtagggatatctagagaaatagatccaaagaaacatctgcatcaccatcttggattacatgactccagtgacggtgatatatagtttgatttgaacatcgcgactactcagtgcacgctctatatttcacggtatattcctttcctttccatccttccttgtgccttactacacctgaaggtcacaatccaactcagaagtgacggtagcgactttattacatccttgtgcctaggtctgtcggcaattatgtgaaaaccgagatcaaaagaaggaaaaaaaacagattgactctctcgttaattcaccccatagatccacttctccgcattgctggtgtaagagaccagctccttgggttcaaaccataaagcgatctcatccttcgctgtctctgggccatcacttccatgaatgatgtttcttccaacaacaatggcaagatcacccctgatggttcctggttcagatttctgtgggtctgtggcaccaattagttttctcccatacttgatgacaccctctncttcccaaaccatttgcagc

SEQ ID NO: 14470 - DNA, 436 bp, Zea mays
  Clone ID: LIB3279-216-Q6-N6-D3
ggaaaaaccaaggggatccctccctagattcaagctcccgtaaatcccttcattccggtctttaacagtggcggggcccaccctgggacccccctgtaaccgcccgtttcttggggggggggggcccctccctgtccctggcccctttgctccccccctcccccgggcccattggcttccaagccccgaaccctgcctttttaaccaccgggccccctgccccggatccgccaacctcccctggggaatgcccccttgccccccccggttccagtgtctaggccggggctctttccccctcccccctggtgccttgctttttgcgccccttctggggagctcttttcccgccccttggcgtggtgggggcctcgcctgtgttctctggcggctctggacatgatattatggggggccggagcgcccccccgtgggc

SEQ ID NO: 14471 - DNA, 457 bp, Zea mays
  Clone ID: LIB3279-216-Q6-N6-D5
ataggaatattttatacccatgaagcacatttatcaggcaattgtttcaaaacttttttcctttccctaaaaaacgtgtatccagcttatattgttacagaaaagaacgcctctgaaagcatacacatgaaactggatcacaattgggtttggggggcctgggttaccaacagagaactatcgattctaccaaggcgtctctcattttcaagcagtatcaggggcccctggggatttcttgtactcaggcttgagctcatgcgttccctggtttggacctcgtttattatacacacacagatcgttcaatatctccttaaggaattgctctggctggtcagtttcttgcacgagtgcctttagggcccaattgggctgcctttcaaaaagcttgaatataacgtttttccatctccggggcgacccctacgagttcttattggataaaaatgggttt

SEQ ID NO: 14472 - DNA, 481 bp, Zea mays
  Clone ID: LIB3279-216-Q6-N6-D6
aagaagcatgaaacgggaatttcagttctcatagcattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagccaaggggtcgcgacggtgcagatgaagaactgggagccgttggtgttgggcccggcgttggccatggagagcacaccgggggcgg

SEQ ID NO: 14473 - DNA, 597 bp, Zea mays
  Clone ID: LIB3279-216-Q6-N6-D7
atgcaaatacacagtaataaaggtaacacaacagatccgagaaacatggaaagaaactaagaaagcatgtctcaacacagcaatcacagtagagcgccacttgttcacagcgcatatatgtcatatactaataaatagatgaaaccgtgccatggggccatcaaaatcaggagcctttcaaaaccacctcaattgacaagaatgcaatatgagagtgtcctgaaataatatttaattaattccgtcgcgacaacccaatgacctacccgagcaaacaggcatcactgttgttgctgttgctgctgtgcagctggttgctgttggtaattgggataaccgccataagcgccataaccatacatgttaggatcctggggttgtgcatacccactgccataagcctcataaccttgtccatagcccccatagtagccaccagcaccagcagccgcaccccattgattggattcctgctgaggctgagcctgcttgttcgacaggcttctaccccatgaaagtcgaacattctgtgcaccaatcaaggccccttgcagcattagcagcgcttgttcagcagaaggtctggtaacgaactga

SEQ ID NO: 14474 - DNA, 574 bp, Zea mays
  Clone ID: LIB3279-216-Q6-N6-D8
cacacgaaatcaggacaacacatgaacattccaaggcacagttaatatgtatcacatacaaaccataacgctaaactttttctgcacacacctaaccaaccactattatcctgtaaacagatacactgatgcacaccactactcttctgttctagaacctcaagactatccttgaacagagtcacacctatacaatcttcgacgacagttttgttagtccgttcaatggcacacctgtcttctgagctgacggcgtggcaacttttgctttcttatcagatagaggagttttcagcacgaaactttcagcagctctcttcttgcctgcctcatgcttcttaggagttgaagtgtcttcctcctcatcgtcactggtatcatcttcatcacttgaatcatcatcatcgccttcttcaggagacaaaccctcaccctcatcagaatcgtctgtctcgtcctcgttagaatcatcagtctcgtcctcatcagaatcatcgtcatccttgctcttcttggaagccggacttgattttgaagctgcaggaactgccttttcttgacttttctgtttctt

SEQ ID NO: 14475 - DNA, 567 bp, Zea mays
  Clone ID: LIB3279-216-Q6-N6-D9
gacatgtaccaacaaaacagtgaacatccaggtaacttgaggtaacaaattcatagggggatagaaaaactctggttcaccagtaaaccccaaccagcacagcaacctacgcctagaattaccacaggaaaagtctttcaagtactttccaacataaaacaaagttaaagtccaaacatgactaagatttttatcccctttgcttccgcgactcaaaaacaatattcttgactattgcacaagcttagtcgaagaggctgaagcccatgtcgtcatcactttcttccttctcctccaccttcttttttttcttcgcctcagctgcaggagcgccgccagcagcaggggcagctgccgcgacagccacaccgccaccgccacatgggactgaagcaaacttctccctgccggcggcaatgagctcggtaatgtccttaccgctcagttgggacagaaggagttccatcttttcattgtcaacttcacagccaactgactccagaaggctgtcaagtcctcggcagaggggcctggagttcccagcgaggacagcaagcaggtaggcag

SEQ ID NO: 14476 - DNA, 598 bp, Zea mays
  unsure (1)..(598): unsure at all n locations; Clone ID: LIB3279-216-Q6-N6-E1
gagcccgacaggcccatggcgacgcccacgtccgccgtggccagcgccggcgcgtcgttcatgccgtccccgaccatcagcgtcggcccggccctcgccttgagatccccgaccagcgcgaccttgtccgccgggaggagctccgagtggacctcctccagggcgccgccgagctgccgctgcgcccgcgacgccgccgctttgctgtcccctgtcagcatgaccgacctgatgcccatcgatctcagctcacggatcgcctctgccgcgccggtcctacagtcgtccgtgagcgaaaacgccgccacgtggtcgccgtcgacgatcacatgcccgatcgacgcaccttgctggccttccatctccggacctgctcctgctgcgtagcaggaggaccttgccatgatccttgtgttcccaatgaagatttgccttccgtttatcgctccggatatgccctctccagggtagatacggaagtcagtgacgcttgtcggctcgggttggatggatttggactgagcgtactcgacgagtgcggttgccattgggtggcttgacttgctctcatgctcgacacccaatanagaagctggct

SEQ ID NO: 14477 - DNA, 548 bp, Zea mays
  Clone ID: LIB3279-216-Q6-N6-E10
gatcaagaaaacaataacgccaaacttaataacccagtagcaaagcgggggaataaagtcttacaacgtaagttgtaaaccacacaacgacagatagataagaaccgacagaaacataacacgataggagccactcagggcagatcacaggatagcagtggcacacaagcccgacgacgccgcgccagtagagcgtctagtactcgtcaccctcgtcgccgtcctcaccctcgtcaaactcagcaccgacctcctcgtagtccttctcgagcgcagccagatcctcacgagcctcggagaactcgccctcctccataccctcaccgacgtaccagtgcacgaaggcgcgcttggcgtacatgaggtcgaacttgtggtcaatgcgggagaagacctccacaacactggtggagttggagatcatgcacacggcacgctgcaccttggccaggtcaccgccggggacgacgctgggaggctggtagttgattccgcacttgaagccagtcgggcaccagtccacgaactggatggtgcgcttggtcttc

SEQ ID NO: 14478 - DNA, 499 bp, Zea mays
  Clone ID: LIB3279-216-Q6-N6-E11
cggggaaccattccaataacaacaaaccgtgttctacacggcacacaaaaaaaatcgaattgggtcgtttggcaacacgaatcatcagtcttttaccaagatcgcttcgggacgaagcggtccacgaactaccacacaaaatagacttgtaaagccgtttttacactacttcgccacgccgtttaaaagcgaacaaacagcataaagttacaaattgcactcctccatccctccgccgccactggggccgggcgcgagatacgcctacgcgcgctcgccggggatgcggcgggcgagctggatgtctttgggcatgatggtgacccgcttggcgtggatggcgcaaaggttggtgtcctcgaacagaccgacgaggtaggcctcggcggcttcctggagggccaggacggcgtggctctggaaccgcagatccgtcttgaagtcctgagcgatctcacggaccaggcgctggaagggcaacttccggatgagcagctcc

SEQ ID NO: 14479 - DNA, 453 bp, Zea mays
  Clone ID: LIB3279-216-Q6-N6-E2
caaaaaggggatttgaattagacaggaagaattacagtgcaccccaattgaaaataaattgagagatcaaattagaggcaacgctacgttggagaaaagtctaacatgccaacattcctacttcaccgtccaatccaatcccatcgaaccagcggtttttacagacccaaagaagcacgactacaggacgacaaagcaaccagctaccacaactgctacaatacgaacacaggaaggcagccaaactagtaccacagatccgagacacctggacaggcaattacccacacctaacctagccgccgaagccataaagagtgcggccctggcgtttgagggcgtacacgacgtccatagcggtgacggttttgcgacgggcgtgctccgtgtaggtcacagcgtcgcggatgacattctcgagaaagatcttgagcacgccgcgggtctcctcgt

SEQ ID NO: 14480 - DNA, 419 bp, Zea mays
  Clone ID: LIB3279-216-Q6-N6-E3
gggggcccccaaaactgaaaccccattggttattctttaacaaggcccaaaagaactaaaacttgggaattcgttccaggacgggggcgggtaaggttaacccaaaaaggacagggggtccaaaacccgcgtgggtcccgggtccaggggccccggtcacatttattctcagcattgcccagccgcaaaaatgggctgggcccaaaggccattgggggcgccccacgatgggggggcggaaatctatctctctactagcctactgggtcttggacatggggggggtccgggcgccgacccggttgctgttgcccccctcggtggggtcccccgggacgagcttgatgaaaggggcgttccgggcaatcccggccttggcgtccaaaaagctccacctggtgtccccggggaaggcgggg

SEQ ID NO: 14481 - DNA, 523 bp, Zea mays
  Clone ID: LIB3279-216-Q6-N6-E4
gctatcgagaggaaaataacaaggtcaacgttcatctacaagaagaagatgaagaaaaaaggcacacagagcatgagagcaaccgatatacatacacgcgaggaagaagggggtacaactccccctcatccatcgtctcactcgctcacgaataaagacagacacgctgcatctgatctcccctggtcctcttcagacgactaggcctctgctctgctgttgatcgccagcgtgaagtagatcagtatcgtcgtccccacgctcgacagcgtcgcgaataagagcagaatcctccgagggttattgacgggcgtgatgagccggccaaacctcctgctgctccttccttccgcggagtcaatgaggaggacaggcgcgcagggagtgcagtgtggagcaaccagggcccgctgctgctccagctgagatggcacaactttgatgataagttttctggccagatcctcttgctccagcagctcatcaccacccttcctttccatccgattcgaacccttgcgtg

SEQ ID NO: 14482 - DNA, 511 bp, Zea mays
  Clone ID: LIB3279-216-Q6-N6-E5
ctaacatctaccatgtattgtatgaatggaagaagaaactgctaatacgtgctattgtacaattatgctatgagatgggtctcggtattgagaagcggtgtcacaagatgctgcccatcaaccataggtgcacagccagccagtacaacataagccctagccttgctcgtggccggttcatcagaatttggctccccgagacccagaaggcatcgaccctatcagcgatgtgctttccctgagctggaatgaagccagatgtatggagtgattttatacgccccttgtcatctgaatcttgtgcagcaattaatcgttctgactctgaaccaatgttgagaacaagatgatccgatgaccccttccgcattgttctagcatgtgcagctgtagaaacagatgaaactgatgttgtcttgcccactggtcctacatcttcaatctcagacatatctgacccaattgttgaggaagatgcttcaaatgatctgtctttactaggttctggctg

SEQ ID NO: 14483 - DNA, 526 bp, Zea mays
  Clone ID: LIB3279-216-Q6-N6-E7
tcgcgatctagaacctagatcgcgagggccgcccttttttttttttttttttttttttttttttttttttttttttttttttttttttttttttttttttttttttttttttttttttttttttttttttaaaaaaaaaaaaaaatttttacctggggttgggcccccttttaaaaaatataaaaaaattaaaaaaaaaagggcccattttttttaaaaaaaaaaaaaggattagttttggggaaccccccttggaaaaaattcacccaaaccgggggggttttttgggggggggaaccccaaaaggtaaaagccggtaattccccccttttttaagggggtttttttgattttttggccccccattttttggggggtttcaaaaaaaaattggtaaccttgggggggaaaccaaaaaacggttttccccccccaaatgggggaaaaaatttttacaaaaaaaaaaagggggcccaaaaaaaaacctggacaaaattgtaaagggaaggagggccttcttttttaa

SEQ ID NO: 14484 - DNA, 491 bp, Zea mays
  Clone ID: LIB3279-216-Q6-N6-E8
aatcaccgaaaccacttaggattcaaatgctttcagttaggggaacagatttttatcttgaaatgacaggggttgctttattcataggggaggatactactaaaaaaacagggcacgctaagaaaaaaaaatcctttaatcggggaatccaatttggggggctatcattcaaccccaataacttttccttgccaaccttcgaaaatgggcacgcaaagaaacatgaccccttcctgttcagtcacctccatccacaactactcgagtgagataccctttggcgggtcaaactttgccccaagattgctcaatttggcatgagcctcggcgtagtcctcgaaaaatgcgtcctgatccttggcatattttgtagcatagatcttgaatgaggaatcctcaaacagcacagcatcagtaggcagaattaggaggtcttcatctcgcctttcttcgatagccttgaaatagctgttgtcaaacttgagccattg

SEQ ID NO: 14485 - DNA, 578 bp, Zea mays
  Clone ID: LIB3279-216-Q6-N6-E9
aaatccaacgacaatgagagaatttactccgattcaaaagggcactgggcacccagccaaagaaagtgacgtagcattccatacagccaaagaaagcgacaactccacatgatattctgcatgtttattgccacagttcccatcttctccccaaaactgggtacttactgacgttctggtttaatgccaggagttcggatcatcctctccacagaaatgagtacttaccgatgtaatggtttaattgcacgagtttcggatctggcagttttacagctacgtaaacacactcaatccagcctcctaagcaagtacgcgacctcaacctccttggttagcggcatgattctgtagctgtacagctcggcgaccaagctcggcctgattttgtagactggttggctgccgttgtccttagcaccaatgttcacctcttgcccgaagatcttggctttggcttccaccctgtgttcgacagcacgctccaccgtttcatatgtgagaaggcgcatgagttgatcacggtcttgggctattatggctggcgtgtaagcttcaggggactcttgaaacttggc

SEQ ID NO: 14486 - DNA, 607 bp, Zea mays
  Clone ID: LIB3279-216-Q6-N6-F1
ccataacgacgttcttaataacccagtggcaaagcggggcggacataaccagaaagtcttacaacatcaggtgttgcaaaccacaacggggacaagagcagcacacaagcctgacgatgaccgcatcaggatacttctagtactcatcaccatcatcaccttcctcaccctcatcaaactcagcaccaacctcctcgtagtccttctcgagcgctgccagatcctcacgggcctcagagaactcgccctcctccataccctcaccgacataccagtgcacgaaggcacgcttggcgtacatgaggtcgaacttgtggtcgatgcgggagaacacctccacaacactggtggagttggagatcatgcacacagcgcgctgcaccttggccaggtcaccaccaggcaccacacttggaggctggtagttaatgccgcacttaaagccagttgggcaccagtccacaaactggatggtgcgcttggtcttgatggtggccacagcagcattcacatccttggggaccacatcaccacggtacatgaggcagcaggccatgtacttaccatgggcgggatcgcacttggccatcatggaggatggctcgaa

SEQ ID NO: 14487 - DNA, 395 bp, Zea mays
  Clone ID: LIB3279-216-Q6-N6-F10
gaccacagaacaattgttgaatgataacatctctgcaaatccaccagtgcaaacaaagactagaccatacaggtaggcaaaaacgaaatactggtcgcagcacaacccagttgctacaccattgtcagttttgtcactaaacttggaacaacaaagaaacttaagcaggcactgtagccactaactccatagtaccttgcagtggcctcgaactaacggttgcctttgtagcacctctggaggtggggaagcaacggacgggcctacagatcgagcttgagttcctggatgtcgccgtcgcgggcgaggaaatggaggatgtaaggggtggcgcggatgacggcggcgcaggaggccatgatgatgatgtgcgaccgcagctgcgtacaagcagc

SEQ ID NO: 14488 - DNA, 564 bp, Zea mays
  Clone ID: LIB3279-216-Q6-N6-F11
aaaacaaacgtctattgtgatctgagatttaaaacaggcaccatagatgcttggggcaagtacagactgcaggctaaacatcccaatccaacaacggtcgagtgccgatgaagcgaagaaactacaaactaaactgcctcactccagggacgggacgacacttgcaaggaaactactcagaagacggcactaatctactgcatctagaaagtccttcgagaaaacccggttaggccgacaacgacgagattttttccctgactgcaaacacttggacagagtttcatccgtcatacatcactcgtcaccctcctcgtcctcgtcgttcacctcggacttggacttgtcggaatcaccagacgccgtggggtctccagactgcttgttgttgtaagcgtcgatcttcttggtgtactcagccttgagcttctctgccttagacacgtagggagccttctcggcatcagacagggacttccacttgtcaccaccagccttgccaatcagggagacttgcttcacattggggtgcttctccttgtagtccttcctgaactcctccat

SEQ ID NO: 14489 - DNA, 123 bp, Zea mays
  unsure (1)..(123): unsure at all n locations; Clone ID: LIB3279-216-Q6-N6-F12
ccccccccccccccnccccccccccccccccccccccccccctcccccccccccccccccccccccccccccccccccccccccccncccccccccccccccnnnccccccccnccccccccc

SEQ ID NO: 14490 - DNA, 567 bp, Zea mays
  Clone ID: LIB3279-216-Q6-N6-F2
cagcagaaacaagccaccacaatacagaggcatcttcagattacatgacaatcacaaacataagatgcagtacaattcaagtatgatcgacttaacagtgttcaaatatagtttgaaaagcgcaaagtaaacaagacaccatcaccagtccaagcctctgaaaaagtgtcgatgaggcccatcacactgaaaggtcttcggcagatcagatgagaagcttctcaatggagtccttgagaccctgtatctgtagtttcagctggctaccctcattactggtcactgagcaagcaataaccggtcttgtcacaccacaagcacggccaagagcttgcttcgatggaacaaacacatatggcacgttcttatcctcagctaacaaggggaggtggagcaggatctcgagaggctctgtgtccgccgccatcactacaaactccgatatgcccctattcagggtcttcgtcgcttcattcgctcccttcttaagctgtttgtagttggcggcctgctggatgatatcgaggatacccatcgtcagctgcgcatcagccagcgggtatgcct

SEQ ID NO: 14491 - DNA, 556 bp, Zea mays
  Clone ID: LIB3279-216-Q6-N6-F3
acataaacgaagtgcttaatatttctcctaaatatcaattggcaaagactaaatatacacattaccagcccaagtgcacaagcgcaacgagcactttggaacatggagacaaactatacacgatctcgattcatcttagaagcctacgttatcgtcgaagaaggccttctatcacttgaagcatcctagtcttcttgcgtgcatgatacggctgcagaatattgagcatcctcgccgttctttctttttcttcctttctcgctgcttcgtcggaggcctgattactaccttgatggcagcatcaaacacagctttcacattctgctgagtttttgagctgcattcgatgtagcaagttgcgccaatgtgcttgcgcagttcctccccctgtgctgtagtaacaggtaccgcaccaggatggtcaactaagtagtgcttgtcttcacgaagatccaatttagttccggccaacactatggggacacccggtgcataatgctgaagctccggtagccacttcttcataacattctcgtagctagctcggctgacaagc

SEQ ID NO: 14492 - DNA, 602 bp, Zea mays
  Clone ID: LIB3279-216-Q6-N6-F4
acagcaactatttttatttcacggccaaaaacaaagcttaaaaacgaaccccaataaaaagaaaacagcgcgatatttcgtccccagcccgccgccgccaccttcgccgggatgatggctccaccattcacgcgtcaccataccgccgccaaaaaccccaccagcgcgagcgcaagtagcgcgggcgcggacacgccggccgcgggcacggcggcgttgggggacttggacggcgccgtggacgaggacgcgcccgcgccgctgtcgccgcccgcggacgggccgccggcctcgggcgcgagggcgggcgagggggcctcggccgccgcgggggccttgccggcgaggacgagcttgctcttggcgccgaggttgtccgcctggaacgcgtgcttgtcgggggcgccgcccgtggaggacgcgccgacctgccacacctggttcacggccttcatccccttgcgcagctgcagcttgccgtacacccggatcttgccgcccgcggcgtccgcggcgaggtcggtcgccgggaagtccagcggcgtggaggccttgcccagcgggacgtaccccgtgatgttgtacgtccgcacggcgggcgc

SEQ ID NO: 14493 - DNA, 290 bp, Zea mays
  Clone ID: LIB3279-216-Q6-N6-F5
ggcagaaaaaaacacggtttaccagattatactgtcacaaactgttaccgaacacttaaaacaaagactagatgttccccaaaactgatgacaaagcacagctcctcagtacttgataggggcaagaatctccaactgagaccccaacttctcctcgggtgccttctcggccttgacacgcagcttggccaattgcttcttcctctcgtaggcaaccttggccttctccttcctcttctcctcaagttccctgatggggtcatgggagttccacccgacctccttagaga

SEQ ID NO: 14494 - DNA, 562 bp, Zea mays
  Clone ID: LIB3279-216-Q6-N6-F6
ggcttggataatatttgattccaaacaacatattaaattcttacataaactggaacaggtcgcttgtaacaattaccaagagttcttcaggttcacagacaggacagcaaaattaactacggcaacaggcaccaaaccaccacttctgaaatccagatgacacacacaactctagtcgaacagggagaatcccatgtcgtcgtcgctctcttacttctcctcttccttcttctcctccttgggagcctcggcagcagcaccaccagatgcaggagcaccgccgccgccacctgcggtgaccatcattggaccaccaccgacagcaccaacaaacacctggaacacggaggagctgggggtgaccatggagaaggacgactggactccgtaggcagagtcggccgcttatgctgtagcgacgaggcggtgctgcacctcgtatggcgtagcggcggaagcctcgatctcgccggagtgctgcttggcggtccactcgccggcgttgctgcggtacacaaaggtgtagacgcccatgtcgcttgttccctgcgtgcacagcggc

SEQ ID NO: 14495 - DNA, 222 bp, Zea mays
  Clone ID: LIB3279-216-Q6-N6-F7
gcaagaattcaagacatcaatacaaaataatcagatgcaaaaacattccatgatcaacacttcttcctcaaggacctcaatgtgttcacgatttggtcagttacatgtgcagaatactggaaattaatgtctccacaactgacttgcagagaattagaaaaaaaaaaacccaattctgtatcaacatgacttcaataacagaggtcgaaggcaataagtccg

SEQ ID NO: 14496 - DNA, 586 bp, Zea mays
  Clone ID: LIB3279-216-Q6-N6-F9
gatggacaagcattcggtaccgcaagtgatatccatgaacagatggatgtacagtcgttttaggagtgaggatacagaatcaatcaacttgctcagacacatcgcacatgctgtgtctatttttttttcaacttctccaaattggccatgctcaaagtccaaacttcgctgggaatctgaatttccaccggacccccacagttcacgcgctttgggaatattcatcatgcctgcagctttcttttcttcttatgcctccttttgcgccgtggtttatgaacatcagaatttgagctcagattactgttattatccccgggacgatttggtactcttctatttttaaatgattcgccgcttgtgctgtttgaagtactgctcgagctggatatcgcacgtttatctgcatgtctgcctctatttggggctaatgagcgtggtggcggcataagaactcgagcatctctctgacgctggttcttttcatcacttgacatgccagatgctgccctacctgaagcactggatgctggttccttagcactcttgtcagtccactcatcatcagcctcttcatcacttgaac

SEQ ID NO: 14497 - DNA, 465 bp, Zea mays
  Clone ID: LIB3279-216-Q6-N6-G1
ccgggatgaaacgaccctttggttttgagttctgaccaaatggggcagccgggcaacatagttccagatttcacaaacgtttcaggagccaaaggcactcaccggttaaaaaaaaccagaatggggggaccttactcttggtttaaaccacgggctttttaatcacataaatccattccatgccacaaatttttctttttttccattcaacccaccatggggcgcttcctggcccggtggcttaattgggccagcttggtctggggggggcaccattggtttgaagcctttctggtccccacccggatttttttcattacattcccacaggacgaatggctggaaataaaagcttttttttacacatattgggcccacggtttggccttaggaattggcgaagtgaaacttaacccaaaattaataaaaaccaattgaatggtaccggtcttaattatcaaggtt

SEQ ID NO: 14498 - DNA, 445 bp, Zea mays
  Clone ID: LIB3279-216-Q6-N6-G10
ggggaaaccagcgcccaccctaagtgacatcaattataaattttaaaacatagccagattggaacacttcctaccacttgtccactacggatgaattttacgaattggaacacccacaaatgtgaacttccacaaaggcaagcctggaacaaatgcaaaccatactacggggccactcccagatgccgtaaacagagaatgtaggccctttaaccaggggtcctcctagccaggtgaatgcccttgggcataatggacacccgcttggcctggatggcgcacagattattgccctgcaataaacccaccaggtacacctccggaatctcctgcagcgcaagcaccgaatggttcttgaaactaaaataagcttgaaatactgagcaattttcctgacaaggctttggaacggaagctctcttatgagcaggagaaggctcttctg

SEQ ID NO: 14499 - DNA, 537 bp, Zea mays
  unsure (1)..(537): unsure at all n locations; Clone ID: LIB3279-216-Q6-N6-G11
agcagtatcaaaatatgaatgtcgtcttcaacttcaacatgcaagcaaccgaagcaacagcatatccagtgctgttgacgttttacagaatttattcattcacaaagctgaccatcggattcggatacatgcgaaacgtgattgccttccaacagcgccatgccaatcctagctaggtagatccctcggccttcttgtcggtgtcggcgggcttggccttgtcagagtcggccttctcctgctcgagcctcttcttgagcttctcctgccgctccctctccatcttctggatgtagacgctctccttggcgcgctcctcctcgctgagcacgcgccccttcccgtcgctgaggaggcgccggccgcccgtcgccgcggggggcgcaggggcgcgcaggcgcgcggggagggaagtcagcgcggtccgcatcgccatctcgtgctctcgtcgcgaactcgggtcgaatctggctgggctgcgcctgcgctgcgtgtcttgggtgctgccttgcnattgctggctggctgggtggactg

SEQ ID NO: 14500 - DNA, 421 bp, Zea mays
  Clone ID: LIB3279-216-Q6-N6-G2
gtaacccacaagtttaaagtgctcttattaaaattgaaacacggacaaacatgtaaggtctccgcgtcacttgaggcttcgtagctccctatggaaagcctcagcgtgctcctgcttgacgcaaagcgccatggcggcaacgccctcgggcttgtcctttttcccgcacaggaagcagcccggcaccaccttgcgctccatgcacccgatgacgcgctcaacgccgcctgtgccgaagtcaacgtcgtccaagccgaggttccaccagctcgtgacgtacagggtgtcgtagccgtcgaggcccttgagccgaccgcccatcttgtcggcgatgtgcgcggctccgtcagcgaacgtgaacgggacccgtgccttggcgtccctgaccagcgtcacaaggtccaagatgtccccgttcgcg

SEQ ID NO: 14501 - DNA, 571 bp, Zea mays
  Clone ID: LIB3279-216-Q6-N6-G3
gaagtccaaacaaattttggatattctttactagctcaacaatacaaacagcacaatcagccaacgacgaccttttatgacaaacatcttacatgaataatctcgttcgcaatcacgtcccacaagccgatgacctgagtaattcagtcacgtctcgacgcggttaagggtacaacaggcgccatagctactgtttgtttttgccaagtaaacccccaaaccactattcatcactggtaagagcatggctccaccaagagcagatgatctgatccacggttagcaccagtctttgcctctttggtctttggcctctcatgcccgcgtcctgctgttctctgcagccctcacttgttggaagtatgggtgtgtcatagcttcacgtgcagtaagcctgtcctgatgatcataacgcaaaagcttgtcgaggaaatctatggcctcatgagacactaggtgttggttgtctgcattaataaactttgtccagggtttcctgctatgccttccaacaagggcttcgagctgagggtcaagctcaattctgtacttgttcaaatagacattcagc

SEQ ID NO: 14502 - DNA, 514 bp, Zea mays
  Clone ID: LIB3279-216-Q6-N6-G4
agcggagagaacaactatattccacaacagggacatcaaatctaagaggaccattacaatccggcgcgccggatttatagagcaggcaagctagctactaggcgggtagggtgggggactggggaaaggacacagcaaagaacccttctaacagatccgcggatcccgcagcgcgctcagttgctggtgaacttggtgacggccttggttccctcggagacggcgtgcttggcgagctctccggggaggactaggcgcacggaggtctggatctcgcgggacgtgatggtgggcttcttgttgtaccgcgccagcttggcggcctcgccggccagcttctcaaagatgtcgttgatgaaggagttcatgatggacatggccttggaggatatgccgatgtcggggtgcacctgcttcagcaccttgaagatgtagatcttgtaggtctccacgctcttcttggccttcttcttccccttcttctcgccgccctccttgccggcccacgcgtccg

SEQ ID NO: 14503 - DNA, 601 bp, Zea mays
  unsure (1)..(601): unsure at all n locations; Clone ID: LIB3279-216-Q6-N6-G5
acaaaacaacatagataatatattgatcaataaaggcaagatacccgatttcagtgaagatttcactacttgatgcacaacagtttcattgaaaatgacagcaattccatggttcgctgatatgatccagctagcacagcagaggataccaaaatagagtagtagtctagtatcctcggggcatagatggaataacatacatcacgcggttttaagtagaaacaggaggcttcccaactctctcgcctccaaacccccactgtttaaatggcgtggtcaggaggaggaatcagaggccggttgttctggctgtgcttcagcagcgcgcttgacggacgcgcacttgatcaagtggttgtagcttcccttctccttgaaaagttgggagaaatggtgtttgcagtagaggatgccctccaaggctgcatagttggaaggtgtaatcgcgcagcccccgtgggagcatttgaagcatgacttatggtaggacttctcttcgactgttaccttctcaagaggatacgcagttntaccacaagtcgcacacttgtcttgtgttcctgaaaactccttgcagctntgcttggtgatctggtcagct

SEQ ID NO: 14504 - DNA, 590 bp, Zea mays
  unsure (1)..(590): unsure at all n locations; Clone ID: LIB3279-216-Q6-N6-G6
ccctttnnttttttttttttttntttttttttttttnttttttttntttttttttnttttttttttttttttttttttttttttttttttttttttttttttttttttttttttttttttttttttttgggttttttttttttttttttttaagggggggccccatattaaaaaattaacccgggggtttaaaaggaaaaaagggggggcggcaaccatttagggggccccaaataaaaacaaagggggggggcccaaaataaaaaaagcccaaaaaggggtttaaaaataagggccaagggggttcaggaaaaaaaaaaaaaactggggcccaaagaaaacatgaaaaaaaatgcctaggggaattggggggcccccaacactggaaaattttggccccccatgtaaaaaaacccgaaaaggaaaaaaaattttgagggaaaaaaggggggaaatttaaaattggccttgggaaaaaaaaaaccccgggaaaagggtgaaaaaaaaaagaaaaaagcaggggtttttaaaaaggttgggggggccttttaaaaaaaccaacagggcccaaggtaaaaaaacctttgggg

SEQ ID NO: 14505 - DNA, 558 bp, Zea mays
  Clone ID: LIB3279-216-Q6-N6-G7
gaaaacaaacaactcatcctcgagatggttgaggttaaactcttcatacagaagtgtcagttctttgtatccagttagcaaaataacacagaaaagtagtatctccttttcaaactgaggttacagttgaacacctccagaacatcatgaagtgaaaccatcgcttgttagctgagcctcatgatcatcgcccgggatggctgttgctttcccaagtgatctctgactaagcattcggacgataccacttctcatcttccggacctgagacccattagcagattgattaccacccattgtcctcgcaagctcttctgaaagagccttcacaagggcgtcgaagcggcgcttggatgtggggtaccttgatatcgactttgtgatcccttgcaaccttcgagcaaatgcttctatttctgcttgttttcgctcactcaatggtggaagccgaatgagattctccttgatgcgctttggatcactaatcaagagcacttgcttctcaggtatgctttctcttcttctgtgaagtttcagctttgatttgatctttgatga

SEQ ID NO: 14506 - DNA, 442 bp, Zea mays
  Clone ID: LIB3279-216-Q6-N6-G8
aaaaaatgacaatttccaacatgcatatagttcccaaatgggggttaaatgtttacaaagcgcaatactggaagttgaatggggggccccacaatattccatcattggccccatgtggattcagtaaccaagcaaacattggtgtttttgccaaagctcgggctactcatcctggactaaaacaaaggccattttagtaagaaaatacaaatgatgagaactgtttaaatgccccaagctgtccaggaaaaactgggggattttcaaccacagctcaggggcaagggcttccaaaacatgcaggggggccatttttgggcttgctagggattccttcatgaggggccctacgaggggaacaacttttgctatgactggggcgtttaaatacaggaaagccactgggtctggtacgtttcctgtcataatcaggactgatact

SEQ ID NO: 14507 - DNA, 579 bp, Zea mays
  unsure (1)..(579): unsure at all n locations; Clone ID: LIB3279-216-Q6-N6-G9
cacggtatcttattaatgagatagcatcaccgaaagaaaatccacgaataaccccagaagcagcttaggcagacacaccaccacggcggcactcgttcagcatgtctaggtagaactggcacttgctgatctcgctgccatagttgttgagacaatcttggaaagccttaaaatggatgctgcaagcgtcagcattcatcactggaggggcaggggcagcagcagcagcttctgaggcaacagtctcatgctgaatggtccggggacctaatacagcatcaacagccctgtgtgccatggcactacccgtgccaaacgccataccttgagcaatggtggacccaattcctccaaacatggagccaccaccatctcgaacaggagctggaggaggagcctggcgtgctggctgtggcgggttcctcactggagcagcacggggagctgggcgtggggcaaaccttcctgagctgcggcgaggcatancggcggcggcggcggcggcggcggcaaaaccctagcgagacggctggctcggggtgaggcggggaacgaatagagagagagagccaacgggcc

SEQ ID NO: 14508 - DNA, 267 bp, Zea mays
  Clone ID: LIB3279-216-Q6-N6-H1
ggcttgaaatttaaaactattgatttcaaaatcgtcaccactggacacagcttcacaagcgtaagagcccgaacaagccaaactacaagcccatgtcattgagatagaaagtaaaacaggggatatggatacatattggtatagggccctctgggtttccaccatgtcccttcacgggtgctatgttttaaagaacagcaccgggagaagtctcgaccactaatttacagtaacataaaatcaagttgcccaagaaaaagaatgaac

SEQ ID NO: 14509 - DNA, 382 bp, Zea mays
  Clone ID: LIB3279-216-Q6-N6-H10
gggggagtagggacccgtaaccggttagggatttccctcccaggaacgtttgcctcgtccgtccgccatcaccggacgtgacagctaaaataatttttttacaaccgacggacccgagagggcaggtcagtttcactcgtacgggttccccaaggtcttgaggagctccgggatgtcgtgagcgagcatgtcgtccaccgcctgcaccatttttgggttcagcttttcaaacttggggatgctgtacccccccaacacctgcttgaagtgctcgacgtcgggaaagtctccgggggggagatggtattccctctgcacctttgcaaactcctcgtttaagttgtctatgagtcgctgctgagccttggcttttcccatcatt

SEQ ID NO: 14510 - DNA, 524 bp, Zea mays
  unsure (1)..(524): unsure at all n locations; Clone ID: LIB3279-216-Q6-N6-H11
gtaagtaaatcagagttgcatacattttttcggtcctcgtaccacgatcatacacaagcacatgcatacacacacgtatacatacgatagattacgtagccacgcttattcgtgcatcacacgcgcgcatatacatacatacatgtatacgtacgtacgtacgcacaacacggcgggcgtgcaggccggccggcgctcgatatcactctcacacgcacgcgtagcaaacggggagggacgacgatcgatatgggaggatcaatcagctagccgaagaagtggtgcttcttctcgccgccggcctcctcggcctccttgtggtccttcttcttctcgtggtgctcgtggaaggcgaagccgccggagccgacggccgccgccgccgcgacctcctcctcgatcttgtggcggtgcgcgtgctccgggtccttcttcgcctcgtgcttctcgtaaagtgcgaaggcgccggcggcgatggcgccggcctcgccgaggtgctgcccacgcgtncgcccacgcgtncg

SEQ ID NO: 14511 - DNA, 586 bp, Zea mays
  unsure (1)..(586): unsure at all n locations; Clone ID: LIB3279-216-Q6-N6-H2
aggttaaactattagtgtaactgatttcataatatcttcgtgtctacaaaaaataatcttataataacagtaagaactgacaaaacccctgttactcagaatatgggagctaggaatctaagaataaaagagaagagaaaaaagtgaagggctaaaagaaacatagtcatacagagagcaccacgaatgacagggagggcagcgtcaataataaacaaacatcacctcagccctaccaagggactcagaattacatcaaggccctggatctgtaactctgttaagcctctaagtatcaattccacaatttacatgaagcacaaaaagataaatcctagaggaatctcctaggcaaaatgccaaaagaatcatgtagaactcaagccgatgtgtaactggagaatagcttcagcaggttgttcaaagattctgggtaaaactttctagcaaaaagatagcagggtctttttgttccattccacatacatggnggtctgtgtcacaactttttatcatcacttgtaatgtgaacattctcattgacagacgttatgttctttaagaagtgatatgtaacatctgcagc

SEQ ID NO: 14512 - DNA, 587 bp, Zea mays
  Clone ID: LIB3279-216-Q6-N6-H3
ggatgaatacaaaatgttcttttttcctctgttaccgcggagtcaggcacactgtccaaaagtacatgtgaaacagaacaggtccaaccagagttattaccagactaagacgcacggaagcagattacgtacgatttacagaagcaaaggccatctggcgcagaactactaaattctcgactgatttcccccactggtcagcttgacaatcctcctcactaaaattgtgaatatcaggaaaaagtggagctgcctggagcctgaacataaatagctggtttctttcgcttttgcatcgcatctgacagagctccctgatgatacacgccttatgcatctgtccagcatcatacattactctttgccaaaatctgcgctgtaatgcgcacttgattccagctttttcgcatcatttagcttccgcacagccttcatgaagtcttcgtggactacataatctctctctgcacgaattgcagccataccagcttcagtgcacacgttccgaagatcagcaccattgaaaccttcagctagtttcacgactgcttcataatcaatttccccatgcttggcaataccagctg

SEQ ID NO: 14513 - DNA, 443 bp, Zea mays
  Clone ID: LIB3279-216-Q6-N6-H4
ggcaaacaccaaacggcggattcgtcattcagattcagggttacttgatgtccgaaaagaaagataggaaacaagtacaggtctgcagccgagagagagagatagagagcttcacgccgattctctttgcgaagcggtgagcaaactacaccaacctatcctattccttcgtcatcgagctagactttaggcaggcagggaacctcacatcacatcttccacgtatacgcgacggggctgcggacgacgtgctcatcgttgacccaggaaatccacccgaagtccggcttcgcgtggccttgccgagccctggacgcaaaggtgacatagtacctgagcttctggccggcctgcctgaacgtgagcctcgccggcgtcaccgtgacggcgacggactcggggccgaccaccttcacgtcgtagaccgacgccgcggggccgac

SEQ ID NO: 14514 - DNA, 552 bp, Zea mays
  Clone ID: LIB3279-216-Q6-N6-H5
caaaaagaaatgagaggcgtagtagcatccacaccaacagaaacttaaatgtcgccaaatacaacagaccaatccacacactcctgatgccactgttgcattacaagtcaaagggggcacacacaaaccactatcagtcacataacacaaccaatgagaagcgacaaatgtacacgtatcaagcggcaaaagctgcccgtcttccaaaccatactcagtttcccaacgacgaatcaacggattagacggcgaaatatgctgctgtgctcggcctactcatcatcagtcagatatgccaccttttgtctgcgccaccagacgcgctgtgaggagaagggccactgcttttcacgccttgcggagcttgcgatgacgacgaccgctgcatgcgaggcgacgagtcgtgcttgccgttggtcatgggcaacgagtgcctcttcctcgcggcgttgctgtcctgcacgtctgggctcatcttcggggacgacgccttggctcttgcggactctgtgaactgcatgtagctaggcaacgggttgctgttgctgttgc

SEQ ID NO: 14515 - DNA, 510 bp, Zea mays
  Clone ID: LIB3279-216-Q6-N6-H7
aacaacttcttaaatctgtgatttagagagctaaaatttacataactattggagttgctcttacagtgttgcatacactgctaagcttacagcaaaacccaacagggcgccgactgtgacctgaagctccgtgtggccaacagattcactcaaccggtaatcctcctctacgtaagcctgtttcagctcaggctctgacccacggagcccattcacccttggtgattcggtgctagaaccgcgcttcaaggaggggctcgcattggagctcgcttcctcggtgaccgaaacaaactcaggagctgccatgtccacttcagaatactccagaggtgccttctctttgaggatccaaaacctgttcaagaccttggcgtggttgcccacttctcttcttactccctgagcatcatacattacaattgctgcaaacaccactgacattccaaatatggagtctgcaaaccccctttctagcccaagcgaagtagcaactgcaacaacactcgc

SEQ ID NO: 14516 - DNA, 399 bp, Zea mays
  Clone ID: LIB3279-216-Q6-N6-H8
ctatcaaaaatttaatcagcccccggccgggtgcgacaacatataacgggggggcaatacaatagcccaaatctttaatctggggcgggggttttcgggttcaccaacctagggcccttgatctaccaacaaagtttcagggaaaggacactttggggaacttaatttattgccacgggttttttcccccggccgaaaggggggaactagttttggcactggccttaaactttttaagcttgcctcaaaccctgttttttgggggtttaagtttatatatgcggaccatccaatggggggttgaaaatacctcctaaaaatgggttagcttgaaaggcttctttcctatttaaaatccccttactctggaaaagccttttccataagtctccacaaacc

SEQ ID NO: 14517 - DNA, 579 bp, Zea mays
  Clone ID: LIB3279-216-Q6-N6-H9
gcttatactcaggctacacaatagtctctaactatccatgccaggtccggtttgcgcctgtgtctgcaactgacccagcagtccggcttgcagttgcgcttgtgagtgcccctgtgattgtagttgtacctgaggttggggttgggaggtttgctgggctgatgattgcaactgcgcttcttggggctgcacttggggctgctcgtggacctgcacttgtggggattgctgcagctgctgatggacctgcaattgtgggggcaactgcggctgagggtgcagatgcacttggggttgcagctgcggctgagagtgcagctgcacttgtgggagctgttgtggctgatggtggagctgcagttgaggttggagggagtgttgtgtttgcgaatgcaactgaacttgagattgcatgggttgctgtggttcagtatgcagctgaagttggggttgtgcttgtggtagctgtggcggttcttgttctggctcctttggcttgggggctccgttattcatccttgctcgagcctcagcaaacatcctttgttgctcagcaacagcttcttcctctgtcatctc

SEQ ID NO: 14518 - DNA, 484 bp, Zea mays
  Clone ID: LIB3279-217-Q6-N6-A1
aagaaaacttgcacaatatatttccaccggtttccctgaatattttaacaaagaaaaacgactagtaacacaaggacgttcagtttaatgcacgacagttaaatgcccagagcatcagcaagcactgatacattatgtccgcaagtcgagcaggaaaatcacacgatcaagcagcaatatcctcgggagggcactgcgcaggttgggcatcagaagacaggtctgtgatggacatcagctttgatctgaacttatccgccccatcgcccagcttcccgttttctgcaatggagatcggtgccttcaccgtctcgggtgaaggtgtctccggaatggtctgggagattgcgatgagagactgacgagctgcttccctactgaactcggttggtgaaggtgaggccatcaatcgtaggcagcgagcgataaagtcggactatgtcggcacggatctccactccgacgcagtccccccacgcgtccg

SEQ ID NO: 14519 - DNA, 470 bp, Zea mays
  Clone ID: LIB3279-217-Q6-N6-A10
accaccagtacaatgcaacaatcatcatgtatcattgttcaaaaaaggtttcagcatcatcgccatcatcaagggacatcggttctcttctacgtggagctacagggagtaagagtaaggctaacagtaaaaacgcgcctccggctccgggaggagccaaagatggaatgtgcgaacagcagcagcaatcctgaaacaaaaatacagcagtgcagctaggcggcggctagcgcacagtacacaaaaagaactggcgatttggcaggagttattcgatattgtccacggtcggtcgggagatcgtatacttctgctgtgtgcttggtgttgccccttttacaggtacttgaagagcaggccaccctgggtggcaaagaaaggggcaaacacgagggactccacggccatgagcttgatgaggatgttgagggacggaccggaggtgtccttcagggggtcaccaatggtgt

SEQ ID NO: 14520 - DNA, 534 bp, Zea mays
  unsure (1)..(534): unsure at all n locations; Clone ID: LIB3279-217-Q6-N6-A11
agggcgagctaaagttaaattgtaatttacggcggcaatgaaaattttcctcctgcccggggatccgccccgggatatacagctctctggttatgcatatgccctacacgtatatgtacaggctcggcaactctattgcctcgcgcagtctgccactagtatttcactctcagtaatcgcacgactaacactgctgcatcatgaaacttctgcgcagcaaaaattagactagtagatgctggggtggctccccctccccctcacatcatattacatcaggcggcgctgcagttcacgtcctcgggctcggcgacattgtagtagagcgtggacgttctgtcgtcgaacttggagacgacgtggtgcggcgtcagcccacagtagcacttgcggaggcgctggatgcagatgtccatgatcttctggaacatgtggtcttcctggatgaagggctgcttcacgaactcctccagcgccatccacttngctgcctgaatctctgtctcgtcaatcttgatctcactcgacacaggc

SEQ ID NO: 14521 - DNA, 582 bp, Zea mays
  Clone ID: LIB3279-217-Q6-N6-A2
aacagttgtgtatgtccgtccatatatttctcagcaagagcgctgatcagggtgcctccagataggctatcggtaacctcaaaagctttcttctcatcaggagtaaaatgtccgaattttccccgccaaccatataggatcattttagcatgtcacatcttatagttgaacccgtaagatgcacctggcttcaacgcggcaatgaaaccactaataacaaagaaactgtctactagtatacatttgtattgttatgaatttaggattttctatatttgacttaataaaaaatagtagtaaattcatgactatacacacacacatagtgtgtgtatatatatatactaggtatgtgcccgtgcgttgctacgagagttataaattcgaataaaacatagatacgaaatactaaacatcactacaatatgtaaatccgtatgacaaaatatcactataacactaattttatatcttcgtagcaagaattttacatatccctatattagtgttactttgataaaaaataatgtagaaaaatcaaatagctcaattaaagagtaaaaggggagctaaatataggaa

SEQ ID NO: 14522 - DNA, 624 bp, Zea mays
  Clone ID: LIB3279-217-Q6-N6-A3
gttataataatttcgatgctttactcccaaaatttatacggtaatacaacgtaatagcaagcatatagatatataggctatggtcgataatacatgtttttgttacttgagcatcttcttgtagtccttgaaagtgcccgagaacggggtcaccctgccttccgacaccacccaaagctcgtccacgcttccagtgataagatgctcatcgtgactcaccatcagcacccctccctgaaaaatgagtaaaccctggatgagcgcctcaacagcgtccagatcaagatggttagaaggctcgtcaaggagaatgatgtgcggcttcttgaaggttattttcgcgaatgcaaccctactcttctgaccacctgataaagtgtacatagattggagggcaaggcttcccgaaacaccaaacgaacccagatgtgccctcaacttctgctccggcacacccggatagcacttcatcatgtacaaaaggggattcaccgtcaaatcaaggccatcaacatgatgctgattgaatacagccatgcgaaccttgggagagcgaaatactgttccagaagttggctgcagatccccagaaatagtttcagtatagtggacttgccaatgcca

SEQ ID NO: 14523 - DNA, 566 bp, Zea mays
  Clone ID: LIB3279-217-Q6-N6-A4
aactattggattatttgcgctggattatataatctggagagattacaatctgaaacaaacaaggtctaagtcaaaccctggaaaactcaggcttgtgttgcgttcatttataagcaactacgcactagattctgtactgacatttgagagctatagattgcgaaatgtggatgaagcgtgtgccattgatccttatttctgagacgcgatagatcttgtccgacgatgtcgtcagacatcaagcggattctcttcggccgcctttggcttgctctccagaggccgcgcgcgcggcgcagcctcgagcagcagcttcacgacgatcctcatggacgggcggttgatcggcaggctggacgtgcagagaagcgcgacgtggagcgccctaaccatgtcgtccctgctggactcgccggcgagcctcgggtccagcaccgagtccacgccatccttctcgatgccggtgtgcacccaccgcaccaggtccttgtccccgagctccgccccgacgggcttcttgccggtgacgagttccagcatcaccacgccgaagctgtacacgtcgc

SEQ ID NO: 14524 - DNA, 562 bp, Zea mays
  Clone ID: LIB3279-217-Q6-N6-A5
aggctaaatatttagagaaaatatattaccttgacagcttcatcacaaatgtttagagcaaggtcatatgacaaggagcaagcattacaggtccgtgaacacatttattccctcttgtgccaacagaaacagtccgcaggacttgagataccaaacatagacaaataagcagacagcttgccttgtcttccccctattatgatgctccgggacacaaactcgtaggaaagctatttcttgccacgcaacttggttcccagggccctctcgagcttgctaatgatctgctggttggggattgccttgcctgattcatactcctgaatcacctgtggcttctcatttatcatctgagcaagttgtgcctgtgtcagcttcttatcgagccttgcttgcatgagattcttcttcagatcacttggaactcgctcatgggcgaggttttcggtgtcgtcgtcgaggcgcttggtgttgagggatgtaccgctggatgccgccttgttcgtaccagcgttgtacttcttcatggtatcgatctccgcaccggcgcggcgcgccgcgt

SEQ ID NO: 14525 - DNA, 481 bp, Zea mays
  Clone ID: LIB3279-217-Q6-N6-A6
agaaaagctgtttttcactggaaccgaatccaaaataacgaatacagaacaacgacgctaatacagcctatttgtttgggaactagacattcatcaaatccccggggatgatgggtacccgcgctcgccacggatgcggggggcgagctggatgtccttgggcatgatggggacccgcttagcgtggatggcgcaaaggttggggtcctcgaagagaccgacgagggaggcctcgggggcctcctggagcgccagcacggggtggctttggaatcggagggctgtcttgaagtcctgcgcgatctcgcgcaccaagcgctggaagggcaacttgcggatcaacagctccgtgctcttttgggacttgcggatctcgcgcaacgccacggttccgggcctgtacctggggggcttcttcaccccgccggtcgtcggggccgacttcctcgccgccttggtggcgagctgcttgcggggggcc

SEQ ID NO: 14526 - DNA, 552 bp, Zea mays
  Clone ID: LIB3279-217-Q6-N6-A7
gcgtatgcaaagtcttaacataaatatagcagttcaatgtctcaaatatatggcatcaaatcctccaaggtacagcgatttaacaatgacttaccagttgcttacaaagtttttggaagccacagaacttgaccagaccctcttaacagctgagcatcatattgagaacaccatggtaaacggctcgctcaacttcccgaagaatttagagaggcgtactgggccttcctcctcgctttcactgcctctgcgcttggaccttgaccggctcttcttttccttccttgttctcttcgatctcgaccgtgatctggacttccttgaacccctatcctcatcgtcgctgcttgaagattctgaagatgaactggaacttgactctgatgaacttttgtgctttctcctctttttacttcttttctttgcgtccttatccttcctctctttcttggaagatgatgattttgagtttgaccttgagtgatttcttccgtttgctagcttttgagctctttcagcatccagttgagctctatactctctcatcatttt

SEQ ID NO: 14527 - DNA, 395 bp, Zea mays
  Clone ID: LIB3279-217-Q6-N6-A8
ggcaggccccccaggtacgccccgccgtgcccagcgagacggccgcggcttgacggcgcttcttggggataatagttcgtcccgccgcgagatgggatggttagggcgtagcaattcgtcccgcagctgcagctgccgtgttaatgttggtaggcttggtctccatgcttcatctaattgttgtcgtcgccgtcgtcgttgctcaattaattaatggagtaattaggaggatttgatgtgctgtcttctgtgctgtgttgtgttcagttcagtttcaccgtgtgtctctggtgttattatgtgctggatctgttgtaagctaagctagggagcttgagtgctgtgttggtcgattaattattataagctgctaatgtggatgtgtacaattaatt

SEQ ID NO: 14528 - DNA, 208 bp, Zea mays
  Clone ID: LIB3279-217-Q6-N6-A9
ccaaaatatatgtgattctttgttaaaaaaaaaaagaagaaataaaaaagggaaaaatatcccctcgacctgatcccccgccgccctcctgctttgatttttttcaggggccttattttttacgcgcgggcccagccttaattttaaagccgccgcaccgacaagcttttttccatttccctccgggcccggggttcctttgctggcc

SEQ ID NO: 14529 - DNA, 558 bp, Zea mays
  unsure (1)..(558): unsure at all n locations; Clone ID: LIB3279-217-Q6-N6-B1
gactgagtactagatatcactaggtcaggtaagtaagcaatacatcacatgaactaaaagtaccaaggggggcaatggttgcctcaatcctttgtggacaaacactaagaaacaaatacttcgacatataagttggttacagacagagacaggcaccatgacacagcacgaccatgggatccacaggtaaacgtcctggtagacaggtagttatatgattcgaacaacaccatctcgtatcattaccctgtttgcatcttgcatcctctccaaaataaactctacttggcttctggtgtaaaggtgcagttgactccctattaaccatctgctcgatttcatcaattgacatttgatctatatggtttgccaacacatgctgacccagaagtgcttcaaatgcttcaattctctctgcagaaacattctgatcatttgatcctacatccacatccattggatcattgccagagcttccatgcccatccacagtgccaccggttgcacctgcatcatgatcagcttgctgtttcatctncattttctttctgtctctct

SEQ ID NO: 14530 - DNA, 515 bp, Zea mays
  unsure (1)..(515): unsure at all n locations; Clone ID: LIB3279-217-Q6-N6-B10
ctttttttnttttttttcttttcttttcttttctttcttttctttcttttttttcttttttttttttttttttttttttttttttttttttttttttttttttttttttttttttttttttttttttttttttttttttttttttttttttttttttgggggggggggggaaaaaaaaaaggggggggggaaaaaaaaaaagggggggggggccttggaaaaaaaaaaattgggaaaaaaaaaagggggccctaaaaaaaaaaaaggggggggggaaccccccccaaaaattttggggggggtccccaaaaaaaaaaaccggggggggggggacccaaaaaaaggggggggaaaaaacaaaccggggaatttggaaaaatttggggggaattttttttttaaccggggggaaaaaaaaaaaaaaatttaaagggggggccaaaatatccatttgtgaaaaacacgggtcttttaaataaaaaagaaaaaccacaacccccaaaaagggggggaac

SEQ ID NO: 14531 - DNA, 92 bp, Zea mays
  unsure (1)..(92): unsure at all n locations; Clone ID: LIB3279-217-Q6-N6-B11
ggccgccctcttttttttnttnntttttttnnttttttnnttttttttgttatgtaacgtgttgtgtaactcttatctctttgcggtacgct

SEQ ID NO: 14532 - DNA, 640 bp, Zea mays
  unsure (1)..(640): unsure at all n locations; Clone ID: LIB3279-217-Q6-N6-B2
ccagaacagctcaccagcaaatctcatcaactcacaccgcgtccacggtctacaattgcaaatggcacgaagaaaaaaataatttcgagccatgatcagtaaacatccatcaaatagccccaaacatggtggaattcgtcatgacaggccacgcacgcataaataacaccatccagcacgccaccatatttttacactacaaatagctgcccggagaacagggcagaaatggacgacaatctaaggtaccactaaactcagcaggaaaagctttacaaaagaggaagcaagatgatgccagcagatccatctccattcgaatgtggcggcgccaggtgatgatttccgggggccagggaagaaccaaaacctaacttagagtgagcgatgtcactgtcaatcaccacacttgtgtcgcgggccgtcacaagagaggcagggcgctgcggacttgataaatatagcatcatcctctcgtcatctaatcgtttaccttttctccctatctcctacaggtcctaccagtctctgcgctaacgaatctcctncagtgctgcaggccagagtcaccttgttggctgatcagatgcctggttggtggcggtcgacggtgccgctgatatcgctggattgcggtgcg

SEQ ID NO: 14533 - DNA, 590 bp, Zea mays
  Clone ID: LIB3279-217-Q6-N6-B3
atatatatagcatcaaaattatgtaatgaagagtagcactgattattgttacatgacgaaggttgagcatccatggaggctagattatagacagacaccctgattttacatgacgaatcgcaagaagcgcatgcattggatatccttagccggagagggcgctggtgttgtagacgaggagggcgccgccgccgaggatcccagcgagggtgacggcccagatcagaagcccagtggttccaccgacgtagacgtcgccggtgggagaccagtcatcctcgttgtagattgggctgtatccgtcgacgttcgcgccgtacttgtcgacgaactggtacacgcccttgcccttgccctttctcccgttggcgtcgacgtcgacggtcaggccacccccaatcccgtagggcttgtcggtcttgatcttcttcttggagcagacgacggcgaaggaggaggcgcggcggccgaggggcggcaggccctgaggcgccaccgccagagctgacgaggagatcatggaggccgccatcgccgccgctgctgctgctcctagctagctgcgtgcagggtgtgctgctctcgctcgc

SEQ ID NO: 14534 - DNA, 590 bp, Zea mays
  unsure (1)..(590): unsure at all n locations; Clone ID: LIB3279-217-Q6-N6-B4
ccggtactaatactgttctgaatacaaacatcgtatatcagcaaacactggtcctggacaaatcaactcgcactatctagaagtttgagacgattaaatttcctaagaatctactcaatattgcatctgtctgttcaatactccgcagatatatcagacccactaccacttccaatacaactgttgtttcgtctcttccttttgtgtcaatgagaactgaacaaatgtgacatagcttcagtcccagaaccttagcgatgcacaaaccacacttgaccacaacacaactgctagcatgggaagttcgactgctcttgaacttcaccaacaggaagttctactgcaaagttagcttgagcatcagcagccgaattatattccctcaaaacatgtctgatttgaaataaatgaaatgttccctttagctccttcactttcttgcagaagctagccatattatcattcttaacacgccagatatcttggacctggttacaaacaagcttagagtcgccttgagcacgaatatacttgaaccctttcttggctgcatatngtagccctaggatcaatgcacgatattcagcagc

SEQ ID NO: 14535 - DNA, 561 bp, Zea mays
  Clone ID: LIB3279-217-Q6-N6-B5
gcccaggaatcatttcaattatcgaacgataagattggattacattcgaaacaacttcaagaatactactaacaatagtccaacacgtcacagacaaggaactaaacgaaataaccctaacaacaaacaggcatccacgacagcaaggagaagaggcatccagcctagcctccgaagccgtagagggttcggccctggcgcttgagcgcgtagacgacgtccatggcggtaacagtcttgcggcgtgcgtgctcggtgtaggtgacggcgtcgcggatgacgttctcgaggaagatcttgaggacgccgcgggtctcctcgtagataagccccgaaatgcgcttcacgccgcccctccgagccagcctacggatcgcgggcttggtgatgccctggatgttgtcacggagcaccttacggtggcgctttgctccgcccttgcccagacctttgccgcccttgccgcgccccgacatcgtcgctgccggtgccctgtctttcacgctctcctcgcctcgaagaaatgggggatttttttgggaaggtgcggacgcgtgggtc

SEQ ID NO: 14536 - DNA, 586 bp, Zea mays
  Clone ID: LIB3279-217-Q6-N6-B6
acagcaaagactcaagtttcagaattaatgatctttgcagcattttaacactaacttattcagtttgtggatgatgttatgtttgcagcgttgatgacaagagactaggcagattccgacttggtgtacatccttacagcgacggccagacccagtattgcgagggggaccaaaaactggaggatcttgatgacgaactcctgggtcttgtcctggttgtaatgcggctgcttggggggcgtgtacttcaccttggtgggtatcgtggctgcatcaatctcacccactaagtactcgtccatcattgcacgggcagtgctgctgtgccccacatcttcgaaatcatcggtagcatccttggcagtggaagacagcagaacatcatcgcctccagggtgatcctccagaaacttggtcacattgtacaccttgccgccgatgacgagccagcagtcgtccttggtgttgtgcttagccacctcctcgagggtgtacaccttggatcccgacatcctcgtcttcctctgttgacggtcaaggtggaggaggcggaggcaaggactgccggctgcaggctgttgctgcc

SEQ ID NO: 14537 - DNA, 466 bp, Zea mays
  Clone ID: LIB3279-217-Q6-N6-B7
cacagaaatcagtttaacttatgatagattgccatcttttgcgttctggggtaccattacaccacatgctcataggttcgacacatcattcacatcccaaactcaaacttcataattcattcaaacacagcaatggagcccacctacatactaaagtaaacactggagcaaacgtccctgacaccgcaaaaaaggcacagtttgcggcttgataccttaaatctcctggacagtcagacctggcgggagcgactgcttgagcttgttggccttgtcggagtcgtggacgcagagggtgtagaggtacctggagcagcgcaccttgaacttgacggcgtccttggcccgcttgatccgcaccgaccgcgcgtccttccgccgtgccgtcagcaggaagtccttgatctcgtggatctgcttcggcattgtggtagcccgggcggaagacgctgcgacgcgaacccga

SEQ ID NO: 14538 - DNA, 625 bp, Zea mays
  unsure (1)..(625): unsure at all n locations; Clone ID: LIB3279-217-Q6-N6-B8
gagattgacaacattgttctaccattagtccaccttaatgaagccaggagggaagaacccacaagcgaacgaccccgtacgaagtccctatcgtctcctctctcctcccctcccttatggaaacctcataattactatacctaacttcgcattcaaggaagttcctttttttttaaagcaaggcgaaaataagctagagaaagggggggaaggagcaggaaagggacagggttctagctaggactcatccccaagcatactgattgttgattgattcacggcgcttcaaccatggcgatgtctgtcggtgatcagcggtgacattgagctccttgagatggtttacttggaacagggccattccatgcggaattgctgatcacatcagtgagcagctgttggcgttctcgtcgctgaagatgttgtaaggctcaacatgcgagtgcgggggcagcactgggtagcccattgggtaatgcatcggtggccggccatagccgtagcccattgccgccgggtatcctaaaccgccgttcccgtgctgctgntgctgctgctgcatcatcatcatctgctgctgctgctgctgcatcaaggccatgtactgctgctgcgccacggggtt

SEQ ID NO: 14539 - DNA, 489 bp, Zea mays
  Clone ID: LIB3279-217-Q6-N6-B9
gggcagactttaaaataatcagttcaacggcgcccaaaagggacataagtctcgaggagctttcaatttttgccgctactgatagcagacaaaggcacacccgcaaggggcgctcgacgttgaccctacccaaacaacagggcacgccgcagcagagcttaacagtacacaataacagtaacaaccgcatacaaaacttcgggatggagtgacaagtcaggtattgcaaaagcagataccggattaacgaccggttgcatcatttctttttggcagctgccttggtaaccttggcgccggtcgggtccttcttttccacacttttgatgactccaacagcaactgtctgcctcatgtcgcggacagcaaacctaccaaggggaggatactgcgaaaatgtctccaccaccatgggcttggggggaattattttcaccataccagcatcgccgttcttcaagaacttgggctctttctcaagctccttgc

SEQ ID NO: 14540 - DNA, 604 bp, Zea mays
  Clone ID: LIB3279-217-Q6-N6-C10
aactcttgtctgaaatagtgaaagaacacaatataaaatatcattatattaattcattaagagacagatagtaagttccaatattagtgagctactaccttaattgcacttgtcaggactccatcctttccacatgtgttcagccatctgtattctcctttaccacttctgcaattcaaaacgttcatccaaagttgtctgatagcttcttttgcagccttcagtaataacttgtcatgtgatattgatgtcttgcgatgctgatctctatagagctcaacagcacactgtccatgaggcagccaatccacaggagcgacatttactgcttccgcacagttgaaaccacagttgaatccagaatggtatgctcgtggtagtgtcagaacaaactcacctgacttctgaacagcacggtaaacagaaactccttctgctttcagaacagatggagataactgtgtaaccagctcatgaagtaggtcaggctgctcttcaaacagtttgggtaagttttttctcatagattcttccagctttactgcctcaccaccagggacaccataccaaacttttggttcaccaaaatgcatataatttaaag

SEQ ID NO: 14541 - DNA, 607 bp, Zea mays
  Clone ID: LIB3279-217-Q6-N6-C11
agcaggaggaggagaagtgggtgcccgtcaccaagctcgggcgcctcgtgaaggagaaccggatcaacaagattgaggagatctacctgcactcgctgccggtcaaggagcaccagatcgtggagaccctcgtcccggggctcaaggacgaggtgatgaagatcacgcccgtccagaagcagacccgcgccgggcagcgcacgcgtttcaaggccttcgtcgtcgtcggcgacggggacggccacgtcgggctcggcgtcaagtgcgccaaggaggtcgccaccgccatccgtggcgccatcatcctggccaagctctcggtcgtgcccgtcaggaggggctactggggaaacaagatcggccagccgcacactgtgccctgcaaggtcaccggcaagtgcgggtccgtcaccgtgcgcatggtgccggcgcccagggggtccgggattgtcgctgcccgcgtgcccaagaaggtcctccagttcgccggcattgaagatgtctttacctcgtcccgtggctccaccaagacactcggtaacttcgtcaaggcaacctttgattgtctgatgaagacctacggcttcctcacttctgagttctgggc

SEQ ID NO: 14542 - DNA, 592 bp, Zea mays
  Clone ID: LIB3279-217-Q6-N6-C3
aacatataagtatatggtgtattgctgtattacaatggaagcttaaaaacagattcacagcaggtctggtgtccattacaggcgaactgactccaagtacacaagttatatgttcgtcacaacctgggcatacatccttccaggcacaacaaatttgtgaatccgagcaaagtccgtccttatttcagataagacaggtaggtcgagtgcaaagaaacgtagcaagcgagcaacagcagaagcatgcttcacttggtccaccagtgaaggaaatccttacgcctgttgatcttcttttggagctgaagaacaccgtacagcagtgcctcagcagttggtgggcacccagggacgtagatgtccacggggactatacggtcacatccacgtacaacagagtaggagtaatggtagtatccaccaccgttggcacagctgcccattgaaataacccatctaggctcaggcatttggtcataaaccttgcggagggctggagccattttgttggtgagcgtgccggcgacgatcatgcaatcggactggcgcggcgagggacggaagatgacgccgaaccggtcgaagtcgtagc

SEQ ID NO: 14543 - DNA, 597 bp, Zea mays
  unsure (1)..(597): unsure at all n locations; Clone ID: LIB3279-217-Q6-N6-C4
gatacactanaaatataactaataaaaaaataacgatacttttttagtatcataaatgttttatgatataaatttgatccaactcaagatgcccggactctccaaaaaatgttggaatatcctataatttggtatacatcctaaaatttgcgatggggtacgaatttaaaatgtagcatgatattggaactccaatccttgtgcaaaatgaaacaggcccaaagaacatccaacagtatagtagggtagaataaacgttgaaccgtaacatcattacatattccaaacaaaaaatatattgtgccggtagaagacacctaacaggttgtagaggcgattctgtcctaagtttccatgatacatccggagctcctagtcagttcgcatttgatattcaagccttgctcgcaatgttgctggacagccagtccaggccctcgtacagaccctcgccagttgtggcacaagtgctctggatgtaccagtgtcgctgccgcaggnagtgtaatccaagcttgtcagtgatctcagcagcattcatggcattaggaaagatcttgcttttgtgcgaaaacaagcagcacagcatcacgtagc

SEQ ID NO: 14544 - DNA, 540 bp, Zea mays
  Clone ID: LIB3279-217-Q6-N6-C5
acagcaactatttttatttcacggccaaaaacaaagcttaaaaacgaaccccaataaaaagaaaacagcgcgatatttcgtccccagcccgccgccgccaccttcgccgggatgatggctccaccattcacgcgtcaccataccgccgccaaaaaccccaccagcgcgagcgcaagtagcgcgggcgcggacacgccggccgcgggcacggcggcgttgggggacttggacggcgccgtggacgaggacgcgcccgcgccgctgtcgccgcccgcggacgggccgccggcctcgggcgcgagggcgggcgagggggcctcggccgccgcgggggccttgccggcgaggacgagcttgctcttggcgccgaggttgtccgcctggaacgcgtgcttgtcgggggcgccgcccgtggaggacgcgccgacctgccacacctggttcacggccttcatccccttgcgcaggtgcagcttgccgtacacccggatcttgccgcccgcggtgttcgcggcgaggtcggtcgccgggaagtccagc

SEQ ID NO: 14545 - DNA, 585 bp, Zea mays
  Clone ID: LIB3279-217-Q6-N6-C6
caaaatatgaactgtcatttcagataacattttgtgttccaatgtgcccttcgagatggggtcagatgaagacagaaagctgtgcacacatcatcacttcaatcgacagttcgataatacagtcttgacttgtgaccaagctctaactcaagatcacaatggtagcttgaggtagatgcaggaacaacgtgaaggatcagcaaggcgggtgggaacacttcgacatcaggctttgaatcggcctcgccgggctgctcctatctcgattccgcctcttttatcgcacggatcagatgggtcatgcggtactggagcttctcgttctccatggtcagcttcttgttcttctccttttcagtcaagcattctgcagtaaccacatctagcttcgactggagatccttcacggcagaggaagttgcctcggatccaccgctcggaccatctttgttgtacagcaaggcttccagcttcgctatgcgtatctcagcctcggaggctctttcctggaagggcttgagggcctcttccagcgccgacgtcgctgggccgccgtccgccgccatgttcgccgtcggtcgcttg

SEQ ID NO: 14546 - DNA, 138 bp, Zea mays
  Clone ID: LIB3279-217-Q6-N6-C7
gcaaccgtccaacatagatttttaataaaattgtcagcgtgcgcatagctgcatgcctgctcctgcagttccgtccctcgccgacgcagtggcccacccaggctcaccgctcacgtgatgcgtgcaggcagctacggg

SEQ ID NO: 14547 - DNA, 286 bp, Zea mays
  Clone ID: LIB3279-217-Q6-N6-C8
cccggggggggaaatatttctaaatcgggaattactttattggcccaaccattccatccttttgccaaacataatagcaggaccaaaaaaaacatagggggccatagcccactagttagtctgaattgccatggcagctctcatccaacaattgggaatcccgagggaaaaaaattttgctccctgaaaacttatcccctcatccttggggggggggccatcatttgctctccacataaaacagttcccatatgagggaggccccgggggcaaatgccccggcaag

SEQ ID NO: 14548 - DNA, 478 bp, Zea mays
  Clone ID: LIB3279-217-Q6-N6-C9
attcttgaccgctgctgtcaatcgctccggggatgctccatgattgcaacgagaaaacaagaagcaggcgtactaaaatctgagctgagaaccaacgcagggagcacgaacgtggagatcgatcgatccatccatgcctacggaagcaagaagagtaagatgggtgcctcaggcattcacgcgtaaaaggccaaacacatccggaactgcataaaacgggtcaaaacagagagcgcgaggaaccttaccgtcttcaccgtgaactgctgcagcggacagcgagaggaccaaggagatgaacaacagcttcctcatgttcccgcaagaaaagcccgccccggccggggggaacttgcagcgcctcggttgggggttctccccccctgtccctttttcgacgggaaatacgagaagcgacttactacctttgctgcagcctctgatccagcattcggccgagcaggatgctaaaaccaac

SEQ ID NO: 14549 - DNA, 530 bp, Zea mays
  Clone ID: LIB3279-217-Q6-N6-D1
aacaaataataccatattctcaggtttctcttgtataacataaaacaagcatgccccatttttacaaagttggaaccatatatgaatactctgcaaaccagagtaaagagaacccagtaatagtacatgcaatttcagttcaagaaaacagcctgttatataaataaacagcaaagcacaactaacttggagcagcattattcttcaacttccttctttatttcttccatgagttcatccttgtaatcctcaaacgtgccatcatatctgttcacagtcccatcctccacaacccatatctcgctcctttgctcatcctcacaaacacgagatattaatcgtgagtcatggctaaccaagacgacacctccagtgaattcatccagcgcgtctgccaatgcatcgatactttgcatgtccaagtgattcgttggctcgtcaagcaggagtatgtgaggttgagacattgatatagaagtgaacacaactcgggccttctgcccgccagataatttaacaattggagtgag

SEQ ID NO: 14550 - DNA, 253 bp, Zea mays
  Clone ID: LIB3279-217-Q6-N6-D10
gaataataaatatataatataatacgatactagaaggtacacgacaggaaatacggtccaattgaattttctacatgagctgcacataacgctccgtaaaagttatttggcactgtttggtttccaggtacagattattgagggtctcggatggctagactccagactacttactgaatcaaaatctccatcattctataaacagatacaattctggcggacgcgtgggcggacgcgtgggcggacgcgtggg

SEQ ID NO: 14551 - DNA, 547 bp, Zea mays
  Clone ID: LIB3279-217-Q6-N6-D11
aagagacgggatatatatataaccacttgcatcggttgtgttacttctgtacactaaacacacagtgacacacacacacacggacggggggttcccgcggggtcaaaacgagtcagacgacagcactgttacatcggagcacgacgggtcttgtggccgtgtccgtccactgacggtgtatatccctggcgatgttgagggcgtcggccgaggcgcccagcagcccccgctgcgagaagccgacggcgtagagcccgttcttccctttccagccgttggggaaggggatcctgggcatcccttcgctcgtgaacacgtcgcctccgtccttgagccaggacggcacgttgctcctgtaccccgtggcctgtatgattgcgtcgaactgctcctccttgccgtccgcgaacctgaccccgcgctgggtcacctccttcactgctcccactaccttaattttgccggttttgatgtgggctagcgtcccgacgtccagcacgggggtcctgccggtgaggttcttcagctcgatgggccccgtcttggg

SEQ ID NO: 14552 - DNA, 550 bp, Zea mays
  Clone ID: LIB3279-217-Q6-N6-D2
aaattgcaacagaattgaacatatccaaacatagcagttatgtaaaggctgataataccacaagataaaatggaccatccatgacacagagtcagcacaggggactctgcgtcagatcacacagctaagcactcatcattcgaacaagttcaagaaaactagataatattattatattggtgtaacactacttgtccatcctcactcctcatcctcatcaccagcatccccgccaccgcttgccttcttctgattctttctcttcacccttcctgcggggcctccaccgaatgggcttgacagtgaaaagtcaatgtgcttctcagactccaccctcaccatgaatgatgggacgttgacaatttgcctgccaaccctgatgtgacgctgcttgatcaagacacgagcatggtgaatggacttggccatgccagccttgaagacaagtgtttgaagccgccttgcgaggaagttctcagcggtgagggcaagaacataatcaagcttgttctgaccctcagcaagcagcccatagcggttcatgcggcga

SEQ ID NO: 14553 - DNA, 604 bp, Zea mays
  Clone ID: LIB3279-217-Q6-N6-D3
gagcctgtgaagctgggtttattgggattcactggcttctacagtgtatgaacagcgccagaatcggagcccgcaggcacagttacatagcaaatcccaaacctcattggcagaagcacaacctctgtagcaacattcagtattataagttcatcagggcggaaacaaaccacccacatcttattacaccacagacaagcattactacatcctagcacagcacctgggtatcccgagccttcagtggagttccttgaggaagtcggtgttgtcaaccagaaccactttccagccatctggatcaacaaaagaggcgatcttagtgttgatcccaggtagaggccctggctgccgcaaaatcttgccacctagttctttggtggccagatcaaccgcctcggcgctcttgtacacatcattggtgccaatggcaacctgagcatatgcattgcccttgctgtattctgtgactccatagttgtacgtcagctccagaacagttgtcttgtcctcatcagcatagcccaacatggcaatggtatacttgtaatcaggtacatccttcttccttaggagcttcatccctagggccttctcataaaac

SEQ ID NO: 14554 - DNA, 516 bp, Zea mays
  Clone ID: LIB3279-217-Q6-N6-D4
gaacaagatcgaccaaacagttcattcaccagctagaaaatgtgttcaaataggagtggcagaaaaataacacggtttaccagattatactgtcacaaactgttaccgaacacttaaaacaaagactagatgttccccaaaactgatgacaaagcacagctcctcagtacttgataggggcaagaatctccaactgagaccccaacttctcctcggctgccttctcggccttgacacgcagcttggccaattgcttcttcctctcgtaggcaaccttggccttctccttcctcttctcctcaagttccctgatggtgtcatggtagttccacccgacctccttagagagctcgccgaggaggcagtacttgtgtccaggctgtagcctcagaaccttaagagcgtcagggatgaccatacgcttggtcttgtcgtacggcggcgggacgccctcgtacgtcttgagcctcgccagagccgcctcccccctcttggtcttgtgcggaatcatcccgc

SEQ ID NO: 14555 - DNA, 611 bp, Zea mays
  Clone ID: LIB3279-217-Q6-N6-D5
gagccatgcttccgtcgtcaatcaggggggccaggtgaccatttcccacgcaggggctctaatcgatcacccaggctgctgacgacctaatgccacgctgcgttttctcatgcgctgctcttcattccgtcagctgtgttgccggagaaagcccagtgcggcttggccagggttcgcttcgtagccttcactgacagtgacagtgggctgtccttgcccatgaggcaggttccctgcctgacgttgcagatggggtagtcatgggggcagcagctgtagtgatcgtcgcagcaggtggcgccctcgagcgggcagcagccccaggcgaagcagtacttaccgtactcgtagatacagcagcaggtggtgctgtcagggcacgagtagtagttgtcgcacacggcgggcgccggggtcggggacggcgggctggggccagggttcggcgggttggcgccctccttcaacgggtatgacggctcaaccgcgataccgcacttgccgctggacgccttgatgttgcgctccatcctcacgtacccggactcgccccagctgctgccccatgagttcttcacgatccagtagtccttgccgttctctgtgccgta

SEQ ID NO: 14556 - DNA, 530 bp, Zea mays
  Clone ID: LIB3279-217-Q6-N6-D6
gacgagtataatcaaatcaacaagcgcaacgcaagtcaactctttcttccatcattttaggtattagtactagcacttcagggagaaactccattacacagtacagtttcaattcgagcactaacccacagggcaaggaaactctttctttcaccatttttcgttagccatttcccgatacactagcttccactaaattttcctccactagttttttttataattacctccagtaataagttgacacaagctcaaaacgctaaaatataaaaatgccagcacccaccgagcccaagcaactacgtccatattaatcatgcatctgttcactagctcgggaacttcatttcatactgttggggggtcataaaagttgctgtgatcatcttccctgcgaaccatcttccatggagtgctttctgtgcgctcatagcggctgttatactatcaaaccgcaggtacacaaaaccggcagtacttttgtctacaaaaatatgttttaattgaccaaacttggaacattcctcctg

SEQ ID NO: 14557 - DNA, 471 bp, Zea mays
  Clone ID: LIB3279-217-Q6-N6-D7
tcgcgatctaggccgccctttttttttttttttttttttttttttttttttttttttttttttttttttttttttttttttttttttttttttttggaaaaaataaaacccacttcgatgaaaaagggggggtccgggtccaggacagagttcctaccctcgggggatgaaaaccctcctcatgacagggccaggggtcaccgaagagggaagtacccctctcactcaaacataactgacttcctcacagacgacggggactaaacacaaacccccaggtgggggccctcatcaccacagatggatcgatcgccaccaactttattttaacaacacgggagcagttggtgaccacaggggggtatgccttcaaagctccaaatcatggggatgaccagggcagccacagaacagcacatttaccaggggacgatcttccagcgctgggtggcgccctcgcaccacttccaa

SEQ ID NO: 14558 - DNA, 165 bp, Zea mays
  Clone ID: LIB3279-217-Q6-N6-D8
ggaaaacacaaatttgggggccgaacaagaacaaccggggggggcaaacagttttttttccggggggggggggctttttgggaaacaggggcccatgggaaaagcaactaagtttttttaagccataattttaactgcctgacaaaggccccccggacccggggg

SEQ ID NO: 14559 - DNA, 521 bp, Zea mays
  unsure (1)..(521): unsure at all n locations; Clone ID: LIB3279-217-Q6-N6-E1
cgcccttntattttttttatattttttttttttattttttttcttttttttttttttttttttttttttttttttttttttttttttttttttttttttttttttttttttaaaagggaaacaaagggggaaccttaaggtaaaaaaaaacccaaaaggaaaaaaaaaagaaaaacgggaaaacaaaaaaaaagggccggtttccgccaaaagaaaaaaaaaaaaaaaaaaacctggggaccccgaaaaggcaataacaaggtgaaaaaaaaaagaaaaaaatcaaaaaaaaaaaaaaggggaggggcattttgggggaaaggggaaaaacctaaaaaaaacccaaaaaaactgaaatttcaaaagcagggggggaaaaaaaaccctggacgggggaaaaaagctggaacccccttggggcaaagctttctcagggggggcccctttgttcttaaacccttggggaaaaaagtttggggaactaaaaagccaaaaattgttgaaaaaaacccttttttttt

SEQ ID NO: 14560 - DNA, 566 bp, Zea mays
  Clone ID: LIB3279-217-Q6-N6-E10
agcataattgtcaattcctcaaccaaaacattatcaatgcacatcatagattcggctaacagtaaatgatcctcgacatagagcaaaatgagcaaaattaaaactccttttggcaagctaataaacagcaacgctacccagaggccagtgcaaagtgatggcaaatagcaaggatacacgcctacagcctccttcccctcctaccaccctttctgcgagtgctgtcagtgggaaccggggtaacatcctcaatgcgtccaattttcatcccagaacgagcaagagccctgagagcagactgagcaccaggtccaggggtcttggtcttgttgcctccagttgcacgaagcttaatgtgcagcgcggtgataccgagctccttgcaacgctgtgcaacatcttgagcagcaagcatagcagcataaggagacgactcatcacgatcagccttaaccttcatgccaccagtgatccgaaccaaaagatcagctagcgagagaagcaatggcgtcggctcctgcgttctgcgtcgcgctgctgctgctgctggcttccgccgctgccgt

SEQ ID NO: 14561 - DNA, 584 bp, Zea mays
  Clone ID: LIB3279-217-Q6-N6-E11
tcgcgatcgagaaccaccaccgatttgaccacgtctagcaggcttgtcagtcccagcaactacgcctccacggccacgaatcaaggccagagcttcgtggcggtcagggccgccggcgtcagcaacgggttcccggcctcggcagggtatgaggcgctgccgagcttcagggacgtgccggcgccggagaaacctggtctgttcctcaggaagctggccatgtgctgtgtggtgttcgacttcgcggacccgaccaaggacgcgagggagaaggaagtcaagaggcagacgctgcttgagctggtggactacatcacctcggccaccggcaagttcccggagcacgtcgtgccggaggtcatcaggatggtgtctgcgaacctgttcagggtgccgccccctgccccgagaaagacaaggcactcgagttgttcgatatggaggaggaagagcccgtcatggacccggcgtggccgcacctgcagattgtgtatgagctgttcttgaggtttattcagtctcccgagacagacgcgaagctagccaagagatacattgatcacggcttcattgtcaggcttctc

SEQ ID NO: 14562 - DNA, 511 bp, Zea mays
  Clone ID: LIB3279-217-Q6-N6-E2
ccagcaacaaatgaggcatgctccagcgtcaaactcagaatttggaacataagtgatcaacaacaaagtgttgatgattcacaaataaacaagtccttgctgggttacatgacgcagttcctacagaagcagagcagcgccgacagagaaaccagcaacatctaactacaacacagggcgaacatcaacacaagagaagcctacaaagggcgagcgtgcaagcctaggaggaggtgaacttggtgacggccttggtgccctcagagacggcgtgcttggcgagctcgccggggagcacgaggcgcacggaggtctggatctcgcgggaggtgatggtgggcttcttgttgtagcgcgcgagcttggcggcctcgccggccagcttctcgaagatgtcgttgatgaaggagttcatgatggacatggccttggaggagatgccgatgtccgggtgcacctgcttcagcaccttgaagatgtagatcttgtacgtctccacgctcttcttgcc

SEQ ID NO: 14563 - DNA, 191 bp, Zea mays
  Clone ID: LIB3279-217-Q6-N6-E3
ccattacacaaccccctttatcgaaaaagcgaaaccacaggagagtggaaaaggcagcggcgtccggagcaaggaagagagaccccagctggctcttggcagcggatcgtcggacgccgattcaccgtagcgcgtcgttgtcgccgggggcaaggacgaggtcggccgcggcgggggccggggcgggggcg

SEQ ID NO: 14564 - DNA, 550 bp, Zea mays
  Clone ID: LIB3279-217-Q6-N6-E4
cactgaaaaatattcaaatttaaaattccttgtaatttcgaaactccttatgtcactacaacaaaggtttattcatccaagctgtataatttcatcatcagcttcaagcacctgttaacttagagtgctccaatacgcttaggcccaattacaaaaagttacatataccaaaataaaactcgacaatgaaaattatctacctagagtaaattttgaatagttggcgccctttcacttaaaacaatgaggagcaaaaagctatgaagtatggccctttgacctgaaacattaggctaaaaatagctatcacaacacaaatactgataaaagtaaatatctctacctctactaatattgaagggaataatatttcttctgctcatgcacaacattggcacctacttcacttccaaactaaccaatcagaaaatctaccattacacgtgcattgctacggtgtctatatataacataggtaaacctgttatagggacaaaacagaaagctatgggggtgggggcaacctgcttttccatctctttggtggtag

SEQ ID NO: 14565 - DNA, 209 bp, Zea mays
  Clone ID: LIB3279-217-Q6-N6-E5
ggccttggggcattgactggtgtaaataaataaaattaatagtatagtacagctggtaaagaaaaggtatgaataaatgggggtaactgggcccaactcctaaatgagacctttgatgaccaaggtttggccgctccggggctaaccttccttttggcaggatttactttcccaaacaacttggttttggcaataagtttggactcctg

SEQ ID NO: 14566 - DNA, 457 bp, Zea mays
  unsure (1)..(457): unsure at all n locations; Clone ID: LIB3279-217-Q6-N6-E7
ctctagnagcggccccgccctttnnttttttttttnntttttttttttttnnttttttttttttnttttttttttttttttttttttttttttttttttttttttttttttttttttttttttttttttttttttttttttttttggggacacccccccaaaacggcggtttaaaaaaccccgggggaaaggggggggggccaaaccgggagaggctccccacaccgggggggggaaaccccaaggggggcaagggcagcccacaagccgggcgaggaccgcaaaagggaccctttggggcccaaaaccaaaaacaccctccccacccccaaaaaaaccagccccaaccccccgggagcccctttggggggcggccaaaaccccaggggcccaaaaaaaaccgcccccctccaaaccctcaccgaaaaaccaagggacaaaggccccccgggggccc

SEQ ID NO: 14567 - DNA, 444 bp, Zea mays
  Clone ID: LIB3279-217-Q6-N6-E8
gctgggaacgggaagcaaaaaaagcaagcgttttttccccagtctcggggattcaccgggctcgtctcctcacagacgagaagagtcaaccctaccgcgcagagcagggggaagtcggtttaaaaaccaaagaaaaccgaagaacaagggaaggggcaacacaccacaccacaccacagacgggcagggtccaagggtggtttggtcggttgttcgctcatcaaaatacaaatccctcgtttttcaacctccctttccacgcaacaaaaaaaaccctaatccacagctggctcaaagttcaaaccacacgattccccggcggtggggtgggcaaaaggctggaacggttggtggtgggtgggtgggtcaagactcaagagcaacccgagaccattcgccgggtcggcgtcggccgcgtggtcaccgcgcggcggcggcggcagg

SEQ ID NO: 14568 - DNA, 521 bp, Zea mays
  Clone ID: LIB3279-217-Q6-N6-E9
acagatggaaaccagaaggaatgctgcatagactttctgacagtgaaaccatacaaatacaaactgctaactacgatataacaagacaaaggcatgcactggtactaattattactcgggatctactccttcctgaaggttttaccactctcaggattccttagttattgagcctactcagctaagtcaactgctaacaaggaagctgcgaaacggcacccatcagtcggtcatcatctttagatctggatcataacggctttggtcctctgatagtgaccaaccaactgcagcatatgtggagtgcaggggaagccccgcgctggtgaatgcactgccgtttggtcccatggggctcccgggatcatcggagtgctcatttgatgtgccatccgatggggggctggcagtcgaggccgccccaaagacagctgtgtgcggtggcaccgatgttggctcacgtttgggttgctcttcttttggctttttagcttcagcaatgaaactgccaactacaacct

SEQ ID NO: 14569 - DNA, 308 bp, Zea mays
  Clone ID: LIB3279-217-Q6-N6-F1
aaccacaaccaaatttgagtcattgagacaagcataggataatatcacttgagaaattcacaacggtaaccaactacaaatcttagcacccaacttttagccagtctcgtgatccaactagaggagctcaacattcccgacaacagcaactaggagaaccctgatgtagcaagctaaatcatgcttcagtctgctctctcaagcgacgaatcgtgctcctgacagtgactgcactagcagtgttcatggtgtaagcaccgccagccttgaccttcccacagtccttgcatccccaaattccaactgct

SEQ ID NO: 14570 - DNA, 570 bp, Zea mays
  unsure (1)..(570): unsure at all n locations; Clone ID: LIB3279-217-Q6-N6-F10
agagaaatagatccaaagaaacatctgcatcaccatcttggattacatgactccagtgacggtgatatatagtttgatttgaacatcgcgactactcagtgcacgctctatatttcacggtatattcctttcctttccatccttccttgtgccttactacacctgaaggtcacaatccaactcagaagtgacggtagcgactttattacatccttgtgcctaggtctgtcggcaattatgtgaaaaccgagatcaaaagaaggaaaaaaaacagattgactctctcgttaattcacccatagatccacttctccgcattgctggtgtaagagaccagctccttgggttcaaaccataaagcgatctcatccttcgctgtctctgggccatcacttccatgaatgatgtttcttccaacaacaatggcaagatcacccctgatggttcctggttcagatttctgtgggtctgtggcaccaattagttntctcccatacttgatgacaccctctccttcccaaaccattgcaagcacagggccagagctgagaaaatcacacaacccactga

SEQ ID NO: 14571 - DNA, 292 bp, Zea mays
  Clone ID: LIB3279-217-Q6-N6-F11
aattaatatcaggagcatgtaaaaactatagggaaaacatgtccatatactggggcaggtatgcaaagtaagtatatgacccggtgtcgattctctggcaggtgtgccgtcgaacgcaacgcaacggtgtgctacctacctaacgcactgcgaacgcccgagaggtccccgtaaaatgtttgatggacccaatcagtggtttggaggcaccaaaatgcctcaacctataaacgcccgacggggcgtcttcaggaacggtccattccagcgtcgcgaagcttctcgggctcaa

SEQ ID NO: 14572 - DNA, 620 bp, Zea mays
  unsure (1)..(620): unsure at all n locations; Clone ID: LIB3279-217-Q6-N6-F2
aaaaatattgactcgttattgaactatttgttctctatttgttcaggattgaacttacaaagtccgtaactcttacaacaaaatgtgcaacaaaaattcacgcatctcaattctacagctcccagcctcccacacaggtatcttgagttcttttacatccctcctcaccagccatattttgcttgagtttctgctttcgtaagaatgcccttagaacgcctctccgcaagctccatctcctttgacttcatgtcaaagtacagagaaccaatctgatgtttccttttatgcaacttggatggctttccttttgctgaaggggcaggctgatagctaggaccgaaggccaaccccgtgagcttagacttatcctgctttggtctgttcttcatcagctctgcttgatttacttctaaaatctggaccggcgtatcatttctacctctcttccctccactcctacccatctctggtggcagtatcggttcatgcaccggtggcaatgtcgctgctacctcatgaccataacctccagcagtataatctactcgatatggcactgccgcaacatggtcatatccactggcatgctcccctncatgtgcatgaacataccctgc

SEQ ID NO: 14573 - DNA, 617 bp, Zea mays
  unsure (1)..(617): unsure at all n locations; Clone ID: LIB3279-217-Q6-N6-F3
ggcagtatcacaacaatgaaaatattttaccatgggattcacgatggaatcacacaaatcatccacaaggattgaattggttataatgcaaatgggactaaacctcttagggcagcagacgaagtgctttcatggtaataagttaataaccgaccattgaccacataagtcttacgcgagacattcgcaagcaaagtgactcccaaaatacttacaaccattaggacaacataaagtagacatagtagtagacaccaccaaacttaggcatcaatagatccagcacctccttactcgaaggcccactggttctccctgcggatctcctcttcctcctcaggggtgaagtcattcttgatattgaaggtcttgcgaatctcttctggtgtcttgcccttgatcatgtcagcaacagtctgacaggtcaggtcgagcagacccttgatgttcagatagtttgcagccaagatgaggtcgaaaagcgtggcctggtcgaccttgacgaagtccgcatcccagttcttgaggtcctcaccggaggcggcggtgctgttggcggaggcggcacccacgtcgtcgggaccggccttcnaggcggcggcggcggcggcggcggc

SEQ ID NO: 14574 - DNA, 576 bp, Zea mays
  Clone ID: LIB3279-217-Q6-N6-F4
aagaatcgttcgtcacaatgaacatcatagacacattttaaccatcatgtgtgcacatgattctaacagaacaccgttcagagttagttttgcaaaaacaggaaggcgaactaggaggaacatacacgcactgtgtgtagccaaggagtaggagtggctcccatgagaagttttacagcaatataccacatgactggagcagcgttttacaagacgttgaatacagatgggcttgccaaggcgccgcgccacatcaatttttacaccacgtatggaattcacctgtcctatatcgcaacagccgactgctgacgggtggtgccaagccagggatgtcgcgaatgtccttgttgtgtgggttcacaatcttaacaattattatagctatgactccagcaacaatgagaaaaagcatggccatgatgcatcgatcagttgcaacctgtcgaccgatttctttcaccaattgagatgcctttttgatggagaaatggatggaatccaactcattaacaactctgctcatttgttctgtctgtgctttcagagcagctgcagtttctgtgcccacattga

SEQ ID NO: 14575 - DNA, 548 bp, Zea mays
  Clone ID: LIB3279-217-Q6-N6-F5
gaggaaaccctaaccctaggatagggctgaaataatagccatgagttgggcctgacccattacagaggggcaagagagtaaatgtacccaaaccctaatacagttccaacacaatcatacataaagagtacatagtgtattgcgcatccgcggtctgaaactaaaacacccgtgtgctggcaaccattgtggtaccacggaaccagcgtgccactaaactatgtctctcgctgtatcccaactcatccaacttctcaggtacctacagccctggtgttgttaggcgataacaatatctttctaggatgacaagcacaagctccaaacagatagacaaaactagcttaagtcaaatatgagaaaatggccagaacatgccatagcattaacacaaactttcgaggcgtttgcagtttgatctagttgtccaacttggtgcaagagggtattttcatagcatccatttgggtttaatcactccatgagagtttcaggccacaaagttcaaggacggaggacagttctggctgaccttatcttgccatttc

SEQ ID NO: 14576 - DNA, 167 bp, Zea mays
  Clone ID: LIB3279-217-Q6-N6-F6
aggtatctcgagaaatattagaggggctaagcagaacgaagtcacaaaacctatcacaaacatttcgagccccaatgatagcatggcactgccactctgcagccatacagcacatcagctacaacaaacttggtagttggctccactaagatattcctattgcattg

SEQ ID NO: 14577 - DNA, 553 bp, Zea mays
  Clone ID: LIB3279-217-Q6-N6-F7
ggatatgtacgtcaatcttcctaccgctttattagagaggacgtattatattatgacttgaagccacaaggtttgacatcattctgaacataagtaacttccagttactgccgcaggcctattttggagcagcaacggacgaggatggcgatcatctttttactgatgcggttgaactatgcttgccaactgcagcgatgaactctaccgccacttttaatgcattaatggacgccaggttcatcaggcttgtggacgaccatgtcggctcccctccagccaagtcagacactcctcggaacacgatcacaggtatgccaggcgacgttgctgtcatcaccaccgctgcgctctcctcgtccattgtagacaccccaaactcttggaaaaggaacttcctgtattccgcgttgtcgaggaacatgtcagccgacgaccccttcagcccgtagacaatccgtggagctgtgggtaagcagaaagtgtcgttgcatctttcaagttccaccgtgagctgttctgcagttctgaaccatgccgaatgcacaggcag

SEQ ID NO: 14578 - DNA, 574 bp, Zea mays
  Clone ID: LIB3279-217-Q6-N6-F8
ggaagtcaacaagcatattttttactagcggcagtatttaacttcgcatctgtaattaataacaaaaagacaaccttttagcttcatacaaacaagaacagtaacacgaggaactcgatgctggtcactaaaaactcgtcaaaatcacaaacgagtagtaggaaattatgcagcatcaaaatcatttgaaggctgcgatttcctccctcaaacgtgtgatgaagccatctacactcgttgtgaccaggtcagcattgtctcttaccctaacgcatatatttccagtctcggcctcttgtgcacctacgacaagaatgtagttgaattgggccagttgagcttcccgtaccttcttttgtattgtcctgtcactcgcgtcaatatcaacatgaaaaccagcttcatgtagagtggcaagaacctgtttcgcatattccactgaaccagaagataccgagcaaacaatggcctggcgagggcttagccataagggccatttaccattgtaatgctccaaaagaaggcaagcatcctttcaaccgaacctaggattgccctgtgtatcatcacaggc

SEQ ID NO: 14579 - DNA, 522 bp, Zea mays
  Clone ID: LIB3279-217-Q6-N6-F9
gaactctatatcttggcacatagagtttatctttatataatttcatatgaaaaggttatgagtgtgtcgattggggataataactttcagggaaaacatacctatcattgctagtttaaaagcatctggaagtgatatgtgtttttggagcaggggatttttctacatcctacagtatgagataaaactacggcgtgaaggaaagcagttgcagttttcatgtgcactccagttcaaacttcaaagctcgccagcctccttttcagggactcgttctccttccggagcctcatgaccttctgcttcagcgtctccacgtgctggaccgaaacaaaatccctttgctgctccgcctgcttaatcctcgggatcctcaactcgttttccacattctgaagcttcctgtgaatgccctttttctcctcttgttcaacaaaaaccacatccctcaaatcctggatctcatttttatactgcgaatgcacgtcattagtaacctgctccaacctgctacctaacatg

SEQ ID NO: 14580 - DNA, 503 bp, Zea mays
  Clone ID: LIB3279-217-Q6-N6-G1
aaaaaagcgttaaaggaagacttaaaaatttatacctcaaaaagaagagcattgacttctatctgtcacgttcgtgagaacgagattctgattgcaggacacacggcgtctgacttaccacagtatctctaaaaatctcatgatggcactacaaccagttgtcgcaaatggtatagatcctcaatcgaacaggaacaccaaattagcgactctaacgattgggcagtacaaacatgtgccatagttggaatgatctaacactggcagctctgtacaatcacatggtttcattggatacatgaccggttcgtgtcaaggtctctctcagcgaacaggttttacacctcaatctggaggcttcatcgggccactctactgttcaacctggagttaatctgaaccgtgtagctagtggtagtgcatctgcccgacatgatactcagaaagcttgctacaaccatcatggccgacgtggtcaacactaacacaactcaccatttgct

SEQ ID NO: 14581 - DNA, 600 bp, Zea mays
  unsure (1)..(600): unsure at all n locations; Clone ID: LIB3279-217-Q6-N6-G10
ctagtaaataaacgaaataatttatctgagatgcggaattcgctatacaagcataggagggagcaatctaagcacaatatcgaattaaacagtgagcccagagtaagaaacaggagcgaatatccgtctacatctagatatgaatggagtattacacttaggtatttagcacatcatcatccaccgtaccttgttcccctgccaagttcctactgaggtagactcataatcagtctttcgaggaactggtgcttgcgacactcttcttcacaccgtatttctgtttcccgatactgaaaggcacatatttgtatttgatcatatgcacaatctggcgcttcattgtaaggacaaagagaacaacccagtagcagaggagtataggccagaagacaggaacgtcaaacacagagaagaaagtcatcacaaaagctacaacaaaagcttttgtgattgcataccagaacttgaactcggggagacgcctgatgaagggcttgaactcgtcagacccccggntgggcagcgccggccccctcgcggcggcggaggggtcgagctcggggtcgaccatgggggagaggaaaccgatgaggagtg

SEQ ID NO: 14582 - DNA, 513 bp, Zea mays
  Clone ID: LIB3279-217-Q6-N6-G11
agtatgccagaattatatattgcactgctcagatcaactttcagatgacaaacattccatacagtcaaaaggcgccacggcgcttaaggacctactcgaaaggagcttaggacgaggtgaacttggtgacggccttggtgccctccgagacggcgtgcttggcgagctcgccgggtagaacgaggcggacggaggtctggatctcccgggaggtgatggtgggcttcttgttgtagcgggcgagcttggccgcctcgccggcgagcttctcgaagatgtcgttgatgaaggagttcatgatggacatggccttggaggagatgccgatgtccgggtgcacctgcttcagcaccttgaagatgtagatcttgtacgtctccacgctcttcttggccttcttccgccccttcttgtcaacaccgccttccttgccggcggattttcccgccgggagccgcttctccgccttcggcttcttcccagcgggggccttctccgccggggccgcgggct

SEQ ID NO: 14583 - DNA, 430 bp, Zea mays
  Clone ID: LIB3279-217-Q6-N6-G3
aaccgaaaaaaaatagggctgcgggggaaaaataccacccccaaagaaactttgggaccccgggaaaacaggggggggcctaacaccacccagggggccccccattccccatcagggtttattaggccgcgcccaaaagaaagggttaaaccccccggaaggtttcacgcccccccccgggaagatccaccccccggggccggccgaggaggttttttggggaaaaaaggggaaactgggcccctaacccttcggtttgaacccccaagcgaactgggggggaaaatttcaggccccccccccccaacaattccccccagataggggggggccctatggccccattgggtttccgggcccccccccttccaaatgggcccaaacatttccatatcccccccttatgtttggggccccccccccgggcccc

SEQ ID NO: 14584 - DNA, 439 bp, Zea mays
  Clone ID: LIB3279-217-Q6-N6-G4
agactacaactagcatccattaactcattcaacttaacacaaactagctcgaacacgcgggctacgctgcacggacttaggaagaagcagcgcttgcattgctatgctacattatttcgaatagtaaaagctactggggataaaaaactacagggcacacggggattctgaacaatgtcaaacaacgtgagcagtgccagacggatcgcatgggggcctccgatttattcggggacgacggggatttctccgggttcgggggatcatattattccggccggagatgcgggaacgacgacgctgcccatgctctccccgcttgggggggcacaccccttggcgtcgtgcttgtgcaaaatctctcgcgccagtttctgcaccgacgcgttcgacgacccgccgttggccacgccgttctggctcagggccttcgcctccg

SEQ ID NO: 14585 - DNA, 583 bp, Zea mays
  Clone ID: LIB3279-217-Q6-N6-G5
gaacacagacaagacaatcacaacttcaccagtgaatgaagggtctcaggattacaacaagcattgtctagagttcgaaatggtttgaatgtagacaccgcacgagaattaaaaaaaaagttcaaaatctaacatcttctggcagcttcaccaagcgatttttggtgccctgatgtgttcttattgatacatctgtctaggagggcacagaagctgcatcggtgctcacttatacagctgctttaacctccttgcggcttcaatgatgttctctctgtgcccgaacgcgctgaccctcacaaagccttcgccacccggtccaaatccagtgccaggagtagtgaccacattggccttctccaggatctcagcgaacacatcccacgaattgcggccagggaagtgcacccatacgtatggagcgttcttggcgccatacacgttgaatccgagtgatgtaaatgtctcaacgattatttcagtgttctccttgtagaagccaacaacatcttgcatagcctttagaccgtctggagagaggcaggctaaaccaccagcttgcgcaatgtttgatgcaccattg

SEQ ID NO: 14586 - DNA, 591 bp, Zea mays
  Clone ID: LIB3279-217-Q6-N6-G6
ggagaaataggcacccacattctgttgaatccaacagagggttgttggcatgttgcagcaataaaagcaatcaaagatcttctacaacagttcaatgttgagttgctgagcacttctctcagcctcaccgcctgatcctcaaaaacataaagcaaagcaacgatacatacactgaaacttattctaccactaccgaacactagcccaagctataaatctccagatatccgaagatcaccttagggactgccctcaacacgctaaatgcaaatctaatgcactacgagtcacggttcaccaaatgagcttctcaggagaagagtcttcgagaccaagcagaagcagggaccggttgaactgcagctgctgctgctttatgggcgagggttgctgctttctctttggattccactatacgtgctccctttggatccgccaaaagggatttctggaaggactgtggaaatcctgtcgcaatgattgtcacatgtatctcaccagtgtaacggtcatcaacgacagcaccgaaaatatgttcgcagatgggtcagctaggcttgtcacaatctgggacaccttgttcacttcttg

SEQ ID NO: 14587 - DNA, 172 bp, Zea mays
  Clone ID: LIB3279-217-Q6-N6-G7
gaaacaaatcatatagtagagtcccaaactccgttgcattttcgataagttacagttcacgatcgcaggctgacagccaccacttcccaggcaagttatgtttccccacgtttataagcaaattcaatgatatgccaacagtttggtgaatgaattgagcaggagtgccaat

SEQ ID NO: 14588 - DNA, 579 bp, Zea mays
  unsure (1)..(579): unsure at all n locations; Clone ID: LIB3279-217-Q6-N6-G8
gtaatctatccaatgatattatcacgtcacatagatagacctataccaaatacatgtcatgaatatcagctcagacacttcccaaacatacgaataggttttgataaataggtactcagggaaaatacagtgtgaaccatagctagaatgccttgagttctcttaacacaaaaatcctaatccaaagtgcaaataaagtgtagccatctcaacaatcaaacatgacatcatagaaaccaaatatgagattgctcaagcttcaacagcaacccttccagccacctggtccagatcacgccttccctgggaggtgatgcgccgtccacccttgggatcgacatcaatgatgcccatctcctgcagctgctggaggatgttgcgtgaaatggcaccactgctcttgcagaagtgaggtgggcgtgagccattcctctggcggccaccataaatcttctggaagccaccaacaccaatgccttgtctcaagtagatcttccttgctacagatgcagccctgatgtagtaccagtcagggtcataaggagggagctncttgaacctcgcagtcttcacaatgtc

SEQ ID NO: 14589 - DNA, 425 bp, Zea mays
  Clone ID: LIB3279-217-Q6-N6-G9
gatgaaaagggaacacagtgtcccttaatgggatgtttagcttaaacctgctgtgaccgtactggagctacacactaatttttcccaaagagtgtttcccccgtaaagcaaattatgtcccgggggggcgatgaactggggccaactatgctacaacaccgaactgccttcatttcatctcctatgaagtgacgagctacccgggcacttgctaacaggaaggcccttacatagcatgacggacataactgaggtgtctcgcggtgtgcctcgtcttaccaatgtaaacattacggctgactggggttgtacaggattaaatgggtaaaaaatggagcacttgaacgcacctttcaccttaggaaccatattatcgatatcgtccccactggctcatgtagactggataagcaaacaattccttt

SEQ ID NO: 14590 - DNA, 350 bp, Zea mays
  Clone ID: LIB3279-217-Q6-N6-H1
caaagaaggcctaaattggatccaaacagttggccttaatcaatttgctcggccaggtagaatagtacctggtaaaggtaccaagcatgccctaacccttctgtcaatcagtattcgccatagttcaatcaatttgaaacggggtctccacttggctgctggccacattgccggttttgctatatatatatgcccaaggcaaatcgtttctgaaaaactgatacaggaagaattctcgcatacaaactacgagcatatacacagcagaacttctggctgctcattcaagattcagcgttgggaatcttcatcgggatgtgtactgtaaagtgagttcacttagcactttt

SEQ ID NO: 14591 - DNA, 479 bp, Zea mays
  Clone ID: LIB3279-217-Q6-N6-H2
aagacaagagcaatcctgaggattccattatgagaaaatgtggctgtttgatgggttccgttagcgttacatacatagtactatgtggctgattctttagctttaaaccaatcccagctattccacacctcacacagcttctacaagcctttcccacactgaattctgatctgctatagtttcaaagctgtaaaatatttctcctccatttatcaccttagatatccaatcgggagccagatcctctaaaatatgtagctgctcttctatctctcccatctgttctatctccaagttgttggcaagaatattatggaaaagctcctgttttgtaattagcgaattcttgatagaatgagaaatatcgcagacgatgccaaatgtggaacgtaacgaagccatcttttcctggacacccactgggtctgccagattgattttctctctatcagtaaagaagacaggaccccacgcgtccg

SEQ ID NO: 14592 - DNA, 583 bp, Zea mays
  Clone ID: LIB3279-217-Q6-N6-H3
tcgcgatctaggggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcg

SEQ ID NO: 14593 - DNA, 604 bp, Zea mays
  Clone ID: LIB3279-217-Q6-N6-H4
gaaccagccaacatttctgtccactttattcctcggtgcacttgtagaacaacgctctgctctctgcactcagcattcctgggtctgctcgaaaatgagcatcattgatcaatcgacactgagtgacacacatcacacgtacactttccctagtactagtagcgctcaataacgtacggggcccacacgagagcataggcatgtggcactcgccgtcgttggcggcggagcgtcgtcgccgtcgaacgacgattagtggacggcggggccccatgccggatacacgacgtatcctggatccggctcccctgccggcttgaccgcgccgtgcatcttgtggaacgggtggccaggcgacgccgccgccgccgggccgagagcgtcctgcttctgcttcacgtggaatggatggtcgggcgacgccgccgccggtccgtgagcgtcctgcctctcgtggaatgggtggtccggtgactccgctggccgcccgacaacgccagcaacgccgcctgcgcgcagaggcctcggcagggcggcactggtctcgcagccgcggtcgtcgtagcactgcccgtagcaggccttcgtcttcgtgtcgtcgtcg

SEQ ID NO: 14594 - DNA, 514 bp, Zea mays
  unsure (1)..(514): unsure at all n locations; Clone ID: LIB3279-217-Q6-N6-H6
aacttataatctcttgagacttcattggcgcaagaatataactctaatgtccatcacacgcagatccaactatagaatttaaagcataacagacaagttcaaaacttaatcgccagaagaaaccacagatctaaaacaagtttaacatagtaacataacaactgtgagtaacggtgcgaccacgacgcaaccactgcgatcggcggtaaacctagacgcggtcacggcggggacctccgtactgcgggcggccgtaggcggggacgctggagacctcagcctggcgctctacgcccgggagatcggccatgccgagtgccgcgagcatctccatggtctccttgtcgacgcggatctcttcgacctcgagcgctgacttctccgggacgaagtccatccggcgctcccgctcctcctcctgcagcttgagcgagatgccacggactgggccccgctggatgcggcngcatcaggtgggtgggtgaagccggcaaccttgttacggaggcgcttc

SEQ ID NO: 14595 - DNA, 575 bp, Zea mays
  Clone ID: LIB3279-217-Q6-N6-H7
gaaaatagggtaggttcaacaagataaatggccgaaatatgtgtaacaactaacatttcaatggtacacgacaattgattcaacttatgtccccaaattggattgccgatcctatattgggtacctatacaattagattcgtcttccactcaaataatgagaagaattatcaggattcaagaatgaaactcaaccattttttagaatttgcctttaggcactggcaagcatatcacacaagcatgtcatatcccaaccaatatgatgtacctttacttttcacttttttcaaataattcacttctcttaactctgattttagccgactgttcctctgcctcaacatcattaactactccacggcatttggggaatccacaaaaacatggaagtcgttgatcacttgaaaaaaacctataatcatatgtcagctcttcccatggatctatgtcccgtttcgcaaaaatgatgatgtgttcatctccaagaatagttatggcacgtgaatagcaattaggctcgcatgagtgattgatcagacgggctatacttccaacccgagtggcatctataac

SEQ ID NO: 14596 - DNA, 624 bp, Zea mays
  Clone ID: LIB3279-217-Q6-N6-H8
gttgtgaacttcccaagactcccatttacatcataatggatgatacaccaagtaatcaactaagctgatgtagcaaattacatgatttgaaatcaaatcaactgtctagttacaagaatggatgaacaagcgattattctgtatcttttacaaatgacgcttgactgggaaaaaaatacaatgcacttctgttttcatacaaacatccaagagcacagacggcttcagtggcaactcgcaaatgatagttgtcatctttgatgctgaaagaatgatatgatctaataaaatctaatatctgcaaatcttctttagaaggaaaaggtggtttcagaaggtgtgccttgctgtaggtatcacacaacatagttcttcagttaagcattcaacctaaaaagttaatcttcatgttcctcttcgccttcagaatcggatcgaacatcatcaccaacatgccctttcgattgaatctgcttaactagcatccgccatatcagtacccaccaatatatgtgaagaactaggagtgagaacagaagacagttgaaaacataatagtatatggggccataaaactgatgtttctccttgtccagggtcagcagtacttcatagcttgtgctt

SEQ ID NO: 14597 - DNA, 624 bp, Zea mays
  Clone ID: LIB3279-217-Q6-N6-H9
aaaaagaaactttgcacatcacattttcaccatagcacaccaatcaggtaccccaggtgtgattcccgccaaactgaatgctgttccaaggcgtgggagtccaacaggatcaaccctcgctactcatcaagtcataaggcaaactccatctcagctcgtttcaggacacgtgaaaccatagagtagaattcaggttcttgttcttttattcggtcgagtgtggtggattcatgggcgtcagcctcactgaacttgacaagtattaagtttgagatgccagcagcctttgatttgtcccaccgaacaagcattagttcgttcacagatctccacatcttccggccagtgtcctggctttggtctctagcacttcgaccacgccacaattctttgacaatgtacattacctcttcagcatctaccagaacttgctcggctgtgccatacatcagttcctcatgctcaataagacgctgatgaagtatacggtaatgatccaaatccaggttaacaaccggttcagtttgaaaatctaatccagcaagctgagtgaccacataggaggccataacttgaccaaatattgcagggatggttcccaatactggtataatgcgaaccctg

SEQ ID NO: 14598 - DNA, 598 bp, Zea mays
  unsure (1)..(598): unsure at all n locations; Clone ID: LIB3279-218-Q6-N6-A10
gatagaccggcagaaactttgttcatgctnaatgaagaaacagcaacaaaaggagaaagaaacggggcgggaggctggcgataatggctcctctcggctttgcatctcttgggcccaaagaattagaagcatttcctgtgcacgatggacgggccagactcgtcgtactcagccttggcaatccacatctgctggaaggtgctgagcgatgccaggatggatcctccaatccagacactgtacttcctttctggaggagcaaccaccttgatcttcatgctgctaggagccagggcggtgatttccttgctcatcctgtcagcaatgccagggaacatagtggtaccaccggagaggacgatgttgccatacagatccttcctaatatccacgtcgcacttcatgatggagttgtaggtggtctcgtggataccagcagcttccatcccaatgaaggatggctggaagaggacctcagggcagcggaagcgctcagcaccaatggtgatgacctgtccgtcaggcagctcgtagctcttctcaacagaaagagctgtcttggcagtctccatctnctggtcgtagtccagggcaatgt

SEQ ID NO: 14599 - DNA, 603 bp, Zea mays
  Clone ID: LIB3279-218-Q6-N6-A11
aggatagcaaaatactattatagcttagcttgttcatagagactggaggagcatgacggctgatcacacgcgatcaactatcccaagtttttacaggcacagaactaccaccgacactcatgctggagctaccgacgaatctagagctactgacaatattacgattggatcaaaatccatgaaagaggggaatctataggcggaattgagggggggatctcgccagcgacaaggcaggcagactacttcttggccttcctggccacgcccttcctggccggggcggcagcagcagcagccttcttcggggttgccaccttcttaggagccgccgctgcctttcccttcttggcaggagcagccgccttcttggctgccttggcgggggaggccttggcggaggtcttggcgaccttgggagggcgcccgcggggcttgggcgacgcggcggcaggagcgacaggcttggccttggccttggccttgggtttgggcgacgccgccttgggcttcgcagcggtcttggccttcgccttcggcgagggctttggcttgggcgcggccttgggtgccttgggcttggcggccttgggctttggcgtc

SEQ ID NO: 14600 - DNA, 620 bp, Zea mays
  Clone ID: LIB3279-218-Q6-N6-A2
aggctgagatgtacaccatcaccagttcagaccatataaaaattcaaacgatgtacaatctaatcacggttgcaactcagctgagtcagactaactgaacagtatgcaaggatgttaactgctgataccaaggaattcggtgaagcttggatactttggttcccaaccgatctcagcccgagtttttgaattctccattctcttccccaatggaccgtcagtaccaataaagcctccaaacttcgtgtcaaattttccactattgttaacagcatccattatttcttgcctggaaaggggcttgttgtcacagcccagaaatattcgactccgcagtccctttttcatgattgctactgcaagggaggcagcatcctggcaacaatattatatgtataatcacaactaataatatagtgttggttgaggaacaagctatactcacaccagtccatggattgacatggtaaggaccttaagaatatgtaaagacatcaacagctctatagggaaccaaagcattcacgggcatgctaggatcacatcgaacatactatggtaaaactaacatatctgtaaaataactgacatgtcacacactcaagtatgtttgaagtgat

SEQ ID NO: 14601 - DNA, 537 bp, Zea mays
  Clone ID: LIB3279-218-Q6-N6-A4
aacagaaacgatatgtacatttctaaattctgccaaataacacgcaacatgaggcaaaagagtcatgacgcttgagttacacagccctagatcctgggaatcacgaatgtcatccacacaaacctcaactgaatcgtgcattcgtatcggcagctagatctgcttgtaaaaagtctacgctaggagtaagctgggggtagctttgagtagtaccaaaaacaagttgcagcaaaagtcatacttcaggcacgccatgttctaaagctctcctgtaggtaagctgggtcatggatggatgttaggcaaggttgccttcccactccattcagtccaaggaactactgcccggttaaccaagtgtcaaactactgcatctgccgagcagttcctcctcaacaatcttgtacgtttcaagcatcagctgaccagcgatctgtttctctgtcacatagctcacatatgtttccatcaaaggagcattaacagcctgcaaacagagcgggtagctatccccacttgaaatttccagatagtaag

SEQ ID NO: 14602 - DNA, 603 bp, Zea mays
  Clone ID: LIB3279-218-Q6-N6-A5
aacagaaaagtatggcttggaagctaacatttcaaaaatccttgcttccaaagtttttgcctctaaaaagcagtaacataggtcagtgttcgggagtagcaggtccatgtcttctcaataagatcaacttcaacttctgagggcagcagttccatggcgcctttccttcttgaaacgagattgatccggatcgaatccaccttcctctgcaccatagacagcccatgagggcgtcatggccatgtaatctcggctattgaaaggctttccagatgtcaccagttcatggaaacggtcataatctatccaggtatgccatttgccgttgatcttgaatttatctacctttgcaagtaggacacaacatgaatgagcatgctcacacgctacttcgtatacaccaccgcttttcgatgccaacacctcggagaattcctttacatcagagtgccaaggtacattttccatagtcaactttgaagttgctgacgagccacagtatgttacacccttgatttcaatgaaatcgggctggccaagatctagcagtttcgcatatgcatctatctcttctgcattccagcctttaaccagtgttagtcg

SEQ ID NO: 14603 - DNA, 429 bp, Zea mays
  Clone ID: LIB3279-218-Q6-N6-A6
agaccattacgaacaccatttttatattgatttggatagagaatacgtactactccctccggtctaaatatttgggggtcaccttaatttttaaactaaaacgcacgcccaatatcacaatctcgagggccggacacattttatggggcggaagctaccacggggagggggggcgggagcagcacggacgcgcctccccatcccattcgacgacgcggaagggggggcgagggcccagcctttttttacgtcctttggaacaaaaacaccggacagggcctgccccagcaccccacaacgcagggccgagctttccacgcccgggatgctcaacagctccgggtgggggggaccttgggtggtgctctcgggacactccatggagctcggtatggaaggaaactggccggctggatcggccggtgcttg

SEQ ID NO: 14604 - DNA, 595 bp, Zea mays
  unsure (1)..(595): unsure at all n locations; Clone ID: LIB3279-218-Q6-N6-A7
gggcgggggccaaaagaagcaaactagcaaagtcgatagagatgcaaatgacaaaacaactaatttattatctgcaacatgcggtccaccaaaccgaaacagcaccttgccttaattgcctgttaatattcagagcagcaaggggcttcatactacatccattttttttaactagacgctccacatcatactagaggaaccaggtgaggaagtcccgttatgtcaagcatgcgaaggggtaacgactcctgagctcgtttatccaagagcaccctacttctgcctcttgtagatcttgtgcaagaaggatttcagcactttctgaaccgcaatgcttggctgggcttcaatgtctgcaatcagcttcttgtagctctcattctcgtactcctgaaataccgcctggaacaaaacgatgaacaaaaacgtcagacttgagaaagtgcttcagtatgtcatcttatttttcagacaaaggagtaacaaaacgtgtggctgattgctacgcatcaatatcatttcagcaacatagaaatacagcaattatcaaagcgggtatacgaatatantgtgtgtgtgtggggggggggggggg

SEQ ID NO: 14605 - DNA, 592 bp, Zea mays
  Clone ID: LIB3279-218-Q6-N6-A8
atatatatagcatcaaaattatgtaatgaagagtagcactgattattgttacatgacgaaggttgagcatccatggaggctagattatagacagacaccctgattttacatgacgaatcgcaagaagcgcatgcattggatatccttagccggagagggcgctggtgttgtagacgaggagggcgccgccgccgaggatcccagcgagggtgacggcccagatcagaagcccagtggttccaccgacgtagacgtcgccggtgggagaccagtcatcctcgttgtagattgggctgtatccgtcgacgttcgcgccgtacttgtcgacgaactggtacacgcccttgcccttgccctttctcccgttggcgtcgacgtcgacggtcaggccacccccaatcccgtagggcttgtcggtcttgatcttcttcttggagcagacgacggcgaaggaggaggcgcggcggccgaggggcggcaggccctgaggcgccaccgccagagctgacgaggagatcatggaggccgccatcgccgccgctgctgctgctcctagctagctgcgtgcagtgtgtgctgctctcgctcgctg

SEQ ID NO: 14606 - DNA, 626 bp, Zea mays
  unsure (1)..(626): unsure at all n locations; Clone ID: LIB3279-218-Q6-N6-A9
tcgcgatctagaactagcgaattctctcggtctctaccaaaaaaacagcgacctctaacgcttagctagctctttgtgtcagcgcctgagcatcgagctattggcatggcgcactccaccaccttggccctggtgattgtcgttgtgctggcgctcacctttggtgccacggtcagtgtctccgctcccgtgaacaagtcgtgcgtcagcggtagcgccggcgccagcgtgagcattggctacggcggggcaagagccagcgccggcgctggcgtgtcccttggcgccgacgcgtaccggagcacgtgcccccgtgccgaggagatcatccgtgcggccgttgagagggccgtcgctgccgacccacgcatggcagcgtctctcctgcgcctccatttccatgactgcttcgtcaacggctgtgacggctccgttcttctggacgacaagccgttcttcatcggcgagaagacggctgtgcccaacgccaactcaatcaggggcttcgaggtcattgacgccatcaagaccgagctggagcgggagtgcccagatacagtttcctgtgccgacctncttgccatcgctgcccgtgactncgtcgttgtgtctggcgggccgagctg

SEQ ID NO: 14607 - DNA, 510 bp, Zea mays
  Clone ID: LIB3279-218-Q6-N6-B10
aaattaaattttttttttgttttaaaaaggatgttttggccaccccaaaaaaaaaggggggcccaaaggaaaaaaggggaggggagccaaccccccgggaaaaaaggaaagaaaaaccccggggggccaaaaagggggggggggggcacccaggaaaagggggggaaccccgggaaaaaaaacccccccggaaaaaaaaaaaaaaagggggggggaaccccccccaagggccccccaaaaaggggggggaaaaaaaaaaaggagggggggggggggccccaaggtggaccccaaagggacgggggggggcccccggaaaaaccggcccggacccgggggggcgccaaaatttccaaaaaaggagggggaaaaaaacagggggaaaaaaaggaaaaaaaggggccccggggaaaaaataatccgccaaaaaacacaaaaaaaaaaagggggaaaaaaaaaaagaaaaaaccgggggcccaaagggagggcccaaccaaaaaaagggggggg

SEQ ID NO: 14608 - DNA, 340 bp, Zea mays
  Clone ID: LIB3279-218-Q6-N6-B11
ggggccacacacacccacttgcataaaaaatcagggggaaaaaagcagtacaatttaaaaggggggaaaagcaaggccagttccctttttaaaaggggacaaactatgacccaccctgggtttactatttgaaacatctaaggactcattagcacaaacttaggtgggtttatgggaaaaaagcaaccacttggggggggcccaaaataaacattttttttgggaaaaaaaaaggggaccacctgcgccttaaaacttttttggggccacgggctgaaaccaggggggctctgccccctatattatcgggtggcggaaaaaacggggcactatcgggctt

SEQ ID NO: 14609 - DNA, 143 bp, Zea mays
  unsure (1)..(143): unsure at all n locations; Clone ID: LIB3279-218-Q6-N6-B12
actgcacaccctttattgaatatnatttacggccaaagtttcccatcgctcgtgctcactgcacgcacacggcttcaacgaatcccttgcgatcacttggatcacacactgattgagaaataaaaaaaaaggggggggggggg

SEQ ID NO: 14610 - DNA, 584 bp, Zea mays
  unsure (1)..(584): unsure at all n locations; Clone ID: LIB3279-218-Q6-N6-B2
cagtggaaatttcttttttaaaaaataaacatcttacatttgacacacattaaacacaggatgggatgacaaccatattgtttgaaagcttcagagttctgatacagattagtccagattcctgatcaactcaaaacacaagccacttcatatgcactgtgccaccttctgatacaaatcctgtggccaattccggctcatgttgcttgctacaaggtttgcgatctttgatttgacagcgcgcaaggtcccatcagtatctctaacattgtcaatgcaatttagagcaaccttcaggagatctggcacgcaagcttgaacatggggtgacaagttcctgaaaatgtcaacagtcacatttggagccttggggtccaaatgaaggaagggtagcctgatggtttccctcaaagcatctacagtttgcccagctcgagctagcctataaatatggagaatagcttcaagctgtctcagcacagtttgttgctcagaaatgaggtccttctcttgaaatgctgcttcagaagagtatctagctgtctccaaaattcattgccagaatgaaatanggcagcagcacg

SEQ ID NO: 14611 - DNA, 519 bp, Zea mays
  Clone ID: LIB3279-218-Q6-N6-B3
actgggctcgaattattttggaagttgctcatttaacagagcgctaagcagatgacccaaaaatttcctcaatgaaacatttcgcagttcatgaaatcaacagactgcaacgaccaaaagatgccggtaaccccaacagttttgttttccccagctgacctgatatgacccaaacagtcatgctaggaccttagaagaaaaaatagtcttgataatcaatcagggcttgggggccacagcaattccaaccttcgagctcttctcaatggtctttgtatcgacctcagccgagatggtgaccagcgactttggcctccactcatgctggatcagggcgctggctttgcccgagttgttgatgcgtgccttcaagacggttagtgggtccagagtgtgctgcccgccaaaggtgagggtgttttcattggtcgagaaactgtgggtaagctctgccccaacagctgtgtttgtcaattcgctcaccttgtggtagtaagctccagtaagggtgtctccctt

SEQ ID NO: 14612 - DNA, 460 bp, Zea mays
  unsure (1)..(460): unsure at all n locations; Clone ID: LIB3279-218-Q6-N6-B4
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgncatcacggngcccgccaccgncgtagccgncgncttcacgggcaccaccgtac

SEQ ID NO: 14613 - DNA, 284 bp, Zea mays
  Clone ID: LIB3279-218-Q6-N6-B5
cagctacagaaatacaacttcgtcttctaataataacacacactggttcgtcatcgtcgccggcgcctccgcccttccaccgctggtacagaatgcccatgtgtaccccagcctccggcatcaaatttacaacctagtaacccaccccgcacaccacccacaactagagcaaaaacgagtaaacatctaaaatcgaaggagcatgaaaccctagattcctgccaagaccaccgctctacttcttcgccttacgcgacggcaccttccgcgacggggtgggagcc

SEQ ID NO: 14614 - DNA, 540 bp, Zea mays
  Clone ID: LIB3279-218-Q6-N6-B6
ggagaaataggcacccacattctgttgaatccaacagagggttgttggcatgttgcagcaataaaagcaatcaaagatcttctacaacagttcaatgttgagttgctgagcacttctctcagcctcaccgcctgatcctcaaaaacataaagcaaagcaacgatacatacactgaaacttattctaccactaccgaacactagcccaagctataaatctccagatatccgaagatcaccttagggactgccctcaacacgctaaatgcaaatctaatgcactacgagtcacggttcaccaaatgagcttctcaggagaagagtcttcgagaccaagcagaagcagggaccggttgaactgcagctgctgctgctttatgggcgagggttgctgctttctctttggattccactatacgtgctccctttggatccgccaaaagggatttctggaaggactgtggaaatcctgtcgcaatgattgtcacatgtatctcaccagtgtaacggtcatcaacgacagcaccgaaaattatgttcg

SEQ ID NO: 14615 - DNA, 414 bp, Zea mays
  Clone ID: LIB3279-218-Q6-N6-B8
ggaaaaaaagaggggcatgtttcatttgctgggtccgagtttattatttacaagatgcaccaacaatccccaagccaagagttgccgcggctttgctcgcccagcttattgcactgttcgcactactccactagatacatattaataacatcggaagagctagctactggaaccgatgcgaccgcaccaaaccatttttcggcgtccatgggaacatccggcaccaccagcccttttttttcctcatgttcttggccctccaacgattcaagtcaagggcgggcgcccccctcaaactaagtctcaactctcaagacgatgactaacctgtaaccttgcacgccatgcgtaaggccaaagttagtctctatatgacggtgccgtccttgatgggtgcgttcttcaggactacca

SEQ ID NO: 14616 - DNA, 207 bp, Zea mays
  Clone ID: LIB3279-218-Q6-N6-B9
tcgaacccgccctcggcgtgccccttggatggtgcgacacccatgatgagagcctgggtggtggtggtcacctgctcagccatgtccgggtacatcttgctgcaccctccgcagccgttgccgcacttgcagccggagccgcacccacagttgcctccgcagcacgacatcctctctctctcgacctcgcaaacaagaacacggatg

SEQ ID NO: 14617 - DNA, 467 bp, Zea mays
  Clone ID: LIB3279-218-Q6-N6-C1
aaacagggacccatattttttctcactatatttatcagagcaggccccgttcaattaggatacacaagatccggttcagggaaaacaaagcctacatctgcaaggcaacttcgtcttcatccataaactggacgggtccaagcagcatgtacaccatggccaggtgcctcatctgcctgtacctggaaacaagcgagcgccagtccggggagtccttggcgtcaatgctgattaggtcttttgggcgcaagttaccggcacccggcaaatacttgagggtcgagtaaccagcaggatcggagagggctatcattaaatctggggagagcgagcgccccgtcacttggacatggcagacacatatggaatacttatcatctggaaattggttctgtatcccccccaggagttcaatcttcactataccaccaatgcaaagggccgggcgtggaaacttgaaggtttgc

SEQ ID NO: 14618 - DNA, 86 bp, Zea mays
  Clone ID: LIB3279-218-Q6-N6-C11
attctcaagttcaacagactcacaatgatctgccagccaagagtgcctaagaaacggtacaaaaacaggatagataaaagggtgac

SEQ ID NO: 14619 - DNA, 582 bp, Zea mays
  Clone ID: LIB3279-218-Q6-N6-C2
atgatcaccagaagagacagaagtctgttccaacaacacaggataaagagaacgtaaccacagattcaacaagatgaacccgtgatgccatggtgcattcgtggagagggttaaaagtttcacggtgtcttattaatgagatacatgggagtgaaaagagaatccatgaataatcccaattggagcaaaagctcaggcagacaacaccacggcggcactcgttcaacatgtcaaggtagaactggcacttgctgatctcactgccatagttgttaagacaatcttggaaagccttagaatggatgctgcaagcattagcgttcatcactggagcaggaggggcagcagcagcagcttctgagataacaatctcatgccgaacagtccggagacccattacagcatcaacagccctgtgtgccatggcactactcgtaccaaatggcataccttaagcaatggtggacccaattcctccaagaatggagccaccaccaccatcacgaacaggagctggaggacgagcctagcgcgcaggctgtggtgggttcctcactggagcagcatgtggagccgggcgtg

SEQ ID NO: 14620 - DNA, 570 bp, Zea mays
  Clone ID: LIB3279-218-Q6-N6-C3
agcagttcaatataaaagacattgacacgacggtatgtgcaaactacaaactagtacatctcagattaattcattaatttaccaccaaaacatttccatgctactaaaccctgttaaggcatttccactactacattgctactctaaggtaagtatgaccaagaaaaacgaaatgtgcatggacaaaagttgaagccacctaggatctacattttgctaacaactccgctcttcacaaatttgcatgggacggatttatgatctagccttgtgttaggattgatatgcaccaccctactggttggactacatccggaaatccatcacgcagactgtgttgttggagaaacaggcagcaatcttgctgccttctttgttccagcacacttcgaatatgcccccagtacctctgtacgtcttcaggatcctgccttctttcacagaccagatgtgtaggcactgatccagggacccgctcgctaagtattcgccgtcggggctaaatgcaacagaatacactggttgcctatgaccagacaagctgtacagaaggcattcttgctcgacttc

SEQ ID NO: 14621 - DNA, 399 bp, Zea mays
  Clone ID: LIB3279-218-Q6-N6-C4
gccaaaaggccggggggaggctaaaaaccaggggggggggggccaggttttgcacacaggaaaaatccatgcccccccccagggtcctgccggggaaccccccgggggtagtttattccacggggcagttacccaggttttccactccgggaaaaaaacgctggggggtagtctgtccaacatgacattttaggggccgcaaggccccccccataagccttgggcattttccggggggggttcgacccccacgggcccctgttgaaacacggacaggaactccgggtcctgaaaaaccttgaccaaaaaggtggcccctgggtttttaaaaaccttcccggggttccttgggggcaggccaaccacgggcactccgggagccacaccggcccggacccc

SEQ ID NO: 14622 - DNA, 591 bp, Zea mays
  Clone ID: LIB3279-218-Q6-N6-C5
gtcccactcacataaactattcactgtccggcagatcatacggtaccaattaagttactcacggtgcagagttccgctgctctggcagagagagagatgcacgacatcggcacgtcatgcgaccgacactgacacacattatacgttcatccaaacataccggaaagataaagatacagttgccagcgcacgagggcatacaagccagcggtggtggctgggtgaaatcctcggcgagtggaacgagggcatccagcagtctaattgttctcctgcaagttgggatggctgggctgcacgcggaaggtgattggcatctgggccgccaggtcccggtcaggatggtaacccagctcaagctctctcatgctgccgctcagcgcgatatcttgctggtggagtttgaaggccagcaatttgttctcgtcttccatcatcttagtgtttgtcacacgcctttcccagtgctccatcagtttctcattcaggttcgtcagtccattatcaagtgcctcctcgatcatgatcaggtctttgggttgcagcgagtttagatcttcacctttcaggtgcctgagctcgatctgcatg

SEQ ID NO: 14623 - DNA, 542 bp, Zea mays
  Clone ID: LIB3279-218-Q6-N6-C6
cacaagaacctgcacttggtcatcatgccaaattatctggacgacgattagttctagcaagctgcaaccgcaacagcgtgtgccaaggacagtgtcaataactcaaagatcgaatctgaatggaagtgcaaggttgatccatgcacggggaccagcccgggctagtacaagtcttcctccctgtgcgtctggatgacgcagtcggacgtcgggtacgcgacgcaggtgagcgcgtacccggcaccgacctgcgcctcgtcgaggaacgactggtctgcctggtcgacggagccctccaggagcttgccggcgcacgtggagcacgcgccggcgcggcaggagtagggcaggtcgagaccggcctcctcggccgcgtccaggatgtagctgtcctctggcacgtcgagcacgctctcctgcccttcggggccgatgagcttcaccttgtagacagcggcgacgcgcaagtctagcctcgctctgaagctcggcgacgtcggcacgctccttgggaagcccaagtgaagccgccgttttgtgct

SEQ ID NO: 14624 - DNA, 399 bp, Zea mays
  Clone ID: LIB3279-218-Q6-N6-C7
attccaacataacaggttcgtttaaatatttatgatcaagagacaaaagtctgctccaacagcataggataacaaaatgtattaatcccaggaagtttagcttcaagctgtggagacaaaagtttcacggtatcttattaatgagatagcatcaccgaaagaaaatccacgaataaccccagaagcagcttaggcagacacaccaccacgggggcactcgttcagcatgtctaggtagaactggcacttgctgatctcgctgccatagttgttgagacaatcttggaaagccttaaaatggatgctgcaagcgtcagcattcatcactggaggggcaggggcagcagcagcagcttctgaggcaacagtctcatgctgaatggtccggggacctaatac

SEQ ID NO: 14625 - DNA, 465 bp, Zea mays
  Clone ID: LIB3279-218-Q6-N6-C8
gagtggtaacattgatactgtattgtctgattcatagcggttcgacatgctcagctagcatagcagggaagcatcaagattcaagagtaccatctagaatacaccaacttcgtccacacaaagccaaacaattcattacatggttttatcataagaataagagtacaggctatcttttaggtccccatccatgcttccattattgccatgctttggagctccccaagtttcagcggtacttgatgaagccaatgtccttggcgttgctgcggaagcactgtctgcagcacatgagcccgtactttcggatcaagccgtgggggttagcgcacacacggcaaaccctagatccagggccgtagttcttggggtgcgagttccacacgttggagtgtcccatggcggcggcggcaggggagcaggcctcacaggtaaaccctaacctagtctgacctggcttatgac

SEQ ID NO: 14626 - DNA, 579 bp, Zea mays
  unsure (1)..(579): unsure at all n locations; Clone ID: LIB3279-218-Q6-N6-C9
ggctctggcggcggcgtcctcggcgcggaactgggtgacgacgcagacgtcgcagcggacgcagaaggagtcgtccttgaggtgcctcgacttctccagcgcttccctccggatgaaggtgttgaagccccagtacgagccgggggcgttgaaccggttcacggggagggtcttggtgagggacggcaccggcttgccggcacggtcgagaaggccgacgctgagctgcgcgagcgcgggggtgcggttggcgggtgcgtcctcgagaacgaggtagagcgagatgtagtcggccgtctgcgcgcagtcgccgttggggaggtaagcgaggtgccaggagtggccgccgacgcggaacgagcaggacttgaggtggatgccggtggcgaggcccttggtgcgcgagtagccgtcgatcttgagcacgtgcgagccgacagcggtggtggcgatgatggaggacgatgaagacgaaacctggaccgtgggcgaggacatcgacatggttaccttcactcgtgagccgnccgcccgcccgcccgccggncggttgcatgcgttcacgccatgcgtacgcca

SEQ ID NO: 14627 - DNA, 492 bp, Zea mays
  Clone ID: LIB3279-218-Q6-N6-D1
ccattagagcacttgcttgttggcagattccgagcaaacttgttcttgaaaacgtacaggaattcagcacgagttgtacaccgacacacgcggccgttgggcgttcagtactgcgagtgggcagctgcaatgagggcggctccgaggccagacccgtccttggtgagcttgacctccaccagcctagacgcctcctccccgagcagctccaccagcgtggcctccaggcgcttcctgaactcggcgtagtgctcgaacaggccgccgtcgatggcgacaaccgaccggcgctcgtcgcctggcgccgttcgaccgatcttcctgaggatcccgacgatccccgccgcggccagccgggcagacctccccgtgacgatgtcgcagatctcgaccaccatcttcctcgtgtccaaggacgtgtccctgaccctgaggttgtcggccagcttctccgccacgactctcaggtcaggcgtgccgtcatggtgcatt

SEQ ID NO: 14628 - DNA, 344 bp, Zea mays
  Clone ID: LIB3279-218-Q6-N6-D10
ggccaacacattcagttacattttttcacatgatgaatgttctcgtgttacaaaagttcctgaaatacatacagcattggatcctatctttcaccacccacaactttggaatttcacatatgcccaaaaaaatatttgactggttctgttctgccccaccaagatttaaaaaaaaaagattaacccgaacttcccatgaacttttcagttatttcacaaaaacagtactatccaggggaaattgtatggatccccacattccaaatggggcctgggggattctacagtctctgtgtacacagtacactggactgcatgggtccaatcgataaaaagcttctgac

SEQ ID NO: 14629 - DNA, 507 bp, Zea mays
  Clone ID: LIB3279-218-Q6-N6-D11
ccatggctccgaaacgtcttattgaaatgagctcagcgaaaggttatccaagtgaagaaggccaggacatcttccaaagataagacaagtccgaaaagaaaacctcagtagttttgtttgtggccagggagaaggatctaccgaggaattgctcgcgattgcccgcaagcatcaaaaagcggtttctcaatgtctctctactgtaccactgggtctattctaccattccacgctgtttgaagatttcaaacatggtagaaccaatcttcgctggtgactcgacaacggtaacaccagcctctctgagtgccttgattttgtcctgggcagtaccctttcctcctgccacgatagctccagcatgacccatgcgacggcctgggggtgccgtaagtccagcaatgaatgcaacaacaggcttttgtgttttgctttcctggatgaacgttgcagcatcctcctcagccgtacctccaatttcaccgatgagaacaatgccttctgtct

SEQ ID NO: 14630 - DNA, 469 bp, Zea mays
  unsure (1)..(469): unsure at all n locations; Clone ID: LIB3279-218-Q6-N6-D12
ttnntnntgtgnttnttnnnntttttttttttttntntnnnnnnnnnnnnttnntntttttttntntttntntttttttttttcttttttttcccttttttttttttnnttttttggggttggtntaggggngttnttttcntttcttcttnttntggtcggttcttcctcctttttttcctttttttnccctnttcttttntttttttttttattcttntttttttctnttnnnntttntttttctgtatntntnttttttttttgtgtgttgtgttttttttttttttttttggcccccccccccttccccccccccctncccctaccccctcccccccctcccctcccctctctccccctccttcttcctccccctttccccctccctttcccttctcttctctcccccccaaacctccccccccgcttcccctcccccccccctcctttccccccccccctcccc

SEQ ID NO: 14631 - DNA, 345 bp, Zea mays
  Clone ID: LIB3279-218-Q6-N6-D2
atataaaacggtaggcgaccacatttagtggattgggcagtaagtatacttactggacctctccaaaaatcaaaataatctacaacaggaacaagtagagatgaacgaatggaacaataaataagctacactatgcctctgctcagcaatctgagtctggctgagtgacttgacttttaggccggagggaagaagcggttgaggttgaatggcaggcggtagaactcctcgttcctgctgtcgcccttgaacgtccggaaccgcacccaccacggcatcccccggtccatgccggcttgcttcacctccagcgtgttgtccaggaacacggccaccatcttctcg

SEQ ID NO: 14632 - DNA, 506 bp, Zea mays
  Clone ID: LIB3279-218-Q6-N6-D3
cttctaaactcaggtttgcacagaacgggaaaattttcaacatgaacacacaataggttcatactactgctcagtgtgagcaaaattgtccgcactagagtaacacagaaggaccaaacaaacaacctagtatccgcccttaagatcattgaccacatcgtacgggatgggagtgacggtctcgatggtagtcccctcaaccatgaagccaggcttgggacccaacggctgcctcttggtgctgatgacctcgccgcgctcctttgcatccgccttcagctgatcattcttcaccttcctcaggcggaactcttctgtgcagcgggacggctgcacatgctccacgcggacatggatacgcttcctgatgatgcgaccattcacctgcttgtttatctcgacgccgatggcgcgcttggtgacgttccagacgcgaccggtgcggccgtggtagaacttgtgcggcatccccttgtggacggcgccgttcaccttgacgtcgacgt

SEQ ID NO: 14633 - DNA, 508 bp, Zea mays
  Clone ID: LIB3279-218-Q6-N6-D4
gacgaatacaggatcaccttcatttggaaattgtcagcatccgatacaacccaacaaccctagcatacttctactttaatcttagcaaatgacataaccggttagcaaattttttccaacttccaggcaatttttgggacaggatcaaagagcagctacacggcagtacagagccgaataaggagacatgaaagattaggagcgaagagactaaaagaatgaacacaaggatcgcgtgagccttctatttcaacggaagcacacaaggtttggcacgccctagcagctaaccgtctatcttccgtcagcagaggtgaacgactccgcgaatccaggaggccttgtagggatgctcgtctgagtgttatccaaacttgcaacaaatgaggaggttgcgccgtcaaagtggctgctatcttcaaaagcctgccatctcttcagagcctgagggagggtcatgttgaggtcaataccgtagctgtcgtccgagtctggacccacgcgtccg

SEQ ID NO: 14634 - DNA, 204 bp, Zea mays
  Clone ID: LIB3279-218-Q6-N6-D5
gcatgtctcagagatggatatacaaagagaaccaataatgttactcgcacaagtacagttacaatacgatcctaggaacttcaataatttccatcctctctttttttgtggttgctgttctcaccactgttgtcattgttgttttccccactagcaagtatgacagcaaacttggcatgaaaagaagatggagcaacgcatgca

SEQ ID NO: 14635 - DNA, 573 bp, Zea mays
  Clone ID: LIB3279-218-Q6-N6-D6
gcgtgatgcaagagtagtatttaaaattccagccatctcatctcctctcctctcctctcctcgtagacatttcaggacactgaattgcaaccttgcatcaatttccgaatctgcatcagggtgaattgcatcaatttcccacgtctctcgttcttggtttggcaacagagaagccttatttagttcttgggctcactggacaggcgctttactgtcttcccatttgttcagtcttttctgcgcttcttcaacctccttgttccagttcgtcctgaatgtaacccacaccaggatcatggtctgcatcagggtgcccccgatcataccgctccagatacccgctgctcctaggtcgaagtagaatcccaggaggcacccaagggggatgccgacgatgtagtagcagccgacattgacgtatgcgaccaacgcttgccatccacaccccacagctaccccagagaggacgggctggatgccgttgaggatgagggtgaccgccagcagcgggctgagctgggcgaccgcccgcgacacgtcgtcgccctcggtgaagatgtagctgatgtagtc

SEQ ID NO: 14636 - DNA, 602 bp, Zea mays
  Clone ID: LIB3279-218-Q6-N6-D7
ggcggcggagcccagcagcagcagcgccacggctttggctatgcaccacccggggttctccacgctctccaccgcctcgtcggacctgtcgaccagctcgtcgtgctcctgcctcgtcctctcgtggtactcgtggatgaacttgctggagaaggcgccgcccacgggcacgctgcgcctggcctcgtccagccacttcctcatcccctgcacgaactcctcctcctcgacgacgtcgttgcgggacgtgtcgaagtcgtccatgaccttgtccaccgcgtccgtcctgtcgaagtcgacctcctcgaagttgatgccgacgatgagggcgtggagctcggcgcgggacagggaccggctctcgtccatgtcgatcttgcggaacagctttctgatgacttgttcattgggcgtgccgtcgtcgttcagcaggcggccgagcgactgcatctgggcgtgcctcagtatcccggagatcacgtgcttgtgcttcgcgtacgcgagcttcctcctctgaatccaggctggaaaacctggtacaggcagtaggcaagcacgagcgcgaacgacacgacaagggccagcagcatagcgaggcgctg

SEQ ID NO: 14637 - DNA, 519 bp, Zea mays
  Clone ID: LIB3279-218-Q6-N6-D8
cacgatgcaaacaattttattcaaaccgcaaagctgcctgtaaatacacaaagcagtggaactggcgtagctagtggtcaatagtccatctactgagagaatcgttgacccccttctgtatcctcaagactagaaagtacagcaaacagtctcacgatacttctctggtactgggaatgataatctagacagaacatatatggttcagaaagacatagcaggtaggccaccatgcgcagattcacagcaatagctctagaccgtaaaactgcttcatccgctgacagaaagagacctctctctccgtgatgatttgcgatatccatcctcataagggctcccacttcttgatctgctgtccacaggtgagccggagtaggacctctctctaagtctgtgtcttggattctgaggtggagaccttgagtagctttggctgcgtgaaggagagcggcccctataataacgaggggacctagagcgagaatacctcctgtcatcataagaatgacccctgac

SEQ ID NO: 14638 - DNA, 549 bp, Zea mays
  Clone ID: LIB3279-218-Q6-N6-D9
cagtagacaatggatgaacaaatcatgagaagacattagtgaccgcttacaggcatgagttgatgaacatcttgcctgggaaatttgaaatgtctggaagaattgtgtatcatcaacccgtccaggttcatacttgagtataccatcatgatgccttccgaataggactaaaggctaaacgggtacccaacgcttacgtaaccaatcatgtcatccactattagtatgtttggttagtggaataaccttgttcggaaccaggtgatccagtatggactcactccttgcaggttcggatgggaggaatgagttggtccgtctgttttacgaggaatgggcagcttctagattttagttttagatcggaatgagtggatgatggatgagatgaatccgtgacggtaaccaaacgctgttttaggttcggatgactctggaccattggatgcctctaaccaaacacactgtatatcaactgcaggtccagcaattggtgccccggatgaggatccgacgaggaggatgtcacgcggcctgatgttctctgcg

SEQ ID NO: 14639 - DNA, 434 bp, Zea mays
  Clone ID: LIB3279-218-Q6-N6-E10
ggcaataaaacatccaaggaaatttgttctctcatagaagttcgtggggggtaaatcactaaaactgaacaaacacgtgactgaaactgaaagcaatgaatcgatgagagaaataggtgatgacccccgacgtgtcatgttgcccccgtacgtagtgtcttccggttactgctgaactaatacttcttaaactaatttactggatgggttatttggctcctccagttgggctctttctctaggacttgtctttggcgaccttgtcgagtatagggtcgacgattgaatccacctctttctttatctcgtcaaccttctcaatcagggcctcagctttgtcggcatcttcctcgatctcatccgcgatcgtcttaatcttggaggctgcctgcttgagagtttcactgccggggaacgcttgcgcaacctcgtcg

SEQ ID NO: 14640 - DNA, 347 bp, Zea mays
  Clone ID: LIB3279-218-Q6-N6-E11
aaaaaaaaaaggggggggggaaccgggggaaataagggggggaaaaaacaatccttgggggcccgggggggcccccgggaaatccgggccgggccccggggggggcccaattttcccaaaaagggggggaaaaaaaagggggggaaaaaaagggaaaaaggggtcccgggggaaaaatggtaacccgccaaaaatcccaaaaaaaaaaaggccggaaaaaaaaaaggaaaaacccggggggcccaaagggggggccaacccaaaaaaagggggggggcccaaacggcccttttcaaagggaaaaaaccggggggcccatttaaaaaaaaaaaacgccaaaccccggg

SEQ ID NO: 14641 - DNA, 382 bp, Zea mays
  Clone ID: LIB3279-218-Q6-N6-E2
aaaaagccccaatctaacccactttcattcaaatccattcaagggaacgacgaacacagggggggatactcgggtcccagttacccaacacacccacggggacagaccctggcattccgacactacgggaaaaaagaggcttgggggctataagcaaactgaaacggggaacacaagggggagagaaactggggaaaccggtaacaactagccaactggtttccatccagtagcgatgaggagatcgagcaacgcttatggggccatgctgccagttccacagcctgccttgggtgggcaccagttcccttgcaccgcatttgagttttaaggacacccaccccaccctggctatggagctttggttgcacccacgcgtccg

SEQ ID NO: 14642 - DNA, 533 bp, Zea mays
  unsure (1)..(533): unsure at all n locations; Clone ID: LIB3279-218-Q6-N6-E3
gcagttggcaagattatgcctcgaccataaggccttcctaggattttgattcttttaacaggaactgtagccggaatatttcgagcggcccacgcaaatgtctgccttgctttcacaggaattgcagtccacaactgcgggctatactaccacaggattctgaacaatatcttcaaaaacatgccccacgattgagatgtgaatcttatgcacaacaaaactggacatcttgaggtcacgatttagtcactgtcccgagaggataaaatcctcttcaaagcatggggtagctccagcacaatgtctgcgtatgctgaaacacaaaacagggngaaacagatcaattcagcacaaagccatgtttgctgtaagccaaggtgacaggaagcaccttctggtngacacaaggttttgagtgcttcctcggcntatgaaaggtgaaagggtactggttgcgcagctgatgccctgctgcttcttgtngattttttcttggccgggcgaagtggccaagccaagacccttgcctggct

SEQ ID NO: 14643 - DNA, 472 bp, Zea mays
  Clone ID: LIB3279-218-Q6-N6-E4
aatgcgaacagacagagtctcgattccattcaagagggcaaatgtaaactggaccggtgaccacgcaccgggtgaggaagacggggagccatcaatcagttgtccccctcgggctcgaactccgggtcgccgtctgggtgcatctccctccactggtcctcgggccagtactccttgatgtggccccacttcttgcggaacttctcgatctggctgtccatgaccacgagcgccgaggtgtcgccgacatagtaggggtggtttccggaccacacgtccaccgtgtactccggcttggtgccccccgtcaccagcaccagctcgccgttgcagtacaccttcgcgtcctcgtagatctccgggtgcaaccccttcttgcgcatcgagcagcgcatcccctgggaggggacgacggagcgtagggtgcgggcggtggtcctcgcggcggcggtgatggggaggaaagaagtgg

SEQ ID NO: 14644 - DNA, 390 bp, Zea mays
  Clone ID: LIB3279-218-Q6-N6-E5
aggggaaaagagggcaagggggaacaaacaacatgccccccacaaaaggcccaccacatcaaccccaacaaagcatggtcgaaaacaacaaccaaacctaagcccccgcttgaaaaaaagcccggcccaaaaaccggccaatatgcagcaggggccaaaaacaccttacccgggagggaccccccccccggccccgaattcccccccaattgcaggggcaacccgggaccggggggacccaaacaccaaaacggtcatggtgctctcaacttgagggaaccccattttatccatgcccccaccaggggaccaatgcaaaaaagctttccccctaaacaaaacaaggaaccgcccccccacacgggggaacatctcccggatggaggggga

SEQ ID NO: 14645 - DNA, 574 bp, Zea mays
  Clone ID: LIB3279-218-Q6-N6-E6
gaggaagctatacattttattttcataagtgatatgtggttcacaaagaagggtatccactatcttaacaagagcaagcaatgaacaagcatgtcttcgggccaacttaaccaccttcagtacagcagcatttggaaacggatacccaattgtcagttggggtgatttagtgttgcatcctgatatctgtcaattcataagatatccagatccaccagttgcatagagtctatacttaatcctttcccttcaggttaatcactgaaagctcctgctcgacataatccccagcgcatataggtggataggaatgagcatcaggtgtttcagcaaagtggccgagcggcttaagaattgcatccgaagcaatgtgcgcgaacagtgttgatgaaaccctccacaagcttctattctgttctttcgctagcgctatggcctctagtgtcctcttagttaccactacctcatgcattccagccaaacaatcgccaccagtaagccattccagctgttttccagactgaattagaaggcaaccaacagggactttcacctccatctttttaccattcct

SEQ ID NO: 14646 - DNA, 554 bp, Zea mays
  Clone ID: LIB3279-218-Q6-N6-E7
ggaaaatacattattcttcgtctcgatttattagtgccgcatgttcacaagatgcatcatcgtacgattccggctcaaatgcagggaaatagttcaacatttgcatacgcctgtgattgctacaaggtttccagagcttcacttttttggtgtatctgcatacttccaggaggtatgtgcataggaattgtattgtcttccaccagccacatcttctgcacgtatctggctgccaatttccttcaggtcctcagctgtgagcttcaccttcaaggagtcaacgttggcatctaggttcttcgtttttgttgtccctggtataggaaccacatcatccccttgatgcagaacccaggctagagctagctgagctgggctgcactggtacttcttggccaaatcttctattttcaggtaaatctgcttgttcttctccaagctttctgttgtaaatcttggatgcctttgcagactagattcagaagaaacttgctgtgtcactcctcttccaccaaaaaatccacggccaattggactgtaagccacaattccaa

SEQ ID NO: 14647 - DNA, 538 bp, Zea mays
  Clone ID: LIB3279-218-Q6-N6-E8
gccatatcatcaaagagtgtcataaaattaagaatgaaacaatgtttctcaatacaaaatttcacttcactatttcataaactaacataccaattaaatactgcaactaaatagtcaatagaaaacaataaaatatgtaaagatgaaacaaatggtgatgtgacatactattaaatgtgtatgaaaccatcataaaactacccttgtaaatagcctaagtacgcaggaaaaaggtgaaatcgtgaaccaccatttctctatccatcaagaaggcacgagaatcatcgagtcaacattttttccctatctttgtttccctgtgcaaaccttccactcggtgcagtactcagcagaactgaaaagaaaagggacccgtattctgccaaatgaaatccacccatcacagtatacttcacttctttgaaagggccatgacattgaagttcatcgagttagggttctccgcaattctagctttgatgacttctgcagcatcctgcaacaaggtttcaggtgatgaagggccatggggtgtggg

SEQ ID NO: 14648 - DNA, 613 bp, Zea mays
  unsure (1)..(613): unsure at all n locations; Clone ID: LIB3279-218-Q6-N6-E9
cgctgaactctgtttccatttccaaagaatgaaaaaaactattgtactttcaaattttgcaataccaaatgtcagtacgactcgaccaagaaaaagaaaagaaaattaaacaatctacgcaaaaaggttacatatcattatcagctacctaagtacctatacaaagacaatctgaacttgagaaggctcctaaatggccagtatcgcagaaacagttgcaaacctaaaagtccttttccccccacgcgatatggttcgaatttaccatctcgctatgtaaatcgttagctttttacagcccagcggcgacccctgatctcatatccgtcagaagcttgatcaccacctccccagctgtccacagcagtaactgagctcacaactctgcgatattttctgccctttgtgacaccactgtcacttgcgcttccgcttaataatggatcatcaatcccacgaacaggcctctctggtgttgctgcactcacccagttgtcgtcctggcttttcttactcttatcattctttntcatcaatttatcaatgcgcttctccactggtcgcactgcttggttaacagtgaacttaaatctttgatcacatattcaccact

SEQ ID NO: 14649 - DNA, 542 bp, Zea mays
  unsure (1)..(542): unsure at all n locations; Clone ID: LIB3279-218-Q6-N6-F1
gataaacattgcaccgagattttaaaaaataaaaggatccgcaacttccgttcaaaatttaaaccatatcatctcgcatatcttgtgtaagtatcaggattccccaaacccacgagaaaatttcttgctgaaacaaattctaagggacttaaacattgtggaagatgcctatatcgcctagttcttggaggccttatccttggttttttggatcttcaaaaccttcttcacgatcttctgctcctcgaccaaaaaggcacggatgatcctctctctcactgcggtaccagacagaacaccaccatatggacggttcacagtcctgcggttccttgccaacctggacctcttgtactcagcaggtctcaggtgtggaattccttggatcttcttcccggtgaccgggcatttcggtccgctcgcgcgcttcttggtgtactggtacacaagcctcccnaccaggggtcttgaccacgcgggtctgattggattttgtggcgtagctgtggcgcttccggtaggtgagccgctgcaccattttg

SEQ ID NO: 14650 - DNA, 517 bp, Zea mays
  Clone ID: LIB3279-218-Q6-N6-F10
gaaaacatatagcacttgatgattctgcataccagtcatctatatatatagcctataggcaagatggaaagtgaaattaaactgtaggacacctgttcatccataaacaggcaaagatacatgtagagtgccagcactcggcagtcttaagttacaggtatccttgccttaagaacataaacatccggaaatagttacaacttactactacactgattacccatgccagcaaaaggaaaataataataataaacaggagcaaaatagagaacactacacttgctgcgcctcaccaaaagggggggagagcaccaccttcgcttgttcggcatacatgcatgagctagatcatggtggcgatcagatttgctgacggccggtggcctactaggacggctgtatggccagtcactggctggaaagctgcagctgactcgagcttctcccacgtaagtctacgcttcgcttctagcgacgcgcgtttttcttcttcgtccttgtacttgggccagcatga

SEQ ID NO: 14651 - DNA, 621 bp, Zea mays
  Clone ID: LIB3279-218-Q6-N6-F11
aaaggagctaaaagtgtgaatcgaatgacaagcatgataagttgacattataaatggtatagttgcaaacacgagcacttgcgagattagacacggatataagaagccaacgacggcatcacacgattacaggcgaacacaccaatcagcacaaacatcaccaaatcctttattctagtcactcagtgcagatgcagcctactgctagcagggcactgaacatcaccatcccgtcgtatggattctggtaagggaacagtatcccttcattcgatcttgtcgcagtcgatgtcgggggtgatgttgtaggacagcgagaggccgcagtcgccgggcagctcctgcgccgcggagagcacagcgtggacctgaacgtaggccgccttgaggcaccggcacgtggcctgcctgtcgggcctggtgtccgccgccgcgtacagggtcctcacgccgtcgcagcactggttgttgctctcgctgggtttggctgccttgccctgcaggaagggcaggcacggcgacaggtcgttgagcacgtcggagcacgagatgtcggccaccgcggactggactgccagcatcgccaccaggaggacgactgcaatgcccgagctagtagtc

SEQ ID NO: 14652 - DNA, 566 bp, Zea mays
  unsure (1)..(566): unsure at all n locations; Clone ID: LIB3279-218-Q6-N6-F2
actagcttgctcttcaaaaggaacatacttactgctgagcgccactattccctaacttgaaccacctttacttttactcgcatagagacacaccacatagtccacgacagtggtggcagccaggaacatggatgtacgaggggcagcagcctttctgatgagatgccctcacaaacctagccaggctcgtggatcacgcggtgggcgctgatattggggctgacctcatactagggctgatcatctgggttactgggtttgtccgggtaccccttctgncgtcgctgatctggattgactagatcaattttaggatcttcatggaccatggctctgttaacactggctgcaaagagacccttgtgtgccttctgcaggtgcaactagagtgaactcgtacttagaccaacattcttgctgcagattggacacaccttcatttctggccgcttgtgttgccagtccatagataccttgccatgcaggctcttgacaagggccaagagatcctttgagaagccctcgattggctgcgctcgacggtgtactttcttcagtaagttcca

SEQ ID NO: 14653 - DNA, 611 bp, Zea mays
  Clone ID: LIB3279-218-Q6-N6-F3
gagcaagatgatctggatacatggtatccatctttgcaaactctgatacaaaacagtcttaaacagagcagtagcatggaacacaccaaatacgccatgctctggtctgcatactttccgctcagctatgctgtgaactacccatctggatttgctcctctcctatggaaaccgttggagtttaatgaaacaagcaacagcaacatggtctcatgccggatgtagcatacaactcattacaaaagatagcaagatacgataaacccttccaaatgaatgaaagacgagtcagtttacgaatcatctgcacagcatgtctgaaactgaaacgaacaagcataactcaaccaccgtccaccagccatcacggttccagagttccaaggcaaccacagacgtcaaggtaacatctagcatagcatcgtttcgtcttggttcattcactgttcagcatccactcagaggcaacgaagacctgtaactacacatcctttccatgccaagtagatcagcatcttcagtctccaccaacctggcgtttccaggagtcctccacaatgagctcgtctactccccagtcttcataacttccatcaggtaggtaccgtctg

SEQ ID NO: 14654 - DNA, 541 bp, Zea mays
  unsure (1)..(541): unsure at all n locations; Clone ID: LIB3279-218-Q6-N6-F4
gagcgaatacatctggatcaaagcacccactggccacacattactacatagagagagtacacagacagaagcgcacacatcggttcatgcctacgtactctgctcgcggcaacatgcatccacgatacaccgtttacgaactgtgtagacgattgctaaacaccataaatgactagagacaggcacacctcgatctagcttaaaataccagtagcattactttattactctccgccatgcatgcattcctcgcccggacgcgcacaggacgcctcatttaattaatcgtgttgcagttaacgttggtgctgatcttgtacggcagggcgacgccgcacttgctgggcagcgcggcggcgcggctgatgtaggtgccgctcccgttggcgccgttggcgacgttcttgaggcagccgcagatggtgcggcggtcgggggtgttgttggcctgctgcagcaggctgcggatgccgccgcagcacggctggggcggcatggccccgcccatctggacgaacggcangcacggcatcagcgtgct

SEQ ID NO: 14655 - DNA, 572 bp, Zea mays
  Clone ID: LIB3279-218-Q6-N6-F5
gaacgttccaaaattctttagcgttatgcataacttgctgtcactttacaacacctaatgtccccataaattaaatgacgattctgtatgcttgaacatgctgcatcaacctgataggggtttcaattaagcagctacgagggtccgctctggggagggtgacggttcaatctcaagtaggggattcttctgaaactcattcctcagctgcccacaggctgcgttagcgtcaagcccacgggtccgtcgaacgctaacggttatcttgcgtgcttctaaagcatcaacaaaggcttggaccacttttctgtaaggtctcttgtactcggagccttcaattgggttatagggaatcaggttcacatggtaaccacctccacacatacgaagtagttctgctagctcttcggcatgctccttttcatcgttaatcccagctagcagagtgtactcgaaggataccctgcgcccagtttcaaggaagtaactcttgcagtcatccattagtgctcccaagggtaagacttggcgctaggaacaatcgtctcccgcagcttctgatttggggcatg

SEQ ID NO: 14656 - DNA, 536 bp, Zea mays
  Clone ID: LIB3279-218-Q6-N6-F6
aaaagcaaagcaaatctgcaattgaatgcaatccagtccaaaattgcaagtcatccagaagataaacgaacatattcttttgtacggtaatgtaacataaaattctcatctaatgcctggacttcttcttcctagatttgttgctagtttttggctgttcagcatttaccgccggtgtctttgatgaattgggggtttggcttccttttgaggaagcaccgacattggtggccgatgtttccctagacacagctccttgagcacctctgacctgagccctcttatccttcctctttggacggtaactggaccgctctctccttggcagccatctttcgggatctggtggcggccccgggtttgctggatcgaagcctttcgggtatctaggcttccgcttcctcttctttgccttttgcttcttcacttcctcgggaacatctaccttcatgtcttggggcccttccacatgccttgcaccagatgtcttctccaagctctcaacattaactcctttgaggcctggcaatggcttc

SEQ ID NO: 14657 - DNA, 526 bp, Zea mays
  unsure (1)..(526): unsure at all n locations; Clone ID: LIB3279-218-Q6-N6-F7
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgccgtagccgccgcctccacggncaccaccgtacccgccgncgccgncgncttcacggncgncgcgggactgggcctcgttgacggtgatgttgcggccg

SEQ ID NO: 14658 - DNA, 586 bp, Zea mays
  Clone ID: LIB3279-218-Q6-N6-F8
acataaccatgcccttcataaggcactttgtctattattacaataggattgcccggttcaacatgtttcaggtagctagaaactagtgcatgttcttcatgaggccaaccatcttttattataacaacagcaatattcaggcatttcggtgatgagatcaaccttcggtgcttgatgacttgacaacggtgacagggcaggttgcgttgttcacgacgtaatcgctgacacttcctaagagcaccctcttgagtttgccaaggcccctgcttcctataaccaagcagctcaacggggtgtcatggataacttgacagagcttctcacgcggatctccccacaggactttcacaaccaccataatcagaggcttggtgtgctcacttccttctgggtagctgtagtgttcaggaggtccaaggtttccatgtcgggttttgctccatatttgggagccggtggattcccagaggatggcctcgctctgctcgtagtcgggctccttgatgacgtgcagcagcagcaggtggtcaccggcgcggagcaggttggtcgccgcccactgcagcgccgctcggctcccctg

SEQ ID NO: 14659 - DNA, 403 bp, Zea mays
  Clone ID: LIB3279-218-Q6-N6-F9
attgcaaccacgggcaaggggggccgggaagcaaacccggccccgcgcccccggggggggggggccacacccaaacgggggggggggaggggaaggaagggaaaaaaaaaaaaaaggggggaaaaggggggggaggggcggaccagccaggggggggacgcccggcgcgcgaccggcgcggccgccgcgagggggacgggaccgggcccgcccaccgaacggccgggcgggggacggacggcccgccccccacacacggccaccaagccagggaagaagccgaacaaaaaaaacaaggggtccgcgggccccacccccctcaaggaaccaaaggaggaggaaacagaaaagaacggggggaaccggaccacgccggaagggagggaaaaacggcttggatggc

SEQ ID NO: 14660 - DNA, 564 bp, Zea mays
  Clone ID: LIB3279-218-Q6-N6-G1
gtatgaagttacccaaatctattcacaacctcagattttacaggtttacaaatagaggttcacaaaacaagttcaaaaaatacaaacaggttcacaaacgcagaacatgagatcttcttttgattatgtgccatcttttttatcatacgaacgcttgagcatgttatcacgtgggtttcaaaagttgcaactactccacctcgcaaattttccttggactgctaggaggtcctatgattgctccatcctggctagcaggacctgtgactgcagccccttggctcctgtgactgctccaacatggcaaatttgccttggactgctctcccctggcaaccatgctccggtatcaggactacgagagtgacgacaaatgacagcgaggaggcagtgtgcacatgataggaataacaatcatgtctcctgcttcaactccaacccccataccaatgtgtggcacattcatgcgcacaacctccagtaaatcatgcaccagtaggtgcattgcagagacccttgacaaagtggccttggagcttctcctagtcatatgttttgggttcg

SEQ ID NO: 14661 - DNA, 506 bp, Zea mays
  unsure (1)..(506): unsure at all n locations; Clone ID: LIB3279-218-Q6-N6-G10
gttcgattattaactgcagattccattaccatttgaagttcatcacaagatcgtcagtgatcgtcgccatccagggaactgaactttgcaagaccaacagaaaggtaaacgctgcctcagatcaggcagagacggagcaccaccagaaagctactagtactacgactgctctgcaacagaaacgactactgcactccagtaattgaaactactaatacgactagctcatggcaactacgatatggatatggactgcaactacggtatggatatggactgcaactaggagacctgggaggacccatccgatgcacacaccctactcgatcttgatctcgaagacgtccttgcgctcctcgtccttgatcttcgggacggtgaccctgagcacgccgttcttcatgtcagccttgatctggtccatcttgaaagcctgngaggagaggccgatgcggtagctgtaccgcgccgggcccttgtcgtcgtcgcccttcgagtccttgccg

SEQ ID NO: 14662 - DNA, 530 bp, Zea mays
  Clone ID: LIB3279-218-Q6-N6-G11
acgatcacaggaaggtcatatagatgtcgattattaactgcagattccattaccatttgaagttcatcacaagatcgtcagtgatcgtcgccatccagggaactgaactttgcaagaccaacagaaaggtaaacgctgcctcagatcaggcagagacggagcaccaccagaaagctactagtactacgactgctctgcaacagaaacgactactgcactccagtaattgaaactactaatacgactagctcatggcaactacgatatggatatggactgcaactacggtatggatatggactgcaactaggagacctgggaggacccatccgatgcacacaccctactcgatcttgatctcgaagacgtccttgcgctcctcgtccttgatcttcgggacggtgaccctgagcacgccgttcttcatgtcagccttgatctggtccatcttgaaagcctgggaggagaggccgatgcggtagctgtaccgcgccgggcccttgtcgtcgtcgccctcgaggtccttgccg

SEQ ID NO: 14663 - DNA, 575 bp, Zea mays
  Clone ID: LIB3279-218-Q6-N6-G2
gaataacccaggctctatgtatgacttcacggctaggataaaatcagggttgttggggcttagctataagagcacccagattctcaacgttgatcctatagagccgactcaagtataattctcgagcctacaaaaagtcttccaaccaacaacaaatttccgcacactacatactcagaaagttaaaaaaaaagataacaaaaggtatagaaaggacgaggggaatcgcaagttcagaccaccaactctctacggacccaggtatctacgcttatgaggagtactcaaagggttgcggcggttgtggctcgtcgtcaacggccatggcagatgatccggacccctgttggcttgcagctgtggcagtgttgccggtgcttcctccaactgctgtgggagcatcggtcagtgcaaggtcctcggcctcagtgggctgaaggtctcggaggaggatgaatccagaaggcgctggtttcacagggacgtatcggctgttttcaagaaacttgatgaacttctcctgtgcagggatcacccgagctgggttcgtcaggagttgatacgttgcttctggt

SEQ ID NO: 14664 - DNA, 499 bp, Zea mays
  Clone ID: LIB3279-218-Q6-N6-G3
attcaattgttcagatattcaaattctttgaaaaactcagcacaaacattcaaatgttcagatattcaaattcttcgaaaatgttcagactttagacaaaaagtaactctaatatagcagcttcacacacgcacaggggacaactccgaaactgagtgggcagaagacttaacacggtcgaaaagctaaagcctatgggcgagcagcaaccggtgctggagatggagctgtagcagcagcaccaggaccagggcgggggcctccttgtccaccagcaggcctatcctccctgcgcctgaagcgctccggcggcttgcggtccctgcgcttctcacgggatcggacgcggacgatgtgagcgtggatcgcgcacgagacgcagtggtgcaccttggcgtacagcttcgggaggacgtagccatcatagacgcatgcttcctggacgtccctgatggccgcctgttccacgatgttcctcacctgaaacctcttgatcgcc

SEQ ID NO: 14665 - DNA, 555 bp, Zea mays
  Clone ID: LIB3279-218-Q6-N6-G5
gtaccatgggtgttcaaatcagcaccatcaaactccatttcatctctccttgatcgatccttccctttctccttttctctctcctcccggtggtctctttctttttctttgcgttctttctccttcctttctttctctttctctttcttcttctctttctcctcacgctctttctctctttttgccttttcttcctccctcaaacgttctttctcttttaacctttctttcaggtggacaacgcactcttcaaaaagctctctagcataagtctcactgtccaaggccctgaactcttggctatcctcgaaaagctgtttagaatcatcccatgttgaagaagctgatatttccttgatggaatacaaaagatctgaaaaattttcacccaaacgctggcgcttcttagcctccttttgctctttttccttgagcctttcaagctgatcatcatagataagcttgatgttgatgattgatattcctttaagagcatcatcctccagaatagcagtttggaattcctctaatgtccatgatgttgtcataggaatc

SEQ ID NO: 14666 - DNA, 500 bp, Zea mays
  unsure (1)..(500): unsure at all n locations; Clone ID: LIB3279-218-Q6-N6-G6
gggcaccgctgcctgcggcgcgggcgccgccgcggcgcagcagcggacggacgcggcgcgagggcggaggcagcccggcacccggcgccgcctccgcctccggtactgatgcggcgaggacggaggcgcggcggcggcggcggcggcgcgggatgtggtcgtcgtggaggaggaggagacagcgggcagatgcggcgtcatgtcgggagaaggtagctgctgtcgctcggtctctctcgctgggctgggtaggtcgctgccggaaaatctgaaaaaatcctctcccctttccgctgcctcgttcgtctccttcctttcacagtttggtgattcgcgaatcgcgatgggaggggagggtggggtgtggcgtccctcaagctcggcgcgcggatatatacggcatccgctgcggcgagatgcgctgtgtcctaaacctcgccggtgagttggtggggcggaaggcgcggngcgacgacgtggcagcggcgtttggatgggaa

SEQ ID NO: 14667 - DNA, 371 bp, Zea mays
  Clone ID: LIB3279-218-Q6-N6-G7
cctgcttcaaatttcttgcatcaaagcaacacgagcagtacaaagatggataacaatctcatagatgcaggggcaattcatcttaatttatccaaagttctaacacaggccatacagccttgacctttatctaccccaccgtagcaaataaactcgcttcgcttcaagaggctttataatgttcattcatggtacttccttcttatggcacgaaataaagggggcagaaacgcttggattggacagttactcagccacattaaccaattcatactctattagagacaggttgttgtcttccttcaccgtgaaactggctggctctacagcctcaatccgcccccacttgtccactgcaacccacgcgtccg

SEQ ID NO: 14668 - DNA, 572 bp, Zea mays
  unsure (1)..(572): unsure at all n locations; Clone ID: LIB3279-218-Q6-N6-G8
caaacaattccatcgtgaccctaccacttgggatgattcgagctgcccgctagcattcgctatatttacataaccgttgtcgaccgaacggaagcgagaagtgtatgttccgcaagaacagaagaattagaccaggcatggcattttttagaatgccaaggattatattacaatgaagtagtagtggtactgtggtagtagaggcgaaaccgtgtctgactggacacctcactccaccagccacaaggccgcccaggaggatcctagaagacgcttcctatcaccaacgcgtgtttccgagtccgaggcaccaccaagccctcacggagtggctacgttttccttggcaagtggggcgatctcctctgcgtcgtcgataccagctcgactcccctcgactccaaggcccagaagcacctcctcccacttcttcgcaggccccttccaggacaggtcttgcgccatgcagttctgaaccatctcnatggaatgccggggtgtcgtactgcttcagggctcgcgtgacggctgacgctactgctgtcacgtcggctgggtctacagtttcacac

SEQ ID NO: 14669 - DNA, 612 bp, Zea mays
  Clone ID: LIB3279-218-Q6-N6-G9
agtctccaatacccaagttttttttaaccagtttgtttcagtagcaaccaggacacagcagcaaacaactgaacagcagggtaaaagtccaggagttttccgcctgttgttgcatcaaggacaagagcatcaggcagacccccccgcgcgcgcttccgatccttctagtgagaagctctccatctcctctccttctatgtgcaaggtagtaaacaaaagggccctgccagccggcgtcgacccggggcgtacgtaggcactttagtactcagtcacacggtggtgaagcaagaacccaaaacaaaaaggccgagcccataacttagaacaagtgacgccacttttcccctcccctctttcatatatgtctattctctattatatatatatgatgatgatatataagcagtgccttccgcacctcctgtacctaggacacctctagtgcatcagctggcgaggcgcacggggacgcacgggagtcttcgaggggctcacccttattggcaaggatcccagtatcacgccactgcagttcagggcagcggtagcactttctgccatcacaaattccacaaaagcgatgcgagtagaatgatggtagtcaccaag

SEQ ID NO: 14670 - DNA, 558 bp, Zea mays
  unsure (1)..(558): unsure at all n locations; Clone ID: LIB3279-218-Q6-N6-H1
gttaacctcattcacgtttctgtaagagaacaacagatctaggctattatcaattcagtattccacaattcagctggaatccaggcataagtcttgcaagataggggtaaataaaacaaccgttcattctcataccagctgtgatgatacaatgttacttcagaatccaaacacaacattggtctaagcattggaaaccagctaagaattatagtgatagtggccatgatttagtccatcctgctcttaatcacatgctccctcacttcagtcggtgtcacaatcagaacatagccaccccacccactaaggcagtcacggtctattgatgaattcagagcttgggatacagtttcgaagagttcatcaggttccatgttcggcttgtacatggactcacaagcaccatacaaagattctgatgctgtcccagatacaacaaaatccttggccagctcctttgcacctaagcagtccatagtacaaataaatggtacgttgtcatctncaagtccagcaatgactggctggcaaaaatatggccgaatctcttctcgt

SEQ ID NO: 14671 - DNA, 511 bp, Zea mays
  Clone ID: LIB3279-218-Q6-N6-H10
ggtccaaaatgtaatatcttatgcttatgttaaaggcacactaatgttaagtgtgatatgctgtttggcgaagaacacaccaatggttgacatctcattctcacaagatttcatatctgaacagaacaaagctgtgttcgatacacggttccagagatgcggtctcactttgtgttatttgttgcccgtgtgatcagcgatcattctctccttggtgttaatgcgcagctgaacgcttccaacttggttcatttgactctcgtagtacctcttcctcttcaggcactgcattgctgcctgcttgtttcccgactttgtgaactccttggcccgttccacctcttgagagatcttcttttgcaggaccacctctttcgccttgaagacatcgtgagcctgcttgagctggtcggaggcggagcactcgtcgcggcagccgcggaggatccaggcgaacatggccacggcgacagacccacacttgcagcgtcggcggcagcggctactgaca

SEQ ID NO: 14672 - DNA, 594 bp, Zea mays
  Clone ID: LIB3279-218-Q6-N6-H11
ctcttcctccttgataagttcttcctgcatctcaaggaattctaattttctcctcctttcagaaactgaatcttcagatggcaatactgtcccaattgtatccacaacttcgtctggtaaagaagatagtgttgctacaacagcctcctctggcttcattctcccagacacagtaaaggctcttgaaagtatgagaagtgaagatggcacagcatgattaagtgataggtccaaccagtctcggagctgctggcacatctcttcagttgacagcaggcctagatgaccacgttcccggcaggcttgccggagctcttcttcagagagagattcaactccctcagcttgaatcagtttatcatcattcttaatgtcctgaagttttttgcgaagcatgaacctcatgtagtgatctgtaccaaaaggccggatacccatatatttgcacatatttaccaagcgtggtctgttcatgttatccagagtaagttcatcattgaatagctttgcaaaattcaagatttcatcattagagacacgtccacctctcctaaccttattcaaaaattcgtccagatcttcagctgtttgttt

SEQ ID NO: 14673 - DNA, 599 bp, Zea mays
  Clone ID: LIB3279-218-Q6-N6-H2
aaaaatgaatagaaatagagcccgatcctaatccaatcatcttatagtgtaaaatttagagcccattaaacctttggctcggctcagtgggaaaacgacttctcaccgctgcaccagtagtaagggatacatcatacatgtggtaaaagactacaacacccacaagtatggttgcctgcacatttctgctataatcaatctctcccatagccccggtgagaataagaatttccagggccacctgtccctgtttccatagcctccggtccctgtgtttccatagcctctgccaccataatatgaacctcgggaacgtccaccgccacggtaacctcgggcgccaccacggtagggttgcctgtgccgtggaaattcgccaaaagtctctgtatctactctgcgccgttcagaaggtctgccccttccatttggtcctccacgtccaaatgttccactagagagggaatcaaaaaaatcatccttgacataaacaggcttaacagatagctctgggttatcagtttcctcaacctccaggtcttcatcaaacacatcatctcccacctcaccatccttgtcccttgactgcgatttctttc

SEQ ID NO: 14674 - DNA, 514 bp, Zea mays
  Clone ID: LIB3279-218-Q6-N6-H3
ggtggaacagacacttaagcaggtgcgcaacattgttcatatacaaaatggcatgaatagtgcttcctgatcatggatcaggcgcttatttggtgtactcaaattgtgttgccaatacaggggaaatggaacagcaacatcctggggtgctcgcttcgatcttctatggggtttgcctcgggggttaaccgctttagccttggagcccaatgattccacaggcaacacgtccgccagcttttccggtgctcttgctaagctcatgtccacctttgccaaggtcatccggatcagcttggacaacaacagctcggccaatgatcgagtggggtccagcaagaggtatctggctgtcagtgattttgacattaacaacaccatcttctcccgctgtcacattccccagatcaccggcttggcggtcctcatcttccggtgcaccatgctccttgccaaccggattgaagtgtggcccagtcgacatgcagccgttggtggtgtcgccaagcgcgtg

SEQ ID NO: 14675 - DNA, 466 bp, Zea mays
  Clone ID: LIB3279-218-Q6-N6-H4
aagaacaaactgggaccaaataataataaaagacgaacggggaaaacgtgtcgttgcagatgcccaggttgtcgcactggccccgtcactgtttgatcgagtatctgcaaagtagctactagctagggagtaggtttcaaatacgagaggattggcaccgttgactttacatgcgcctgcacattattctcaagtagtactacttgtaatcacccctagcagaaagctcaggccttgagcatgccacataacctttgtttctcgtctgtggtctggaagcgcccatgcccaaacttggacgaggtgtcgatgaacttgagcttgatctcctccagggccagtcgagaggtctgcttcagcagggactggcagagagtcacgaccctcttcttggggccgacacagcaggtagtcgcctttgacgataccgtagtgggggaagccacccatttgggagtgatgtcct

SEQ ID NO: 14676 - DNA, 511 bp, Zea mays
  Clone ID: LIB3279-218-Q6-N6-H5
acacgggtgattttattgctatggcggtaactttgcatatttgatttgatttacacaggtgggtactgcttgcttcgtcgttctttttttatttgtcacatttttgaaatgaactatcaaatgacaaatatttgagaacggaagcaagtactccgtaataaataaataaataaaaagaagcgccaccgcttgcgctttgcttgttgcagcaacaagaagcagacagatgcagcagcaaaaactaaaaagggagtggttggttggtgcgtgcaagctacgttacgctaacccaattcaattcatgctgcgcagctgcagctgagcaccatgtttcgtggcggatctggggctggggccggagccggagcggcgccgcttgtcggtggtggtggtggtcggcggcgggcaggggcggaagaggcgctccagctcgtcgaggcggatgctgataacagggacgggccccgcctcagcaagctgctgatccgccgcttggaagaggcgcttcctg

SEQ ID NO: 14677 - DNA, 545 bp, Zea mays
  Clone ID: LIB3279-218-Q6-N6-H6
gaaacaatattttttattcatcccatatatacagataatttgatctatcatctaatgctgatcgctatgtgccacgcccacgctacaaagaaatgttacaacaattcttctcgctccattcagggcagagaactcgtttatgctataatgtttaaagaaaccacaaagtatacaacatcaaacaaatgcccaaatgacggaaatcttggatcctcaacctttgctacacaggtttctttcgttccaggttctaaaattcatcatcatcaagtggaaactcatcatctggcatcatagctgtcagcagtgagtatttcacccgcaatgagatcttactcctctcaaggttcaactttgcgcctgaaaccacccaatagcccggtgagtcctgcggcccacgcatcatctctgttggatcaacaaacttcagcagctttggggtctgcactggaacaggtggtcccccagggtacaccgccgagtttatgttcacatcggctggccgcggcggaggcgtctgagctaccgaggagaaatgtgtgcta

SEQ ID NO: 14678 - DNA, 570 bp, Zea mays
  Clone ID: LIB3279-218-Q6-N6-H8
ggataaccagcacatcgactaacatgaacacccccttgctaaacctaaagaatacattttgagtaattgggagtataacgatcgctagaacaccttattctttgggggtccaaaatgaacacgaatgccgtaagtaaccaaataaaaaaattgtagagggtgtcagtcaaatgatatataatgttacaagtaaaatatatgaatcacggaactaaactgctggtgtcgggcttccagcgagccaaccccacatgccacccgaactttgcctctgcttagcgtccattgctgcttgctccgaagcggctctctgtcgccgaagcagctcgacctccttttccaatgcatccatactctgaagcttttgtcgaagttccgcaacatcaacctcaagtttgaaacatcttgactgctcaaaagcaagttggccacggacagcttgaagttcctttgtcagctctgcatttctagtctctgctcgggcaatgtcttctttaagttgcacagtttgcagctgttccctgctaagtgttgcttctagttcctctttctgagctttaagatctgcta

SEQ ID NO: 14679 - DNA, 564 bp, Zea mays
  Clone ID: LIB3279-218-Q6-N6-H9
cgaggataaaacccaatatttcacagaattgaccaataaaacgctcagggctcatccacagagcaggcgtgggcgcggcgcaaacgttgaccagtatacatagacaaagaagctcccagaaaccgatccaaacaccaaccattaggacgaccacaaaaggaaactagaccttagttccaaagaaaacggcagtaacagaatagtattggtagtgggtgtccatggtctgaagacataaaacgttgaagaacaaaacggctaggtagcatctgtatgaagttctgcacttctgcaggctaacggtatttatcctacttaaaagtgccagaagcgtgaattaacagcactgcatggtgcttcccagttcaatgccatgtgatttgataatcctagcagctcccaaaagaatttcttgttgggcagatagccactcatcttttctctgactggagaacaaagagttgggtactatgacagggagcttttctggattgatcaatgaagtagaagtgagtcctatttcaaccaccttgccttctattgatcccgcctttatgtagtcgt

SEQ ID NO: 14680 - DNA, 420 bp, Zea mays
  Clone ID: LIB3279-220-Q1-N6-A1
gcaaccaaaaaaatcgttttacattatttatgtcaagaaaatatgcaattcatgtttctttacataagtaaacaagatctaacagagccatcttatcaacatgagcgtttatcactgcacaacacgctgctctttgttactatatttttcagccatttctaaatggatacccttcgcaactatggacactgatctataaacagaaagcaaggtcccatgcccgaaccaaatcgaccagcaaagattacaagaacaagaactgctgaccttaagtcgcaatccttatgaggtctgagtagcaacctttgctcccaccgcattttgctcagtgccacctccatcgctatgttccgtcgtcggatggtccactgttatcattggctcacctttaacaagaataggcccttcactcaccggctt

SEQ ID NO: 14681 - DNA, 416 bp, Zea mays
  Clone ID: LIB3279-220-Q1-N6-A10
gcaaaagcaatgtcatccacgaattaacgttttggaggtacaagtacaccattttgtttgattgcacatcatgcttattacaagtttgatagatgcatactctagttcgtactttaacaatgggcacggttgaaagcaaaataaaatcgagccaggaggaaaacgacatcgtgccaatgtcagcatcacaaatgtctcgagctcatgcttgctccgctttcggaggacctctccacttgaagttctcagcgtaggccttaggcctcaaaagaggtgcatggcgtttccgaaccacataattccatccatgtttttcggcaaacgcctttgctgactctgcactgtcaaacgtaagtcctgcttcaccgacattagcatatggatccccagtagatgtccatcccatcaacgggttc

SEQ ID NO: 14682 - DNA, 449 bp, Zea mays
  Clone ID: LIB3279-220-Q1-N6-A11
ggcagtaattgtgtttttttttcacattaattcttgcagcaacaaaaatagattctcctcttctttcacttggtcggtcgaatggagcaggcagtagtatggctgctgaacgtcgtcgtgtcagtgtgggagggcggcggccttcccgcagaggatggcgttggcggggatggcgtactcgttggagaggctctgctccggcgtccacaccctgaggtagagctgctgcccgaggtactgccggtcccacatcgccgaccgcaggttccacatcccctggttgtccagcgacaccaggatcgccgaccacccgttggggtacacctgaacggtgtgtcttgcctgcgcgtccaccaagttgtacgtctgccgctgcgtctcattccactggccatcgccgtacctggagaaagaagccacgggcaatggtgtttgacaaggcacggcac

SEQ ID NO: 14683 - DNA, 545 bp, Zea mays
  Clone ID: LIB3279-220-Q1-N6-A12
ggacaacaacaaatttactgtgtcgaatcacttcgttcaaagtcactcttcgatggtactcgccagaaatttattctgctcggaacaagcacattgctggcaaatggcaaatggcacaagaaactagtccctacccagcgcagcaaagtgtgaaatgacataagacataaccgggaagactcatctttacgccttcacttgaggaggagcatcgccttggagggcgggatctgatttgacggcatctagtgtcttgaagaactcctcaggaagagcaacgggccggtgctgaggaacatgcttaggaattggggtgtcgtcttcaatcacctcacattcgtagtcatcagggacaccccacggatcccattcaatcattttggcgatgagcttgagctcgtcctcggcctcctcgatgagctcctcgacttgcccgcatccgattcggtcctcgatgcgcttccagtcgtcctcctcctggcagatctggaggcggtgattggtgaaggactcaacggccttgcggtagccctcgtctttgggga

SEQ ID NO: 14684 - DNA, 552 bp, Zea mays
  Clone ID: LIB3279-220-Q1-N6-A2
aatcctggaaatcatgattttacttgcaacgggaacacatgcaatgtagttacacatcacgctcattctaaataacctggagtcttgaaatccataaacatgagcagagcaaatgaactcgcagtccagtgcattacagttgcttgtacaacaataacaagatagagggaaggggggcaggcatgaaaaacttcattttgtagcctgagcaataatgttacttatggagctggcttcctttttagcagcttcgaccaatgaatcctgtgcagcaataagtcttgcaacattcttcttgctagattcttgaagttcaccagcgatgagaatctcatccagtatgtagtaggccttatgaaaattgaatatcaaatccaactcacatacactgccaaaatagcggtccagtatctcgacgaaatgatggatgatctcaaggacttcaagctcattgtcctcggcatcaatgcacatgcagaaatacaggctaacatacctccggtatacgaccttgtaacctctccactcaacaaaattgcagagtttgggccc

SEQ ID NO: 14685 - DNA, 580 bp, Zea mays
  Clone ID: LIB3279-220-Q1-N6-A3
cagaataaggtacgacgaaatgcatttcacattgacaggcccatcgaggaccaccgtacaaacacagtaacacaggagataagtgactgtccagaatccaaactgcagtcgataagaagcaaacaatccaaagttcccagcacgacctcatatcacaaactcgtatttactgacggcgacacatcacacatcaaggccaacagcagcagatgataaaccacgggaagcacagataaaactagggtagggaaggtggtggaatagctcacatgccacgccccatggtctgctccatgggcggcatcatgacaaagacggagtgcccattgttgaatccagggtggggaaccctgcggcgcagctcgcgaccctcctggcagagggcgcaggggtggcagaggtagtgggtcgcaaggtcacaggcggcctctaggtgctcacgcctctcctcgtcctcgaccagatcgccgcagcacccaacattgcctggtgaaagcctcaaagctaccctcaagattgtagcgttgtcgaatagcagtacgagtgggatgagagaacatggggcaaggcagttccaccc

SEQ ID NO: 14686 - DNA, 568 bp, Zea mays
  Clone ID: LIB3279-220-Q1-N6-A5
ggttaatacattactagttagatacccgtgcgttacgaacggaacacaaattattcaataaaatattaaaacacaattattacataaaaatatacaacacatgtattatatctatttctgtgtcagtctctgccactgtccttatcctcttcctctcttcccatgactatggtgcttcctgcggaaaagcaaggcttgttaaccccttcaagactcacgtttagaattttagaatagttaatatggtacaataaaaagagcaaaaagagggtaaggtcccatataaaatcattcagctctctagtctgatatactgcacgtgctggtggtcaattctctttactaatattgatgtcttaagtgcattggtaatccaattctcatttcagccacccaactcggaaccgaacaagctctttaggattgtaatacaactcttcctttgagtatgccatcgtcattggaaattttgcaccgacttggctagttatttgcacaatttaatttgcttataaagcaaaacaccaacaagacactgtgatcgatgcttaacctctctgtgtgagca

SEQ ID NO: 14687 - DNA, 430 bp, Zea mays
  Clone ID: LIB3279-220-Q1-N6-A6
aggactcaaatctaacatacccaagcagcaactggttactggtacagcagactaatttacattcagattggcaacttggacaccggctatattatacagagtttatgcaagtatacctctgcatttcaaaattcaaatacaccgacctgccaggcccccgtgcagaaaccaaccatttagaatttagaaatgtgaagggccaagctactcagtcccaacttggtcgatgatgttagaggtttttgcttgataagtgccatgcaatgcatgagcagctacatgatgctgcctgcgtcttcaagtcccgtcacttgggttccaaaagaagctgcttccttcggctgagtatccctgtggaaggtgaggtccatagacgacgttttcagaatgtggaagatgaggtccgtagacaacgttttcagaatgtgga

SEQ ID NO: 14688 - DNA, 545 bp, Zea mays
  Clone ID: LIB3279-220-Q1-N6-A7
ctcacttgtggatcccatttataaagagaatagggttgtctggagtgctaatcccctatgtgctaatcccctatgctgttaggagcgttgataaagatgacaacacagtccatcgcttaacagaaaagaagggcgtccgtaagactaccaggtcaacaaaaactcttgcaccagcaggatgtaaagccatgccaggtatcttcgcgcaattatgatgctagtatttcatgatgagtacaggtctcgttctcacaatgcagataaaacttaaagcgcaaacaatcaatttccgccgatgaactccttcatgctcttcagccaaacaacatactccttctcatcctttctcatcatgtattcgtacagccaatcatgtagtgaatgtttgaaccccctgacctcaaggtacctgtgcaaggccttctgcaagctcttatccaggtccgaaaattgtggcccctcatacacattcttagcatcggggttatcacggttcagcgccctcatattttcaattggtagttcatcatcattaaagttgcagt

SEQ ID NO: 14689 - DNA, 428 bp, Zea mays
  Clone ID: LIB3279-220-Q1-N6-A8
gcagtcaacttccaaattaaataaaacattaggtaggttcaaccgtatcatgtgcagctcgctgttttccctacacatattacaaacaagttctttcttcaacagctcaaactcagatacggcgcaaagatgccagtcgcctttccagatcctcaacttcagcagaggagggttctagagcaggagccgccacgttccttgcaggacgtgcttgaccgttatcgactttcttgttagtagctccgatgcgccctttaggagccgaagagagctgaaaagccacatcgacgccaatctcgtcaaggacctggtttgtgagctcttctgtttcctcctccgcctcatctttgtcaagtgtttcatcaatagcatcagacatcatctcaagcgtcatgtccaactgtgttgattggttctggaattctttc

SEQ ID NO: 14690 - DNA, 516 bp, Zea mays
  Clone ID: LIB3279-220-Q1-N6-A9
gtgaacaaacaacagattatggcaaggccttcacggcattgtttcagccgtgcgacgagtattacacttctccttttctgcactcgccattttgtattgagcgtagacatggatccattacggcgacagcagaaggctaaaacctactacaacagtcaacgtgccatgacccaggcttccgtcctgccgtcatgagctaggcgcttccttccacctgcaagcagcagctgctgctgcccgagctgctgacgaggcaggggaggtcgcgcacctgcagcttcacgctgcgcgagccgatcgagtccaggacgtccacgcactcctggaggtcggcgtcgttcgccaggatcacccactcgtcctcgtcgtccttgtatttgagctggaacgctcctgtcgccagcttaaacctcttcgctacctcttccagcaggtggtaccagcccattgccggcaggaacttgaacgcacggtgtcgccgttacaagtagctttcaccgtcagtgcatcgctgct

SEQ ID NO: 14691 - DNA, 313 bp, Zea mays
  unsure (1)..(313): unsure at all n locations; Clone ID: LIB3279-220-Q1-N6-B1
gaaacaaccattaaaaatgacttttattgtagatgtaataaatccagtagccagctgctacagacacgggttaagtctttttacaaggtgcagtgctgcagggaaataggtaggtagtncctncagnnnaaattaccagggacncacgtgaactacaggaattccataggttcctcagaaattacagcatccgtcggctgatctctctgtgatatgaactacagngaccacatgaaccgataaatcaacagagtaatatacatngctcgttcccgcgctttgcggtcccaatagctgctccaagtttatattg

SEQ ID NO: 14692 - DNA, 596 bp, Zea mays
  Clone ID: LIB3279-220-Q1-N6-B10
ggcggcgggatccaagtcaggcggccatgagttgctgatgtttgaggcccttcgtgaagccttgatagaagagatgaatttggatccaacagtgtgcgtcatgggtgaagatgttggtcattatggaggttcatacaaggtgaccaaagggttggctgagatgttcggagatctccgggtccttgatacccctatcgccgagaactccttcactggcatgggagttggagcagcaatgaaggggctgaggcctgttgtggaaggcatgaacatgggcttccttctccttgcctacaaccagatctcgaacaactgcggcatgcttcattacacctcaggcggccagttcaagatcccggtcgtgatccgaggccccggcggtgtcggtcgccagctcggtgccgagcactcgcagcggctagagtcgtacttccagtcgattcctggccttcagatggttgcctgctccactccttacaacgcaaagggcctgatgaaggcggccataaggagcgagaaccccgtggtgctgtttgagcacgtcctcttgtacaacctgaaggagaaatccccgacgaggagtacatctgctgcct

SEQ ID NO: 14693 - DNA, 413 bp, Zea mays
  Clone ID: LIB3279-220-Q1-N6-B11
ggggaaaaaacccggaacttcgtgttttcaggggtgtttggtaaaaatgtcactcggttttaattttacaactagtaaaataagttcaaatggaaatgggcattaaattaaggggagccctcctccggcatattcaacctcccgagcaggagccagagaagacacccaatctgatggatttgttggaagaaggcccaatgtattaagcttccatatacccaatcccatggcagccaaattgagggcaataaagagcaacttaggagcaatagtatccacccttgggtccttaaatggttcaaaaactttcccaacaaatcggaaagcgttgaggggttgccacaaagcaaaaaaggtaattcccatgcttaaaaagtggacagtgctccctgccattcacattataaatccca

SEQ ID NO: 14694 - DNA, 588 bp, Zea mays
  Clone ID: LIB3279-220-Q1-N6-B2
ccaaagttgccccagctccattgataaacacattgcgaccataacttgaactcgcaaaaattaaatctaatacatatcttgttataaccagtttgtgtgttcgtaaccagaaaacaacctagaagcaacacagctttctttgatagcatcaagcgatggactaaaaactcgatcatggtcaagatgtatatgtggtacaacatctctgcaaactggaaggatgtagaaacctgtgccaaaactggatttctcactgactccatccaggccgacctaaagggcttctctgagatgaaacgccttcgaaatggctctagctttatcgtactcgttcagaacagccagtatgtttttcaaccggcgagctagcccacgtgtctcgtcctcgctgatgcctgacgcgtgcctcctctccagcttgtttcccagctcaaccactagatctgcgaaaggccgcagcttttggttttgtttaggccagacttctgagagcgcggcggctactcgctcggcccgggtgatcgcgtcgtggacatccaggatgatgctcttcatatgaggaagaatcttccctctcagtagttcgtc

SEQ ID NO: 14695 - DNA, 576 bp, Zea mays
  Clone ID: LIB3279-220-Q1-N6-B3
gataaaagcactaaacgtgtgtaactcactgataagcaagacaggaaatgacgatttagcaattttacaagtaaactaaaatctaatgatctaagactttacggatagttacaagaatcacaactcgtgcacaaaaatggatgtaccatccaagtaaatcgacagttgaatcccttgcatcatttgatttgttgtacaagggagcatatacttaaacctagcaagaaatgtgaattgggagctgacaaacaacagactcatctgataaaaattgctaaacaatgttgttatattctgtcattgaaacatcctgaggaagttatttgcatatgccatcggcttcacatcaggatgtggcacagctgagaaagtaacaatatctggtttcatttctggagctgtgaagcgaataaatgcacccttgttgcccatctggtcacagtaattaggcgcagagaagactgttataagctttccatcatgttcaatttcatggccttcatcctttacttcatgagaccggacaataagatccaggttattttcctgtaaaaacttcttagtcacatctgcgcc

SEQ ID NO: 14696 - DNA, 547 bp, Zea mays
  Clone ID: LIB3279-220-Q1-N6-B5
caaataaccatagcaatgcattaccaccatgactaaattcataacacaggcaaaagccactgcaccacttacacacaccagccaaccaccactactaccatgagaagcggcacatcacagtgcttgcttgagaagcagacaacaacgacgcctactacaagggggctaagacgaggtgaacttggtgacggccttggtaccctccgagacggcgtgcttggcgagctcgccggggaggacgaggcggacggaggtctggatctcgcgggaggtgatggtgggcttcttgttgtaccgggcgagcttggcggcctccgcggcgagcttctcgaagatgtcgttgatgaaggagttcatgatggacatggccttggaggagatgccgatgtcggggtgcacctgcttcaggaccttgaagatgtagatcttgtaggtctccacgctcttcttcgccttcttcctacccttcttgtcgccgccctccttgccggcggacttgcccgcaggtagccgcttctccgccttgggcttcttccccgcggggcct

SEQ ID NO: 14697 - DNA, 585 bp, Zea mays
  unsure (1)..(585): unsure at all n locations; Clone ID: LIB3279-220-Q1-N6-B6
acaatcttacccagttcattgattattcgagaattaagtggatagtttccatgttcatcacaaatgttacacacatacttgtcatgcaagaaccttgaagtacactccaagcacaacgtatagcacaggcagctgcatgcggccatgcttattaattcggaattgcgcagtagttcgatctcatggcaaccacgggggcaggaaggtggtcatgcatgagctagtcagtgcctctgaaggataccctatctgaagggtgggttcaccagcaccatcgaggggatggaagaagttattgccattgagctgctgcggctgcacttcagaatgccgctcgctttgctcccacgcatgctgccatataacctggttgctctcctccagtcttcttcgaagacacttatttgcttcacaaaacatttgttcctttttctgaagttctgtcagttgatcaaccatgtgttgtgtccttgtagatcttatgtgcttcaaggacgaatcgagctgcttctccaggtgctccagctcttttatgcctaatgactncaagatcttcaccaagcaagttccttttgagtccgctgt

SEQ ID NO: 14698 - DNA, 529 bp, Zea mays
  Clone ID: LIB3279-220-Q1-N6-B7
agcacacataagtggcgatttccattgatgacaacaaagaggttgacatggtttgagacattgctgatcagtacaccactccttccacacgacccgaccactagtacaaacttccgagaagagcctgcgccacgggccacggcctatccggccggccgcctaggcgcgctccccgcggatgcggcgggcgagctggatgtccttgggcatgatggtgacccgcttggcgtggatggcgcaaaggttggtgtcctcgaacaggccgacgaggtaggcctcggcggcctcctgcagcgcggcgacggcggaggactggaagcggaggtcggtcttgaagtcctgcgcgatctcgcggaccaggcgctggaagggcagcttgcggatgaaaagctccgtgctcttctggtacttgcggatctcgcgcagcgccacggtgcccgggcggaagcggtgcggcttcttcacgccgccggtcgcaggggccgacttgcgcgccgccttggtcgccagctgcttcctcggggccttg

SEQ ID NO: 14699 - DNA, 462 bp, Zea mays
  unsure (1)..(462): unsure at all n locations; Clone ID: LIB3279-220-Q1-N6-B8
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgncgtagccgccgcctccacggncaccaccgtaccc

SEQ ID NO: 14700 - DNA, 582 bp, Zea mays
  unsure (1)..(582): unsure at all n locations; Clone ID: LIB3279-220-Q1-N6-B9
gttgtattaacaatgaatcatattgtgaataagaaaaatgaagtttgtacatggagctccctaccacttatgggacgacgagagcaacctctgtccttgttagttcatttactctaatgccattctctagtaggagctgcaaaatccttgctgagggttcagatccagactgccccctcttctctacagctcgcaggcatgcacaacacaccctagctcccctctgtaggtgagtgtgtcgtccatcacgtcgagctcccagtagggccattgcatgacctcggcggagcagccaataagccctgaaacataaattgataggtgtgctgcatgtggatttccagcacctagtttattggacactaatattatttgattgataaaattgaagtttcaagttttggatctaaaagaaatcatggtttgtaaagcttgtaccatcatgngtggtggcagcangcaatgaagtgttattgataaactccgccatgatgcatttgaaaccatggtttgcaatagactcaatagagttaataaacttcaatgaaaaatatatctataaattaanggatagctgcattt

SEQ ID NO: 14701 - DNA, 592 bp, Zea mays
  Clone ID: LIB3279-220-Q1-N6-C1
agatgtagctagttcagattaaagccataggaagtcaggaacatgctgtccattgttagggtcacccgaaaccataggttgacaccgctccccagtaccgatcaaacacagacaaacagtcagtagggcctcttgtaattgtgctgctatgttgtatgccatgtcaagaatgagtattggtaagcattcaagagttcactcaaaacttcaatcgatacaaaacctaataactcagtatattagatgcagacagacttgaactgctacatctgacagggcaccacgtcaggactataaattacagcctccttcctcttctaccaccctttctgcgtgtgctgtctgtggggactggagtaacatcctcaatacggcctatcttcatgccagatcgagcaagagctctaagagcagactgagcaccagggccaggggttttggtcttgtttccaccagtagcacggagcttaatgtgcaatgcagtaattccaagctccttgcatctttgcgcgacatcctgtgaggcaagcatagcagcataaggcgaggactcatcacgatcagctttaaccttcatgccaccagtgatgcg

SEQ ID NO: 14702 - DNA, 53 bp, Zea mays
  Clone ID: LIB3279-220-Q1-N6-C11
cgctacagcacatcgcacagcacagcacaccacgatcacattccgaagggtcc

SEQ ID NO: 14703 - DNA, 505 bp, Zea mays
  Clone ID: LIB3279-220-Q1-N6-C12
gcaagaacaaaattatcattattcgatagtcgtttgttgtgtcactgataggagaatcatcattcacattgtatcgtattgtacaagcattgacattatgttcggccacaaaatatacattatagaagtatgatatatccttaattaagcaaacatgggccaatcggaataggatgcatcggtttgatcgaaaggtatgaagccgttttacgccagtcaatgcaaataattctcgcatccttagcgaactttggatcaaagctgtctaaagtcttccacacatctccattgtgtaccatcacttttttgttctcccactcagcttctttgtgccactgcatgagcatggtcattctttttgagaaaaatgttgtttcagtcgagctgtaataggcatgtaacgaagttatttatgtgcaaccatcattgtaacaactgtcatcatttataaccttaatgttcctcattttgccacattttaagcatttggtttgtttctgggggt

SEQ ID NO: 14704 - DNA, 584 bp, Zea mays
  Clone ID: LIB3279-220-Q1-N6-C2
aaaagctaatctcaggtcccatattagcgagcggatctgtcacagatggtagcaggaagggaaacaaaagtgcaaaacatgtccagactcagcatgaacctggcgacccagaggcacgcgccatccacatttattctcggcatacacaagcagcaaccatccatgagaagcaggggggaaaaacccctactgggtcttgaacatgtggcggatcaggtcgacgacgcggttgctgtagccccactcgttgtcgtaccacgagacgagcttgacgaagtggtcgttcagagcgatcccggccttggcgtcgaagatgctcgacctgctgtcaccaaggaagtcggtagaaaccagatcctcttccacataacccatgatacccttgagtggaccctcggaagcagccttaatagctttcttgatatcctcataggaggcccccttctcgattctgacggtgaggtcaacaaccgagacatccacagtaggaacacggaaggacataccagtgagcttgccattcagatcaggaagaactttaccaacagccttggcagcaccggtgctgctaggaatgatgttaa

SEQ ID NO: 14705 - DNA, 595 bp, Zea mays
  Clone ID: LIB3279-220-Q1-N6-C3
ccaagattggcttctttcatatttatttccatcaattatccgtgaggacaaacccaaaaatgacccccaataatgcatgtatacgttgatcctacttaacaatggcaatatcaaaacggagaagactggctctgtgctcttggtttggagacgccactctttggtggcctggttatttaacatgacaaaaaattgtgttaggtctcatccatcctaacttcacagcagcattgaagttgggttctcgatgtatcccttgaatgctttcagaaattccgcaccgattgcgccatctataaccctgtggtcacagctcagtgttgctgacatgaatgaaccaaattcaaactgaccatcagcggaaccaggtatcaccctcttctcagcagaaccaatggccaaaattgctgactgggggggatttatgatggcgcagaattgtttaattccgaagggacctcccaaatttgatacagtgaaggtgccgccctcgtaatctgctggttttaggctattatctcttgctttttgagccaactgcttcacctcctcagcaattgcaccgagtcccttcttgtctgcatccctaattact

SEQ ID NO: 14706 - DNA, 580 bp, Zea mays
  unsure (1)..(580): unsure at all n locations; Clone ID: LIB3279-220-Q1-N6-C4
ggtcatgtctctagcacttagataaacatgttagtaacaaaaaacaattgactaagtccaaagacatacctttctttttgatttgcacatcttacttagttagcacatatgaactcaaaacaatgtgttgggcatctaatcaccaaaacaattatagaaatgtcctaagggcacatttccctttcaatctcccccttttggtgattcatgccaacacattaaaaagcaactaaaaagtgcaaattgaagaccaaatttaatcacataggattttggcatatttggattactcttgccaccacttggtttgtttttgcaaattaaattcgttttcctatctctaagtcaaacacacttgtttgggcaaatatagagatattgcaagagtaaaaatgattaagtgtcaaaaactcccctttttcccataatcaaaattctccccataagaggccaagttttacaaatgagaggatttgggacaaaatacaaatttcaactctattatttttgaaattacatgtggttggctgatccagttgctttggccttaatttctncccctttggcattaagcaccaaa

SEQ ID NO: 14707 - DNA, 406 bp, Zea mays
  Clone ID: LIB3279-220-Q1-N6-C5
attaaaactctcccctttctttgcacaatgaagcgagatcatcgtctcctgtgagttataacacaggttttcatggtcaaacaaccatttgccggtgttgccacagccttccatccaaacaagcaagaagaaatatgcccatcacctaaacagcgctagcattgctgcttctcttgaccttgaagtaaacaggatctttcagcaccttcactttcacgttgctccacacgtttgtgcttgtcggcagcagtgccatctcctcagcgatcgccatgtccatgggaagcacattcccgaacacggggtaggcgtccctccactcctcgtggtccgctaagctgatcaggaactctggccctgaccctacccaggcaacggacccttttttcaccgccggacatgcccc

SEQ ID NO: 14708 - DNA, 83 bp, Zea mays
  unsure (1)..(83): unsure at all n locations; Clone ID: LIB3279-220-Q1-N6-C6
nntttttttttttttttttttttttttttttttnttttnttttnnttttnttttnntttntttttttttttttnttttttttt

SEQ ID NO: 14709 - DNA, 501 bp, Zea mays
  Clone ID: LIB3279-220-Q1-N6-C7
aacagcagcgcctcaaatggcatcttttgccccccacaaagtcaatacagacgtcagatacctctgtgtactccatcacgtaatcgtgaatgggccaccccatcgtgccctggatcaaaaggaaaaaaaccatgggccggaatgctggcccataagtacgatacgatgcggctctatagcccagcctagaatcgtaacattaaagtctcgctgttctcaaggaagcccatggttgtacgaggcccgcgcatgccggtgcggacggcgtcggcccgagactaggctgcggacggcgggacagcccgctccccactcaggcgaatggcgatcatcaggcctccttttttacaagtgtaggccttttcgccgccaggcggacgcggtcgccgtccagctccccgaggcgcgcggcgcggacgcggtccaggaggccgtagtagagcgcctcgcggtagagcgtcgcctcggggacgcccggcggcacgtggagcgcccccgtgc

SEQ ID NO: 14710 - DNA, 574 bp, Zea mays
  unsure (1)..(574): unsure at all n locations; Clone ID: LIB3279-220-Q1-N6-C8
aaatgtgaaagaacaacgctatatttattaatttgtgctggttataccagaaaatcttagccaactactgtaacacaaatctcccttccggctttcaatcacaactaagtgtgcactgtgtacatacattcacacaacattgcatggtagtcagttatcatccagggactcctttctcgagaattgaaatggttgggtaactacgatttctataaaaattgtagcaacacatggtaatcaggtatcatccacggagatttaagaaccttgcaactatttgcttgattcaagcttgcaagagtacgagcaactatgaccttttcctgcacttcattatcctgatcaggtggacaagatgacgatgaaggctcacctaccatgatctcacatgatacatggtttcctggcactcacttgcattaccgtaacaaccataggcaagggaatggagctcatatccgaatagtcttgaccttgaagtggagattgaatagcgaaaaacaaaaattttagatcatgatctcacatgatacatggtttcctggcactcacttgcattaccatnacaaccata

SEQ ID NO: 14711 - DNA, 234 bp, Zea mays
  unsure (1)..(234): unsure at all n locations; Clone ID: LIB3279-220-Q1-N6-C9
aaacacacgnnccgaaaagaaaaggggatcgagatgtatacctagcagccggctaccacatgatgangaaagaagtcattcgcacacaaatactacataggatagaaagggtagactacgagagtgaagtcgacagccagccgcagcaaaaacaagatacagacttcgcttatgtgccacgtactgacaacactctcacaagctcacagacacacggccacctcctctcacggc

SEQ ID NO: 14712 - DNA, 111 bp, Zea mays
  unsure (1)..(111): unsure at all n locations; Clone ID: LIB3279-220-Q1-N6-D1
gaacaagatcgaccaaacagttcatttcaccagctagaaatgtgttcaaataggggagtggcagnaaaaataacacggtttnaccagatttactgtcacaaactgttaccg

SEQ ID NO: 14713 - DNA, 548 bp, Zea mays
  Clone ID: LIB3279-220-Q1-N6-D10
aaaacgaagggaaattcacttgcatcaaccaaccaaagttcagttcaccgtgtcagagtctcagaaaacaggcgtagtagaatggtacagagcagggacaggctaagccgtccgtgacgttgccatctactcggcgagtcggcgatcttccaaatccgctgctgcgatctcagagaactccacatggaaaccagctaaacaaacggtttatgcgcagcgacttctactggcccccgtggcggtacaggagcaacgaccggtacaccgcggcgaggtggaggaacacgatgagcaggatgagcaggtcatcgacgaatccaaagaggcccagcatgctttcgggaagaatgtcgacagggctcagcacataaattgcactcagtgcgaccatcatcagcatccgcgccctgaacacgagtgggagggtccgctgggggtccattagttctctgaacagtcttcggatgaagaagggtaggtcttgcaacctctgagttaggctgcgtggtgctccaccaaatatacagttatagtgctgaatctctcct

SEQ ID NO: 14714 - DNA, 80 bp, Zea mays
  Clone ID: LIB3279-220-Q1-N6-D11
acatgaacaatcattaatataccatgttcgcaatcacgtcccaaacctcacaactcctcgaggaggttacgttacgtaca

SEQ ID NO: 14715 - DNA, 333 bp, Zea mays
  Clone ID: LIB3279-220-Q1-N6-D12
ggtattcccaaacacattgggctttaaaagaaatgctgactaaatgggggctaaacctaggaaacaagaggggggggaatgccttttttccaggggggagctttaggtggcattggcatcgacgggggaagccttggaccaaccaacctttttggggaggaggggctgggggattttgggcataacccccccccttgggaaggggggaccaccaaacaagttgggaaactccttttttttgcccacggggagctggatttgacccggcacaaagcgggtttttttggtatccctcggtgggttcccagaaaggtccaagaacttaagggggag

SEQ ID NO: 14716 - DNA, 563 bp, Zea mays
  Clone ID: LIB3279-220-Q1-N6-D2
gaaacagcggcaggcctgccgtggcgaaacatttgctcaataacttatacaaacaataaagtgtgatgctaaggggaaggcaatagcgcagacatcaaattagctagagtaaaaaaatatcttttatgacaacaaatacaaaaccacacacagcccctatatcttttatgacaacaaatacaagcattgagtaaagcaagttcaagcaaccatctgaatatcacaggatattagtatcttttattcgatgcatacatagggccttctatggcttccttgctctatggcaccttagcgacgcaacagccagcgcagcagctctttggtggcagaagcagaatgggtggtggtggcgcagcagcggcggcagcagcagcagcagcagcacagcagtagcggcggcggtgggcagagcactcaagtttagctaacagaaaacttcaacttgtatatggatgcaaaaagcgacaggcaggtcgattgcattctcctcgtttaaaatcacggcatacttcaacattggcgctcgcagccgctgtatgtgtcccaaggtgtaaaaaccg

SEQ ID NO: 14717 - DNA, 585 bp, Zea mays
  Clone ID: LIB3279-220-Q1-N6-D3
atccaattatctttattattattgcaatcttccaagtgcaactacacaccactgccaaacttcgaatgataaagagtgcagactaacaagtagtacaactcatgacatcgtactctccagtcctgaattctggtctggagtagtgatagcagcaagcaactttaccatcaaagagctttttttacgagcactgtactgtacacgagctcctgtccattaacaggactgatgctgtcagttaatgatgcattacattccctggagtgaatgccccttcacagcttagatggaggctggtaccatccccacggttcatccgagcaatacttggtgacttgcttaactgtcaggtagttatcaagaccccattctccgagctcccgaccaaaaccgctccgcttgttccctccccaaggagcttggacgaagcatggttgcgagcaatttatccaaataataccagagtgaagagcctttgaaatgcgctcacacctctcttgatcattggagatcacggcaccagctaaaccatagtgagtatcatttgcaagttccacagcttcactctctgtcctaaactcctta

SEQ ID NO: 14718 - DNA, 535 bp, Zea mays
  Clone ID: LIB3279-220-Q1-N6-D5
gaaacaatacggtagcaatctgggtctggagacaagggaacatggaaaaacgaagtgaatccatacatagattcaagctaccataaatacattcatactgctctataacaaattacaagatcaactatggcaatctcgagtaagcgtcagttagtaggaaggggggtgccgttacatgtcactgcgacatagactactcagctacacaggtcacattgtcgtacaagtacgtaaccttgcatcttcaacaacaggctcgcatgcctcagatcgtcaaacatcccaggggaaatgcacagttgcaaccacaggttccagtctcaaggcgcggtcatttcacaatccaacataggaacattgcttctttgcatgttctggaatcaatttcgcgacaatgtctgatgggactcctttaagttcgtgaggcttgaaattgaatagtggtggcaaaaagcgaccatttggaaggcgagtattaggatctcgaagctcatcaaagaatgggtgaacaagtgcctccatagcagtgcatctc

SEQ ID NO: 14719 - DNA, 587 bp, Zea mays
  unsure (1)..(587): unsure at all n locations; Clone ID: LIB3279-220-Q1-N6-D6
gattaatcttttgtgaagaccattcattatacttaactcatgatcagcattctactctagttacaacttacaaggcctttcattaggcagccctagatatatgtacaataatgaagggggttataaaactatttgagacattctccttgaaacattcacacagcacgattaacttcttcgagctacatgatcattttttcctttctttccatcgtttgctcttaacagtcatagcaagtcccgcgcacctctctagcccaaaagaagtttgcatcacgatgaatatgtaccgtctcaaaatgccaaacacaaaaaatagaggtgaggccatcatactcttgaaaaaaaaaatctttggtttgcttgtgagtttcaagcaaagcttccaataaccaatgatcggtgttgtaggatgcttgtatagagcagtcgagtcttttagtgccctgtcaaaacagtgaaatgcagacctataagaagtaaaccaatggttagtgcttccattgagggtgcagacactggataagcagggccatcagagcatcanccaaggcacgaaagcatcgcaggcccgcatggcaacacta

SEQ ID NO: 14720 - DNA, 552 bp, Zea mays
  Clone ID: LIB3279-220-Q1-N6-D7
gaacttaaattaattcaaattaaagaacatggcgaactttagacttggcaccatggtttgtttacaaagtactattattagtatacaggcatcaccattgcccattgccacggcgatacatatagtctgaatatccctcccactagctaaattagtagtctcccatctgctgtggaaatacattagaattgtatgcaaggttcacagctggatttggatggctatatgcccaacgcttcggcggtgcagttgaatccaacctttcgttggggtaaccatccaacctatgcagagcattctgtgtattataggccctccggtaaccctcgccatagtaagggtcggtcatgtcaaaccggacagaactacttacggatggtatttctgagtcagccacattgcctcctgaagaaaaggcaaaccaaacgtatgatactcatgaagaggagagactgtcatatgggcactgttttggtcttcatcaagcaagtcatttataatatcaatgtggggggaattcttcgcccactgacccatacttgctggcgtgaa

SEQ ID NO: 14721 - DNA, 451 bp, Zea mays
  Clone ID: LIB3279-220-Q1-N6-D8
acatggggggggggcataagaccactggtcaacattcaaataaccatagcaatgcattaccaccatgactaaattcataacacaggcaaaagccactggaccacttacacacaccagccaaccaccacttctaccatgagaaggggcacatcacagtgcttgcttgaaaagcaaacaacaacgacgcctactacaagggggctaaaacgaggggaacttggtgacggccttggtaccctccgaaacggggtgcttggcgagctccccggggaggaccaggcggacggaggtctggatctcgcgggaggggatggggggctttttgttgtaccgggcgagcttggcggcctccgcggcgagcttctcaaagatgtcgttgatgaaggagttcatgatggacatggccttggaggagatgcccatgtcggggtgcacctgcttcaagaccttg

SEQ ID NO: 14722 - DNA, 402 bp, Zea mays
  Clone ID: LIB3279-220-Q1-N6-D9
gcaaacgagaactagacattagacaagcatcacagttccagactagttcacgaaatagtttcaacgaattaggactccttatacaattttttgtaataaaaacggctcgaatctaaaggaactccacttaacataggacaacacaacatagcaagttcaacagagaattgttcccaactttccagcaagcagaatctcctaatcatggttgaaagactggtacagaggaacctgagacatcattggactaacattatcatagcaatggggatacatcattgttggggttggccaatgtcgataaacagcagctccagaagaccctattgttagatcaggctggccaaagtacatagtatgctggtttgtggacatgccaggagattgcaccccacgcgtccg

SEQ ID NO: 14723 - DNA, 578 bp, Zea mays
  Clone ID: LIB3279-220-Q1-N6-E1
gaagaacacagctcattgcattttcatacttaagttgtaacatctgtgtcggtgtcattcataaaacatagagaaattcaaaagtgaaatacatagttgtctgccgtctcctcaaaaggtgaatatattgctcaaccattccaccgcctcgtctactaaggatccaacaacccattagagtaaattagagtaaaatactatgcctcatcgaacttgatctttttcgctgatggttgaatgctccctataagagctggacactcatagtcaataccagctgccttgattcttttgcgacgctttccatcccgctttacaattccttcaaccatctttttgtgctctgctacagtcttatccttgttgtgtctcttccgttcaattgctactcgatcaacaggtataaatccccttcgcacccctttccataatttaggatgaactttctccggctcaacaagtgcaacttgcaaggtgcgctcaaacaagagatagttattcatctcatctgctacgacctttgccacagcagggttctcaaactcaatgaatccatagtgcttggactttcctgtctt

SEQ ID NO: 14724 - DNA, 483 bp, Zea mays
  Clone ID: LIB3279-220-Q1-N6-E10
agttcaaaaactctctccactcgccattcattactggttgttcaaaatcgtcatcgaacagcttttacaaaagccgccccagatagattcgctggccccggcttgtagaacacctatttaagcttatgtatagctttttgcatagactacatgattcagtgagaagtgtatttgagtggcggcgcattaatcgccgcccttcctgatcttgccaatccagctggccaccaccggcgtcagcgccaccgtcggcgggaacctgatcggcgacccggccttgtgcgcggcgtaggccaacccgaaggtcccgaccttccctccggtttcccctgtcacgatccccacctttgcgagcaggtcctgcacgttgaccccggcgctgaccaggaggtagcataaagtgaaggaaaccatggaaagcgagatggaggtggccaggtacgccccgccctacttagccagcagttccttggcctggtccgt

SEQ ID NO: 14725 - DNA, 413 bp, Zea mays
  Clone ID: LIB3279-220-Q1-N6-E11
tcgcgatctatttttttttttttttttttttttttttttttttttttttttttttttttttttttttttttttttttttttttttttttcggcccgggccccagggaaattggcaccctcccaaccgtcccatttttaaaccccttggtatcaacccgttccaaggggggccgaattttaaccttaacccagggccccgaatggcgatgcctttttcgaattccttgccggccaattttttagccccatttcaggttgggccccccaaccagggtcaaaccttgtttgggaaagccttaaatttttttaaacaaaaccccttccccggcccaagcctttaaaaaaggggtccttggggcccatccccctaaaaggtttttggaaaataaaataaaaaccttttccggccccgg

SEQ ID NO: 14726 - DNA, 421 bp, Zea mays
  Clone ID: LIB3279-220-Q1-N6-E12
ggccagccatctcgggatggcaacacatgttttcttctaaaaaaaactggatcagtaccacacaaacaataacgggtgctattttacaaatggattcgacacacatattcctaggtgtacactactagggctgggacccttaagatacacagcatgcaccaactaccaggcacagctaatgcagcctcagcctgcatttgcaatgtttgagcctgaacctgacaaggactgcctgcaccatcaacttttggttacaaacggcatttctggatgatgccatggtctaaacagttagtaagttattcatactgatctggcatctgtacatcaatcacagccatctactgctccaggttgatcggagcgggcgctgaactataaaaggtttcgccaccatgattcggcgggcttcaaattatac

SEQ ID NO: 14727 - DNA, 576 bp, Zea mays
  Clone ID: LIB3279-220-Q1-N6-E2
ggatgaagaagttatgaacatttttagttgagccggtgtgtcttgctcagtaataagcatatgctaaaagcaagagaagagtcatcgcaaagaaattctatgcagagccgctatcagattcaccagcaccagcttttttcttggcaaagtactcttctgctcgggcttggttctttagataattttgtggaagccatttctttcgtttaggtaacagagttagggaacaaccagctgcctcaagcttctctttagctgaagctgaaaacgctccagccttgatattcaacttaactgatacatccccatctcctaagatctacaaacaggtgaacaacaagtgatcatgaaggtaagacaaaatatgattgcaaaaactaacaggtggcacatgccacttcatgtttatgttagcagatatggaagtttgtagttactctagaatatattgtaaatccaatgaacaacctatgggaacattgccaaattgtacaaacaaagctattcaacacttcaagtggtgctcatctaacagaaacaaccaaaaaaactcgatcccgtattgcatgttctaat

SEQ ID NO: 14728 - DNA, 531 bp, Zea mays
  Clone ID: LIB3279-220-Q1-N6-E3
aagtgaaattttcactatattggagtaaaataaaagatgagcattctaagtaattagcagggagttaacataaactccatccagttggccgttatatatacatacatacagggatagtacaagcatggcgatacacactcacttggttaattagaaatcacaacaatcgcggatacagttattagaatcccgctctctattcgccccggtcaagcctgcagccagtgactgcaagcaggaggcacctggcgcgcgccctcatggaccttcgatctggatgctgctgaatgaatgagcgagaccgccggttcccctcaaattctggagctctgctttgatcgtctccgcaatcttggcctcctcaaggccaggcgagggcacatccacgtggaccgagccttgttttctgggaccaacggagtcctgattcagagattgctgctgcttcatgtagttgtacagctgctggtggaaagggtggtcgtaggagtagcaatctactccatccagcgagtcgctggatgaacctga

SEQ ID NO: 14729 - DNA, 507 bp, Zea mays
  Clone ID: LIB3279-220-Q1-N6-E6
cagttcaggcttgctcttattttgtccaactgttttcacaaggtatgacgctactgatggaactgcacaaatgaagtctacggattgactgacagcatgggaaatgcgcccttgggtacatagcaggagactggaaaggtaacaaatggaatacggacacgtagataaccatggaggcccagcaatgttgaggtattgtttggtcactgcatagccgatgatgatcaccacgcctcgtggatgcctcatgtcttaacagcagccagatgatctttgagcccggttgccacctaccacatccacggtatctggcacatacaattcttcctccggttcattcttcaaagcattctttacaatacactggaaggcattttccacgttcgttccatccttagcagacgtctcaaaagtacggaatgttccctttagaggcgcaccatgcctttgcctttttctccgacaccacacggttgttcccaccatctacatcaactttgttaccca

SEQ ID NO: 14730 - DNA, 480 bp, Zea mays
  Clone ID: LIB3279-220-Q1-N6-E7
caacaatatggacagttgagaagctcttctacatgaagtaacaaatatattacagtatcagcaagttctaccacagatactgatttgtcaaaggtgccccaaggtaaagggaaccgaccacaggtgtacaaccaaacaattcagagtgatagtcatgtagagacttcattccatggcaaatatctccagcctattttttatcaagcaaatggcaatagatgaggactgaagtatgatgggttattacatcaagaacatcactgcgttctcatgcaccgctcgcatacaggcgagtccactccttagctgtttcgacagcttctacttcattggctttccagtgctttgcaatgttatccgaaagagggtcgtctggatttggcgcactcagtagagcctgtatactcaaaagaactgttcgaatctgaagtgctgggctccatttgtccttgagaatgtcgaggcatacccacgcgtccg

SEQ ID NO: 14731 - DNA, 536 bp, Zea mays
  Clone ID: LIB3279-220-Q1-N6-E8
agcacaatccaacagatggcaacatgtcatgttcaagcagtagccacatgttcagacagtattcgtcagttcgagtagactagttgaggctgaatctgcacttcagtagttagacatcctacaggagttcatgcagcacatgctacgttttttatatacacatcataacacgtttccgcagcacatccaaaacaccgaagggccagtttgcagattccgcgctcctcaatcaacaagacagctgcttccgatttattgtcggtctagttccattggagattcacttagcagcttttatgtttgcgagggcggtaagaacctcggtgactgaaccttcgatagctgacctattagccttgagagatggcactagtgcgtaaacctcttcaacggtctcaggcccaatgtttgctatcatgcatatctctccatcactgaccccacattttttaagaggttcaatggcttgtttcacagagcttgcagtggagaaatgatttccatcttttgaatactgaaaagctttgtcaaatgac

SEQ ID NO: 14732 - DNA, 466 bp, Zea mays
  Clone ID: LIB3279-220-Q1-N6-E9
gggtatgacacgcaaattatattgatcctttcaagcaatacttagagcgccaggatacttatagtagtaccaccattctgaaacatagtagcgccaggacgaaatataggatcgtccaaaaacatatccttaacaagagtttaattcaataaaacctcggtgccagaacctagcagacttcacaaaagagcatacttagaacaccctgtatggcttccccatggtgctcttgacgtagaggcatctcacattctgccagttcttcttcagaagggaaacaaggaagttcacgctcatctggatgttctgctggatctgcttctcctccatcgccaagttgccgacggcgacgcccatgcaaaggaccttcttgagctggaacttgacggttgccttagtctcgttcaccttggattcgagggattcctggtgagtaaccagggtcgggaacttgcctgccttgttg

SEQ ID NO: 14733 - DNA, 454 bp, Zea mays
  Clone ID: LIB3279-220-Q1-N6-F1
acgaccccagtaacatgggttttctcaacaacagattcatcgacatcattctatgggttacaagccacatgggcaggggcgaagcccggatccaaaattaggggggaccaaattagattaggggggtgtttacatgaaaaatagctaaaaacaaacatgtcctataaaattaggggagcattaggaggacatttccccctgggccccctggcgtcgcccctgcacatgggactcaggctatgacaatgcattttgaggcacaaacactgggtccccttcgacaatgtcgttggccaaaaaaggaacaggggggggggcctccatattcactacgacttttaacaaaatatccaattaagcgcacctttacatttttaaaggacaaaaaatgcggcttttattatagcccaaatgaataactttagcatccacaacccgaccaattttgtaaaaa

SEQ ID NO: 14734 - DNA, 380 bp, Zea mays
  Clone ID: LIB3279-220-Q1-N6-F10
aacccgggggaaacaaaaaccaccacttttgcacaaacatgggtcattttaggggacaacgccaactcatcatttcgacttgcctatgcaatgcaacgggaaacaaaaaaacacatgccttttgcagcattaatcaatccacgttcgtacaccctttccgatccgaaagacaatgaagttgcatagcatagccgttgagcttaattgctggggaccaaattgggggcgtaggcccatgccttgttgttgactgggtcaacgatgtggtcagggaggtttttgagcgggcccttgccggtgaccatggcctggaccaaaaaacccaacatggaaaacatggggagggggccgttcttgagctccttcaccttgagctcggg

SEQ ID NO: 14735 - DNA, 547 bp, Zea mays
  Clone ID: LIB3279-220-Q1-N6-F12
gcggtattgaggaatccacttcagaatacaacctagcacgcgacaacaaagcaacgacagtaaaatagaggtgttaaggtccccattattagtgcggttccacgctgctgctacgacatatataatcacataaataccaatataataaaaccaacagcacgtccctgccccttcctccccacagcgtcagccagcctttcaccgttcagacttcagacttcgcggctccccaacctttcaagatactgggccttgcgccctgcttgccgtccgcagtcatctccattcccgctgactccatgccatcgaacgacttggcggggctgtacggagctttgctcacgaccctgtcacgacgtttctcaaggaagcgctggagagagtgcctcctggcaatggggagatcagcctgaagcttgcttattgagctagggtcagcaacaacctgagcttgtccagctgctacagaagtgctctgcagtgatggagaccgtgtaagcacaggagagaagactgctgctggggcgacagtggctgtatgtaccat

SEQ ID NO: 14736 - DNA, 524 bp, Zea mays
  Clone ID: LIB3279-220-Q1-N6-F2
gaccaaccatataatctctccttacattgcaagagaaggttacagcaggacagctactactagcacactactagcggcaggattacaactagaggaggcggtggcaagaacacagcaagcaacgggagggggaacagaagggggaacagagctgctagcctagcgcggacacggattattaactcgccttgttcgaaccgacgagctactacttagccgggaaaacttagcatagatccagacggacggatctgtctggggctcaaatcatgccgcacgtccagcgaatcggggccccctctcctttcgccgcctttgggcgcggcgtctcgggggccggcgcggttgctagccaagtcaggcgtacacgacgccggaggagagcgccatgagcaagatggccgcgcgctcctcctcgcccaggcggcgcctccgccgcatccgccgccgctgcttcagcaccacctccttgccgaaccccaccgcgcggagctccacggtgacctcgtcccggacgcgtgggc

SEQ ID NO: 14737 - DNA, 441 bp, Zea mays
  Clone ID: LIB3279-220-Q1-N6-F3
attcagcgatcagtagtcatatattgagatctgagatttaaaacagcacctattgagatttaaaacaggcagcgttgatgcttgggggtaagtataagtgccgaagaagcgaacacactaccaactaaacagcatcacttcagggacaacactttcaattactaactcagagcaggcactactagtctacagcatctcaaaagacagacagcttccagacgctacggagcagcaaagcccggttaggcccaacgacgatgagatttccctgctgactgcaagcacttgggcagcccagagtttcacccgtcatccatcactcatcaccctcctcgtccccgtcgttgacctcggacttggacttgtcagaatcaccagacaatgtgggtcctcctccagactgcttgttgttataggcgtccatcttctcccacgcgtccg

SEQ ID NO: 14738 - DNA, 260 bp, Zea mays
  Clone ID: LIB3279-220-Q1-N6-F4
aataggtggccgggccacaggcaaaagcgacggtccatggggtccagagttaaaacaacaaacccgaaaacgctaggcaactgggctttactactagggggaccgggttctcacacaaaggaccagttcacaaacataaaggcaaggcagtgcggggtgtcgtcgtcgttaaagaccttccaccccaccgcctgtttgtacaacaccggccgcccaatgcttaaaaaaaacaccccaccggggaggtacccaaacccctg

SEQ ID NO: 14739 - DNA, 544 bp, Zea mays
  Clone ID: LIB3279-220-Q1-N6-F5
gtaaagcatctccgagatgaagcaacaacgtaaacagccataattattctcaataacccggtagcaatgcaggggaattaacaactcttacaacatcaggtgttgtaaaccacacaatacttcagaacagacacacataacacgatagcaggagcaactctcggcagatcacgggataagggcagcacactggcctgatgctgcgtcatcagcaaacttctctagtactcgtcaccctcgtcgccatcctcgccctcatcgaactcagcaccgacctcctcgtagtccttctcgagcgccgccaggtcctcacgggcctcagagaactcaccttcctccataccctcaccgacgtaccagtgcacgaaggcacgcttggcgtacatgaggtcgaacttgtggtcgatgcgggagaacacctccacaacactggtggagttggagatcatgcacacggcacgctgcaccttggccaggtcgccaccaggcacaacgctaggaggctggtagttgatgccgcacttgaagccagtcgggcaccaat

SEQ ID NO: 14740 - DNA, 314 bp, Zea mays
  Clone ID: LIB3279-220-Q1-N6-F6
gagttgcattgggctagcataacattcatcggtgttatagatatcgttactctatactgtaaaataaaattttaaattatttttggacgggagaggcatctcgcccaagacaagacaaaacgatagtcaaaactttgaagtttgaccatggatctcaaaatgcaaacacattgagaaatggagccatggaggagggagcagtcagcagtgacgacggatggtaccttgaggaaaacagcggttgcaggtggaatactctcaaacatattgcctgcgacgaagtgcacgttgccatcagacggagcaccggcgac

SEQ ID NO: 14741 - DNA, 368 bp, Zea mays
  Clone ID: LIB3279-220-Q1-N6-F7
aaaaaaaaggccaattttttaaaaacaggccccgggggggggggaaaaaatagccggggcccttttaaaacaaaccggttacaaaaggggccacatttttggaaaaagggaatccataactttaaccccccaaggtcccaagtttgccttggggggggaaaaaaagggggggtacaagggtttggagaaaccaaaaatggttggccccccccccgaaaagggggggtttttgcctttaaaaattttaagcccacatggaaaaacaaaaacaaaaccaaaacggggaaaggccaccacccacaaatccgggggaaggttacttcctacaagttggcccccagggaacaggggattattggaaccaaaaa

SEQ ID NO: 14742 - DNA, 214 bp, Zea mays
  Clone ID: LIB3279-220-Q1-N6-F8
aaggataaccataacgaacaaaacagcttctgtgaaacgcagtcaaacgataacaagtatatcaggaagttcctttatttaatacgcgctgctaatgcaggctacgtgttacaatattattattcaaaaacacggccatgtggataccacatcgatgcagatttttggccccatcaaacaagtagcagcagatgagatcgagttgaggcacgcc

SEQ ID NO: 14743 - DNA, 521 bp, Zea mays
  Clone ID: LIB3279-220-Q1-N6-F9
attgggaaccagttcaaattcgaaagttttctaaattgcatcacaaaaaagcaacaagttttatcctcatgatatgatgtttcaccacaaatttatgacatcacgacagggcacagttctttctggagtttgttcccagcttcaaatcctacgcatatcaccaccacccgcttgcccgcgatctgaatcagtccacaagtgtgcccaaaatgtcatcctctctgaagaggaggtactctttatcagccgcaagcttgacttcagatccaccatactcgggcagaaaaacagtgtcgccttccttcaaagcaactgggatcagattgcctgccttgtcgcgctcaccagggccaacagccaccactttagcagcattcagctgcttggatgtttccgggaggaggatgccgccggcggtcttcttgggctgcaccagcttctccaccagcacccggttcagcgacgggagcagcctcttcgccatcgccgccctcctctcgtttcccttcttcttgcgcagc

SEQ ID NO: 14744 - DNA, 436 bp, Zea mays
  Clone ID: LIB3279-220-Q1-N6-G1
agatgcggaacgaaccctccggaactggggggtttttacacttttgacgaggccgcgtttgccgagttcaggcttgagaatcaacagcagcagcagcactacacacaccctggacaagggcctgccaccccctgggggtttgaccaccacccgttttgcggttttgtaaacccatccaatccaatatttacatgcagggacaaactgacagctaccaacaacgaggggcgagctcgttatgggcttttgatgggcgccttgccggggggaaacccgtgcgggcggtcctttttagcacgtacaaacaacggggggggttgcttattttggccggcccgtgtactcctttcattgtactaaaaggctcgttatggggcatagcgcgaggagaaaaagaaccagcgggagggagcattgccctgcattctggcggggt

SEQ ID NO: 14745 - DNA, 372 bp, Zea mays
  Clone ID: LIB3279-220-Q1-N6-G10
agtctgatacatacattttattcatcggtgagatgtaacatgcaagaaaactatggaacaagaggccggaatgaaagtttgtgtaagcgcctcaactcattctaaaacactcttcaaaatttatgtgatgacggtgggggcagagcgtccagtgtactcttgcatcttggagagcttgagcgcaacatcaaccagcggagcaagggcgtcctgtgaatccctgccggtcttagaggagtccctctcgtactgctcgatgtagacacggatggtggcaccaacagaaccggttccagagaggcggaacaccagtcgtgaaccatctccaaagaggtatcggatgccctggtgcttggacacagagccatcaac

SEQ ID NO: 14746 - DNA, 426 bp, Zea mays
  Clone ID: LIB3279-220-Q1-N6-G11
acaaacaaacagaaaaaaatgacacatgcacacacaccacagccacaggactccaacactagaacggtcaggagcaggtccgaggagtttccctggcgctgcatcggcaaccgttgtccgtggacgtcgtacaagtctgccgccgtgcccgtgtgcctcacgaagcacggggaggacattcaaaccgtctcccgcgccatggtctctggccaacgccgcgaagcgaggcgcttcacgtctccaagccccgccaccggccgcggtggcgacgtcacggcgacgcactgccgccgatgaggctccagagccgtggccttcggatttggttcgctagcgcggcacaggtggcggccttcacgaccatcgccgctgcaacataggccaagaagcgcggcccccaggctcgcccagcacccgccggcgccg

SEQ ID NO: 14747 - DNA, 538 bp, Zea mays
  unsure (1)..(538): unsure at all n locations; Clone ID: LIB3279-220-Q1-N6-G12
accgtctggaattttacatgcngaaaaatttgcagacgaggaacacaagagttgcctacgtacgatttacatcttaagaccttactttactttagggtaggaaaaagaacctccgacgtaactaagatcagtccagtaattaaattatttacctaggacgccacgtcacgtcagtcgtcgatggccttggccctcatgcagcaggacgggccgcgggccttctgcttgggccgccggctgtcgcgccgccgcccgtacaggtactccacaagctgcacccgcgaccgccgctgcacctgcacggtggtgctcgccgccgccgccttggccgcgcgccgcgccgcgcgctcctcctcgtgccgcagcagcgcgtgctggaaccgctgcagctccagctccagccgcccggccttgtccgacatcttgcgcacgcgctccaggatcttgcgctggctccggctgcgcaggtccacgtcgccgncgccgtcgcccgccgacgtgaactcctccgccttcttcaggactttacgtttcgcgt

SEQ ID NO: 14748 - DNA, 274 bp, Zea mays
  unsure (1)..(274): unsure at all n locations; Clone ID: LIB3279-220-Q1-N6-G2
agcaaatattcaggctcattatacttngaaaacaatagaattacattnaaaaaaggcgcgaaaccgtgaggcgtggattaacaagaagaaacggtaatggtacagtaattcatgaagtgaagggatnntttacaatcaccaccagctgggntgctgnaaaacaccnncctttttttttttnnnnnnnnnnccncccccggcttttttttttttttttttgggggggggggggggggggttttttttttttttttttctcccccccccccccccc

SEQ ID NO: 14749 - DNA, 578 bp, Zea mays
  Clone ID: LIB3279-220-Q1-N6-G3
atgtacctgcacacacattcacagggtgcaggacaggaaacaccagagcctgcctcctcgtcagtcgtcacagcgttgcatctgatgtaacgctcagttcagttttgcagagttacccttttacacataaacaacacgcgtacccaatcatatactactgaacatacaaaatgaggacgccatttatttggatgtacagcaatggcgtcaaccaggggatctctgagttccacgcaggggatgatggttttgaccgcggcagtttttctgccaggatctcacatctgaggcccggattttgggtagggaaacgagcagctcccgatcctctcgtcatggaagtgcgtagccaggttgaccgaggggttattggaggagctcagcggatttgccatgtccatggagtcaccgaacgggtcgaagaagtcggagtacctcacgttcgccactggtatctccggcagggagttcagtatgccgtcgaatatctcgtcaccctgtggcacgatcgcgagcataccagcttctgctgcgacggggcctgcatagtcatggaacgcttgtggagctggcagtgc

SEQ ID NO: 14750 - DNA, 425 bp, Zea mays
  Clone ID: LIB3279-220-Q1-N6-G4
ggcaaaaaaagaaattggtccattgaaataaggttccaagatacagatcataatcttttcgaaaacatatctaaagcacaaatggggacatgcttcctctggctctcaaggtaggatgtgaaactttccatgtttacttctcgtaaatccaggggtgctggctgctctgccaatcagcagggccctcggggaaccacagggcaatctccttattagcactctcaatgctgtcacttccatgaatgacattcctgccaatgtcgacagcaaagtcgccacggatggtgccgggctcaaaagccagggggttggtggcgccaatgatcttgcggccagttgtgacgacgctcttgccctcccagaccatggccaccacagggccagagatgatgtagtccacgaggccctggaagaaggcttggagg

SEQ ID NO: 14751 - DNA, 504 bp, Zea mays
  Clone ID: LIB3279-220-Q1-N6-G5
aaagcttgactcggctgtctcataattttcaattgcacataacagaggcgcggcatattacacaattggtacagatgaattacaagtctgggttcggataaaagcagctccgaactttgaaagaggaatggaatggaatggaactgcacgtaacatagtaggggatcatttgaaacagccacgaatccatccttttaagaccggcatcatctcgaagcagcagcatcggctcccttaagacctactcttgaacgggattgccctgatgatcacctggtggtagatggcagccagcgcagcgccgatgaaggggccgacccagaagatccagtggtcagcccaggcatggtgctggttgtaaatcacggcggcgccaaggctccgcgcggggttgatgccggtgccggtgatagggatggtggccaggtggacgaggaacacggcaaacccgattggaagagggcgaggatcggcacatgggagtcctggcgttcctcttgcgtc

SEQ ID NO: 14752 - DNA, 599 bp, Zea mays
  unsure (1)..(599): unsure at all n locations; Clone ID: LIB3279-220-Q1-N6-G6
gcctgtaacacatntactgaattcaagattgaaattgttctgcatttacatgaaacagaagagggagcgttcctatggggaaaattcactacatcaaatcaatgacgaatctatcagttattaaccagatacatctctacaaggaaagtagggagagaggaatgtacagatgggggtggtgagactaccctgctatctaaaagctaaactccccatgatcaggtagccaaggtgtgagtcggaaaaagaatcatgtagactaaaatctccaaaaaggagaaagaaccaaataccaccttatctgcctacaaaccttttttactagcctaggaaaacatttggtctagtcttgagccagtgcaccatctccttgtcaagcggggaattattcaacacggtgtccatcattggactaccaaagaatctcggatcactcttgaacacccatatcctatcctttggccatggtctttgtgcctgtttttccatgcgcgataacatgaatctcacagttctgtttccataagctcgctcttgtgatggctttgcagacttcaatagaaggatgagacatctggcaacgacatgcaaccttttct

SEQ ID NO: 14753 - DNA, 597 bp, Zea mays
  Clone ID: LIB3279-220-Q1-N6-G7
gcaggaaaattttaatttcgtccaagtgtcttatttcacggttacaactattatcaggattttgatagctaatctaatctaattccagcaccagcccccaaccctaaacctcatatgtatatataaaaactgaataagagaagagggagcccccccaactcttgcatctctggagatcacgcctcattaaccaatcttctttcttgaaccagtgtgtttccatttagctcctgatctcttgtgcatccgatgaaggtaccaaccttctcaccgacaatagcctttgcaatgtttccaggctcttgcaagttaaacacgacaatgggaatgttgttttcttggcatagtgtaatagcagtcatatccattactgagagatctcttgtcgtaacttcatgatagctcacagtctccagaaggcgggcatttggattctgcctggggtccgcatcatacacaccatcaacatttgttgctttcagcactacctctgcattgatttcggcacaacggagagcagcagctgtatcagtcgtgaagaatgggttccctgttccagcagcaaatatgacaactcttcctttctctaaatgtctg

SEQ ID NO: 14754 - DNA, 322 bp, Zea mays
  Clone ID: LIB3279-220-Q1-N6-G8
aaggtccagatcgaaccatccaagatttattccatcaccatccatccgaattccgaaaccatagttcaactacggagacaagattaaccaaccaaaaaagcagtgttcccctcggccacagtccattctcttattagatcgactcacttcgtccaggcaagtgatcgatctatgggtcgacaccaagcagaaaaaacgccagaccagccatcacgttactatactgagatgcaacagaactacgatgacctagtggcactagctaccactggtgatgatactactactactgccaaagggggatcttgaaaacgagttgcac

SEQ ID NO: 14755 - DNA, 435 bp, Zea mays
  Clone ID: LIB3279-220-Q1-N6-G9
gaaacagagacaaatagagagctctttatttctttcttctatatctgggtgcctttacaatggagactgaactgctctcctgtttatagagggaatggacatgcagagctgtctagaagcctctcccgttgattactctgtctcgtgagccagcgctcgtccatatgctttgtcgtcatgtgattaccgtccacatgattgattcacccacgtagagaaatatttcctccgtctcctttcatctccagtataacgtatggctcgaaaacaagacacatctatctatacgaatcccaacactgctaaacctgaacagagcacgatcacacgtccagttccttatgcgtgtacagctgcaggcctttggctggtcttgattcctttgatagcttcagcgtagtctggagccccgaaaactgcagagccagcaacgat

SEQ ID NO: 14756 - DNA, 557 bp, Zea mays
  Clone ID: LIB3279-220-Q1-N6-H1
aaccacaagaaagcaatcacagagttgacacggtggttatcccgtggttcggccaagtacaaaacttgcctactccacgttgtggcgtcccaacggacgagagttgcactcaactcctctcaagtgatccaatgatcaacttgaataccatggtgtttttctttcctttgatcttttcccgtttgcgaggaatctccacaacttggagtctctcgcccttacaattgagttcacaaagaaatacggagtaaggtgggaatgagcaacgcacacaagactcgaaaatcagagcaacaacacgcacacaagtcgcaacaagagctcgcaacgcaacacaaagagttcacaactccacaagagctctatatgctatcacaatgaaacgaatgcgtgagattgatgtcttggtgcttagaagagttgtaggaatgcttggtgtgctcctccatgcgcctaggggtcccttttatagccccaaggcagctaggagccgttgggaacaaatctggaaggccatctttgccttctgtctcgtggcgcaccggacagtccggtgc

SEQ ID NO: 14757 - DNA, 176 bp, Zea mays
  Clone ID: LIB3279-220-Q1-N6-H11
cagagtaaacgaatgagaaggaggtcataggagcagcgtaagtttacatcgtttattactgtgccaaaatgaaacggtcaaaccgaagcaaactggtgaccaaaatttatcattcctcagctggcctctgccccaaaaccgatatgtcttcgtaccttttcccgcccacgcgtccg

SEQ ID NO: 14758 - DNA, 408 bp, Zea mays
  Clone ID: LIB3279-220-Q1-N6-H12
tttcggccgcccgcgatctagaggtgattccaccggtcatggcggctccgatccgagcaccttcggcatgggcgggcgcgggttcctccccggcggcgcggcccttgcagcggcctctcctggtgggcacggcctgccccggcgacgcggtagcagccgtccctgcccctgcgcgggcgcggcggtcaagggcgagcaggaccgacccggctcgggcggcaccagccactgccggcgcgggggcacgaccttggcggctggagcagccctcggtgcgagtgcgcaaccctggcgcgtgctccagcgggtgcgggcagcatccggcggcgcacacggtgcggtgggcgcggaccttgcctggctccccggcgactcacggcatgcggccccagtcgggttgcggcgcgg

SEQ ID NO: 14759 - DNA, 389 bp, Zea mays
  Clone ID: LIB3279-220-Q1-N6-H3
aaagcatgaggggccacaagccccctcccccgggaaagggccatttctcaaagaaacagcccctgggtttccatcccacccgaagccaagcataacccccaatccaaatccgggcccaacactggccccaaaaaacagaacccaagcaaaaatattcactgggtgcaacaccccaaggtcatgcccgagccctcggtttacaaaaccaaaaggggggcaaactttggggccccaatgcccaaaacaggacctggccatacttttaaaaacccggctcaataagggaaccggcgagcctttccaccaccatctggcattgccctggagtcattggctcgggggggaccccaataatcaaggccatggcgggtttccagacagtaatgccc

SEQ ID NO: 14760 - DNA, 354 bp, Zea mays
  Clone ID: LIB3279-220-Q1-N6-H4
catgccccattgtagagcaaagtaatttactttatcccccagcttacaagttaaaaccatcaaaagtttcagtagctgcagcagcaaaggccatgcacatcgcaggccatggcgtcgcagttgcggaaacacaacaacattcgcatgaactttagctactggtacagggcaacggtaaatatagagttctcctgctagtatgatcgaaaagcacttcacaacgaccttgaaacgctctgttttgggctgctatacttttgttttcctttgaacacaccgcccccgtcgccgggatccgaacacttaaccggaccattcaatcggtaggagcgacgggcggtgcggacccttggg

SEQ ID NO: 14761 - DNA, 430 bp, Zea mays
  Clone ID: LIB3279-220-Q1-N6-H5
acaatcttacccagttcattgattattcgagaattaagtggatagtttccatgttcatcagcaaatgttacacacatacttgtcatgcaagaaccttgaagtacactccaagcacaacgtatagcacaggcagctgcatgcggccatgcttattaattcggaattgcgcagtagttcgatctcatggcaaccacgggggcaggaaggtggtcatgcatgagctagtcagtgcctctgaaggatgccctatctgaagggtgggttcaccagcaccatcgaggggatggaagaagttattgccattgaactgctgcggatgcactttagaatgccgttcgctttgctcccacgcatgctgccatataatctggttgctctcctccagtcttcttcgaagacacttatttgcttcacaaaaacatttggtact

SEQ ID NO: 14762 - DNA, 465 bp, Zea mays
  Clone ID: LIB3279-220-Q1-N6-H6
ggggggaaaaaaaaaaaatcggaaaaaaaatttggaaaaaaaaaaaaacgggaaaagggggccctttttttttttccccccccccccctttttgaaaaaaaaaaaaccatcggggaaaactacttttaaccaaaaggggcgggggacaacccttttattttttttgttgggcccccacctttagttgggaaaaaacaaaaaaaagggccctgaaaaaaaaaaaaacctttttttggggggcccccctggggggggaaaacccccggggagtttaaatttttttaaaaaccaaaaagggggggttgttggaaaaggtttggaaaaaaaaaaaaaggtttttaacccccccccgggcccaaaaaaaagaactgggcttggcccggttaaccttttaaaaaaaaaaatggggccccctaattttttgggcaaaaacccggttgggttaaagggaaaaaaaaacctttt

SEQ ID NO: 14763 - DNA, 553 bp, Zea mays
  Clone ID: LIB3279-220-Q1-N6-H7
acaaaaatctcgtagaaatggaatgatctactgagcgggtggtactcatccatccactgatcgaaaagagtgttgtaggcaaaattaacattttctgatgctgctgggtacagaagtactattcaccactctgtttggacaacatttacaggtatggagaattgcagacgagacgacgaaaagaccatggaagcttctgttttagctctagatacacagatcactttgtaactgaataaaatataactcatcgcatatggtgcctcagtgtttcctttgtcccacggcgaactttgcagcggatggttgggagaccaaggcgctggtgagcctcgtagcggtggcatccagagaagccataatagaccccatcgacctccaacacatcaataggtacttggaggccgatgacacggatactgcccatgagttcttgcaccttgactggatcattggcccgcgttcgcatcagtggcctccggatttggtccagtggaatttccattatcactgggcccttcttctccgaatctgttgtcagggatggcactgc

SEQ ID NO: 14764 - DNA, 453 bp, Zea mays
  Clone ID: LIB3279-220-Q1-N6-H8
acccagcaatgccctactaaacaatcattttcatcgactcggccccgtcacttgctccatgggacaaacaacggggttcaaggggctcaaaagtaacccatgtggcaaaatttaacaatgaaacaaatttcccaaattctttcaaaaagcctgcatggggggggttccacagtagcagagcatcaaaatgtgtgtgctcaacggtagcggcggagggaaagggtttggttgcccttccagggggccctcctggacggcctgtttttggggggaggggggcccttgccacccaaaccacggaactttttgcctgcagaggggaaaccacggagctcacggggcttgggcacaggattgcataaccagttgatttttgggtcgttgcggatgggggggtgagccacatcaaccaggatgatctcgaagtacttgtaggggctttcctcattcacc

SEQ ID NO: 14765 - DNA, 521 bp, Zea mays
  Clone ID: LIB3279-220-Q1-N6-H9
caaagttcactcgcgtgaataaatagaatgaatcatggatcaatcagtataacaaactaatgtcatatataaaccacatcctggtgacattatgtacagtaagactgggcgagctatatatctatctattcatggaaatgcttgctcgaaaaggccccatgggcggccatgggctctttcctggcttcagtccattttgtaagcacgccgatcttcacttcccacagttccatctggaggtcggaacgcatttgaggtagtggcaccagccgcagggatcattcgcgttcactcctttgaaaagcatccccagcccaatggcgaacctgcgcaacacatgagtttaaattcagtcaaaccgacaaaactgagagaactttattttattattttttccttttgggggggtgggacgcggacgaaagctgacaggatggcattagattagcattatggcacgagcattaagaaatttgagctagtactcgaactcctactgctactggcgagttaggtctcaa

SEQ ID NO: 14766 - DNA, 642 bp, Zea mays
  unsure (1)..(642): unsure at all n locations; Clone ID: LIB3279-221-Q6-K6-A1
ccataccgtcggactacacctgggttgatgccaccgagaagaagcggaggatgaaggcaaagaaagccaagagcaggcggggcccagcccgaaaacagtcctcaaagaacactgcggaaggagcccaccgcccaatgatggatggcttcgaggagtaaaccatgctctcaccggcgttgtaagttgcctctgcattcattcttaagatgttagttgttgatggcagcttcacgcccgaggcagattgaaagttgtgccttggagcaccccccgtggtgttggtgtggcaatggatcggagtcgaatctcattgagaacgtacagatggcttataccccactaatctgtaattcagtcagcgctatttttgtccccacctccgattttcatcttgctggatgtatgcttgacagatgatgatacggccctgttgttgttgttgttgttgaaaaagatgtgttgaggggactgtagtgttcctctcccccctgttgtatggaagattaccaatatgcagcgattttctctcaaagaggaagctcaatgcacatgcttgtttgttcacattcctttntctgctctgagtttctgctgatgcatgtgtaacgacagtgtaatttgatgtttgcccacgctttcgag

SEQ ID NO: 14767 - DNA, 536 bp, Zea mays
  unsure (1)..(536): unsure at all n locations; Clone ID: LIB3279-221-Q6-K6-A10
cgatcgatcgcccggaaactgacctctaccgatgtctggagccggcgaggaggataagaagcccgcggagggcggcgcccacatcaaccttaaggtcaagggacaggatggcaatgaggtgttctttncataaagaggtccacccagctgaagaagctgatgaacgcctattgggaccgccagtctgtggacatgaatgccattgcattcctgtttgatggccgcaggcttcgcggcgagcagacccctgatgagctggagatggaggacggcgacgagatcgacgccatgcttcaccagaccggaggcagcgttcctagcaccacctaaaagcagcagctgcggagcctcgttttgctctccgccctgcgtagtactaaacaaaagggaaaaagtctttttaaggaacttgtgatgctctggctccttgtgccattgctgagggacatccttagcctttatttagtggtatggtttggtactttgttctgtcatcactcgtttatctatccctaatacatgccgccatgtttgta

SEQ ID NO: 14768 - DNA, 654 bp, Zea mays
  unsure (1)..(654): unsure at all n locations; Clone ID: LIB3279-221-Q6-K6-A11
gaacagtgtggatttcagcctgcccgtggacggggagaggtccatcgccgagctgatgaacatgtacgacaacaancttcgtgccgaacaagaacccgagcagcgacagcgtcgccgtcatggagaggccaaacgcgatgccccagcagaggatccagatggacgagggtttctttcggacagtcgaacggagccttcgacgacgtcaacagcatgatgcagcagcagcagcagcaacaccaggcgccagtgcagcagcagcagcagttcttcatccgcgacgacacgccattcgtgagccagatgggcgacatcgccgccagcgcgccggagttcaggttcggtcatggtttcaacatgtctagcggcgtcgactacccaggcgcggcacagaggaacgacgggaccaattggttctactgaagaataaataaacctgtagggctgagaaaagagagagagaaaaaaaagcgtcgttagagcatctccaacaatgcctcaaactagtgcctcaaattgaaatatagggctctacacaggaaaaactactccaacagtgactcatttcataaatttttgtaaaaaattatagggcaccctctcaagtgactcanatatactacancgtagtgggctgccctataatctagattt

SEQ ID NO: 14769 - DNA, 289 bp, Zea mays
  Clone ID: LIB3279-221-Q6-K6-A2
cccacgcgtccggcctcctgtactgggggctaaggctggaagaagtatgttctacagacgaggcgccttctgtcttcttcttttttttaaaaaaaaagaaagttcttccccatggcaattgtgactgtaattaatttctgggtcctgacagcaagggtcagtagggtagcgagtgagtagtgactgagctcgggcttgcttgctagcgcctctgggttctgattcttgacaacgcaaatgcgtactacgtggttaacagtaaaatccaatccagcctccagtttctggc

SEQ ID NO: 14770 - DNA, 647 bp, Zea mays
  Clone ID: LIB3279-221-Q6-K6-A3
gtacaagcacgtggtgggcacggacacgagcgcgcagcagctcgcctacgcgacgcgcctcagcaacacccgctacgtgcacaccccagcggacctgcccctggaggggatccacgccaccgtggccccgccggcctccgtcgacctcgtcaccgtcgcgcaggccttccactggctcgacctcccgcgcttctacgcgcaggcccgctccgtgctgcgccccggccacggcgtgctcgccgcctggtgctacaccgagccacgcgtcgacgccgccgtcgacgccgtgttctggcgcctgtaccacgggtcccagggatactgggcgcccaaccgccggatggtcgacgacgagtaccggagcgccgacttcccgttcgacccggtcgaaggggagaaccacacgggcccgttccagttctccacgcaccgccggatggacctcgatgactacctcatgtatatcacgtcctggtccgcctaccagactgcccaggataacggcgtcgagctgctcgatgcgcccaccgtccaggagttcgcggcggcgtggggcggcgatgccaaggaggtgaagaccgtcacgtaccccatcttcctcaggattggcaaggtcaggtcggagtgagctgcacggaaaaatgaaa

SEQ ID NO: 14771 - DNA, 630 bp, Zea mays
  Clone ID: LIB3279-221-Q6-K6-A4
tactcaattcgtcactggtcagcattgagtggtgtggatactgaacttatcaacgtccaaggacatgtggcaccaagggagaagcatgcaggaagtttattagaggggttttatcagactcaagttagtaccttgacagtcaaggacaatttactggtagctggtgggtttcaaggagagctgatctgtaaacaccttgatcaggaaggtattagtttttgctgtcgaacaacttatgatgataatgctattacaaatgcggttgagatatttaatacctctagtggcgccgttcacttcatggcatcaaataacgactctggtgtgagatactatgacatggagagattccagctattcaagcattttcagtttgaatggccagtgaatcatgcttcgttgagtcctgacagaaaggtggttgttattgtgggtgatgatcctgatggtctacttattgatgcaaactctggaaagacagttcattccataaaaggacatcgggactactcatttgcatcggcttggagccctgatgggcgaacatttgctaccggcaaccaagacaagacatgccgaatctgggacgtgaggaacctctcaaatccgtccatgtgttgaggggtaacc

SEQ ID NO: 14772 - DNA, 651 bp, Zea mays
  unsure (1)..(651): unsure at all n locations; Clone ID: LIB3279-221-Q6-K6-A5
caactccaaggatgaccctgccaaggaggctgctagcttcacctcccaggtcatcatcatgaaccaccctggccagattggcaatggctatgccccagttctggactgccacacctcacacattgctgtcaagtttgctgagctcgttaccaagattgataggcgatccggcaaggagctggagaaggagcccaaatttctcaagaacggtgatgctggtatggtgaagatggttcccactaagcccatggtggtggagaccttttctcagtatcctcctcttggtcgatttgctgtccgtgacatgaggcaaacggtggctgtcggagtcatcaagagtgtggagaagaaggacccaactggagccaaggtgacgaaggctgctgccaagaagaaatgatctatctggctggtgacgaaggctgctgccaagaagaaatgatctatctggctggtgctgtgcttgcttgttggttacctcgtggaagcttaaaatatctcgtcttgttgacatccttgcagttgtcgcgtgaacaagtaatctatgatggcaatgtttgcctggtcatgaagtattattactntcgttgaaaccgtgatgctattaagacttaattttttttatggaacatcgaatgtaaggcatacatg

SEQ ID NO: 14773 - DNA, 641 bp, Zea mays
  Clone ID: LIB3279-221-Q6-K6-A6
catggctcaacagcagtcctcgtctcctcattctcagagtgctcaagccacacccttgtttcctccattcagctccccgaagcctgctagttctaacactgagccaattacaagaagtatggctgggcagcctccatactcttcatcgcagcagcagcatgaagtcgcccattcattttatggccaaggcaatacaatattggttcctgtagctgatcataatgctcagcatcagcaatcgcaatcagtgcagctacacagccagggcacctgtctacctcaaccaagcaagcccagtcactgcagtgttgcatcctatgctgttcaaggaaatggtcagacctacagctccacatacaagaacccttctaactgccctgcaactgtcgtagctcttctgcctcagcctccagctactgcttctatggcgtatcatcccttgggaccacaggtcgtgcacaatcatccatttggaaatatggttgaaacggctagtgtggtagggtattcacgggaccaaggtgagatactcccagtggtgactgcagtacaacccgtgatggttgataagcttaatgctggcagcaacgtaacatcccctcgtgaatggtcagcatagtggacgatgtgccatcgtacac

SEQ ID NO: 14774 - DNA, 639 bp, Zea mays
  unsure (1)..(639): unsure at all n locations; Clone ID: LIB3279-221-Q6-K6-A7
ctcgtagctaatcggaccggggggctagggttgcggtgcgcctctgcaatcggacgcgaggctaggctgggcatggagggaaccgctgcggcccggaagaggtcccggccggagacggcgaacggggctgccgccgccgggaagcgctccaaagacacggagtcatttcaaactgggctatcaagcaaatcgaagccttgcaccaagtttttcagtacgattgggtgcccgtttggcgagggatgtcattttctgcactttgtccctggtggttacccggcagttgcaaaaatgctgaatctaagtagctctgctgtatctgcgccatcaagaactcatgtggatcatgccgctcttaccggtgcctctcatccagcttctacggtcaagacacgcatgtgcaccaagtacaacactacagaaggctgcaagttcggtgataagtgccatttcgctcatagcgaaagagagcttgcgaagccagcctacatgtctcaagaaggacctcctatgggtggtcgatatggacgagctgaacctatgcaaccagctgccatgggccctccagcaggaaactntggtgcctcggcgactgccaagatcagtgtggacgcctctctggccggtggcataaatcgc

SEQ ID NO: 14775 - DNA, 650 bp, Zea mays
  Clone ID: LIB3279-221-Q6-K6-A8
cgtcaacatggtataggagccaactatcgatcccggatgtccacagactcctctcttttttccgcctcctccccttccaccatgactaccaacgctccagcattccaatctgcctgcattccaattcctctgcaccatgtggtaaccatccgtcttaccaagagcaactatcttctatgggacgcccaacttgttccgttcctcaggagcgcgaaactcatgggttatcttgatggcacattgccggcgcctgcccaactgatcgcctcttcaacggcgactggtgctgcgcaagtggcaaatccagcatatatacgctggtatgatcaagatcagcagcttctcagcggacttctctcatcgatgactgaagatgttctttgggacgtggttgcagccacctcatccaaggaggtgtgggactctctgtagaagaagttctcctccactcgagctcgcacggttcagatctgtgttgaactcgctacgacaaagaagcgtgactcaacagctgctgactactatcgcaagattacagggctggcaaatgagctggctgctgctggcgctccactccaagatgatgaggttctctcttatctacttgctggcctttctgctgaatatgatctgtttgttacttccattac

SEQ ID NO: 14776 - DNA, 645 bp, Zea mays
  unsure (1)..(645): unsure at all n locations; Clone ID: LIB3279-221-Q6-K6-A9
ctccggttcgacgtaggcgccggcggcgaaatgaaggtctccgtgaagacgctcaagggatccagcttccatatcgaagtggatcctaccgacaaggttgccgacgtgaaaaaggttatagagagtatacaagagcaggcttcctatcctgctgaccaacaagtgcttatacaccaggggaaggtgctcaaggacgacacaacattggaggaaaaccaagtagttgaaaataattttcttgttataatgctcagacagaacaagggatcatcaagtgcagcaccagctaaggtaaccgcgaatcaggcaccctctactcagacagtgcctgctactccacctcaaacgtcagcagccccagatgcaccggcacctattgtacctgtcagtgcaccggctgcaactgctacagcctcagcagctcctgctgttgctgtctccactgaggcggatagttatggtcaggctacctcaaacctagttgctggcagcaacttggaaggaacaattaaatccattcttgaaatgggtggcgggacatgggatagagacactgtactacgtgctctgcgggctgcgtacaacaatccagagcgtgctgttgagtacttatattctgtaagaatgattctttgtnctcgttac

SEQ ID NO: 14777 - DNA, 602 bp, Zea mays
  Clone ID: LIB3279-221-Q6-K6-B1
gcaggactatccctcaagtctcaggatttaactgcattatttctagctgttagactgtactgcagctttgtcatggagtatgacatccatacaattctggacactgctacacttgtagccacactgtttgttatttatatgatacggttcaaactgaggtcaacttatatggtggataaggataactttgcgttgtattatgtggtaagaaataaacttatatcttggtaatttatggatttgcatcagtaactgttcttggctaagaatttcagtttcttatacccatgccaatgatatcgagttgaactgttggagctgtccagtttctgcaaaataaccacattatcttctcaatgtattttctttatactgaatttggttaggttaagaccaaggctgtgtgagctttatgattagaatgcacatcaccttttagatggtttattattgaaacattttgaaatccatgtctctgttttgtaattaactagtttctttctctttctgtacttctgggatcagaggtagtgtttctgatgctcctgctaacagaaagcattgggcttatgctggctagttgtacttgttctgccacaaca

SEQ ID NO: 14778 - DNA, 451 bp, Zea mays
  unsure (1)..(451): unsure at all n locations; Clone ID: LIB3279-221-Q6-K6-B2
gccaggtggaggtggaggcgcaggcaggggaggaagacatacacacagacacaggctccccccccgcacgcgggcgtcagggaagggaccagccccaccaccgggctacttggttgggtcgggagacgcaagacatgatggatcaactgagcctggtgccctacgatggggtcggcggcgacgccccgggcgggaagtacaaggagtgcatgcgcaaccaccccgggggcatgggcgggcaagcgttcgaacgctggggggagtacattgggttcttgccggacacacttaagtgcgcacagtgcgggtgccaccgcagatttcaccgccgcgcgcttgcggcggngagcccctgcgcgccgcccgtnttttttcgnccgccgccgccgcccgcgctgtccgcgccgccgcagaagnacttttaccaccaccaccaccaacagggcgcgct

SEQ ID NO: 14779 - DNA, 626 bp, Zea mays
  Clone ID: LIB3279-221-Q6-K6-B3
attccgcattcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtaggctgcagat

SEQ ID NO: 14780 - DNA, 605 bp, Zea mays
  unsure (1)..(605): unsure at all n locations; Clone ID: LIB3279-221-Q6-K6-B4
cggacgcgtggggcacgccccagttctgtcccccccgacatcctcgcccatcgagccgcgcacgccccatgtcgcgcttccccaccacgcccgccgcacacgccgcaaaccgtcgatggaaggtgagcggggcgtggccgcccctggcatggcgctatcaaaataggccctccgcgcacgcctcgctccatcaatggaaggctccatcaatggaagttttacagattgtcttgtcctactgcctactatctgccttgaggaagtaccaaggggtttccgttctgtcttcagtggtgcaaacaaaattggtgatggtggttttggttctgtcttcagtgacgcaaataacgactttgtgctactatgctgaggaacaagctttgtgacttattttggatttgagcagcacggtcataacattgctgntctatttcattcatatgttcgggtgaatcttttctctagcaagatgccaagaaagatgatcctctatgttcactacatcttgcactatgtcctgcgtgttaccggccaaacaaaacaccttggagtgcagcgacgacaggaactacctctacaggaaccggtttaacgagtaatttgac

SEQ ID NO: 14781 - DNA, 640 bp, Zea mays
  unsure (1)..(640): unsure at all n locations; Clone ID: LIB3279-221-Q6-K6-B5
cccacgcgtccgagaaaattgaaggatctcatgataaaaagtgataataggatatgtgctgactgtggtngcacctgatcccaaatgggcatctgctaatattggagtgtttctttgcttaaaatggggagatgttcatagggcacttggacctgacatttcaaagggtttatctgtaactttggatgattggtctgacaatgatatcgacttcatggttgagagctaagtatgagacacaagattttttgaagcccagtttgcgccatttattgagaacatcttttaaatctaccaattctgtgaagagtgtagatagcaatttctctatcactctaaagaaagatatctcttaagatacaagagaatttgttggagagctgaatattacagtcgtgaaagggactatacttggccgttagagacatgctcacaagtgatccatatgttgttttaacactctgagggcagaaagctcaatcgacagttaaaaaaagtgatctttatccgccatggaatgaagagcttaagatatctgttcctcgaaattacggacctctaaaacttgaagtgtatgaccatgatacgttctcagccgatgatatcatggggtgaagcagagatagatctccaccaatga

SEQ ID NO: 14782 - DNA, 623 bp, Zea mays
  unsure (1)..(623): unsure at all n locations; Clone ID: LIB3279-221-Q6-K6-B6
gagcaccgtcgccaccgcgccgagcttctccggcctgctgcgcgagctcggcgagctggagcggagcgtcgcgtcgtggggcggcgcgcggaagggacaccgccgcgaccgcgagggcaagctctcgccgccggcgctgcggcacgagcagcagaggagggcggccaagggcgagcccagggactcggaggagaaccgcttcgtcgacgcgggcgcggggctccagggcagcgtggcggtggtgaagcagtcggacgacccgctccgcgacttccggcgctcgatgctgcagatgatcgtggagaacgggatcgtggcgggcgaggacctgcgcgagatgctccggcgcttcctcaccctcaacgcgccgcaccaccacgacgccatcctgcgcgccttcgccgagatctgggacgacgtgttcgtcgccgccgccgcgtcgctcgacgactgtgccagcccggtcggccgagcgtcctccgtctcaggccgggaaccggcggcggcgggcaggccgccagcgcccagaacgaccgcccgccaccaccgncgctcgccaccggcgtggcgcgtgtagtgggtagtaagggtaactcgtcgtacgcgtgcgttgtctttctcat

SEQ ID NO: 14783 - DNA, 526 bp, Zea mays
  unsure (1)..(526): unsure at all n locations; Clone ID: LIB3279-221-Q6-K6-B8
tggtgaagtcggggccatcccgtgcagatttggcagtaggtgagtgtggaattgggatgagcttctggttcccggcagtgtggtcgttacagcaacggagcttttctgctggtctggtctggaacgcaagtctgaaaagtggtgaggccatcgctgcccgttctagggcaatcacttccaactattggggccatctttctggtttgaagtattattacacaaagggggaccaggcttttaaatactaccagaaatctggattgaagaagaacaagaaagggaagttcccagatagcaattcataccacgacttggtgttccgttttttcgtgaagagaaggggcggctcttgatatgcctcacctgtcacaattgggtcaatgttgtttgatagtaactctttggtgggtcaagataccttttctcgccatgtcacagccgagatgaagcaaaagctgcttaatgtcagctatgatatctactatgttgggaaaatggnctctagaatcattccatcgtcgacata

SEQ ID NO: 14784 - DNA, 330 bp, Zea mays
  Clone ID: LIB3279-221-Q6-K6-B9
cccacgcgtccggaggggatggcgcagccgccagccctcaacgttcctaccagctgccaccgcctgttaccagtgatgtctcccgcccttgccgctggcgtggagcccatggccgtcgacgattccgcctccaagaaggccaagcgcaagcagctcaaggccgccgccgccgccgcggaggcggaggcggaggccgcttcggtcaagaagaaagagaagaaagagaagaagcgaaaggtgaaggagccgtcccctccgctcccatcagccgcgtcctctgatgaggaagagaaaagcagcaccagctccgaggagacagcacccgccgcg

SEQ ID NO: 14785 - DNA, 651 bp, Zea mays
  unsure (1)..(651): unsure at all n locations; Clone ID: LIB3279-221-Q6-K6-C1
ttcccaagactggcctgaggtgacaaagtatgctggtctagtttctgctcagtctcataggcaagagctgatagaggatctctacaacgtcacacacgatcctcagaaaggaaccgtttgtggtggcatggtcagggagcttcttatatccttcaaaaaatcaactggtcaaaagcctcagaggatactattctacagggatggtgtgagtgaagggcagttctaccaagttctactgcatgaactggatgctatccgaaaggcgtgtgcatcgctggaagcaaactaccaaccgcaggtgactttcatcgtcgtccagaaacgccaccataccaggttgttcgcgcacaaccacaacgaccagaattcggtcgacaggagcggcaacatacttcctggaactgtcgtggactcgaagatctgccaccctacagagttcgacttcttcctgtgcagccatgctggcatcaagggcaccagccgtcctgctcactaccatgtcttgtgggacgagaacaacttcacagccgacgcactgcagaccctcaccaacaacctttgctacacctacgcgaggtgcacgcgctctgtgtncattgtcccgccggcgtactacgctcacctggccgcattccgcgccccgttctacat

SEQ ID NO: 14786 - DNA, 420 bp, Zea mays
  unsure (1)..(420): unsure at all n locations; Clone ID: LIB3279-221-Q6-K6-C10
gtcaatttgtcggcgtttggggcggcggcgtgactggccgctggtcgcggcgcgcgtccggcctggtgggatcccttcggacttccgcagattcccgcgcgggggtgtttgatttggatgagaggagcgcggcggcgggatggggaccccttcgcagggctcggcgaccgtgacggctgttcgggtcgacctctgcgcgctcgacctcatgcccgtctttgccaaggagatgatcgccggcggcgtcgccggcgccttctccaaaacctgcatcgcgccgctcgagcgcgtcaagatattgctgcngaccagancaaatgagtttgggtctcttggagttctcaaatcnttgaagaacctgagacactttgatggagtcntggggttttacataggaattggtgcctgcgtgatgagaat

SEQ ID NO: 14787 - DNA, 203 bp, Zea mays
  unsure (1)..(203): unsure at all n locations; Clone ID: LIB3279-221-Q6-K6-C11
cccacgcgtccgggagaggttatggagtcaacgcggggaatgatgaacaatgaactgttggcgttagctcctgcagatggaagcatgtatagggaggaggatggattgctgccacagtggtttagtgaagcaatgtctggccccctgctgagctcangaatgtgcactgaagttttgcagtgggatgtgtccccatcatctgc

SEQ ID NO: 14788 - DNA, 404 bp, Zea mays
  Clone ID: LIB3279-221-Q6-K6-C2
ccaccttccgccctccgctgcccgctcgcctccgcgcccgaaaggcaaagcctcctcgctcctgccccgccccctcctcgcggcgtcggtcaaaccctagcacaccgtacgcgcaggcccgcccgctcccattccccacctccacccatggcggcgctctccgcgccccctcgcgcccgcggcggcggatcccgcgttggcgggtccgaccccggcaagggctcgggcgggaggagcactggcttaacttaattcgggtgggccttcccctacattaaggccttctcttcggctgcgaagaacctcgagccggtgagggcgatagccacgcaggcgccccctgccatgccacaatattcgagtggggagaagacaaagattggcatcaaccggtttgggcggat

SEQ ID NO: 14789 - DNA, 515 bp, Zea mays
  Clone ID: LIB3279-221-Q6-K6-C3
gagacctgaagaagtcaacgctggtatgaacaaggcggcgtccagcggcacatccctcaacaccaagcgcctcgacgacgacacagagaacctcgcccatgagcgagttccaagtgacccggagaaaaatctcatggcagcaagggttggttagaaggtggcccaagccccggttggtcgggtggaccatgggaagccccagggggtcccagaggttggggcaaggaagggaattcccaacccgccgaacattggccagcccgagaggggcctggggaccaaaccgcgtggccaggaataacccggagccgcctaggggagacaagggaaaccggctggttattatttgcgctgtgtggggtctcaaggcatgcggaccggttgtgttggttcaagagagaattaaccgtgtgctcctgaaagcccgctgcctgtcatatgagtatatgagctagctctcaaaaaaatggggtgaagatgtcgaccgttatgacaacctcctaaccaccgtgagc

SEQ ID NO: 14790 - DNA, 652 bp, Zea mays
  unsure (1)..(652): unsure at all n locations; Clone ID: LIB3279-221-Q6-K6-C4
gaggagacccaccgtcggctcgcccgtgtcccgattcccactcacgacatcaacctgtccccatccatctcgcccgcgacgtttgatggagtctctcctcgcctcgcgatccattaggtcttccttctccgccgtcgccagcatcaggggcgccgcttcccccaggccctcgcgcgtcgccaccctcgccagcgcctgcgccggcgcccgctcccgcgcgctccgtgctggccacacggactcaatccttgaggtgctggcacaggacgatatgctgaacgcaaaggagctggtccaatgggagaatggcttgtcattcaatgacatagcggctaggcaggggattcgcatccgcagacactgccgccccactgcctccttgaaggagatagaggaggagctgggagccccccttaacatcctagagaagatcatttgggacaaggagattgaagtagctgaggggcatgctaagaagcctcttgaggaggtgattcaggctgcaacgaaagcccctccttcaagagacttctatggcgctntagaagctgcctacaagcgtaatggggtgcctgcattgattgctgaggtcaagaagcatccccgagtaggggtgtgctcagggagaactttaatcctggtgaaattgctc

SEQ ID NO: 14791 - DNA, 475 bp, Zea mays
  Clone ID: LIB3279-221-Q6-K6-C5
tgctacgttagcccggtcttctctcgtcataactggcagcttccgttgcacagtttacctatcaaagacggtgcgagccggctgcaggtgtttgcatgcgcgttgcttaaaggggacgtcctgccatgtctacgggacgccaaggatttcctcgcgctgtcaccatccgctgtgttggggcctgccaggcaacgtaaagtgggagaccttcttagcaggatgaaaatcggtccgaagttagtcgacagccgggcagcacttagaggcgtgtggaatttggatcctggttttctctattctgagctcaaggtgtggtaccaggatagattccatgaccagtttgacttggtgtgggagcagatgcaccaacaagttctccttgaggggcgcaagctttttccaaagaggtccaagaaagttaaaagctatgccaaaaattttggtgcacttggttcgctggcagaaactttttttt

SEQ ID NO: 14792 - DNA, 519 bp, Zea mays
  Clone ID: LIB3279-221-Q6-K6-C6
cctgcttgcacgcaagccactccgaggccaagtctagggtttgggaatctgtaggaggggagaggggagcgcgctcagggtcagggaggcgaagatgatcgaggtggtgctgaacgacccgctggggaaaaaggggcgggtgaagtgcaaccaggaccaaacccttcggcaacctaaaaaggttgtgggggggccaaccgggacccccccccagaagattcccattcaaaaatggttccacattttccagggccacattacgcttaaaggcttccagattcaccaacggattggggttgagctctattataacttagcgcccttaccccaaccctgccctgttgtaaaggttattccaattcttaagtcattggtgcgcttccactcacagagtctttatctaacaagctctcatacatatatgcaacttgagtgagctatgtattaccgatattgttgtgtggcaaactgtcaaagactattgacatacttgcatatattgacatgtgacaaggatca

SEQ ID NO: 14793 - DNA, 650 bp, Zea mays
  unsure (1)..(650): unsure at all n locations; Clone ID: LIB3279-221-Q6-K6-C7
attcttgctagccttgtaatgaacccaccaaaggctggggatgaatcctttgaatccttcatgtcagagagggatggtatcctttcatcgttggctcggcgtgcaaaggctttggaagaagcattcaacagtttagaaggaattacatgcaacaaagccgaaggtgcaatgtatctgttcccacgccttcatttaccccagaaggcaattggagctgcccaagcagtcggcactgcgccagatgcatactacgcaaaacgcctactggaagccactggaatcgtcgtcgtccccggttctgggtttggacaggtccctggaacgtggcacttcaggtgcacgatactgccgcaggaggacaagatacctgcgatagtatccaggctcaaggagttccacgagaagttcatggatgaattccgtgattgagctgagtacccatcgccctggcgtgatttttatctgttcaaaataataaggctgccaattggttgcctcccctccctccctcgtcgtcctatggatgcgctacagccaaacaccatcccaaattgtgttacaggcagaggcagattcgtatcgaanaacctacagaatctcgggcactgcagtctgcaatgccatgcttctgtttgccttgtgagaagtgt

SEQ ID NO: 14794 - DNA, 177 bp, Zea mays
  Clone ID: LIB3279-221-Q6-K6-C8
ggcgccgctcccctcccctcgccgccgccggagatctgatccgatccgatccgatccgtttgtgcttgtgctgcagcaggagtgagaagtaaaaaaatatggctgccctgccactggccaccgccgaagtatgcgacgctaaccctcacctgatcatgaacggcgagctccgcgcgc

SEQ ID NO: 14795 - DNA, 446 bp, Zea mays
  unsure (1)..(446): unsure at all n locations; Clone ID: LIB3279-221-Q6-K6-C9
cgtaaaggagagagagatgcaggagaagctcatgacaaggcattccaccgttgtcgacagctntgagaagaagctgcgcgggcaagatgtagagaacaggattgctttgcagcagcagaaaattgcttgccttggggcagggggtggattttttttaaaggtcctttatgggaattggggcgaggggtgcttgtgggggctgattccttttttacggttagaccggctttggttgggttaagggttaccccaatattggaatctacttccctgagattggggcgggaacccttttatttcccaagtgagagacctggaaagtgcaatggccctgtaacctgataaacaagggaaatctggagccgactaaatttttgcgtttaatatcaatatcacaagaaccggcatcttttgggctcggaaaaaaaaaaaaanaaaannaaaaa

SEQ ID NO: 14796 - DNA, 610 bp, Zea mays
  unsure (1)..(610): unsure at all n locations; Clone ID: LIB3279-221-Q6-K6-D1
ccacgcatccggttgcgctgctcccggttccatcgcgcggtgcggaatttaacatggccgtgccggaggtggtggtcgacggcgtcgtcttcccgccggtggcccgcccgccgggctccgccggctcgcacttcctcggcggcgcaggcgtgcgaggcctcgagatcggaggcaacttcatcaagttcacggccatcggcgtgtacctggaggacgcggccgtgcccgcgctggccaagaagtggggcggcaagacggccgacgagctcgcctccgacgccgccttcttccgcgacgtcgtcacgggcgacttcgagaagttcacgagggtgacgatgatcctcccgctgacgggcgagcagtacgcggagaaagtgacggagaactgcgtggcgttctggaaggccgccggcctgtacacggacgccgagggcgtcgccgtggagaagttcagggaggtgttcaagccagagactttcgcgccgggcgcctncatcctcttcactcactcgcccgccggagtcctcaccgtcgccttctccaaggactcgtcggtgccggtggccggcggcgtggcgatcgagaacaagcgcctctgcgaggccgtgct

SEQ ID NO: 14797 - DNA, 611 bp, Zea mays
  unsure (1)..(611): unsure at all n locations; Clone ID: LIB3279-221-Q6-K6-D10
cgaagaagcaaaatccccaatctctgcgccggcggggttctgtgtcgttcttcgcccgccgtcgttccgtgtcgttcttagcccgccgccgtttgtagtcgcggcttcatcgtcgcgtaccgatccccaccgcccccactgccaccagaggtgtcgacatgtctcagaacacccctccgaggtggtccctcagagctgatcgaccggtgcatcgggtccaagatctgggtgatcatgaagggggacaaggagctcgttggcaccctctgcggctttgatgtctacgtcaatatggtgctggaggacgtcaccgagtatgaatacactgctgaagggcgccgtattacaaaacttgaccagatcctcctgaacggcaacaacatagccattttggttcctggtggttcaccacctgatgtgtaatgaacttttgcttcccagagtatcattcgtggtgaaggcagccccgtgaactttgcaccttatattttttaatcattggatgtntcctcatctcggatgtgtttctcctgttcatgattataccgaagtttattgttaactctgtcagcatggaatctcttctctgtattgaacttactgacctgaag

SEQ ID NO: 14798 - DNA, 349 bp, Zea mays
  unsure (1)..(349): unsure at all n locations; Clone ID: LIB3279-221-Q6-K6-D11
gtgatctgatctgctgtagaagaaggggggaggtgaagggtttaacggccgtagccacctcggcaggaggtgaccaacagcgcagcgcggatggtgttctctcaggataagtcaatatatgaggcaatggagtgtgcattcccgcaatcattgttagaatgcgcttataattcagtcgtgtcntaatctggtaaaatgattgctcatatgcgtgatgaattgattggcttgtgtgcaagagcgagctatatttacgggacacaggcagaatatctagaggatagcaatgggataaactacatgcagctttcgcattgaataatttggtgatacaatactactttagaac

SEQ ID NO: 14799 - DNA, 637 bp, Zea mays
  Clone ID: LIB3279-221-Q6-K6-D2
cggctataattagctacaagcaggctctccggctgcgtcctgattttcctgaggcaacctgtaatctcctgcatactctacagtgtgtctgtgactgggaaaacagagatggcatgtttcgagatgttgaagaaattattagaaggcaaataaagatgtcagtacttccaagtgttcaacctttccatgccattgcttatcctattgatccattgcttgctttggaaataagccgtaaatatgcggcccactgttccttgattgcctctcgttttgggctgccgccttttgtgcatccacctcctgttcctgtaaaagcagagggtaaacactgccgactgaaagtaggatatgtgagtagtgattttggtaatcaccccctttcccatctcatgggatcagtatttggaatgcatgatcgtgccaatatcgaggtcttttgctatgcactcagtcaaaacgatggtactgagtggaggcagcgtattcagtctgaggcagaacattttgtcgatgtttctgccatgacttccgataatatcgccaagcttatcaatcaagacaaaatacaaattttgataaatcttaatggctacacaaagggtgccaggaacgaaatttttgcaatgcagccagc

SEQ ID NO: 14800 - DNA, 444 bp, Zea mays
  Clone ID: LIB3279-221-Q6-K6-D3
caaggaagatctacctaaggcaaggcatcggtgtgggtggctttcagaagatctacggtggccgccagaggaatggctcccgcccaccacacttctgcaagagcagtggtgctgttgcacgcaacatcctgcagcagctgcagattatgggcatcatcgatgtcgatcccaagggtggacgcctcatcaccaaccagggaaggcgtgatctggaccaagtggctggaagggtcgctgttgaagcgtgagcagtgtcatctttggtttcaatggtgtcatgtttgatggttgagaagactgcgctctatttgctcttttgggttaggattttcgagttcagaggactttaaggtttattgcatctagctatggcgccacactatgttccccgagtacctaatgtgatatcaagactcaattctcgaatctaagatatatgtttgc

SEQ ID NO: 14801 - DNA, 612 bp, Zea mays
  Clone ID: LIB3279-221-Q6-K6-D4
cggacgcgtggggcaaagctgataaagactccagtattgtccatcccgaggtaaaagatgctcctgaagcagaagcccagccgcagaaggaagtagaagagaatgggcatgttcctgcccttgaaacggaagcccagccacaaaaggagccacatactgaaccggaagtggcagatttgcatggacaattggaaaaatcggtcacatcttatgccacacctgaagggactccaatgagccgaacgaccaccattccggagtctcatgggacaccgtcaagtgaggtctctgttaacaccaaaaggagcaggagcaagaagcccaagtcccacgcgagcaagagggcgctggctagtccaggcagcgactcagttggacggagcagcaccgagaacttttcgaaggaatcaaggcatgccaagagagagagctcctcaagcaaagctgctaaatccgaccagggcgatcaagaacctcgtgtaagcaacagcaacagcaacccgttgcctagctacatgcagttcacagagtccgcaagagccaaggcgtcgtccccgaagatgagcccagacgtgcaggacagcaacgccgcgaggaagaggcactcgttgc

SEQ ID NO: 14802 - DNA, 632 bp, Zea mays
  Clone ID: LIB3279-221-Q6-K6-D5
gatgaatgtgccggtctagtttcgtctgggttggcccctctgcttggccgcgtttgtcgtttagatctatccaaatatcatcgtttgttgatttcgaaattggggctgttttgctcatgatttcagttcaaacttcaccatgcttcatgttttggaattgtaattggtggctatgttaattgtctagacaattgtttagacttcagttcagatttgtggacttgctgctgcgtaatgctatcctctgacactggcggtttggttcaataagttgtgcgggcttactattttgttgaattcgatgttgaaatctgttcgttcctagaagggttttgttcaacttgcatattcacttcaacgctccgatgcagtatacgtttgttcccttgcccgccctttgacgttgtgcagtttctgaatcgcaggagaaggctccctacgtatctaaggccgagaagctgaaggttgagtacacaaagaagatggacgcctataacaacaagcagtctggaggaggacccacattgtctggtgattctgacaagtccaagtccgaggtcaacgacggggacgaggagggtgatgagtgatggatgacgggtgaaactctgggctgcccaagtgcttgcagt

SEQ ID NO: 14803 - DNA, 635 bp, Zea mays
  unsure (1)..(635): unsure at all n locations; Clone ID: LIB3279-221-Q6-K6-D6
cccacgcgtccgctcgttcctgtcgcgcagccacgacctccacttccacatcttccccggcggcggcgcggtcagttgaaccatggcggactccaaggccacctcggcggtcaccctccgcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaaggaccccaacaccatctttgtcttcaagttccgcacccacttcggaggaggaaagtccactggtttcggcctcatctacgacaacctcgaggctgccaagaagttcgagccgaaataccgcctcatcaggaatggtcttgctactaaggttgagaagtcccgcaagcaaatgaaggagcggaagaacagggccaagaagatccgtggtgtcaagaagaccaaagctggtgacgccaagaagaagtaaacgttcgtttacatttgtattactgttctgggctctgggtggtctagctgcaatgtcataattatggtcgtgttaggttttgttccacctttggcactgaagtgattnttttgtaattcctcggcactgaagtgaagtt

SEQ ID NO: 14804 - DNA, 607 bp, Zea mays
  Clone ID: LIB3279-221-Q6-K6-D7
ctttcggttcccctcccccctccgcgggccaggggcctcgagaagcttccaccctcccctcctgcgacgccgccagagccgcggaaaccctacccaccccggccgctcacgcaccgggcgcccgcagccgccggtcgcgtgcctgccgccgacaccgcccaaagcgattggatctcgagggggtgaggagccacgatggaggactgggattctgaagaattccagccagttgtgcctgttgtgaaagccgagccacttaaaaatcagtgggctgatgaagatgttgaagaagatgatgtaaaagaatcatgggaagaagaggaggaggaggagaaacctaagccagcgccagtggaaaaggttgctgcaaaacctagcactaaggctcctgctaaaaagggaaaacagcaagcattgacaagtgctgaagaaccagatgagcctcctcttagtcccacttcacagaaaattcgccaacaaagacttgtggaagaagctgacttcaagtcgaccaccgagctttttgcaaagaagggcagtgagcaaaagtcactagatacttttattccaaagtccgagagtgactttgcggaatacgcggagctta

SEQ ID NO: 14805 - DNA, 635 bp, Zea mays
  unsure (1)..(635): unsure at all n locations; Clone ID: LIB3279-221-Q6-K6-D8
ggaaaaatatccccaaaccctagctcccgatctggatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtgcgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcgtncgttcctttggatctgaata

SEQ ID NO: 14806 - DNA, 636 bp, Zea mays
  Clone ID: LIB3279-221-Q6-K6-D9
agaaggtccagaccgtatttttgtgggtggcctgccgtattacttcactgaagcgcaagttcgggagttgcttgaatcattcggtcctcttcgagggtttgatcttgtgaaggatagggaaactggtaactcaaaaggctatgcattctgtgtttaccaggacctcaccgtcactgacaggggttgtgctgcactaaatggtatcaagatgggtgacaaaacccttactgtcagacgagcaaaccagggggcatctcagcccagaccagagcaggaaagtatcctattgcaggcacaacaacaggtgcagttgcagaaacttgtgtatcaagttggagcgcttcctacaaaggttgtatgcctcacacaggtggtaactgcagatgaattgaaagatgatgaagagtatgaggacattatggaagacatgaggctagaagcaggcaaatatggtaatttggtgaaagttatcatcccacgccctgaccccagcggacagccagttgtaggagttgggaaggtgttcctggaatatgcagatatcgatggtgctgccaaagcaaagacagcgctgcatggaaggaaatttggtgggaacccagtggtcgctgtctgctatgcggaggacaagtttgc

SEQ ID NO: 14807 - DNA, 560 bp, Zea mays
  unsure (1)..(560): unsure at all n locations; Clone ID: LIB3279-221-Q6-K6-E10
atatttctttggttgtggatgctactgtgaagacgcggataatgcggcaagtagaggcatttaaggcaggattcaaatcaggtgtttgacatatcatcactgcaaatattttctcctcaagaacttgattatctgatttgtggtcgctgtgaactttgggagccggaaacactgcctgagcggtgaaaattcgaccatggttatacctctaagagtcctgcaattgttaattttcttgagatcatggcagaatttactcctgagcagcaacatgctttctgccagtttgtgactggtgctcctcggcttcacctgggggtttggctgctctaaatcctaagttgaccattgttaggaagcactcttctgtggcaaataatagttcaaatgcaactggagcgacagagtctgcagatgatgatttgcctagtgtcatgacttgcgccaactatcttaaactaccaccatactccaccaaggctatcatgctaaagaaactgctttatgcgatcaacgaaggccaanggtcatttgatctttcgtgaatctcaacactacat

SEQ ID NO: 14808 - DNA, 592 bp, Zea mays
  Clone ID: LIB3279-221-Q6-K6-E11
cagagaggtactgacaaaattggagctgagagagcgttgtgctgctgcaatactttggatctcctggtgcaactacagagctgtctgggcgttgaacaaatatttcccaaatgtgaagacatttgttagagcacatgatgttgatcatggtgttaatttggagaaagctggtgcaagggtggttgtccctgagaccttggagccaagtcttcagctagctgctgctgtccttgcacaagcaaaactcccaatgtcagagattcaggaaaccatcaacgagttccggaatcgtcatctgtcagagcttacagagttgtgtgctacgtcaggaagttctcttggctatggattttccagagctacctccaaatcaaagtctttcaccttcgacgacgaaaaccaaacagtggatggcacactatcaatctgatgctgatgagataaaatgggacccccttgctagcgctagattggttgcactgttcagtagataatcctgtttcatgtggaaggagggtggaataattattcatataagagctgtcataaaagttggcgtccaattttgtatgttagacacttagtgcttgtt

SEQ ID NO: 14809 - DNA, 594 bp, Zea mays
  Clone ID: LIB3279-221-Q6-K6-E2
ggagtaccaagatatgacagtggcagccaacagggattccgatcatatgcgcatcatcatcccctaatccataggctgacccctcgcagcggaagcaatctggtggcaccattagggtcagttccagccgtcgtggcagagactagaggccatggccatggtgcaccgggccatatgtaccagcactcatctgtgcagggcagcccgttccctcctaccaccagaagggttaggcccagagccttgacgattacgtctttcatcgcagcgacttcctcagctgagattgcagggccccttggccacgggtttcccgctcctggagccgtgaacaggagcgtttctgatgccgagggcattgaccgagcgtacacatggggccgggagggatatgatctgttcccttggacccctgctgaatggggcaccttcaatcccatgcagaaccatacgcatggaagctttaccagaaagcctgctggggagcggatgccgcagagtcgccccgagaacggataccagccgcctgtgcccccttcacagaagatgccaccgttcttgtgatcagacgaggctgcctctccaattgctgtg

SEQ ID NO: 14810 - DNA, 638 bp, Zea mays
  unsure (1)..(638): unsure at all n locations; Clone ID: LIB3279-221-Q6-K6-E3
gtacggtcaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagatccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgnccgtctgagcgcctggccaaat

SEQ ID NO: 14811 - DNA, 286 bp, Zea mays
  unsure (1)..(286): unsure at all n locations; Clone ID: LIB3279-221-Q6-K6-E4
ccaggctgccggcgccggcttcgagcgggcaggtccggccgtgtcctactccgaagagtacgggctctccttcggcatcggccactcgaccagcagcagcaccgaggacgggcagccgctgtacgtgtcgaggaactcttccttcaacaccgccgacgacggaaggatgggcagagacggcaagcttcaacnccggcttgatggggatactcnngtcggcgaaggccncggnnaaaaagccttggcnccttttntggtggggcccccccccggggggggggggggg

SEQ ID NO: 14812 - DNA, 579 bp, Zea mays
  Clone ID: LIB3279-221-Q6-K6-E5
ctcgcatccagctcctctgcttctggcgaccaaattctgccgtctccaccgccgccgcagccatcgtcaccggagggatctgccgtctcccttgctccacgcgatgaacaccgacatcaccgcctcgactaagccggagtacccggtggtggatcggaacccggccttcaccaaggtggtcggcaacttctctgcgctcgactacatgcgcctctccaccatctccgccgtctccgtcaccgttggctacctctccgggatcaagccggggatccggggcccgtcgatggtcacgggcggcctcatcggggtcatgggagggttcatgtacgcctaccagaactccgccgggcgcctaatgggattctttcccaacgacgccgaggttgcgcgctacaagcacaagcttcattgaggatccagctccattccgtctctcttttcgcaaccgtttcgcctgttcctttcctgattccgtgttaacttcagtactttatctgggcactctatggccttggttaaataaaagtggtatgttgttgcacggttatgaggattcgatgatacaattcacctcat

SEQ ID NO: 14813 - DNA, 601 bp, Zea mays
  Clone ID: LIB3279-221-Q6-K6-E6
cgcagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgctcaccaaagttatcctcccctgcctgctgcgtgctatgtctgaatcgtgaacaaccgttgtcatttcatgtgtgtaccccgtgcaatgctttgtgcgcatggttgatttctctgtggcaaacttcccgtcctgcatggggttgtaagctgtctctaaatttcacggcaagtcgtgtgcctgaaccttcatcttaagttgttgtcgt

SEQ ID NO: 14814 - DNA, 558 bp, Zea mays
  Clone ID: LIB3279-221-Q6-K6-E7
gcgtgactatgcattcattgaattcagtgacccgcgtgatgctgatgatgcgcagtacaacctagatggcagggaagtcgatggaagccgtattattgttgaatttgctaaaggagttcctcgtggttctggtggttcacgtgagtacatgggaagaggacctccaccaggaacaggtcggggttttaactgtggaatggatggtcactgggcaagggactgcaaggctggtgactggaagaacaaatgctaccgctgtggtgaatcgggccatatagagagaaattgccagaacagtccaaggaatctcaggcgtgagaaaagctattcacggtctccatccccacgtggtggacgtggccgcagccggagctacagcagaagccggagctatagccgatccagatccccatctggatctcccaggggtggacgccgtgaacgtgacgagaggagatcaaggagtcttagctacagcaggagcgcaagtcccaggcgttctgtctcacctgcaaaggaaaaagagcgcagtcgcacaccccatggcagtaggagccc

SEQ ID NO: 14815 - DNA, 568 bp, Zea mays
  Clone ID: LIB3279-221-Q6-K6-E8
caacaagcatgaccagctagctagcgggtgcgagtgctatcacccgggccccggccagccatctggctgaaagagaaaagcgcagccatgaagactactagctcgggcattgcagtcgtcctcctggtggcgatgctggcagtccagtccgcggtggccgacatctcgtgctccgacgggcggggcgacctgtcgccgtgcctgcccttcctgcagggcaaggcagccaaacccagcgagagcaacaaccagtgctgcgaccgcgtgaggaccctgtacgcggcggcggacaccaggcccgacaggcaggccacgtgccggtgcctcaaggcggcctacgttcaggtccacgctgtgctctccgcggcgcaagagctgcccggcgactgcgggctctcgctgtcctacaacatcacccccgacatcgactgcgacaagatcgaatgaagggatactgttcccttaccagaatccatacgacgggatggtgatgttcagtgccctgctagcagtaggctgcatctgcactgagtgactagaataaaggatttggtgatgtttgtgctga

SEQ ID NO: 14816 - DNA, 638 bp, Zea mays
  Clone ID: LIB3279-221-Q6-K6-E9
gcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcggcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagagtgacatgaagctatggcctttcaaggtcatcccaggtcctggtgacaagcccatgattgtagtcaactacaagggcgaggagaagcagttcgctgctgaggagatatcctccatggtcctcatcaagatgaaggagattgctgaagcctaccttggttccaccatcaagaacgcagtggtgacagtgccggcctatttcaacgactcgcagaggcaggccaccaaggacgccggtgtcattgcgggcctcaatgtgatgcgtatcatcaa

SEQ ID NO: 14817 - DNA, 643 bp, Zea mays
  Clone ID: LIB3279-221-Q6-K6-F1
gctatatgcaatgacaccaatgagtttggttactgggagccagtatatgtgggaatcagcacctggtggtgcccatttgaaaaaacaagttgaaggggattatttttcttttgcgtggcaacgatgatagatctgaaagcagaaataatttcttgaaaaacagtagccatagaattaagtacaagaatgctctattcaaattctgagttgaaggctgttgaatttttctccccagttgctggagcaaactcaaggatctagcacatttaagtttaactatctagtcaagtattcaacataaagatacttcagaatcacagtaagctgacaaatacatcttgtttcggaactgtaaggctgcaccattagtccatatcaatgtgatcatcattagtgcatgatttccattttttggtcttttattcatatgtttttagtaatgttattatcaaagcagtcgttgatccttaccttttgtatcctccctaacatgatagcgttgctgttttgatgctgttacttggttttcatgctaacatggcttcaatactatcgttgtttttgagcactttgagaattgtagccaccagcatgcctctccaaagacgtgcatggagattcaaaaccgtatcttgcttgctgt

SEQ ID NO: 14818 - DNA, 605 bp, Zea mays
  unsure (1)..(605): unsure at all n locations; Clone ID: LIB3279-221-Q6-K6-F10
cggacgcgtgggttgttgccatctttgacgcagagcttcaacctcatcccgactttctgaagcgcactgtgccacatttcaaggacaatgatgagcttgggctagtgcaagcaagatggtcctttgtcaataaggatgagaacctgctgactcggttgcaatatattaacctttgcgttgagtgtgaggtggaacagcaggtgaatggagtgttcttgaacttctttgggttcaatggcactgctggggtgtggaggataaaggcattggaggactcaggtggatggttggaacggacaaccgtggaggatatggacattgctgttagggcacatctccatggctggaagtttatattcctgaatgacgttgagtgccagtgcgaattgcccgagtcttatgaggcttacaggaagcagcagcatcggtggcattcgggtccaatgcagctattcaggctttgtttaccggacatcatcaaatgcaagattgcattttggaagaaggcgaacctgatattccttttctttctgctncggaagctcatactgnctttctactccttcacgctgttctgcatcattctcccgatgaccatgttcgtg

SEQ ID NO: 14819 - DNA, 639 bp, Zea mays
  Clone ID: LIB3279-221-Q6-K6-F11
cggacgcgtgggtccaaacaggccctggtcggagtggtcaaaatgaaactcctctggtgaaatggagaatccaggggatggatgagtcgtctttacctctgtcagtcaattgctggccgtcagtatctggaaatgaaacctatgtgaacattgaatatgaagcttctgagatgtttgagcgtggcaacgttgtcatatctatacctctgccagcacttcgggaggctccgagtgttagacagatcgatggagagtggaagttcgactcaagaaactctgtgttggaatggtctattctccttatcgatcagtcgaatcgcagtggttccatggaatttgttgttcccccagctgacccatcatcgtttttccccatctccgttggattttctgcatcgagtactttcagtgatctgaaggttactggaattcttcctctgaaggaaggcaaccctcccaagttttctcagcgggctcgtttgctcactgctaactaccaagttgtttaacgcttgtaccgcgagtgttggtccacttgaatgctccaatagcagatgttattgccgtggacttatgcaagccatggcacgggagattattttgtgtttggaaatttctttactatgcgctctattgtat

SEQ ID NO: 14820 - DNA, 634 bp, Zea mays
  unsure (1)..(634): unsure at all n locations; Clone ID: LIB3279-221-Q6-K6-F2
gccaaatttccaatcgcacaggagagaccgagagagaggttttccatccatggctcccggcgtcgcttccgtgctggtcccgcaggagcccgtcctcctcaaggacatcctcgcctcaccgtccccctgcgggaacaccgctgtctccgcccgccacctcttcggcaacggagtcgcggcggcacgctcctcggacgacggcatcaaggacgccgctgccgaccgccacggtgaccgcgacctctccatccccaagatcttcaccggagacgtgctggacctgctcgacgatgctgcgaggctggacctgatgctggcgctgacgggggacggcggtgcggcgtccatggccggcttctccgcgcgcgggtggtgggtctcgaaggaggatggcgacgcggtgcagctgaaggtgccgatgccggggctggggaaggagcacgtgaagatgcgggtggagaaggacgccctggtgatcaagggggaggccggcaaggacctcgagggcgacgacgacaagggcccggcgcggtacagctaccgnatcggactctcctcccaggctttcaagatggaccagatcaaggctgacatgaagaacggtgtgctcagggtcaccgttccgaagatcaag

SEQ ID NO: 14821 - DNA, 634 bp, Zea mays; identical to SEQ ID NO: 13685
  Clone ID: LIB3279-221-Q6-K6-F3

SEQ ID NO: 14822 - DNA, 354 bp, Zea mays
  Clone ID: LIB3279-221-Q6-K6-F4
ccgggctgggttcgtcgaccggttttccaatgcactgttgtattacaagccagtgttcgagtcacttgatgtggcgatgccacgggactcaccggagagggtgagggtggagcgatgcatgtttggggagcgcattagaagggccattgggccagaggaaggagcagagaggactgataggatggcggctagtagggagtggcagacgctgatggagtggtgtggctttgagcccgtcagactcagcaactacgccatgagccaggctgatcttttgctttggaattacgattcgaagtacaagtattcgcttgttgagctaccaccagcgttcttatctctggcttgggagaa

SEQ ID NO: 14823 - DNA, 642 bp, Zea mays
  Clone ID: LIB3279-221-Q6-K6-F5
cgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgaatccaaggtgaacgagactaaggcaaccgtcaagttccagctcaagaaggtcctttgcatgggcgtcgccgtcggcaacttggcgatggaggagaagcagatccagcagaacatccagatgagcgtgaacttccttgttttccttctgaagaagaactggcag

SEQ ID NO: 14824 - DNA, 637 bp, Zea mays
  Clone ID: LIB3279-221-Q6-K6-F6
gcatgttagaggggtggatctgaagaatggatctacttccagaggatgtctacatctaattgatcttgctgggagtgaaagagttgagcgatctgaagcaattggagatagattaaaagaagcacagtatattaacaaatccctctctgctcttggtgatgtgattttttctttggcacagaaaaatgcccatgttccttatcgaaacagcaagctgactcaagttctacagagctctttaggtgggcaagcaaagacactgatgtttgttcaaattaatccggatactggatcatattcagaaacaataagcactttgaagtttgctgaaagggtttctggagttgagttaggtgctgcaagaagtaacaaagagggtaaagatataaaagagctgctagaacaggtttcatctctgaaagacacaatatcacggaaagatatggaaatcgatcaactcctgaagaacaaagccaaatctccaggttcatcaatagatagaaatgacagtcgccaacagatccggcgactatcagggactggatcaagtgaagccgaatgtgaagataacatgtctgatgatggctgctcagtagcaggaaccgagtattcagtaggtggtgcttcagaggcgaca

SEQ ID NO: 14825 - DNA, 561 bp, Zea mays
  Clone ID: LIB3279-221-Q6-K6-F7
gcggcgatttcaaatctacaatcttcttgtagcacaccactgtcttcgtccaactcggcggcgatgtctgggcgcggcaagggcggcaaggggctgggcaagggcggcgcgaaacgccaccgtaaggttctccgcgacaacatccagggtatcacgaagccggcaatccggaggctggggaggaggggcggcgtgaagcgtatctccgggcttatctacgaggaaacccgcggcgtgctcaagatcttcctcgagaatgtcatccgcgacgcggtcacctacaccgagcacgctcgccgcaagaccgtcaccgccatggatgttgtgtacgccctcaagcgccagggccgcactctgtacgggttcggtggttgagcgcatctcttccctcgtctgcagcggctgccggtggcgtttcctcagttccctctgccttgcttggcttgatgtagagagttatcagattaaaatatctctgatgtgcttcgttattgggtggaatcatgtgtcccagcagtgctgggaaatcgagatcaagatgtatctttctttgcagtaatg

SEQ ID NO: 14826 - DNA, 641 bp, Zea mays
  Clone ID: LIB3279-221-Q6-K6-F8
taatcgtctcaggtcatcgccatgtgtgcttggggcagcgaagtttggttggtcagccaatatggaaaggctgatgagagcacagtctatgggtgatacagcctctttggatttcatgcgttcgaggaaagtttttgaaataaacccagagcatgagataatcaaggccttgaatgtggcgggcaggaataaccctgatgatcctgaagccctaaaggctctggatgttctctttgaaactgctatgatttcaagtggcttttcgcctgacaacccggcggagctcagtgggaagatttacgagatgatgacctctgccatcgctggcaaatggtcctcacagccacaggcgcaggcgcaacctgccgacccaatcccacagcacgacgcacctgtgaggtcagacgagccgcttgaagctcaagtggtggaggcagagcccgttgaggctggtcagcagaagtgagggcctgttcgtgcagaatctttgtacggagtagttttgaaccgttgtgcacaacatggctgagaatttcgagtatttgttttgacggcctgtatctgtgtcatgagctgttactggtaatgtaagacgtattggttagaaattaggagattaggaataatcgggtagctggact

SEQ ID NO: 14827 - DNA, 586 bp, Zea mays
  unsure (1)..(586): unsure at all n locations; Clone ID: LIB3279-221-Q6-K6-G1
cttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctaccgcggcggtcgcggcggcggcggctatggtggcgggcgccgtgacggcggttatggcggcggtggcggctacngcggtcggcgcgagggtggtggcggcggctaccgaggcggtggcggctaccgcggtccgcgcgagggtggtggtggcttctacngcggcggccgcggcggcttgagggactgatgtgtgggcccatcctggcttcggccgagttatcttatctatctata

SEQ ID NO: 14828 - DNA, 430 bp, Zea mays
  Clone ID: LIB3279-221-Q6-K6-G10
tcgcagcccacaccaccacctggataccgcgcgccttgcattctacggaacagcgccaccagatccgccctcgatggagtcgtggtgaacccgaaggcatacccgctggctgggcgcagctgacgatgggtatcctcgatatcatccagcaggccgccaactacaaacagcttaagaagggagcgaatgaagcgacgaagaccctgaataggggcatatcggagtttgtagtgatggcggcggacacagagcctctcgagatcctgctccacctccccttgttagctgaggataagaacgtgccatatgtgtttgttccatcgaagcaagctcttggccgtgcttgtggtgtgacaagaccggttattgcttgctcagtgaccagtaatgagggtagccagctgaaactacagatacagggtctcaagga

SEQ ID NO: 14829 - DNA, 488 bp, Zea mays
  Clone ID: LIB3279-221-Q6-K6-G11
ctgcagtctggtgcgaattcggtcgaccagcgtcggttgtgaggtgttggagtggaagcgtaggggccaaagagccaagtcatgaagttcaaggatggctcatgatctatctggtcagcagtgacgagtcattgactcggctgtgagacacgttcttctcagacagggtgttcttggcatcaaggtgaagatcatgcttgacgtggagcgggaagggcaaggttggcccgatcactcctcttccggacctggtgaccatccacaccccgaaggacgaggacgagccgcgccctccggtcttggcacctcctgaggtgtaaggtcccaactgtgtccttgaaatggcagtttgatcgggtcctagataggtttctatcttacgataaggacaatgctaaggcagttggttaccttaatctttatggacagatgctatgtgttgcttctgtggcacttttgtttaagctaagttttgcggagacaagata

SEQ ID NO: 14830 - DNA, 640 bp, Zea mays
  unsure (1)..(640): unsure at all n locations; Clone ID: LIB3279-221-Q6-K6-G2
ccccaaaccccaaaccctagcttcgctcgttgcggcgagccggcgatggcgaagtctctgcgatccaaacgcgagaagcggcttcggacgttgcgccgggagatagcggagccgttctacgacaagaaggaggccgccaagctcgccgcgcaggccgcagccctagctgctgccccgctcccggtccgcgggcccccgccgtcccaggatgccggcacctcccgcgcagctagctcggcctcggctatggatgtggagatgtctggtgcagggaacagcaggtctaagaccttcctgaggccacttggcagcattagcaagaagaaggtgcagcttcatttgaagatcaagaaagacaagagaaaagctaggaagaagggaaagttttcttttaagaagtagaggagtgtatgataattcatgcagttttgttcccagtttgtaaaacaaacgcactgcagtcatgtgcacctacctaagttcattcgtgggtgacctaaatatgttgaaatgggtacgaaaaaaggatagtgctgacctatcagctgtttctgttctgcgggtataaatgtcaagtactcaaattgctgagattntgtttcattttcacattgtatcgtggtgaaccatgtttggaaac

SEQ ID NO: 14831 - DNA, 642 bp, Zea mays
  unsure (1)..(642): unsure at all n locations; Clone ID: LIB3279-221-Q6-K6-G3
cagccatgtcgctcagcggcgcggcgaacgacctactccccaagtacggcctcccgaaggggctcatcccggactccgtcgcctcctacagcttcgacgaggccacgggcgccttcgagatccacctcgccggcacctgctacgtccacttcggctcccacctcgtctactacgagaggaccataaccggcaagctctccaagggcgccatctcggacctctccggcgtccaggccaagaagctcttcctctgggtctacgtcacggggatggtcgcgcaccctgaccagggcaccatcgagttccaggccggcttcatctcggagtcgctatcggcctcgatgtttgacgaggtgcccacctgcggttccagcgttggcgcgcagctgcgcggcgcggctggggtgatcggcgagcttgggctgctccccgttgcacaggcctgaatgtgggttggagaagtccacatacagtcccagagaaccgcaggaccttaccgtctgctgtcgcgtgagccctanagtgcaggaggcgttcagccgnggtgtgttctgcttctgcctgtacgtaccagtgtcttggtgttgctcccggtgtcaaatggacatggatgatatgtagaaatgtatgtctattatatgc

SEQ ID NO: 14832 - DNA, 612 bp, Zea mays
  Clone ID: LIB3279-221-Q6-K6-G4
acaaaactatttttctagattcaatctataatttctgcaattaatcgtcgaagtttaagtttctctccaactccaacgaaacttcggcgatgaattgctcctctctattcatcttccgaggtgacctaggagtctaggacaccgccgtgaccgggtcgacgagagcttcatcaccatgctcagttcatcgatcagatcttcggtttgccgtcaatctaaaaaacaactctttcttctacgatgagctcctccattctcgttcttcgtttttcttcaagttcttcactgcactgtccatcttctcactcttccgcaccacatcccgcagctccgtgtcccctctctcctctaccctggccgctcctccccttctctccgagacatgacgcggttgcagcaaggcccttgctgagcccccctgtcagcattgtcggaccggctacaagacctaacgaaattgaagaagttgaagatgctgcatttgggaacaagcgagataattctctgaagaagctgaaggttcgtgaaggggaggaccggcacctattggggaggggagtaaaaggggatccaaacccaacccaaagtataccagcggtgactcggtgtaat

SEQ ID NO: 14833 - DNA, 641 bp, Zea mays
  Clone ID: LIB3279-221-Q6-K6-G5
cgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgaatccaaggtgaacgagactaaggcaaccgtcaagttccagctcaagaaggtcctttgcatgggcgtcgccgtcggcaacttggcgatggaggagaagcagatccagcagaacatccagatgagcgtgaacttccttgtttcccttctgaagaagaactggca

SEQ ID NO: 14834 - DNA, 606 bp, Zea mays
  Clone ID: LIB3279-221-Q6-K6-G6
gcaaggaggaggaggcaagggaagccgccgccgccgccgccgccgccgcccccgccccgtccctcctcgccggcccgccgccacaggtttcaagatgtcaacctgcacgtttgcgacctcctgcgtgctcttgggcaatgctcggacaaccgatgtcccccagaaagcgctcaagagccgggggagcttccttggccgaggcgcgctgcagctgccgagcctgaggtcctcctcaaagaagaagctggatgtctcagcggcggccacgtacaaggtgaagctggtgaccccggaaggggaggagcacgagtttgaggcgccggacgacgcctacatcctggactctgcggagacagcgggggtggagctgccctactcgtgccgggcgggggcatgctcgacctgcgcgggcaagatcgaggcgggcgcggtggaccagtcggacgggtcgttcctggacgacgcgcagcaggaggagggctacgtgctgacgtgcgtcgcctaccccaagtcggactgcgtcatccacacccacaaggagggcgacctgtattaggggtctcacctctggctcccccggtgtgttgagtagaaccttgatgctct

SEQ ID NO: 14835 - DNA, 496 bp, Zea mays
  unsure (1)..(496): unsure at all n locations; Clone ID: LIB3279-221-Q6-K6-G7
atagccattccgaagatgcttaatgatggagcggtggagtatgaggatggtacacctgcaactgaagcccagatgggtaaggatgtcgtatcattcctttcgtgggcagctgagcctgagatggaagagagaaagctgatgggagtgaaatggatctttctactatcactagcgcttcggggggctgcctactaccgccgcatgaggtggtcagtcttgaagtcccgaaagctggtcctggatgtcgtcaactaaggactatcattaccctttttattgaaatatgttgagccgttaaggagcattcaaaataatgagttggtggtgtacaattttgccactggggctaggttccatgcctagaaattattttgttttctttactctgctgagctgcaaaagcatttcaccaagggagtacaannaaaaaaaaaanaaaaanaaanaaaanaaaaaaaannaaanaaaanaaaanaaaanaaaaanaaaaanaaaa

SEQ ID NO: 14836 - DNA, 640 bp, Zea mays
  Clone ID: LIB3279-221-Q6-K6-G8
gccaactgcgaagtatgcaattgtcacggagagggcgagactaacggcgcgcgccatcgccgcagttcagccgctcgccgtcgccggagagggcaagggcaggaccgtccacgcgcatctccctcgacttgtttcacgcgcacacacacccacgccaccctgctgcaccgcgcgcatggtggggaccaaggggacgccgcctctgctcctccgccgcccactcctctccccctccttgcctgcggattggggcgacaggggttggcgatgccggaggccaatgccggcgcgctggcgcaggcggagcagaggaagaaggcggggaggtcggttccagagcgtggaaagcgcgatagagattaagagatacgagttgttagtcctccccagagtccgaagcaagctactaggttttcagtttcagatccccgaaaaatacggttgttgttttgacgccaaccgatatacgcggcaggagtaccacgcgacgctggtattggattcgcgtgacttgaacccaccagacatggagtccttcagcgacgccgacagatacataccccaagagatcatcggcagaggcagctacggggtcgtttgctcagctattgaccggcgcaccggcgagaaggtcgcgatc

SEQ ID NO: 14837 - DNA, 606 bp, Zea mays
  unsure (1)..(606): unsure at all n locations; Clone ID: LIB3279-221-Q6-K6-G9
ctcctcctctcccctcccgatttcttgggtgtgccgctaaatggatgggcacgctactgcgccggatttctccccagccggttccttcggccacgcgaccgcgcgctcggaaaactccgctgacagcgaaggaggcgaaccaagggcgacgtattcgccgccggagaaggtaagcggcggggcggcgtgtcccgcgattcgtttgtcttccgggcggcgagcagcagtgggggtcgtcctcgcggatctgccttcaagctttcgcggattcgccttcaagcttcgcggatcccacacgaaacctccgagttctgtcgccaattcgatccgcctcgccgccgccgcccgtncgccggtcgggcttgactgctccgtcgcacgtggcggttcgcagcacggaatctaccttgtgttgcagtacccggggaacccttgttcctggtcattccggctcgaatcttctgcggactggcaaggtaagcgttctccattggagggcgacgatctacggggcggntgttggcggggttgcgggaatggagcacgtgtttcgagggaatttaagcttgggaagaagatcgggagcggatctttctgcgagctcta

SEQ ID NO: 14838 - DNA, 615 bp, Zea mays
  Clone ID: LIB3279-221-Q6-K6-H1
aaatgaactattgaaatacaacaatcttctatgtagagcctctagttctattatttcacccaacaggttaactaattggttttagcacaatactgaactagaagattcagttgtattgagtgaatatgtggataaacttcatgttactgcatcctaacttttatttcaatgtgatgatgcttagcttggacaaccattttttttcttcctatatagttccattcagacactttactagagtcttttttagtatttagctgtcatctattagtactttaaaggtcatatgagaaatttgagtggtcctgatattctatcaatcaagggcaggcctggtgcagcagtgagagtgtctcactgagtcaccaggtcacaggttctaagcagcctccccgcatctgtgggggaaagcttgcctcggtttatcccttccctagaccaccccactcatgtggtggaagcctttgacactaggtctgtttttctggtattctatcaataacccttatgttccagccagtggttattgacaattttctcatacaatacagctgcaacacatgggaatatgtcgtttagcctgatttctgcagctgatgctcttctgggctcatc

SEQ ID NO: 14839 - DNA, 572 bp, Zea mays
  unsure (1)..(572): unsure at all n locations; Clone ID: LIB3279-221-Q6-K6-H10
cccacgcgtccgtagaagcgcccctgtgcctcgcgctctctctcttcgccgtccgaagctccgcaccccaatctaatcgacacctcgccgagatgggccgcaagttcttcgtcggtggcaactggaaatgcaatggaaccacagatcaggtcgagaagattgcaaaaccctgaatgagggggcaggtcccccttcagatgttgtggaggtcgttgtcagccctccttatgtcttccttcctgtggtcaagagccagctgcgccaagagttccatgttgcggctcagaactgctgggttaagaagggaggtgctttcaccggtgaagtcagtgctgagatgctcgtcaaccttggtgttccctgggtcattcttggacactctgaaaggagagctctgctgggagaatcaaatgaatttgttggagacaaggttgcgtatgccctgtctcanggactaaaggtcattgcatgtgttggtgagacacttgagcagagggaggctgggtctccatgnaggttgttgctgcacaaacaataagcattgctgagaagatcaaggactggagcaacgt

SEQ ID NO: 14840 - DNA, 598 bp, Zea mays
  Clone ID: LIB3279-221-Q6-K6-H11
ctccccacctcggagagcaccctgagtgggttcgctagggagcatcagatcttgcaagaccctactggaaagactataccctcgaggtggagtcttctgacaccatcgacaacgtcaaggccaagatccaggacaaggagggcatccctccagaccagcagcggctcgtttttgccggcaagcagctcgaggacgggcgcacgctggccgactacaacattcagaaggagagcaccctccacttggtgctgcgtctcaggggcggcatgcagatcttcgtgaagactctgaccggcaagactatcacccttgaggtcgagtcttctgataccattgataatgtcaaggccaagatccaggacaaggagggcatccctccggaccagcagcggctcatttttgccggcaagcagctcgaggacgggcgcacgctggccgactacaacattcagaaggagagcaccctccacttggtgctgcgtctcaggggtggcatgcagatcttcgtgaagacacttactggcaagacgatcacccttgaggtggagtcctcagacaccattgacaacgtaaggccaagatcaggacaaggagggca

SEQ ID NO: 14841 - DNA, 644 bp, Zea mays
  Clone ID: LIB3279-221-Q6-K6-H2
ggcgtgtactggcaaggaattatagtgcaggtttgtggaaggatctgtctgagaatgattcttgtggaactttggttactaaaaggtctggcgaggaaattgccgctgtagaagcagccaagatcctcaaagcattatctgatgaggaccttgttctggaacatcttggatgggtggcagacattgatcaagatctagcgattgcagttttaacatctgagacgagggaaaatcaactctcaccagaaaaggttgttgcttctgttgatacagaaaaggttgtgatccatcaaagatatttgcagtggttgattgagggtcagggctgcgatgatcctcactatcacacatcatatgctctttcactggccaaatctgcaattgaagcagttgatatggagtctaaatatagagggaaagatgatagtgaaattgattctgatgcacagtttgtttattcagtaagagaaagcttgcaattgtttctgcaagcttcagacctgtatgacccagaagatgtgctcgatgtcatagcagaatcagagctatggctggaaaaggcaatattgtataggaagatgggccaagagaatattgtacttcagatactagcattgaagctggaggatagtgaagctgctgaa

SEQ ID NO: 14842 - DNA, 614 bp, Zea mays
  Clone ID: LIB3279-221-Q6-K6-H3
cgctgggccaccagctttgaccgccgcctcccttcccctccgctactgctcctcctcaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggaccctcttttggaggaggtggtggaagcagcacgggaagaaggcaaaggaggggagaagatgtagtccacccacttaaagtttctctggaagatctttacaatggcacctcaaagaagctctctctttcgcgcaatgtcatctgctccaagtgcaagggcaagggct

SEQ ID NO: 14843 - DNA, 534 bp, Zea mays
  Clone ID: LIB3279-221-Q6-K6-H5
cacggattagcggctacagctgtttgagaggcgtgtccactaactaccttagccagagaattagaacattgattgattgaaaccacatccgcaacaaatgtttcacaaaatcatctagcttcctcggcctaaagaaaatctaaacaagaacatataagaccatgacttagtaaattctactgttaactagttaattgaacaaagcttatatataaatattagtcagttggtcatatgtgaagataacttgtgaatttactttgcacaactttttcagacgacacctcctaacctagcggtaccagaagatccacatgttgaaactccgatgcaacattgggtggatcaattgtctgaaaatggtggagttagaccacaaaactcaaatattgaacggactggtggtggtggacctcaaatattgtctgaaaatggtggagttagatccaccaaccttaagtcagatcttcattctttgcttgtatggactcgttttttggattgttaacgtgtatgaaccttgttgttagactc

SEQ ID NO: 14844 - DNA, 614 bp, Zea mays
  Clone ID: LIB3279-221-Q6-K6-H6
gtgtgcctttgaccctcgccatgggcgtgaggtggaccgcctcggccatgttccgcgggaagatgagcaccaaggaggttgacgagcagatgatcaacgtccagaacaagaactcgtcctacttcgtggagtggatccccaacaacgtcaagtccagcgtgtgcgacatcccgcccaggggcgtgtccatggcgtccaccttcatcggcaactcgacctccatccaggagatgttccggagggtgagcgagcagttcactgccatgttcaggaggaaggctttcttgcactggtacacgggcgagggcatggacgagatggagttcaccgaggccgagagcaacatgaacgacctcgtgtcggagtaccagcagtaccaggacgcgactgccgacgaggaggagtaccaggacgaggaggaggtgcaggccgatgacatgtgaggggagggctgttatcgtgtgaagccttgtggtccctagggcaagcggacctcgatgagttcggtgttccctttcgtgttgttgccatctttctactgctagcgtacccaccctcgtggcccattccgtcgctgttgacgtatgtatttttcttgtgctatggaaccttgc

SEQ ID NO: 14845 - DNA, 635 bp, Zea mays
  Clone ID: LIB3279-221-Q6-K6-H7
ctggggggttcagatcggatcggaaggttgcatgagtttccatcgggcttcgccgctcgccggtatggcgatccgcaaggggtcttcgtacgccgtcgcggcacttctcgcgctcgcctctgtcgccgccgtcgcaggggaggtcttcttccaggagaagttcgaagatggctgggaaagggggtgggtcaagtccgagtggaagaaggatgagaacatggctggtgaatggaaccacacttcgggaaaatggaatggagatgccgaggacaaaggtattcaaacctccgaggattacaggttctatgccatttcagccgaataccctgagttcagcaacaaggataagaccctggtgctgcagttctctgtgaagcacgagcagaagcttgactgcggtggtggctacgtcaagttgctgggtggtgatgtagaccagaagaaatttggtggagacacatcttacagcattatgtttggaccagatatctgtgggtacagcaccaagaaggttcacactatcctgaccaaggatggcaagaaccacttgatcaagaaggatgtgccttgtgagactgatcagttgactcatgtttacactttgatcatccgtcctgatgcaacatacagcattc

SEQ ID NO: 14846 - DNA, 616 bp, Zea mays
  unsure (1)..(616): unsure at all n locations; Clone ID: LIB3279-221-Q6-K6-H9
cccacgcgtccgcccactgcgttcgcggaggcgggggcccacgcgtccgcccacgtgtccgcccacgcgtccgcccacgcgtacgcacgaacaccgaaccgcaacgtagccggctaggggaagagctctttccttcagctgtgccgtgcacaacgcacggcacgctggtttggtttggatgggccccgccaagaaagacgctgccgtgagcgggctgagcgggcgggaagcagcagcaggcgggcgacatgccgagcggcagcgcgttctccgggtcggggaacctcaagcacgtcaagctggggtaccagtacctggtgaaccacttcctgacgctgctgctggtgccggtgatggccgccacggcgctggagctggcgcgcctcagcccctgcgagctgctctctctgtggcgctcgctggagctggacctggtccacattctctgctcggcgttcctggtcgtcttcatcggcaccgtgtacgtgatgtcgcggcccangccggtgtacctggtggactacgcctgctacaagccccccgccagctgtcgagtgcccttcgccaccgttatggagcacacgcgcctcatcagcgactacgacaagagcgtgcg

SEQ ID NO: 14847 - DNA, 496 bp, Zea mays
  Clone ID: LIB3279-221-Q6-N6-A10
ggaaggacaaacatggggggatgttttaggggtagataaacggggggggacagaacaaaggcccaaaccatacccctaaaaaaagggtaagggggtccctcaaaaatgggccaaggggcccgagcatcacaaggtccttaaaaagactttttcccttttgttaaaaactacccaggggggaaagcaaaaagagggtccccaactgctgtttttagggggggctaggaacccttcctccggtctggggaaaaatggggttaattttgtggccgtcctccatttccaactaaaaaggggtttgttccccggaaaacctggggccataaaacaggaaagcaaggggatttatgtccacaaactggggggcccaaaaggggttaataaatttttttagggggggggacctttttatgcaaaaaaacacttattggcatcctgtcccttgaccttaagggggaggggggcgccgccctccgcgggcttcttaacccccccc

SEQ ID NO: 14848 - DNA, 579 bp, Zea mays
  Clone ID: LIB3279-221-Q6-N6-A11
gacagcccgtgtatatatatgaacagcgttgaagctaacaaactaattaaaactagggatatagcattaagtttccataagaggattttttatggctggacggacgtagtacaagtataaaccagtttccaagttccagccgccttgcagctactgcagaaacctatacgacgaagaccctatagactcgacaacttaggagaaccatggagcaggagcaccatggagagatccaaagcttataagagcatctccaacaacgtgacctataaaaatgcactataatttaaaaatgagtatattttatagaatttagggcactaacaaaacactccgctacaacagtaaagccccaaatctagattatagggcagcccactacggtgtagtatatttgagtcacttgagagggtgccctataattttttgacaaaaatttatgaaatgagtcactgttggagtagtttttcctgtgtagagccctatatttcaatttgaggcactagtttgaggcattgttggagatgctctaacgacgcttttttttctctctctcttttctcagccctacaggtttat

SEQ ID NO: 14849 - DNA, 406 bp, Zea mays
  unsure (1)..(406): unsure at all n locations; Clone ID: LIB3279-221-Q6-N6-A12
gtgggggtttttaaataaattttttttttggttttctatttttttggggtgttttttttcttgtgtttttgtttggtgtgtttattttatttgttatgttttgtatgtttgtttttttttttcttttcctgnttnnnattttgtttgtggggggggggtttttttntttttttatttttttttttttttgttagttttttgttttttcttttcctttttccttttttttttttttttttttttgttttgttctatttatttcttttcttttttttgtgtttttttttttttttttgaatttttgattttttgtttattattttttttctttttgcttttttttttttgtgtatttttaaattttttcttgttgttattttttttattttgttttggtttttttttt

SEQ ID NO: 14850 - DNA, 577 bp, Zea mays
  unsure (1)..(577): unsure at all n locations; Clone ID: LIB3279-221-Q6-N6-A3
aaagtcgaacagnatagtgcatgcattagaatttgaaatacaattgtgaagaacaaactctgcaatcgaataaaacattattcaaaaaggttataagcatcgattcctagatgatcgatcatcaatcgtcggcgcgtccgtagtgtatccatagtttgtcaagtttcatttttccgtgcagctcactccgacctgaccttgccaatcctgaggaagatggggtacgtgacggtcttcacctccttggcatcgccgccccacgccgccgcgaactcctggacggtgggcgcatcgagcagctcgacgccgttatcctgggcagtctggtaggcggaccaggacgtgatatacatgaggtagtcatcgaggtccatccggcggtgcgtggagaactggaacgggcccgtgtggttctccccttcgaccgggtcgaacgggaagtcggcgctccggtactcgtcgtcgaccatccggcggttgggcgcccagtatccctgggacccgtggtacaggcgccagaacacggggtcgacggcggcgtcgacgcgtggctcggtgtagcaccaggcggcgagca

SEQ ID NO: 14851 - DNA, 578 bp, Zea mays
  Clone ID: LIB3279-221-Q6-N6-A4
aattcaattatctttgcaacttaatatcctgattagggataaccacctaatttatgctgacaacattcagagcactgaggtacaccaaaatccaacagttcaacacccgtttggatccacatcaaaacagggagtcaagatatgagtagttgtacaggcggccaaattgtagcaggctgccatacatcctatcccacacaccaacgaaaagcgtgtcagtgtctgggctgaacgatgtgccggatatctcgccaaagaagtccagctcctgccttttgttgtagtcactcttcacgtcgtagatgtgcacaaagtcagcaggttcagccatggacatgaactggccatccgaggtgaagcggatggaccggatggctccaaggttacccctcaacacatggacggattttgagaggttcctcacgtcccagattcggcatgtcttgtcttggttgccggtagcaaatgttcgcccatcagggctccaagccgatgcaaatgagtagtcccgatgtccttttatggaatgaactgtctttccagagtttgcatcaataagtagaccatcaggatcatca

SEQ ID NO: 14852 - DNA, 576 bp, Zea mays
  Clone ID: LIB3279-221-Q6-N6-A5
aaccatgtatgccttacattcgatgttccataaaaaaaataagtcttaatagcatcacggtttcaacgaaagtaataatacttcatgaccaggcaaacattgccatcatagattacttgttcacgcgacaactgcaaggatgtcaacaagacgagatattttaagcttccacgaggtaaccaacaagcaagcacagcaccagccagatagatcatttcttcttggcagcagccttcgtcaccagccagatagatcatttcttcttggcagcagccttcgtcaccttggctccagttgggtccttcttctccacactcttgatgactccgacagccaccgtttgcctcatgtcacggacagcaaatcgaccaagaggaggatactgagaaaaggtctccaccaccatgggcttagtgggaaccatcttcaccataccagcatcaccgttcttgagaaatttgggctccttctccagctccttgccggatcgcctatcaatcttggtaacgagctcagcaaacttgacagcaatgtgtgaggtgtggcagtccagaactggggcatagccattgccaa

SEQ ID NO: 14853 - DNA, 562 bp, Zea mays
  Clone ID: LIB3279-221-Q6-N6-A6
gatgtaaacccatcatgtattcatataaggcatataagttcgcaaccggttacaagaagatatgcccattaaaagtgaggacatatgccaacagtgatcactcagctaacctacttttcttatttcatactgaccttcagctgaaaaggtagaaggatctattctaatctgctggctgatggaaaaaaggagccagataaaatagacctgatgagcttccaactgcaatatgtgcagtagtaagttgtggaagcagtgaagtgtacgatggcacatcgtccactatgctgaccattcacgaggggatgttacgttgctgccagcattaagcttatcaaccatcacgggttgtactgcagtcaccactgggagtatctcaccttggtcccgtgaataccctaccacactagccgtttcaaccatatttccaaatggatgattgtgcacgacctgtggtcccaagggatgatacgccataaaagcagtagctggaggctgaggcagaagagctacgacagttgcagggcagttagaagggttcttgtatgtggagctgtaggtc

SEQ ID NO: 14854 - DNA, 542 bp, Zea mays
  Clone ID: LIB3279-221-Q6-N6-A7
gaaagctgaaatctagagtttaatccattgacgtcgcaacacaacacaacagtccaaccgcctagcgctgcagggcgaaaattcacagtagcaaaaggggagagcatagggcatctcattgcctagagcacctcgactctcatgcagcacctctccgctgctccgtctcgccatgggcgaaggggcaccggtcaccaaaagtacaggcccccttcaagaagttctcgcacagcttcgtcttgtagttgctgctcttgccccctggaccaccgccttggcctcctcctgctggtgccgcggcagcagatggatttttcgctggcatgcttgcgctgatggttgcgatgagatcacgcaccaagtcgctggcttgcttgatctggtcaaaattgccttccagctcgatgttctttaggttggggttagactcgtggtcgcggatggagagcttgacgcctgtaattttacttatctgcttagggttgaccccacccttgccgattatgccaccggccagagaggcgtccacactgatcttggca

SEQ ID NO: 14855 - DNA, 578 bp, Zea mays
  Clone ID: LIB3279-221-Q6-N6-A8
ggaagatcactaggacataaaaatttattaagatgcaaaattgactggaccacttgagatgagggatgcccaaggcgagcatgccattgggcgcgacttggagtcctactaatcaaagcttgatgaagggcgatgacatcacaaggcttgatgggatataggccggcctcacacttcccgtccagcaggcttttcttggtgtgccagtcctgctccattaccgacgtggacttgctcatcatcgttgtagcgttctcgtatggccagacgatcgagatcgctggttatgtgatcggtagcgcccgtatcaagataccagtttggatcgatcttgtacgaagtagtggccaccagagctgaggatgaaggtgtctcagtgtaggattcatccatgcgatccagcacttgattgctgtatgtccttccttttcacaaatttgacaagtgggacgagaagatgagccatgaccaccggaagcgcgaggaggcgcaccccccctaggtgcaaaatgcccgcagccacaagtgttgcggccacgaccgcgatgaccacgaccaccacgcccaacatagttcgc

SEQ ID NO: 14856 - DNA, 581 bp, Zea mays
  unsure (1)..(581): unsure at all n locations; Clone ID: LIB3279-221-Q6-N6-A9
gtcaggttgaacccgtngataactgcatgctggcccaatgcggccagaacagcaataagtagcacaaaacatatgatccagaaaagagtaaactttgtcttttctgtaaatctagaattatgtactaaacagcaaagaaatgtagggggagcggagcggacagacgagacaaatcccaaaacgttttcctattttctgtccacagccttcgcatcgcatcacaatggaggccctccgagcccgtcatcgttgtcgaactcgtgcatgtgatccaagaggtagttggcggccagctgctcgttcttgttgcaggcgaagaacacttccaggacgagtgcccggtcaaagcccatcccttcaagacgaagtatagcttcattctcctctggagtgactgcaatggtctcagttgcatctgccatctgatccagcatcatttcattctcttcgtctccctctagtggctcactaatcaaccgcataaactctgcttggttttcctggattagctgcataacccggggattttgtttcctcaattcttgaagcaatggctgcaaaatttgagggttagcctgaac

SEQ ID NO: 14857 - DNA, 574 bp, Zea mays
  Clone ID: LIB3279-221-Q6-N6-B1
gaccttggtccaaccattttcacgtggctagttctgctgatacatcaagatcaatctgtttcatatgaaagcattatagaattatataatccaatgagatcactaaccacctgattctaagaccaccacgacagtcacaggaagctagtactcggagattgggcatcaagaaacggcgcagctatgaagtctcaatgacaaactatgttttaagagaacccttgcagcaattttgtcatacatagtcattacttgcaacatcatcagctaaaagaaggctcccaggttgggcactagagcataactgttattcagagtatctcttctgcacttcttacaccacccctgagggaagccgtagcaccagttgcccaccaacaagactcttcacatagtagtagcagaaatctgcaaggatgaatgtctgcacgatttctgataaaagcaccatagacggccacaaaccatagccaagagctgtcaacagacgaccacgcgtgtccaaaacctgtagaacccagtgggcgcagctaagaaaccttgcaactcccaatgcaaatacatagtgagctgt

SEQ ID NO: 14858 - DNA, 475 bp, Zea mays
  Clone ID: LIB3279-221-Q6-N6-B10
ggggcccaaaggggggggggcggattcgaggaaaaaataaaaccccaaacggggttaaacgggaaacaggggccaaaaaacccaaagccgcccaaattcacacagggggggaagcagggggtttcgaagacccaaaggggaaaaagggggggaggggggggaccaaaacgttaaaaagctacaggtaggccgggttttttagggggaaaaaaaaagaaaaaaaacccgccccgccttttaaaaaagcaaagcccgggtgggtttcccccttaaaatcccgggggggaaaaaaccggtaccggagggtttaataaattggccaaaaaaaccttgacaaaccccccgaaggtgaatggggcaatgccaaaaaagggggccccggggataaattaaaaaacccccttggggggaaacttttccccgggggggggaaaaaaggggggggaccccccccaaaaaaaaaaacccttctggc

SEQ ID NO: 14859 - DNA, 65 bp, Zea mays
  Clone ID: LIB3279-221-Q6-N6-B11
gcactacaacaaagaagggtacaagcaagtatttcctttcttacgtccatacgttggtgcctaca

SEQ ID NO: 14860 - DNA, 330 bp, Zea mays
  Clone ID: LIB3279-221-Q6-N6-B2
ggtagcggagttggaggcgagctggttcttgtggttgtgcatccacaccttgagcacctgccgcttgacaccgatctcgtcgcagaagcggtcgagggcgccgtcgtcgttgcgctggatgcgccagccctgcttctccgcgaactcgcgcatccgctccttctgctccggggtgaacttggtccggaaccgcttgcgcccgaagctgccgctgcccgcgccgcttccgggcgcaaggcctactccgacgccgaatcatcgaggcgcggtggcgttgggagccagtgcgcgcggtgagcctatggggcgcgggtggctgcattggccacg

SEQ ID NO: 14861 - DNA, 570 bp, Zea mays
  Clone ID: LIB3279-221-Q6-N6-B3
gaaacaggcatttcttcttccattctaaatagcaaaggacaacttgcagcaggacacatacacatacaagcacattcgtcccatctgcagcctacgcatcaccgcatactggtaacaaggtactgctaaacatcagatcactccggacagtcagtctatgccttcttaggggacttggcggccttcttgggcgactttgcctccttgctcccgccactggacgccttctccgccgtcttcttgggcagcagaacagggttgatattggggagcacaccgccgtgagcgatggtcacgccgcccaacagcttcccaagctcctcgtcgttccggatcgccagaagcacgtggcgcggaataatgcgagtcttcttgttgtccctggcagcattaccggcgagctccagaacctcagcggcgaggtattcgaggacagcggcgaggtagacgggggcgccggtgccgacacgctgcgcgtagcggcccttcttcaagtagcgcccgatgcggccgacggggaactggagaccggccttcacggaccttgacaccgacttcttacttggcccc

SEQ ID NO: 14862 - DNA, 577 bp, Zea mays
  unsure (1)..(577): unsure at all n locations; Clone ID: LIB3279-221-Q6-N6-B4
gcaacggnaacatataatatcagataacttatgtacaaataagtgttatactgttataggtgagtgcaatactaaaacactactattttgctcagaacgttatataagtgaaaatatgtccctcctttccaagtccttgtttcagatggtcaaccatctcatcaggtttcaaagggtgcatatcctgcattgcaagcatataataataaaaaaatatccatgttcggagggaaaaaaatgtgtgacaagctgcttaccagagccatagacaggtgcaatcaactgcttgcctagcaatcaagtaagccatattgataatacagtttttatctactggtctggtttgaataatgccaaaaaataacaatggcttaatagtagctaagctaaaaatgatagcatcacacttcaaataatgtgatgttgcaccatacagctccgaaccagtagattcaattagcaaaagaccatttcatcaacatatcattaaggtattccatttttcatcaaaatatgtgttatgccttgaaaatagacaaaagcgaaacacgagtcaaatctgtaaataatcagtgaa

SEQ ID NO: 14863 - DNA, 579 bp, Zea mays
  Clone ID: LIB3279-221-Q6-N6-B5
agcataaagagttcactagctataattgcccatctcttataatacacatgtcctttcaatgggacaatacaacaacaatcaagagacggcgagtaattacaaggcatgacaaccaaaggggggtgaaaatgaaaggctgtgattatagctgacagttacaccaggatatttaacaatgacaatttttttaacaaattcaagccatccagcaaaaatgtccaagatcatcaaagtggacagcttgaaaattttgatgcatcttgaggatagttttttagacaaaaggatcaggggagttatcatagtctagaggatcggaacccattctagctctaactccagctcaccagattctacgttctgcagctttaagtgcacctcctgttttaccttgcctgcaacaacattcactgtgctatctttcatcagggcgttgtctttggtcgtgaaccaccgcccaatttgcatgtcaccaagacgtgaagtatctccaaaggccatggcggctgtgatcattggatggaagatctatctctgcttcacccatgatatcatcggctgagaacgtatcatggacat

SEQ ID NO: 14864 - DNA, 475 bp, Zea mays
  Clone ID: LIB3279-221-Q6-N6-B6
agcaacacccgaccaatcagggtcacggggagaacgggggaagaggggaggccaaaaaaagaaaaagggaaaaccacattctcgggccttttccaggccgcggaaagggaacacgaaagaaccgaaccggggggggaaaaaatttgccttttaagaagggcacgcccccccgtacattgccaccccgggggagcaaaagaaaaaaaaacccacgcgtacaaagaggtacccttactacccaaaaaacgccccaccccgggggcaaacggcggggggggcgggcggtctttttgggccctgggggcctgccccccccccccggttcccggcctgaaaaggaggaccctcggcccaccgggctggcacaattcgtcaagcaacccgggggggggaaaaaaaacgttgtcccaaatctcggcaaaggcccccaagaaggcctctggggggggcggccccttgagggggagaaaacccc

SEQ ID NO: 14865 - DNA, 253 bp, Zea mays
  Clone ID: LIB3279-221-Q6-N6-B8
gatccgaaaaaggaatagctattttttttaaagtctataggtaaacctcctctacatttcccttgcaacaacgatgtcaagaaccggctataaaagcatttcatatccactcgatttttcttaagaagctggccatgcgaaaccatttcgtactctctcgtcctcctgttcttcgaacagaggaagaaagcttctccgcgccactgctggaagaagaggagcgccggcagtagcagtgctccgcaaggtgtga

SEQ ID NO: 14866 - DNA, 330 bp, Zea mays
  Clone ID: LIB3279-221-Q6-N6-B9
cgcggcgggtgctgtctcctcggagctggtgctgcttttctcttcctcatcagaggacgcggctgatgggagcggaggggacggctccttcacctttcgcttcttctctttcttctctttcttcttgaccgaagcggcctccgcctctgcctccgcggcggcggcggcggccttgagctgcttgcgcttggccttcttggaggcggaatcgtcgacggccatgggctccacgccagcggcaagggcgggagacatcactggtaacaggcggtggcagctggtaggaacgttgagggctggcggctgcgccatcccctccggacgcgtggg

SEQ ID NO: 14867 - DNA, 535 bp, Zea mays
  Clone ID: LIB3279-221-Q6-N6-C10
gaaactcaaaggtagatgaatgaggaaaattagaatgaaagaattgtcaggtacataagctatcacgtgacacaacacaattagtactaggtaacagaattgcgggcgaggctgcttcattctattgtaagcttcatacggcattcccatgccttaaaaagaagcagtgcttttctgctagctgcagaattgagcggccaaaatttcaagcaggaccatgctcagaccttattcttctctcttggaggtatcttcagcaaatgcttcatggtgtcatatgcggtgaaaccaatggccactgaaggcaccaccttgatgtaattgaggctcaagccagcaaataattgtttccaaccctgtgtttgtttaatggacacaagaccctggaatgtgcccgttattcgtggggcaccaaattgctcatgttgttgctgattttgaacctgcatctgcctcctgacaacatctaatggatatgtcagagtctgtccaaataaaccagcagcagcaccacatgacagcttcaatgttacag

SEQ ID NO: 14868 - DNA, 561 bp, Zea mays
  Clone ID: LIB3279-221-Q6-N6-C11
gactacgaaaagccctgcgacatcatcaaagttcacaaggccaaaatacatcatggagcacacaaaacttgaataaatgaacaaaggcagctgtcttacacctcttctgctataaaatgtataggtcagctttatcaactcacgtccaaaacccagacctaaaggtgagggctatggcttttgaacggcaggacacaagagtacgtaacatacttaacactatctataagaacgacaactaagatgcgggacaatgattttgaagagatccttccctcaccatccccatcgccagcctctctgggatcagccagcacagagacgaccactgacgaaacaggcttcgtactgccaaagctcttgaggtgctcagtgtcgttggatgttgaacctctcagaggaatggcctcggagtacgaaatccttctgttcttgaccgtgcgaacacgagcagggggaagatcttgagtgaagttctgtgacgagtttgacatggcattggaatagacaggaatgatgccatttggatgagcagatgatggggacacatcgaactggaaa

SEQ ID NO: 14869 - DNA, 505 bp, Zea mays
  unsure (1)..(505): unsure at all n locations; Clone ID: LIB3279-221-Q6-N6-C12
ggggtgttttttttttttttttttttttttttttttttttttttttttttttttttttttttttttttttttttttttatttgtttaggtttgtttttttttttttggtttgtttttttttttaanttgttaatttttttttttttggggggggggggttttntttnnnttcttttttttttggtttttttttttttgttgtagttgtggttttgttttttgtttttttggttttttttgggtttttttttatgggttgtgtttttgtgttttttggttttttttttttgtttttttttttttttgttgttgtttggttgtgtttgtgtttttttttttgtttttttttgtgttatttttttttttttttttttttagttttttaattgtttttgtggttttgtttgtttttgtttatgttgtgttttttttgtttgagtgttttttcttttttttttttttgatggtttatatttttttcttctttttttttttctttttttat

SEQ ID NO: 14870 - DNA, 569 bp, Zea mays
  unsure (1)..(569): unsure at all n locations; Clone ID: LIB3279-221-Q6-N6-C2
agtacgatgcaaatttgccccctctacaactaaaacacaggtcatngaatcggattccagttttgcgcgagttccaagtgttccaacatttggtcttttattccaaacaacagctaaaagaaaaggccgtcaaaactgcagcctcttatctaggctactactggtactggaggaacgagtacgaacatcagtgcttggcgctcacaagagccatgtgagcgatcagatccagaacccggttgctgtagccccactcgttgtcataccaagacacgagcttcatgaaggaagagctcagtccaataccagccttggcatcaaagatgcttgaccttgaatcaccaacaaaatcattggaaacaacatcctcgtctgtgtagccaagaatacctttgagtgcaccctctgatgccgtcttgatggctgctttcacatcatcataggaggcgcttttctcaatccggcatgtcaaatccacaacagagacatttggtgttggaacttggaaggccataccagtgagttttncattcagctcaggcaggacttttccaacagcctttgctgca

SEQ ID NO: 14871 - DNA, 517 bp, Zea mays
  Clone ID: LIB3279-221-Q6-N6-C3
gatcacgctggttatgaggttgtcatatcagttgacatcttcatcacaaattttttagagctagatcatatactcatatgacaagcagcaagcattcaggagaacacagttaattcactcttgtaccaacacaaacagtccgcatgacttgagataccaaacatagcaaataataagcagacagtttgccttgtcttccctatgctgctcctggttatttcttgccacgcagcttcgttcccagggccctctcgagcttgccaatgatctgctggttgggaattgccttacctgactcatactcctggatcacctgtggcttctcattgatcatctgagcaagctgtgcctgggtcaacttcttatctagccttgcttgcatgagatttttcttcaggtcacttggaactcgctcatgggcgaggttctctgtgtcgtcgtcgaggcgcttggtgttgagggatgtgccgctggacgccgtcttgttcataccagcgttgtactttttcatggtctc

SEQ ID NO: 14872 - DNA, 527 bp, Zea mays
  Clone ID: LIB3279-221-Q6-N6-C5
ggaacaaaaaaatttctgacacaaatggcagggtgaaggttgcttgcagaggaacggggtacatcaacagttcaacacggggatgcaatggaacaaatccagatcaaggcaaaatgtctagacaaaactgcttgggcatgatgtctcactgcatctctcgtatctattcctgaaaaccacccacccccaaaaaaaacttttgccagcgaaccaactgcaccaaaatttttggcctagcctttaacttttttggacctctttgggaaaagcttgcgcccctcaaggagaacctgttggggcatttgctcccacaccaagtcaaactggtcatggaatttatcctggtaccacaacttgagctcaggatagagaaaaccaggatccaaattccacacgccttttaatgctgcccgggtgtggactaactttggaccgatctttatcctgctaaaaagggttcccactttacgttgcctgggaggccccaacacaacggatggtgacagcgcgaggaaaccttggcgtcc

SEQ ID NO: 14873 - DNA, 584 bp, Zea mays
  Clone ID: LIB3279-221-Q6-N6-C6
aattgaaaaaccaccacctgtgttatttaagataataaggtctgcgagtagcagggcaccagttttgcaggttgatccttgtcacatgtcaatatatgcaaggatgtcaatagtcattggcagtttgccacacaaccatatccgtactacatagctcactcaagttgcctatatgtatgcgagcttgttagctaaagacgctgtgactggaagcgcacccatgacttcagaattcggattaaccttacatcagggcacggttggggtcagggcgcctagttgtagtagagctcgagccccatcccgtcgtggatctcgtagtccttgagcgtgatgtggtccttgtagatgttgtaccacttctggatgcggatcttctcggggcgcgtccccgtctgcgccgccaccagcttcttgaggtcgccgatggtgtcgtcctcgttgcacttcacccgcaccttcttccccaggcggtcgttcagcaccacctcgatcatcttcgcctccctgaccctgagcgcgctcccctctcccctcctacagattcccaaaccctagacttggcctcggagtggcttgcgtgc

SEQ ID NO: 14874 - DNA, 429 bp, Zea mays
  Clone ID: LIB3279-221-Q6-N6-C7
gggacagaaaaaaaccccccaacaaaaggggggcaggaggttaagcaggcgccgaaacaaccaaaatgggcccaaaaggtcggggatggtgggccacaaaaaagctcaaagcccaccccgcccgaaacacttttaaaaagggaaaaaaaagcaggggattgcaaacgggagggccccaaaatctggagggttttaaaaacaaaactgcccttgcccgaaaaaaaaatggggaggggggtggggtggagcccaaccaaaggacaacaagggggggggggggggcaaccaaagggcagccttaatattttaaaaaaaaaaaaaacaccccagggggagggggccccaactaaaacacggaaatcaaccaagaaacttttgggggaaccccttggagccgggatacaaacgcagggatcttggccccctggg

SEQ ID NO: 14875 - DNA, 576 bp, Zea mays
  unsure (1)..(576): unsure at all n locations; Clone ID: LIB3279-221-Q6-N6-C8
gtaaccaagnaagcaagcattcgattattctaagtataaatgtgtgatccagcaagaatccattattgcaagctcgggcttaacagcaagagcgcccgattccttatacacacacacatacaaccaggtgtctgtctacacggtgagttccgtcctggagacaagaatgccatcgggatcggcgtagagccactcgccgtcgcaaatcctggatccagcgatgttgacggggacgtgcttctcgcccatccccttcttgttggccttcatagggtgcgagctgagagcccggacaccgatgtcgcagccgttgatctcatccacgtccctgatgcagccgttgaccaggataccagcccacccgttgttctgcgcctgctggacggggttgccgccaaggatggcgcagcgcatgctgccgccgccgtcgaccacgaggaccctaccgtggcctttctcctcgaggaactcgcggaccaggacgttgtcctcgtagaccttgagcgtgacgatggggccggcgaagacctggcgccgtccgtagatctggaagattggctggagcgcgcggcactc

SEQ ID NO: 14876 - DNA, 418 bp, Zea mays
  Clone ID: LIB3279-221-Q6-N6-C9
cagtccaaaaaagacggttcctgtgatattgatattaaatgcaaaaatttagtcagctccagaattacactgattatcatgttacaaggtcattgcaacttccaggtctctcaactgggaaactagatggttaccgacacaatctcagagtagtagatttcaatattggggtaaaccctaaaccaaacaaaggcagtctaatcgctaaagatgtatcacgccacagcagcactcatttgctcaaatctcactaatgtactctaaaagagattcaacctcctgcctcagggcagcaattttctgctgctgcaaagcaatcctgttctctacatcttgcccgcgcagcttcttctcaaagctgtcgacaacggtggaatgccttgtcatgagcttctcctgcatctctctctcctttacg

SEQ ID NO: 14877 - DNA, 600 bp, Zea mays
  Clone ID: LIB3279-221-Q6-N6-D1
ggcggtctccttggcgaggagctccgacaccctcgcggcgaggctcagcttcgcggccggcgacacgccgcgctccccgatgatggactccagcacggcctcgcagaggcgcttgttctcgatcgccacgccgccggccaccggcaccgacgagtccttggagaaggcgacggtgaggactccggcgggcgagtgcgtgaagaggatggaggcgcccggcgcgaaagtctctggcttgaacacctccctgaacttctccacggcgacgccctcggcgtccgtgtacaggccggcggccttccagaacgccacgcagttctccgtcactttctccgcgtactgctcgcccgtcagcgggaggatcatcgtcaccctcgtgaacttctcgaagtcgcccgtgacgacgtcgcggaagaaggcggcgtcggaggcgagctcgtcggccgtcttgccgccccacttcttggccagcgcgggcacggccgcgtcctccaggtacacgccgatggccgtgaacttgatgaagttgcctccgatctcgaggcctcgcacgcctgcgccgccgaggaagtgcgagccggcggagcccggcgggcgggc

SEQ ID NO: 14878 - DNA, 578 bp, Zea mays
  Clone ID: LIB3279-221-Q6-N6-D10
aaacgccaaatacaaccgatgcgcttccatttatcaggtttcttcataatccattgcctgcaattcacattacagtacaatgatgatgagcaaagcgaatcatataaccacagctatgcaggcacactacttcaggtcagtaagttcaatacagaggagagattccatgctgacagagttaacaataaacttcggtataatcatgaacaggagaaacacatccgagatgaggaaacatccaatgattaaaaaatataaggtgcaaagttcacggggctgccttcaccacgaatgatactctgggaagcaaaagttcattacacatcaggtggtgaaccaccaggaaccaaaatggctatgttgttgccgttcaggaggatctggtcaagttttgtaatacggcgcccttcagcagtgtattcatactcggtgacgtcctccagcaccatattgacgtagacatcaaagccgcagagggtgccaacgagctccttgtcccccttcatgatcacccagatcttggacccgatgcaccggtcgatcagctctgaggggagaagctgggaggggttgttctg

SEQ ID NO: 14879 - DNA, 351 bp, Zea mays
  Clone ID: LIB3279-221-Q6-N6-D11
gggtcaaaaggagaattggatcaccaaattattcaatgcgaaagctgcatgtagtttatcccattggtatcccctaaatattctgccgggggcccgaaaatatagctcgctcttgcacacaagccaatcaattcatcacgcatatgagcaatcattttaccagattgggacccgactgaattataagcgcattctaacaatgatggggggaatgcacactccattgcctaaaaaattgacttaacccgagagaacaccatccgcgctgggctgggggtccacctcctgcccagggggctacggccgttaaacccttcagctccgccctttttttacaggaaaacaaaacac

SEQ ID NO: 14880 - DNA, 599 bp, Zea mays
  Clone ID: LIB3279-221-Q6-N6-D2
cacatcaacactcctaaaggttgcagtttattttagaaaccacgaccgagtaacaatatagcaaactaaatagtgataacaataggctaaccctaggacttcttttgcagtgtagtacatacatactacgaagttagcctccacagaggtgatgtgcacggcaggaaagggggcggcaaacaagcacctggagcaacagcggtcacgatgctaaatattctacaactctcgccttatttacagagccgggctgctgatgagatctcgttagcggtcaaatgggaactcattgtcatcctctaccaccttgaatggctccgggtggcgactggagcagtaaaggttccacatcttgtagtatgccctttcaaggttgcgcacccatcgagctgtatcaaacaacgggcaggtcatacgaacttccttgagcttgttagtcagcgcttgaagcttcaccggattcagcgctagttctactgctctatcttcatacttcttcatgctgctaacaatcatctcctccccaagcccagtagctacgcagagggaaccagctactctggttgccattttctctagtggaagggtgatcattggca

SEQ ID NO: 14881 - DNA, 324 bp, Zea mays
  Clone ID: LIB3279-221-Q6-N6-D3
ggggggggggggttggggaaaaaagggggggaaagggaaaaaggggatggggtttaaattttggggtgggggggaaaaaggggggggcgtgggtgggggggaaaaaaaaataaaagttctggggctggaaaaggtaacccccaaaggggtaagagggaggagggtttttgcggggggagggggggaggcctttcaaccgagggaggatttgggggggtttttaggggtggcttttgtcttttttgggggaggaaaacgtctcggggggggggggaaggggggggggggttggggttggggcggagggggcccctgaaattttga

SEQ ID NO: 14882 - DNA, 555 bp, Zea mays
  Clone ID: LIB3279-221-Q6-N6-D4
caaaaaaaaagagaggcgtagtagcatccacaccaacagaaacttaaatgtcgccaaatacaacagaccaatccacacactcctgatgccactgttgcattacaagtcaaagggggcacacacaaaccactatcagtcacataacacaaccaatgagaagcgacaaatgtacacgtatcaagcggcaaaagctgcccgtcttccaaaccatactcagtttcccaacgacgaatcaacggattagacggcgaaatatgctgctgtgctcggcctactcatcatcagtcagatatgccaccttttgtctgcgccaccagacgcgctgtgaggagaagggccactgtttttcacgccttgcggagcttgcgatgacgacgaccgctgcatgcgaggcgacgagtcgtgcttgccgttggtcatgggcaacgagtgccttttcctcgcggcgttgctgtcctgcacgtctgggctcatcttcggggacgacgccttggctcttgcggactctgtgaactgcatgtagctaggcaacgggttgctgttgctgttgcttac

SEQ ID NO: 14883 - DNA, 580 bp, Zea mays
  Clone ID: LIB3279-221-Q6-N6-D5
ctattcagcgatcagtagtcatatattgagatctgagatttaaaacagcacctattgagatttaaaacaggcagcgttgatgcttgggggtaagtataagtgccgaagaagcgaacacactaccaactaaacagcatcacttcagggacaacactttcaattactaactcagagcaggcactactagtctacagcatctcaaaagacagacagcttccagacgctacggagcagcaaagcccggttaggcccaacgacgatgagatttccctgctgactgcaagcacttgggcagcccagagtttcacccgtcatccatcactcatcaccctcctcgtccccgtcgttgacctcggacttggacttgtcagaatcaccagacaatgtgggtcctcctccagactgcttgttgttataggcgtccatcttctttgtgtactcaaccttcagcttctcggccttagatacgtagggagccttctcctgcgattcagaaactgcacaacgtcaaagggcgggcaagggaacaaacgtatactgcatcggagcgttgaagtgaatatgcaagttgaacaaaacc

SEQ ID NO: 14884 - DNA, 587 bp, Zea mays
  Clone ID: LIB3279-221-Q6-N6-D6
atgttacgaggcaatattctgacaaaacttcacttcagtgccgaggaattacaaaaaaacacttcagtgccaaaggtggaacaaaacctaacacgaccataattatgacattgcagctagaccacccagagcccagaacagtaatacaaatgtaaacgaacgtttacttcttcttggcgtcaccagctttggtcttcttgacaccacggatcttcttggccctgttcttccgctccttcatttgcttgcgggacttctcaaccttagtagcaagaccattcctgatgaggcggtatttcggctcgaacttcttggcagcctcgaggttgtcgtagatgaggccgaaaccagtggactttcctcctccgaagtgggtgcggaacttgaagacaaagatggtgttggggtccttcacctcgtacgccttggcaagcctctccttcaactccgccttggagacgttggcgcggccggggtggatcacctcaagcacgaattgcttgcgggccaggaggcggttggtcatgaacttgcgggtgcggagggtgaccgccgaggtggccttggagtccgccatggttcaactg

SEQ ID NO: 14885 - DNA, 569 bp, Zea mays
  Clone ID: LIB3279-221-Q6-N6-D7
gatcacaagtgctcttcttatcctgcagagtcaaaaacattctcgaatagataacgcatgttccatgcaatagtatgccgcaaactctagtgatatattctctgcccgccaaaggtatacataacagaaacctactctccctcccagccagatcacatgaagtcgtactcgtcggggtcatcgtagccaccaccccggccggggatgaagtcgtcgtctcctttctcgatgtggagttgcttctttttcgctccttgtttctttttgcctgctgcagcctccttctcagccttgatcttctcgttagcaattgccgtcacggaagaagatatatctttcgcgtccgcacctttcaacgatgtcatggaaagtctcatgacattcttaagcagagccatatagtgaaagcttttctcataggggcgtagtttgtttgcaataagctccgcgtattccgcaaagtcactctcggactttggaataaaagtatctagtgacttttgctcactgcccttctttgcaaaaagctcggtggtcgacttgaagtcagcttcttccacaagtctttg

SEQ ID NO: 14886 - DNA, 629 bp, Zea mays
  Clone ID: LIB3279-221-Q6-N6-D8
tcgcgatctagctagatcgcgagcgccgccctttttttttttttttaagaagcatgaaacgggaatttcagttctcatagcattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagccaaggggtcgcgacggtgcagatgaagaactgggagccgttggtgttgggcccggcgttggccatggagagcacaccgggggcggtgtgcttgcgcacgaacttctcgtcggggaacttctcgccgtagatggactcgccgccggtgccgttgccgcgggtgaagtcgccgccctggcacatgaact

SEQ ID NO: 14887 - DNA, 507 bp, Zea mays
  Clone ID: LIB3279-221-Q6-N6-D9
aaaggcatacaagaaattctttattaataacattcgttacatattttcgacagcaacaagcgaacccaagcaaagaaacctattcttacaacgttcacaaatcacaacaggggggggctcaaaaaaaatccggggtatcaatacagggggggggtcagcttaaatgagagaccgttcatctttgttgcaattaaacaagcgggtagcatagagccaaagacaaagaccggctactggtatagttcaagagggataagattttcatccatcatattccccattggcaaacttgtcctccgcatagcaaacagcgaccactgggttcccaccaaatttccttccatgcagcgctgtctttgctttggcagcaccatcgatatctgcatattccaggaacaccttcccaactcctacaactggctgtccgctggggtcagggcgtgggatgataactttcaccaaattaccatatttgcctgcttctagcctcatgtcttccataagggc

SEQ ID NO: 14888 - DNA, 558 bp, Zea mays
  Clone ID: LIB3279-221-Q6-N6-E10
agcgcaaaacaatttattactattattcactataaagatccgcaagaatatacaaccaagaaaagagagtatagacatccacacccaaaggtacgggctccaaaccttcggtgggactccggagagctgagtttaacctatgtcatacatgaatgaggtagaaactaactctgggtaacaatgacgcagatttctagggggaccaatacctatgttagtgttgagattcacgaaagatcaaatgacccttggccttcgttgatcgcataaagcagtttctttagcatgatagccttggtggagtatggtggtagtttaagatagttggcgcaagtcatgacactaggcaaatcatcatctgcagactctgtcgctccagttgcatttgaactattatttgccacagaagagtgcttcctaacaatggtcaacttaggatttagagcagccaaacccccaggtggaagccgaggagcaccagtcacaaactggcagaaagcatgttgctgctcaggagtaaattctgccatgatctcaagaaaataacaattgcaggac

SEQ ID NO: 14889 - DNA, 551 bp, Zea mays
  unsure (1)..(551): unsure at all n locations; Clone ID: LIB3279-221-Q6-N6-E11
ggccctaaagattttgggcctctcagtcccctccattactctcaaacaagcactaagtgtctaacatacaaaattggacgccaacttttatgacagctcttatatgaataattattccaccctccttccacatgaaacaggattatctactgaacagtgcaaccaatctagcgctagcaagggggtcccattttatctcatcagcatcagattgctagtgtgccatccactgtttggttttcgtcgtcggaggtgaaagactttgatttggacgtagctctggaaaatccatagccaagagaacttcctgacgtagcacacaactctgtaagctctgacagatgacgattccggaactcgttgatggtttcctgaatctctgacattgggagttttgcttgtgcaaggacagcagcagctagctgaagacttggctccaaggtctcagggacaaccgccgttgcaccagctttctccaaattaacaccatgatcaacatcatgtgctctaacaaatgtcttcacatttgnggaaatatttgttcaacgccc

SEQ ID NO: 14890 - DNA, 455 bp, Zea mays
  Clone ID: LIB3279-221-Q6-N6-E12
gaaggaagcctacaatttagcaatactataaatttcaaaactacaaagtttgttgcgtccaaacacatcaagacactctaaaaccaaattgtttcacaaaaccaaagtatttttctaaaactcccccgaatactgcggatcctcggcagcgcacaggaaactggtgccaccgttttcctgcaagctatccttcttcctgcgtaaccggcaactccatgacccacacaggcaaggagaacgcttacagagcatgacacatttctccactgtattacctggtaaatcacaaattcacaggataacatgaaagccaccgagaatggcaagggagaggcccattgaacaatatctaaacaacacacgcaccataccatacaagctactggataaaacgaacgcacaaacccaatgaggaaacagaaatcctaccggacgcgtagtgtcaacccggaaaa

SEQ ID NO: 14891 - DNA, 468 bp, Zea mays
  Clone ID: LIB3279-221-Q6-N6-E2
aggtaaaacaggccttttaaacgcaacacccttttaggcaggggaaaaaaaagggcccgaaaaaaccggggagcctggggggccgaaagcgctaaaaaacgggggggtttataaaaataaaacacacacggggcccggagcccaccagtttcgagggtgccgggcaaacaaaattcgctggggggtttttggaagccccgaataaaataattttatacacaggaattggggagggagccttgtttggaaaaaaaaacggggggatcctttgggaagggggcacaggggggtggtatccgttttgggggggaatttgggggattcggtcccaaaaaggcctttggggaaaggttccatgcgtaggggtttggaagggaaagaaggggccccattaagagggggtccaagggaaaaaaaatattcctcccgggccacagtgtacgctgggggaaagcccttggaataaaa

SEQ ID NO: 14892 - DNA, 581 bp, Zea mays
  Clone ID: LIB3279-221-Q6-N6-E4
caaagcttacacttacacacatcgaaccgaagagcacaagtttgcggaaccaaccaaccaactccacacacagatgaattgcgaacaactcacacacacaagctagccactaagcagtaaggaagcacacatcaggccgccagtaatcaccctaatcaaatcactacacactgccactaaagacatgtcgtgtatgctaccttctcctaaacccgatcgccagagccccgccaaacgaggatcatcagctacgacctgagcttgagggattccaggccatggatccctttcttcaggatcccatggagcggcaagccaccgctcctcgccttggacctcttcgccgcaccgtctcgcgcgcccgccgcgtcgtttcccgccacgcagacgcctttgcccttgccgtcgacgtgcgctctcgcgctgggcgcgcgcctgtcgaagctctcgaataggtcgggcgagtgccgcagcagctcgctcgccgacgagtatcccatcagccggtgaagcttgccgtctctgcccatccttccgtcgtcggcggtgttgaaggaagagttcctcgacacgtacagcgg

SEQ ID NO: 14893 - DNA, 579 bp, Zea mays
  Clone ID: LIB3279-221-Q6-N6-E5
cagagcagaaatcacttcagtattcataaattcacccaaacggcgacgaaattctcaccaaacaacataaagatgaggtgaattgtatcatcgaatcctcataaccgtgcaacaacataccacttttatttaaccaaggccatagagtgcccagataaagtactgaagttaacacggaatcaggaaaggaacaggcgaaacggttgcgaaaagagagacggaatggagctggatcctcaatgaagcttgtgcttgtagcgcgcaacctcggcgtcgttgggaaagaatcccattaggcgcccggcggagttctggtaggcgtacatgaaccctcccatgaccccgatgaggccgcccgtgaccatcgacgggccccggatccccggcttgatcccggagaggtagccaacggtgacggagacggcggagatggtggagaggcgcatgtagtcgagcgcagagaagttgccgaccaccttggtgaaggccgggttccgatccaccaccgggtactccggcttagtcgaggcggtgatgtcggtgttcatcgcgtggagcaagggagacggcagatccctc

SEQ ID NO: 14894 - DNA, 587 bp, Zea mays
  Clone ID: LIB3279-221-Q6-N6-E6
acgacaacaacttaagatgaaggttcaggcacacgacttgccgtgaaatttagagacagcttacaaccccatgcaggacgggaagtttgccacagagaaatcaaccatgcgcacaaagcattgcacggggtacacacatgaaatgacaacggttgttcacgattcagacatagcacgcagcaggcaggggaggataactttggtgagcgcaccagcacgggcatcagttgccaccgaacaggtagcccagggaagagccaccgccaggagcagcgtggaccttggttgaaggacggtccgtaaggaagttgccagtgttctgaccatcagccctgtggtagttattggtttggctggtaaccccagcagcaacctgcttggccgcatcagtctttgcagcagatggtttctcaacaggtggagcacttgcagctggtgccactgctggtttggggggctcaccgcttccaaagagataacccagagaactttgaccaccaccggcactaccaccacggctcatcttgattattgaaaagagaaacgagaggcagcggcgaggagatggagggcgaccggcggcgggg

SEQ ID NO: 14895 - DNA, 567 bp, Zea mays
  Clone ID: LIB3279-221-Q6-N6-E7
cacaaaccaggaataacttgaaggtaacaaattcttacacaagttttctagctcaaaagcataaacctgactgtatgataaatgagcaaatacagtttgttgtctcaaactaaaatataacagttacaaccgaatcgtgcggcccaaatttgatcagaatttctcagttcaggggggactgacttcctctaggtgaaccagggcgctcgtcatcttcgttgttgcccttggggcttgggctccgatcgtccctcgggctcgggctgcgcccattggccacagggctacggtagccatcagatgggctccgactcctcttgctgttctctccaccaccagggctgccttcatggtctgagccattgcgtgcaccattatccttcagtggtgggctcacctcagcccttgggctggggctcctactgccattgggtgtgcgactgcgctccttttcctttgcaggtgagacagaacgcctgggacttgcgctcctgctgtagctaagactccttgatctcctctcgtcacgttcacggcgtccacccctgggagatccagtggggatct

SEQ ID NO: 14896 - DNA, 439 bp, Zea mays
  Clone ID: LIB3279-221-Q6-N6-E8
gggagaatagacccgggtttaaaaagccaacgacgggattacacgattacggggggacaccccaatcagcacaaacatcaccaaaacctttattttagtcactcagggcaaatgcagcctactggtagcaggggactgaaaataaccatcccggcgtatgggttttgggaagggaacagaatccctttattcgaacttggcgcaatcgatgtcgggggggatgttgtaggacaaggaaaggccccaatcgccgggaaattcctggccccgggaaaggacaagggggacctgaacgtaggcccccttgagggaccggcacgtggcctgcctgtcgggcctggggtcccccccccggtacagggtcctaaacccggcccaaaactgggtggtggtctcgctggggttgggtgccttgccctgcaagaaggggaggcacggg

SEQ ID NO: 14897 - DNA, 568 bp, Zea mays
  Clone ID: LIB3279-221-Q6-N6-E9
aggaacgaaacttatttatttctgagaagttcaacacaggccgcagctattgcgaccacttcgtaagatcacttatctcacaaacaaccttcagagttcaggcacttgacacctcaccaaaccaaacctcgaacactaaccaatttaatccacctcctcgatcttgggaccagcaccgctcccaccagacggggcatcctcatccatgccagcagcagcgcccatgcccgcgccctcgccctggtacatcttcgcgatgatggggttgcagatcccctcaagctccttcatcttgtcttcgaactcctccacctcagccagctggttgctgtccagccagctgatggcgccgtcaacggcatcttcgatcttcttcttgtcctcagccgggagcttggaggcgatcttgtcatccttgatggtgttcctcatgttgtaggcataattctcgagcgcgttcttggcatccaccttcttcttgacctcctcgtcctctgccttgtacttctcagcctcctgcaccatcttctcgatctcctccttgctaagccggcccttgtcgttggtg

SEQ ID NO: 14898 - DNA, 587 bp, Zea mays
  Clone ID: LIB3279-221-Q6-N6-F1
aacgtctccatatgatattccatataagcacttccacgcctgcagtgtgctttacaagctcaaacggggaacagattcagacgcgcgtgacaaacgtcagcatactctgtttttgtacatttggttcctttcatccctacagtgttctttacaagctcaaattggtaaactagagagcaatacaacatcacaattcacacatgacgagttcacaaatctggttgcttttgacagcaagcaagataccggtttgaatctccatgcacgtctttggagaggcatgctggtggctacaattctcaaagtgctcaaaaacaacgatagtattgaagccatgttagcatgaaaaccaagtaacagcatcaaaacagcaacgctatcatgttagggaggatacaaaaggtaaggatcaacgactgctttgataataacattactaaaaacatatgaataaaagaccaaaaaatggaaatcatgcactaatgatgatcacattgatatggactaatggtgcagccttacagttccgaaacaagatgtatttgtcagcttactgtgattctgaagtatctttatgttgaatactt

SEQ ID NO: 14899 - DNA, 601 bp, Zea mays
  Clone ID: LIB3279-221-Q6-N6-F10
ggtcaggagcagcatcgacagcgccagctccttcttgtatatccggttgtgcttctccttcttcttcttcacggtggtggcggcggcggcggcgtccttcctcgacgccgccgccaggtgctcctccttggcgacggcgtcgaggttcggcgcggagcccgtcctcgtcgcgtgaagcttcacgggctccttgggcggggccagcgcgatgaggtcgccctccgacgagcggcccgacttcttggtcaccacccactcgtacgcgctccccagctggaacagcccggagatcatcgcgttgaacttggtcacggacatggtgttctcgaagagcaggtacgggatgatgaaggggaacgacttgggggacggcaggatgttcagcagggacatcagggccgggacgtagcacaccacccagtcggggagctcggcctccggcacgaacatcgtcatcgggaggatgatgcagaacagcgtgaaggagtagaaaggcagtatgagcttccggagcaggaagaaaaggaatatcaggttcgccttcttccaaaagcaatcttgcatttgatgatgtccggtaaacaaagcctgaatagctgca

SEQ ID NO: 14900 - DNA, 576 bp, Zea mays
  Clone ID: LIB3279-221-Q6-N6-F11
gccaacaaaatgcaagaacattacttatttctctggtggcaatacattagaaacaacatttgtgcaatatgctataacaatgagaagcgcatagtaaagaaattttccaaacacaaaataatctcccgtgccatggcttgcataagtccacggcaataacatctgctattggagcattcaagtggaccaacactcgcggtacaagcgttaaacaacttggtagttagcagtgagcaaacgagcccgctgagaaaacttgggagggttgccttccttcagaggaagaattccagtaaccttcagatcactgaaagtactcgatgcaaaaaatccaacggagatggggaaaaacgatgatgggtcagctgggggaacaacaaattccatggaaccactgcgattcgactgatcgataaggagaatagaccattccaacacagagtttcttgagtcgaacttccactctccatcgatctgtctaacactcggagcctcccgaagtgctggcagaggtatagatatgacaacgttgtgcagatcaaacatctcagaagcttcatattcaatgttcacata

SEQ ID NO: 14901 - DNA, 478 bp, Zea mays
  Clone ID: LIB3279-221-Q6-N6-F2
gggggaatataaacgggggatccccttcccatgggggggtaaaaaaaagaccggcaggggggggcgccctccagggaacgggactttggaggaccaacaaaaggggaaaccctgcctcaaatacagggggggacggggcccccccaaaaaggtcctagaactaaaacgggtttgaaaaaaaaaccactcccgccccccaggaattgaaacccctaaaaccactaggtcaggggaaccaccaaagggatatgggcgggaaccccgggggggaaatggcccgcaacaaggaaaccggggaggacccattcgaggcaaacaccctaattgattttgaactaaaaaaaggccttgggccccttggccttgaatttgggggagggaaccctgaacaccccgtttttaaaggcaaccttgaactggcccactttgaaagcctggggagaaaggcccatggggtatttgtacccccccgggccct

SEQ ID NO: 14902 - DNA, 589 bp, Zea mays
  Clone ID: LIB3279-221-Q6-N6-F3
atgataataacaccatatattcctgtgaatacgttatgcacactttaaataaaaccagacttcctggccatgtaaatatacaataacctgagaagatggaatttatatcctcaagaacattccatccagatacagcagatgctactgtatagaaatgacaggtaccaaaaacattagcagcctttcatcttttcctccaccaactcgatgcagcggtatagcaccagttgaacaagatttaacatgcacactatttgttttgtaatctcatcagcatccttttcattttccaactgaatttgctccgcgattggtcttaatggggtcagccactccgagtgcaccttgtgcaatgtctctttccgaaacaattttgcagatctttgtcctcttgaatctattatcagaataaatcttagcaagtttagagctgatattacctgttcactgtgatcaggaaggcaaggaggaccaccttctggaggcctcaaaatcagctcaactaactcaagtgcatgagatgcccagcgcggtaacccattacctcgaaatccttcgtcttcaatacaatcattgtcagcttggcgac

SEQ ID NO: 14903 - DNA, 343 bp, Zea mays
  Clone ID: LIB3279-221-Q6-N6-F4
ttctcccagccagaaaagacgctggtggtagctcacagcgatcttgtacttcgaacgtaattccaaacaaaagacagcctggctcatggcgtagttgctgagtctgacgggctcaaagccacaccactccatcagcgtctgccactccctactagccgccatcctatcagtcctctctgctccttcctctggcccaatggcccttctaatgcgctccccaaacatgcatcgctccaccctcaccctctccggtgagtcccgtggcatcgccacatcaagtgactcgaacactggcttgtaatacaacagtgcattggaaaaccggtcgacgaacccagcccgg

SEQ ID NO: 14904 - DNA, 587 bp, Zea mays
  unsure (1)..(587): unsure at all n locations; Clone ID: LIB3279-221-Q6-N6-F5
atattgatcctttcaagcaatacttagagcgccaggatacttatagtagtaccaccattctngaacatagtagcgccaggacgaaatataggatcgtccaaaaacatatccttaacaagagtttaattcaataaaacctcggtgccagaacctagcagacttcacaaaagagcatacttagaacaccctgtatggcttccccatggtgctcttgacgtagaggcatctcacattctgccagttcttcttcagaagggaaacaaggaagttcacgctcatctggatgttctgctggatctgcttctcctccatcgccaagttgccgacggcgacgcccatgcaaaggaccttcttgagctggaacttgacggttgccttagtctcgttcaccttggattcgagggattcctggtgagtaaccagggtcgggaacttgcctgccttgttgagaccaggaccaaggagacggggaatctgcttgatgatggcctctgatgccaagaaagcatggtacttcttggcaagcctcttaacaagcttcttgttcttgttcattttcttgagagcctcaacatccatgtagtcaa

SEQ ID NO: 14905 - DNA, 580 bp, Zea mays
  Clone ID: LIB3279-221-Q6-N6-F6
aagtatagtatagataaaaagttgatgatggtcagtaacatagtcgataactaacgtgatggtcagcagggctgagaaaccaacctcatggcgtccagctcatacaacatccagcctacagtcggctgctcatcatggtgatgacaagtgaacccgttacagtgacatcgtcacatacccccatcaacatggcaaatcctagatgatggaatctttatttctctaccgcctcttagggggtttcactaaagatcctcctgtcgcctggcttcctcctgtagatgtcgtgcgacctggtggtttcagagcagactcccttggttttggtttggagtttgcaggctgtccattctttgtgtggaatagcctggctatccttgatggggccttctgcatccgttctgctgtcgcctctgaagcaccacctactgaatactcggttcctgctactgagcagccatcatcagacatgttatcttcacattcggcttcacttgatccagtccctgatagtcgccggatctgttggcgactgtcatttctatctattgatgaacctggagatttggctttgttcttc

SEQ ID NO: 14906 - DNA, 571 bp, Zea mays
  Clone ID: LIB3279-221-Q6-N6-F7
cattactgcaaagaaagaacatcttgatctcgatttcccagcactgctgggacacatgattccacccaataacgaagcacatcagagatattttaatctgataactctctacatcaagccaagcaaggcagagggaactgaggaaacgccaccggcagccgctgcagacgagggaagagatgcgctcaaccaccgaacccgtacagagtgcggccctggcgcttgagggcgtacacaacatccatggcggtgacggtcttgcggcgagcgtgctcggtgtaggtgaccgcgtcgcggatgacattctcgaggaagatcttgagcacgccgcgggtttcctcgtagataagcccggagatacgcttcacgccgcccctcctcgccagcctccggattgccggcttcgtgataccctggatgttgtcgcggagaaccttacggtggcgtttcgcgccgcccttgcccagccccttgccgcccttgccgcgcccagacatcgccgccgagttggacgaagacagtggtgtgctacaagaagattgtgagatttgaactcgccgccggacgcgtg

SEQ ID NO: 14907 - DNA, 562 bp, Zea mays
  Clone ID: LIB3279-221-Q6-N6-F8
gtagaacagtagaaaccgatatgtattaaagccaaacagaaatagagcctacaaaacaacgaattggcttcaaaattactactgcccccaaggacgcagtagaagctaaccatgagtccataaccctcctgatggttcaggaaccagttcaagtagtccagctacccgattattcctaatctcctaatttctaaccaatacgtcttacattaccagtaacagctcatgacacagatacaggccgtcaaaacaaatactcgaaattctcagccatgttgtgcacaacggttcaaaactactccgtacaaagattctgcacgaacaggccctcacttctgctgaccagcctcaacgggctctgcctccaccacttgagcttcaagcggctcgtctgacctcacaggtgcgtcgtgctgtgggattgggtcggcaggttgcgcctgcgcctgtggctgtgaggaccatttgccagcgatggcagaggtcatcatctcgtaaatcttcccactgagctccgccgggttgtcaggcgaaagccacttgaaatatagcagtttcaaag

SEQ ID NO: 14908 - DNA, 513 bp, Zea mays
  Clone ID: LIB3279-221-Q6-N6-G10
aagcaaaaacaagccaccacaatacaggggcattttcagattacatgacaatcacaaacataagaggcagtccaattaaggttggaccgactaaacagggtcaaaatatagttggaaaggcgcaaagtaaacaagacaccatccccagcccaagcctttaaaaaagggtcgaggaggcccatcacactgaaggggcttcggcaaatcaaatgaaaagcttttaaagggagtccttgaaaccctgtatctgaagtttaagggggctaccctaattacggggcactgagcaagcaaaaaccggttttgtaacaccaaaagcacggccaaaagcttgtttcaagggaacaaacacatatggcacgtttttatcctcaactaacaaggggagggggagcaggatctcaaaaggctttgggtcccccgccataactacaaactccgatatgcccctattaaggggcttcggcgcttaattccctcccttctaaacctgtttgaagttggcggcctgct

SEQ ID NO: 14909 - DNA, 458 bp, Zea mays
  Clone ID: LIB3279-221-Q6-N6-G11
atcttgtctccgcaaaattagcttaaacaaagtgccacagaagcaacacatagcatctgtccataaagattaaggtaaccaactgccttagcattgtccttatcgtaagatagaaacctatctaggacccgatcaaactgccatttcaaggacacagttgggaccttacacctcaggaggtgccaagaccggagggcgcggctcgtcctcgtccttcggggtgtggatggtcaccaggtccggaagaggagtgatcgggccaaccttgcccttcgggtcccagtcaagcatgatcttcaccttgatgccaagaacaccctgtctgagaagaacgtgtctcacagccgagtcaatgtactcgttcactggctgaccagatgagatcatgtagccatccttgaacttcatggacttggctctttgggccctgagctttccactcacaatcacctcacaac

SEQ ID NO: 14910 - DNA, 581 bp, Zea mays
  Clone ID: LIB3279-221-Q6-N6-G2
gacagttcatatgctccctaactgctcgacattgtttccaaacatggttcaccacgatacaatgtgaaaatgaaacaaaatctcagcaatttgagtacttgacatttatacccgcagaacagaaacagctgataggtcagcactatccttttttcgtacccatttcaacatatttaggtcacccacgaatgaacttaggtaggtgcacatgactgcagtgcgtttgttttacaaactgggaacaaaactgcatgaattatcatacactcctctacttcttaaaagaaaactttcccttcttcctagcttttctcttgtctttcttgatcttcaaatgaagctgcaccttcttcttgctaatgctgccaagtggcctcaggaaggtcttagacctgctgttccctgcaccagacatctccacatccatagccgaggccgagctagctgcgcgggaggtgccggcatcctgggacggcgggggcccgcggaccgggagcggggcagcagctagggctgcggcctgcgcggcgagcttggcggcctccttcttgtcgtagaacggctccgctatctcccggcgc

SEQ ID NO: 14911 - DNA, 51 bp, Zea mays
  Clone ID: LIB3279-221-Q6-N6-G4
ggggggggggggggggggggggggggggggggggggggggggggggggggg

SEQ ID NO: 14912 - DNA, 587 bp, Zea mays
  Clone ID: LIB3279-221-Q6-N6-G5
atattgatcctttcaagcaatacttagagcgccaggatacttatagtagtaccaccattctgaaacatagtagcgccaggacgaaatataggatcgtccaaaaacatatccttaacaagagtttaattcaataaaacctcggtgccagaacctagcagacttcacaaaagagcatacttagaacaccctgtatggcttccccatggtgctcttgacgtagaggcatctcacattctgccagttcttcttcagaagggaaacaaggaagttcacgctcatctggatgttctgctggatctgcttctcctccatcgccaagttgccgacggcgacgcccatgcaaaggaccttcttgagctggaacttgacggttgccttagtctcgttcaccttggattcgagggattcctggtgagtaaccagggtcgggaacttgcctgccttgttgagaccaggaccaaggagacggggaatctgcttgatgatggcctctgatgccaagaaagcatggtacttcttggcaagcctcttaacaagcttcttgttcttgttcattttcttgagagcctcaacatccatgtagtcaa

SEQ ID NO: 14913 - DNA, 561 bp, Zea mays
  Clone ID: LIB3279-221-Q6-N6-G6
cgcaaaaccatgaaactgcattttagtcccttatttctcattctcctccatctccatctccatctccatctccatgggggggttcacccaacaatccgactaacgaccaaagcacacaggcgggcaggcaggggataaacaaccatcaagattggttttacagagcatcaaggttctactcaacacaaccgggggagccagaggggagacccctaatacaggtcgccctccttgggggtgtggatgacgcagtccgacttggggtaggcgacgcacgtcagcacgtagccctcctcctgctgcgcgtcgtccaggaacgacccgtccgactggtccaccgcgcccgcctcgatcttgcccgcgcaggtcgagcatgcccccgcccggcacgagtagggcagctccacccccgccgtttccgccgagtccaggatgtaggcgtcgtccggcgcctcaaactcgtgctcctccccttccggggtcaccagcttcaccttgtacgtggccgccgctgagacatccagcttcttctttgaggaggacctcaggctcggcagctgc

SEQ ID NO: 14914 - DNA, 444 bp, Zea mays
  Clone ID: LIB3279-221-Q6-N6-G7
gggcccccctgggggaaagggtttggcggctcaggggggaaaaaaaaacaaaaaattttttggggggggaacccacccccggggggaaaatgggccccccccaaccaattttttggaagggcccttaaggggcaaaaaaatttaaaaaaaaggggggagggggggccttagtggaaaaaaaccaggaccagttttggggacttaaaaaagggcccccctatggggggggggggggcaatttggaaaaacccttgggaaaaaaaaaaaaaccatttcacccccaaaaggttttttttttcaatttaagggccaacggcccccaaaaggaaggaaacaaaatccttcccccatgggggttaagggggggggggcccaacctaaaactaaaaaggtccattaaaaaaaatttttgggaggggtattggacccggggggccccccgga

SEQ ID NO: 14915 - DNA, 591 bp, Zea mays
  Clone ID: LIB3279-221-Q6-N6-G8
aaacaaaatttggaaaccctcaattaaatgggtgtacagtatacacaggtatgcagactgtttaggctgctacaactgtaatctataaagacaaaacaatgtagaaattggccgactttaatccaaagcgaacaccttaacgatcatgtgtctgttatcacctagctttctcctaactaatcctccaaattccggagaagaaatcactttgctatatatagaacgatagcaagagatgcattcttgttaagcttccaaaaattccttcgagttcagaaacatgagctcgaggcctagcgttaactgaaccagtttcaccatcccgttgcagatctgctgcagctcatccaacagaccagtcatcgggcatccttcgctctttcggtgaagaacaccagcgaccgctgcgacgcctttgaagggagcaacgccgtgcagcgggctcctatggaggttggccctgtctgttaggtcgctttgggcaagccccttgtaacatagtactgtggcgggcgtatttgttccggcccatctcatgtgctaccttggcatccatgggatgctgccctgtcctatactgcatatggtctt

SEQ ID NO: 14916 - DNA, 480 bp, Zea mays
  unsure (1)..(480): unsure at all n locations; Clone ID: LIB3279-221-Q6-N6-G9
tcgcngactaatccggggaaacccttgttcctggtcattccggctcgaatcttctgcggactggcaaggtaagcgttctccattggagggcgacgatctacggggcggttgttggcggggttgcgggaatggagcacgtgttcggagggaagtttaagcttgggaagaagatcgggagcggatctttcggcgagctctatctcggttagcgtctcgccgggttcttcactgaatctgtcacacgtctctgcagattcctacgcgccgctgttttggtttgaaaatcttgttattactcatgtaaaaatatagctcgggaccatgccagtgttttttaaagcaattacatgcagaacatcatctattttctgtcatcccataatctacacacaaattcttcacgaaaccgttgctagcaatggttgaccatgatatgtttgcatatggaacaaactcatgccgaatgcccagcatataact

SEQ ID NO: 14917 - DNA, 578 bp, Zea mays
  Clone ID: LIB3279-221-Q6-N6-H1
agattcaaaccttcatgcattagagaatcagaacaaggctggactacaatacaagaggtcctctagtcaccatgtcagaggatttagggcacccaaatatattttacaacctggagggggcatgcataacacttacagcattgtgccaactcttattctctacaacctatgaaaaaattatacaacgttcctctgcagctcaagacctcagattacagaggcacaactcgctcttcctatcctctactccctaggagatgtcacagtcgtcttctacctacttgaatcccatagctacgactgggattctgacgaggtgaccgcggtcacctttcatggcaatctcaccgaaactgtaggtgccggtcacggacctcgccgtcagggtcacagttatctctcgtgatgctccggggaccacggtcaccgccggaggcgtcacctccagggcgacctctggcggcatccttgtcatgatggtgtaggtctcggtttcgtcggacacgctcgtgacggtccgcttcactaccaccgtgcctcgaagctgagagacggcgatcgaggggatgttgaggtcg

SEQ ID NO: 14918 - DNA, 578 bp, Zea mays
  Clone ID: LIB3279-221-Q6-N6-H10
attcaatcctctatgcctggggagatcgaattatatcgtacaataattgtctggctgcctccgtgcaacgattagctgacaagttgcattcgcagatcaggctaatccgtacggagcacagatgaccggtacagttttggcagcattcgaccaatgtggggcacaaggctaccttgtcccaaatgtccaaaaacttcagtctcaccctaggcatcgggtgacgcaattacatacaccaaacccatggttcagatgacggatccaccgtaattcggcacaaaaaaggggtacataagcaccattattgatacgtccagaggtaaacattattagcaagctcaagctaaaagttgggggcaggcaaaacagtctctgctcctgcgcaaaagctactagcttacatagcacagttgagcaaaaaaaaagtatgttcgtcttcagcgtaacatcttaagcggacttcacggtggccgcgttgatgatgtcgatgaactcaggcttcaaagaagctccaccgacaagaaacccatcgacatcaggctgtgctgctagctctttgcagttcgcggcagttacag

SEQ ID NO: 14919 - DNA, 453 bp, Zea mays
  Clone ID: LIB3279-221-Q6-N6-H11
aacctcacaagggttcaagccctactggtgcaaaaaagttttggggcccacacaaagggcccaacggggcccttaaaccaacgaagccccaaccccgattcatgacccacaaaccacaggtgtttattaaaccacgaccacccaaatccccaggtacagcagcagcttaaaagaaccatgggttactgacccccacgggggcggagccccagggggagagggccccccttctggagggtggaatctgctagggggcaaccatcccccaactgtttgccaaaaaaaaacaaacccttctggtctggggggaacccctctttgccccggaactttgccctcaccttggcaaggggggcggagccttaaacccccaggggtatgggcttcccagacaagggcttcacaaaaatatgcataccacctcccaagcggaacaccagggggagggggccc

SEQ ID NO: 14920 - DNA, 503 bp, Zea mays
  unsure (1)..(503): unsure at all n locations; Clone ID: LIB3279-221-Q6-N6-H12
ctctanacgcccccttggtggtgttttttttaaaatttttttttttttttttttttttaataaactnctttttttccccaacttatcatcttccggcgtacactgagaaacctgttttttctttttttttttggngngaacaaacattttttgttagacanggggtctttcttnaacncanaantctacaattcaaaaacctcggttaaaccccnaacatttcanagggtttttttctgctactgttaattcgactatagcttgcaatacattttttagcaaaggcaaacttttacccacatctgcttgcccccccgtttcacttaactttttatcagagacttccttatttcctccacaatcgcacggggtttcccttttctcagttttaagaccctttctcttacttaaatctctttctctttcgtgttctacccacaaaaggctatcctatttttacactatcattcctatatcgtttccctttcttccttttttaccaa

SEQ ID NO: 14921 - DNA, 539 bp, Zea mays
  unsure (1)..(539): unsure at all n locations; Clone ID: LIB3279-221-Q6-N6-H2
gtatatattcattcattggcctcaaaaagaaatacaacaccctggtcaagtttccagagagcctatccagacaaaaacttggtgcccatttcagagcagccacaggcgaatgctggcctcaagacaccactcttcattccttcctcgctatctatctacttacaagccagctctgtttgaatataacatctttcctcatgctacgaccatgccctgatgaagattcaccttgctgggatcgatagcacctgtagcaaacaaccgagtcatttgggtacatagcaaatagcttggtgccgaggcgagctcgacaggagtcgnagatactctcatcggttagctgcacatgccttgatctttcctccagtcttgtcaaccgcacgtccaggtttgtcgcacgcgatagattatggactatctgtccttgacgatgatggtgcactcgggcccttagtgtccgtaaaattgtgtttgatgccagctggagaggcatattaagagataatttttccaatacttgtatgggggtccaacgattc

SEQ ID NO: 14922 - DNA, 562 bp, Zea mays
  Clone ID: LIB3279-221-Q6-N6-H3
cagaaagcaatgcaacagacattgcacccaaatgtgcgttataccgtagcattccacagacattcaagtccccctatatatcgaaaccatcactctagcaaatccccaaacagaagttaaaaggtacccagctatgcctgggtagcattttttatgttgcagcaaaaaggatacattccccgcttaagaggtcgattcagcttcctatttcccagctcggcgacagcaaaaccagagatcactcccacgctttaagggcaccacccctcccaattgccttgatgatagtctgcttactgttgcgcgcactgcactctttgggctccgcccggcatctcgtcgtcctcctcgtacgcctcctgggcagcgtgagcttgcttcctgcgcatctcttcctcgatgttgttcacatcatgcatagtcgtctcctcgcattcatctatctccatgtctgtcagcttggatgaaggccttggtggaagtactgtctcgagagctttgcactgctctggtgccagcgagtcagggaactccaccggtgaaatggagtacagcttcccct

SEQ ID NO: 14923 - DNA, 498 bp, Zea mays
  Clone ID: LIB3279-221-Q6-N6-H5
gggggctaacaacaagggtcatacccgttaacaatccaaaaacgggtccctacaagcaaagaaatgaaaatctgccttaagggggggggatctaaccccaccattttcaaacaatatttgggggccaccaccaccaggccgttcaaaatttgagttttgggggctaaccccaccattttcaaacaattgacccacccaatggtgcatcggagtttcaacatggggatcttttggtacccctagggtaggaggggtcctctgaaaaattgggcaaagaaaattcacaagttattttcacatatgaccaactgactaatatttatatataagctttgttcaattaactagttaataggaaaatttactaaggcatgggcttatatggtcttggtaaaatattctttaggccgaggaagctaaatgattttgggaaacatttgttgcggatggggtttcaatcaaaaaaggttctaattctctggctaagggagttagggg

SEQ ID NO: 14924 - DNA, 558 bp, Zea mays
  Clone ID: LIB3279-221-Q6-N6-H6
agtaccgtaccaaaagcaaggttccatagcacaagaaaaatcatacgtcaacagcgacggaatgggccacgagggtgggtaccctagcagtagaaagaggcaacaacacgaaagggaacaccgaactcatcgaggtccgcttgccctagggaccacaaggcttcacacgataacagccctcccctcacatgtcatcggcctgcacctcctcctcgtcctcgtactcctcctcgtcggcagtcgcgtcctggtactgctggtactccgacacgaggtcgttcatgttgctctcggcctcggtgaactccatttcgtccatgccctcgcccgtgtaccagtgcaagaaagccttcctcctgaacatggcagtgaactgctcgctcaccctccggaacatttcctggatggaggtcgagttgccgatgaaggtggacgccatggacaggcccctgggcgggatgtcgcacacgctggacttgacgttgttggggatccactccacgaagtaggacgagttcttgttctggacgttgatcatctgctcgtcaacctccttgg

SEQ ID NO: 14925 - DNA, 597 bp, Zea mays
  Clone ID: LIB3279-221-Q6-N6-H7
aacatcatcctcgccatctagagctcgtcgtgctgcttctcatcatcagaatccttgctatcctcggcatcagagtcggccttgtcctcgtctgccttctcatcgtcttcctcatcctctaggtcatcatcctcatcatccccacccttggcggcatcctcttcttccttctttttctcggcctcatcaaaagcagccttttctgcctccttgtgcttgccccaagtctcctctgcaaaagtcttggccaacgcagggtcatcagtgatgatgatgttgtcaaacagagtgcccgatttaacctgccacagctcaatgccaatgtacttcaagctgtcgaaggcgtaaatgtatggatcatccttaaaatctgggttgtcaatcataggtgccttccatttaccctggtagttcgggttcttgattttcttttgtttccatggtcccttgtattctgggttgggaatggtaggggcagtccattcaccatcttcctcatcgtcccagtcctcaggcttcttagcatcagggtcaggaatttccttgggaatatcatcatagccctctggcttcttgtcctcagggtcaggaatgtac

SEQ ID NO: 14926 - DNA, 583 bp, Zea mays
  Clone ID: LIB3279-221-Q6-N6-H9
atcagggaaaatgcatgtatccctttcacacagttacaacatgggttacaatttacaagtgctcgattcattctcattcaagcaaattccaatcacccaatccctggcctgagggatgacaatactttccaactgtcagagtgtatatggatctttctttcttttttaccctttttatattaatagcgaaggaaatgggaagagaagagaacagagaggacgtacaggtacacagtaggacggcggcggcggcggcggtggtgccagccgagctcgctcgttgtcgtcgtagccgtagcccgtaggtcaaagcttgacgacctccgggacgtcgacggggtagcggtggatgcagtcgtcccagggcccgttggtgggggtcttgatgctgcggaggcacttccagacggcgctgttgcacttgaacccgctgccgaagccgatctgccagacgcggtcgccgcggcgcatgcggcccttggcctccatgtaggcgagctcgtaccagagggagctgctggacgtgttgccgaagcggtgcagcgtcatgcgggacgcctccacgtggcgcggcgacagctgc

SEQ ID NO: 14927 - DNA, 620 bp, Zea mays
  Clone ID: LIB3279-222-Q6-K6-A1
agtcgctctaaaccctagagctctcgcctgctcgcctccgccgccggagcgagctccccatcttcatccgtcaaccatggcgacccagatcagcaagaagaagaagttcgtcagcgacggtgttttctacgccgagctcaacgagatgctgacgcgggagctggcggaggacggctactctggcgtggaggtgcgcgtcacgccgatgcgcacggagatcatcatccgcgccacgcgcacgcagaacgtgctcggcgagaagggccgtaggatcagggagctcacctccgtcgtccagaagaggttcaacttccctgagaatggcgtagagctttacgccgagaaggtcgtcaaccgtggcctctgtgccatcgcgcaggccgagtccctccgttacaagctcctcggaggccttgccgtccgcagggcttgctatggtgttcttcgttatgttatggagagtggtgccaagggttgtgaggtgattgtgagtggaaagctcagggcccaaagagccaagtccatgaagttcaaggatggctacatgatctcatctggtcagccagtgaacgagtacattgactcggctgtgagacacgttcttctcagacagggtgttc

SEQ ID NO: 14928 - DNA, 598 bp, Zea mays
  unsure (1)..(598): unsure at all n locations; Clone ID: LIB3279-222-Q6-K6-A10
ggtctgatcccccactacccccagcgtcgggaggaaccttccagaagcgcaagactctaaaggccgtcgccttcccattcttcctcgccgcgggggtcgcctgagatcacataaacaatggtgaaggctgttgctgtgcttggtagcagcgatggtgtcaagggcccatctttgtacgcaagagggagatggccctaccgctgtcaccggaagtgtctctggcctcaagcctggcctccatgggttccatgtacatgcacttggtgacaccaccaatggatgcatgtcaactggaccacactacaatcctgcgagcaaggagcatggggcaccagaagatgagaaccgccatgctggtgatcttggaaacgtgacagctggagcagatggtgttgctaatatcaatgtcaccgacagccagatcccactgactgggccaaactcaatcattggcagagctgttgttgttcacgctgatcctgatgatcttggaaagggtgggcacgagctcagcaagagcactggaaacgccggtggccgtgttgcttgtggaatcattggactccagngctgaaaacgatcgccngacttgggggtg

SEQ ID NO: 14929 - DNA, 452 bp, Zea mays
  Clone ID: LIB3279-222-Q6-K6-A11
cccacgcgtccggtcaggttcacgggggagtgagggacgaggagaagatgaacatctgcagggggctcagctacgagaagctatcgccggaatgctgcaagcacatgttgcggaacggcgagttcccgaccacggcggcggtgcaagcgctggcatcgcagcacacggtgttgaagagcatgttgctgcgcgaaccgggccaactgaagtccgtgtcgccatcccctaccgcttccacgggaaagcgccgcgacggctatgacgacgacaatggcggcggcgagaacgacgggcaggtgatcctgtacgcgagacggctggacctgtcggtggagaaccagaacctgcggtcgctccttgacgggatgcactggcgggtggtggagctggagaaggtgtgcagccggatgaagacgcggatgagcaagatgaagcaggccaggagaggcggc

SEQ ID NO: 14930 - DNA, 457 bp, Zea mays
  Clone ID: LIB3279-222-Q6-K6-A2
ctcgcatgccggttggttcatggagatctatcttggccatagggaagcccgaaacattgacacacagagtatgcgaatctgaacctgagcaatgaataagcacctggccaatagagttatgggcatgggtttgccatgcagatacatatgctaaaagacttgccttttagaagtctgtcctggaggtctcctttctaatttatgggaccatatacattacttgaatgtgctgtgtgtgtacttccaaagacagcatacactggttcatgaatagtacagttgagaccattctgtaattccatttctgctcccccttatgaagtttatgagtgcaatactgaaaatcataaactgattcttaaaaggcagaaaagaatggagtattcacaaaataagattgattattatgtgctatgacatgactgttgcgcggagcataaagggcgagaagggttga

SEQ ID NO: 14931 - DNA, 636 bp, Zea mays
  unsure (1)..(636): unsure at all n locations; Clone ID: LIB3279-222-Q6-K6-A3
attgtggtgaactgcggtctgggcgcggaggcagggaactccaaggggctggatgccgccatgaaggacctggccatgatcaccgggcagtggcccgtcaagaccaaggccaggaagtccgtggccagcttcaagatccgtgagggaaacaccatcggtatcgcagtcaccctccgcggcaggataatgtacaacttcctggataggctcatcaaccttgggctccctaggaccatggacttcctgggtgtcaaccccaacagcttcgacgggcacggcaactacagccttggcctccgtgaccagggcgtgttcccggagatcccgtacgaggtgggcgggaagaagaacggcatggacgtgtccatcgtcaccagcgccaagacggacaacgaggcgttcaggttgctggtcctcctcggcatgccgttctcggagaacatcaagaccgacgtggtgatccggaagaagaggttgaagcgccaccacttcctgagcaagggcaaggggaagggaggacgacggtgaggagaggaaccagccagccagcccatggttgcacacgctctgctcagcttgttttaattccgatctttttgcagaatttggcttacaaattcnatgctgttgatgact

SEQ ID NO: 14932 - DNA, 568 bp, Zea mays
  Clone ID: LIB3279-222-Q6-K6-A4
cactggtatccttctgacttgttcaccagagccaaaattgagtcaatcttggattggcatcactcaaatttgcggcgtggtgcagcaacccttgtaatgcacactgcattggctcccttccttggtcttacgacaagtcatgaggctgtgaaacaagcagagaagcttgtgatgcagtcactgggggtgatcgaatccgtatggctgaaaggcgatgccaagttcttgctaggtagcccccagccatcgattgcagatctgagccttgtctgtgagataatgcagttggagatccttggcgatgaggtccgtgaccgattcctgggagctcatgagaggatccttgtctggatggacaaggtgaagaaagccacgagccctcattttgaggaagcccacgagctccttttccaagtgaagaaggcacgcatggtgcaaggcagcagcagcaaggcttttgagtcgagcacaaagctcaaaacagcatcaaagctctgacgaccaaaggcagaataagcgacagacagatccatcttgtgatataatataataaacgggaactattatt

SEQ ID NO: 14933 - DNA, 590 bp, Zea mays
  Clone ID: LIB3279-222-Q6-K6-A5
gttgacgaagcaactgtgcgaagtcttaatggttgcagagtggcggatcagattcttcggcttgttccaaatgttgagaatttccggacaacacttagatgcttgaagtactgggcaaagagaaggggtgtttattctaacattactggtttccttgggggtgtgaactgggctctgctggttgctcgtgtatgccaactctatcctaatgctgtgccaagtatgctggtttctaggttcttcagagtttttacccagtggcaatggccaaatccagtgatgctatgtgcgattgagaataatgatcttggtttttctatatgggatccacgcaaaaatccacgtgacagaaaccatctcatgcccatcatcactccagcctacccatgcatgaactctagttacaatgtttcaaccagcacactgagggttataatggagcaatttcaatttggcaacaaagtttgtcaggaaattgaacttaataaggccaattggaatgccttatttgagcctttccatttttttgaggcatacagaaagtttctagtggttgacatagttgcagaggatgacgatgatcttcgtct

SEQ ID NO: 14934 - DNA, 181 bp, Zea mays
  Clone ID: LIB3279-222-Q6-K6-A6
agttggaatgcgaatccagacgttttggtttagcctatcttattttgctttgtgcaacatgaattttaagtgtatggggtattacagtgccttgtgtgaacctgcttatctcgtgctgaacatcgttatgcatggaagtacttatcttttgttctgctaaaaattaaagtgttctgcgact

SEQ ID NO: 14935 - DNA, 396 bp, Zea mays
  Clone ID: LIB3279-222-Q6-K6-A7
gcagccgcttccaccgcatgctcaagctgggcctgagcatcgacgaggacgaggaggctccggaggctgacaccgacatgccccctctggaggatgacgctggcgagagcaagatggaggaggtcgactaagctgggtttattcttatggaggaaagagagagaacatcgggtctgttctgtgggtcttaccacttatgctattatgcaatctgttgttggtatgctagtgctactattgtctctgctgtcttctagttaattttgttgttgttttgcgtggtcagtttctcatcgcatcagtggtagaaaacattcacctgtgggactaaaaaaatgtttgactgggaattggaacgcatcgccaagttcttctgttcttggttctattatatgt

SEQ ID NO: 14936 - DNA, 577 bp, Zea mays
  Clone ID: LIB3279-222-Q6-K6-A8
gtccatccagtcacccacccaccgcgagcgcgagagcacctagcgagcgaagcaaggctttcgtcgtggagcgagccgtgagcgagagggcgatggaggcggtgggagaggagaagggagcgaccgcggtggaggaggggaagatgatgaaggagcagggagagaaggcagtggcggcgtgggaggcagagggtgggaagatggtggaggggcagggagacaaggcagtggcgacctcggaggcggaggatgtgaagattgtggatgggaagggagagaaggcagtggcgacctcggaggcggaggatgtgaagatggtggaggggaagggagagaaggcagtggcgaccacggaggctgagatagggacttcggaaccgaaggatgtggccggcgggaggcttatcaccttgaagagctcggacggcaaggttcatcgcgcgtcggtggcggcggcacagctgtcggtgattctcagcggcatgatagaggaagtcgtcaccgacgacgaagtcgtcatagtccctttagtcgacgggcccaccctggtcacggtgctggagtactgcaccaagca

SEQ ID NO: 14937 - DNA, 292 bp, Zea mays
  Clone ID: LIB3279-222-Q6-K6-A9
cgtgtttcacgctatctttggatagagggttttgtgtcaactctcatgtttcacgcttcctttggacagattttgatttgaacttacctctagatgagtttggcgcggttgtagagaaccaccgacgaaaagagatgacaaaagatatgaggaaacaagtgtaccaagcgttgttggctagaagcggtaacgggagactccacaagaaagatacccaaattgttgccaaccaatttgatctccaccttcggtcagtgcagcgcgtatggaacagaggtaaaatacaacttgc

SEQ ID NO: 14938 - DNA, 660 bp, Zea mays
  Clone ID: LIB3279-222-Q6-K6-B1
cccacgcgtccgcccacgcgtccgcccacgcgtccgcaaaggacttgctgatgatgtcgaagttcctatgctttcaaaactacgccggcaactggttggtaaaggttctcaccgccgtttagtctattctgtggattttggtgcccatgaaggtgctatggttaatttccttgatcactacgatgcccatctggtgatatttgaaaaacttcctgatggagtgtttgccgacccatttgagctacagcattttgttgagcgcaaagttttcgttgatgttgctgtttttggagacgccaaccttgaactgcccacagctctatccaatgggtcatctgttgagatccattttgatctcaggcgaatcatttcaaacaactgtaaccttgtaatagagatgcctctccatgctagatacccgcctcttgatgccagtggctatgccacagtggagtttggtagcccagatctattcctccgctacagaaaaaaggacatgcattctggttcctgtccttgggtgatcaataatctcaaagctgcacccctggagaaagctgcatggcgcataccctgtggagacgaggcccacataggatttgtatctagcatcacgtttctttcagctcttgtttgctccatgtccattgtcttggcttc

SEQ ID NO: 14939 - DNA, 630 bp, Zea mays
  unsure (1)..(630): unsure at all n locations; Clone ID: LIB3279-222-Q6-K6-B10
ctggaaaccctagccgccatatctcgggatccgggggagcaccaagccgagggaaggtgaggagcgatggcgcgcggcgtggtgtcggcgaagggcggcgcggtcgcgggcaagaagaaggggtcggtttccttcacgatcgactgaccaagccagtggaggacaagatcatggaggtgggctcgntcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacattgctgagaacgagggcgaggaagaagattagattgcactacgcttatattttagtattgaactcgttgcattttgatacctgtacccgtagtttcgcaaatgtcccatgttatggtgtggtatggttaatttgaagatccttatgtactgaatctctgcaaaagctatgttgtgacagaagtgtacgtgccgatttctgcatt

SEQ ID NO: 14940 - DNA, 144 bp, Zea mays
  Clone ID: LIB3279-222-Q6-K6-B2
ctctctctctttccttcagtgccttctgcctgtgttgagagtcccaagaagcactgagaattttgttgcatctacccttgagagtgaggggagctaggagctctctgggcgccattggccttttcttgctcgctctctcatcat

SEQ ID NO: 14941 - DNA, 596 bp, Zea mays
  Clone ID: LIB3279-222-Q6-K6-B3
aaacccctcatcctattctcgcgcccggcgtctcccttctccaacctccgtttctaatccgcgctgctaatcccactcccagtcccagctcgtccgctgagatggacagtagcagcctcaaatccgcgcagctcctggagctgatgcgccagcacctggccaccgacgccggcaaggagctcaccaagaaggttggcctcgtctaccagctcaacatcgcccccaagaagatcggcgttgatgaggagatcttcgtggtcgacctcaagaagggcgaggtcaccaaagggccgtaccagggaaagccggatgccactttctccttcacggacaacgatttccttggaatcgccaccggcaagacgaatccacagattgcattcatccgaggggcgattaaaatcaaggggagcatcagtgcggcgcagaagttcacccctgacatcttccccaagcctgccaagctgtagaaggttagattgtattacttggtcgaggtgaataataatgtttgcaagcttcaattactatgtacgagatacaatgagtggaacatgaaaagcacgttctccgtgggaatttggatatggttgaac

SEQ ID NO: 14942 - DNA, 426 bp, Zea mays
  Clone ID: LIB3279-222-Q6-K6-B4
tgagaagctggtcggcgctcctagatcccttcgcctctctcgcgttcgaggctaggtagccgccaccatgagccgctcggggcagcctccggatctcaagaagtacatggacaagaagcttcagattaagctgaatgcaaaccgtgttgttattggcacacttcggggattcgaccagttcatgaatctggtgatcgacaacactgtggaggtcaatggaaatgacaagacagatattggaatggtggttatcaggggaaacagtgttgtcatgatcgaggcactggagccagttgccaagtcgcagtgaatccttatttttcagctgatatagtcgcagcatgaaaactgatgtaaatgctatgagtgaaccctgttgtacttcggactcgtgcttttgcacagcaacataactcggctaccagc

SEQ ID NO: 14943 - DNA, 149 bp, Zea mays
  Clone ID: LIB3279-222-Q6-K6-B5
ctctgacgcgtgcgtagctctgtgcaaggagatgcacctgaaggtggttgatctctggcatgccatgcagaagagggaggactggaagactgcgtgcttcacggatgggctgcatctgtctgaagaaagggagcacattgtggtggaag

SEQ ID NO: 14944 - DNA, 612 bp, Zea mays
  Clone ID: LIB3279-222-Q6-K6-B6
ccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactaaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctt

SEQ ID NO: 14945 - DNA, 661 bp, Zea mays
  unsure (1)..(661): unsure at all n locations; Clone ID: LIB3279-222-Q6-K6-B7
cgcacactcgcagagccgccagccacctcccctctccatcttctccccatggcacccctcctctccctggctggacgcgggcatcacctttttcctccctctctcttccccatcccctccacgcggccatctggctgtggctcggcagccggcccggtgccctcgcccgcatgcacggcgtccatgctggtcgtcgaggtccctgcgtacaagcagcagaaccgtcgcaacctactccatattcagcgacttcaccttgattgcaatctgttcctgagcttcgaggaaatgacgatcgagatttggtgaaccactggtcccgagatcgagctcttcgagttctacaaagttgaagatcctgagcatctgtttggtgaaggttgcctttggtgcaatctatgctcaggtaaagaaaaaggtgtcgaggcggatctccaggagttccaggacttcgacgagttcaaggactaggctagcgacctcccccagtcagctgcctgtggtgggttgtttacgttggctacgtttcgattctgtgtactttgatttatattatgtaaatggctctagtctgtaatattattccttactctntattgtaatttgaagcattgtgctatgatgagtcatttatgtaatcgctgtgtacgtgaattactga

SEQ ID NO: 14946 - DNA, 86 bp, Zea mays
  unsure (1)..(86): unsure at all n locations; Clone ID: LIB3279-222-Q6-K6-B8
tcgcacccaccgtcttcgccgncgacacagcgtagtgtagtgtagttccggagagggttggggagagtagtantgatccgcaatgt

SEQ ID NO: 14947 - DNA, 606 bp, Zea mays
  Clone ID: LIB3279-222-Q6-K6-B9
cgatgacagcagtttgggcccgggggatgaatgtgagtctgacccccgcatgccaggcgaggatgagttcgaccatttctaccgtgttctcgccaagaagactgacaacctgctcagctgctacattccaatgccgcttgcactttctgaagaggagaaggccgtgcagaaggagttcagggtgatcgcgagcggatgcatcgacctcctggttggtgcgatgcgccgcacccccgcagagaaaaggcgcccactggtcttggtgtttggtgagctgtacccggtatttgagtttgtgaggtggactgccgaggcggggtgtgccaagtggtggatggcgctgcagatcatcgagaagctggagatcgtgcgcaagatggtgtcgagcgctttcggcggcgcccctgttgacagaagcatggtgttcgccaggaaggtggacctcaccggtgtcgacggcgaggcgctcgccggccacgggctctggagcaacttatcagtggtgatcttcgtgctgatggacagcgtcttcagcaacgtcaagtcggacatcgatgccatgggctctgctgcttccactccttattagccatcgtcacctagcta

SEQ ID NO: 14948 - DNA, 647 bp, Zea mays
  Clone ID: LIB3279-222-Q6-K6-C1
gccctccaaacacttgcgccgccactgcctcacaggtaaggccgccatggtctccggttcgggcgtgtgcgcgaagcgcatcgtggtggacgcgcgccaccacatgctgggccgtctctcctcgatcatagccaaggagctgctcaatgggcagaaggtggtcgtcgtccgctgcgaggagatctgcatgtcgggcggcctcgtccgtcagaagatgaagtacctccgcttcctccgcaagcggatgaacaccaagccgtcccacgggcccatccacttccgcgcccccgccaagatcctgtggcgcaccatccgcgggatgattccgcacaagaccaagaggggggaggcggctctggcgaggctcaagacgtacgagggcgtcccgccgccgtacgacaagaccaagcgtatggtcatccctgacgctcttaaggttctgaggctacagcctggacacaagtactgcctcctcggcgagctctctaaggaggtcgggtggaactaccatgacaccatcagggaacttgaggagaagaggaaggagaaggccaaggttgcctacgagaggaagaagcaattggccaagctgcgtgtcaaggccgagaaggcagccgaggagaagttggggtctcagttggagattc

SEQ ID NO: 14949 - DNA, 637 bp, Zea mays
  unsure (1)..(637): unsure at all n locations; Clone ID: LIB3279-222-Q6-K6-C10
gcctgccttcctgcctcggcctcctggctcgtgcgtccctactccgccgcctcaaacccggccccctcgcgcgcgtgcgcggcgctcgaggcgacgaatccagccacctcctccgcacccatccccgccgccggtcgccgatgagctcggaaggctgggacgctgacccgaattttagtaggagaggatgccagagctgcgaagcaatactcgtcaagcacgcttaaggtctaagaagcttgacgatctgcagccaggagagccgcttgcgaaaccggtgtcacctgctctgccgagcgcacggaagcgtgctcctacacgtgctgctaggggcagaaagggtgctgctgggagaggagtgcctcccgcaccaaagcctagaagaaagggggttgatattgtcgtcttagaagctgatcctgcttgtgaaaccccacttaaagctntcaagggactggaagttgctgctgctgcgcccaagaaccttnctttgaagcaggtagccgaagttggtgttccgaaaatgaatggtgaaagtggggagaagattgttggggctgaagatgaatcgacagctacacctgtncccagaagggttcaagtaggtaattctccagagtacataactgacaggaag

SEQ ID NO: 14950 - DNA, 624 bp, Zea mays
  Clone ID: LIB3279-222-Q6-K6-C11
gcaagctgttcgtaaggcaccaacaacgtgccgtggttttcggatccagtgcaacaaatgggctatcatagtgaggctgctgcttggtgagattccagagaggactgttttcatgcagaaaggaatgaagaaagctctgacaccttattttgagctcacaaatgctgtcagggttggatgctttgaactgttcaggactgtcgctgacaaatttgcaagcacattcagcgcagacaggactcgcaacttgattgtgaggctgcgccacaatgtcattcgaactggactgcgcaacatcagcatttcttactcaaggatctcccttgctgacattgctaagaagctaagactggactctgagaaccctgttgctgatgcagagagcattgtagccaaggccataagagatggcgcaattgacgccaccatagatcatgcaaatggctggatggtatcgaaggaaaccggtgatgtctactctacaaatgagccacaaattgcattcaactccaggattgcgttctgcctcaacatgcacaatgaggcggtcaaggcgatgagattcccccctaattctcataaggaaaaggagagcgccgagaagcgccgagagaggcttcaaca

SEQ ID NO: 14951 - DNA, 159 bp, Zea mays
  Clone ID: LIB3279-222-Q6-K6-C2
cggacgcgtgggcggacgcgtggggatgtttagcagtaccttgttaccagtatgcggtgatgcgtaggctgcagatgggacgaatgtgcttgtatgtgtatgtgtcctgctgcaagttgtcctttgctatttagaatggaagaagaaatgccttgtttc

SEQ ID NO: 14952 - DNA, 632 bp, Zea mays
  Clone ID: LIB3279-222-Q6-K6-C6
atctcctctatagcctcacaacaatgccaccaccatccaagccacaatagctcgcccccagctaagctcgtagccataagctgtcatgcccatctcgtcgaagttcgactccctccccaactctagcgacaactctagtgagaaatttctctccttccgtttatcttccggggctacctagaacatcgttgtgatcggctcggcgagagcttcgtcgccgcgctttcgatttgccgatctgttctccagttcatcgtcaaaaaccgagatgtccaacaacagcgtgggatcaaagggcttgattggaaggagtagaggcgagttgacgaggaatctgaagcctaacttttgggtcaacatctggactacaaggttatcgcaagtgtaaggggggcttcggcttcgggatgaaggttttctctcgtgacagggtgaagatgtagcccgaaggtaataagaatggacgacgaagctatagccgaagagtttcagcttaatgtgatgacgaagaccaagtatgatgatgaccgaaaagagacaaagactattcagtccttaatgattcttgttatgcttatagatgaatgtcaacggcataaatgtacttttactcgggctatgccccgtaccta

SEQ ID NO: 14953 - DNA, 319 bp, Zea mays
  Clone ID: LIB3279-222-Q6-K6-C7
gcgagagcaagatggaggaggtcgactaagctgggtttattcttatggaggaaagagagagaacatcgggtctgttctgtgggtcttaccacttatgctattatgcaatctgttgttggtatgctagtgctactattgtctctgctgtcttctagttaattttgttgttgttttgcgtgggcagtttctcatcgcatcagtggtagaaaacattcacctgtgggactaaaaaaatgtttgactgggaattggaacgcatcgccaagttcttctgttcttggttctattatatgtaaaggtgatttgctttgagaactta

SEQ ID NO: 14954 - DNA, 631 bp, Zea mays
  unsure (1)..(631): unsure at all n locations; Clone ID: LIB3279-222-Q6-K6-C8
agggtgactaccacaggtaccttgctgagttcaagtctggtgcagagaggaaggatgctgcggagagcaccatgaatgcctacaaagctgctcaggacattgctcttgcagatctggctccaacccaccccatcaggcttggccttgctctcaacttctcagtgttctactacgagatcctgaactcccctgatcgcgcctgcaaccttgcaaaacaggccttcgatgaggcgatctctgagctagacagcctgggagaggagtcctacaaggacagcactctgatcatgcagctcctgcgcgacaacttgaccctatggacttccgacaccaacgaggatggcggcgacgagatcaaggatgctgctgccccgaaagaatctgcggagggtcagtaagatggattcagtctcacgacctgctgctgctgatgttgaggagtgaccagaaccagaaccgtcgtcctcgattctgatagattatcttctagtataccttgtgttgtcgttgtcgtcggcgcgacgatcgtcgtcgtcgtcgcgccggtgtatgcgatgaagctgccattgctgctgttttaattaagcattctagatgttataccgcatgctntgtttcggtttctatgtcg

SEQ ID NO: 14955 - DNA, 486 bp, Zea mays
  Clone ID: LIB3279-222-Q6-K6-C9
gtgcgatctttgcactttttgtatgcgtgtatgatggcagcgcttcttttgtgtaaccgcctcaacagatctgatcatctgaagtgccatttccctctgatttttttgtttaatattttgttctcgttgcagtgaagtacctttttcctctggattcacgacttagctgacatcttctagagattgcgtaagattccagatgtacaggtggtgacttgtgttgaacgatttgaccaagagatgtttacttcagttgtggctacccaatacaaaaaggtcggcaaaataaactatcactgagagcataagagggtttgtctttgtaatccttgtgatggtgacgtagctcgtaggtgattgaaatgtatcattcccagagctgagatgtactcactccgttccaaattaaaattcgtttttctttttattagatttatacaataatgtatgtgttatatatatatatatatattcataattatctaa

SEQ ID NO: 14956 - DNA, 648 bp, Zea mays
  unsure (1)..(648): unsure at all n locations; Clone ID: LIB3279-222-Q6-K6-D1
gagatccggagcagccgcagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgctcaccaaagttatcctcccctgcctgctgcgtgctatgtctgaatcgtgaacaaccgttgtcatttcatgtgtgtaccccgtgcaatgctttgtgcgcatggttgatttctctgtggcaaacttcccgtcctgcatggggttgtaagctgtctctaaatttcacggcaagtcgtgtgcctgaaccttcatcttaagttgttgtcgtatcccttcgtctaaaaaaaaanaaaaagggcg

SEQ ID NO: 14957 - DNA, 282 bp, Zea mays
  unsure (1)..(282): unsure at all n locations; Clone ID: LIB3279-222-Q6-K6-D10
tataatatcttctatatttggatgtttgatgtgttttctaaatacaaggatgatcatctggttggcggggcgacgtcnatcttcttattccatgagctagttatgtctantnaacaacttcatgnacattatacacattctnncnaanngtctctctcnangacaacanntctcaaaaccctcacncatnangtnatngncattctnatcnacatnaccaaacaaatnaccctcatttnttnnnccanacctctattntccctantanntctantacaccat

SEQ ID NO: 14958 - DNA, 642 bp, Zea mays
  unsure (1)..(642): unsure at all n locations; Clone ID: LIB3279-222-Q6-K6-D11
cctcgacatgcacccaaatcgacgagtgcttcgcggctctccgatctcgacgcgcaccgatgcgggcgatgtcgtcggcggttaatggtatgctgcgggcacggctgcgcggggcagcgcgcgttcgcggcggcggcggcgagggggccgggcggtggacgaccccaggtcacgagtatgtccgcaaggggtacctcttcaaccggccgccgccgcctccgggggaatctcgcaagtgggaggattgggagctgccctgctacgtgacctccttcctcaccgtcgtcatcctcggcgtcggcctcaacgcgaagcccgaccttacaatcgagacgtgggcgcaccagaaggcgctcgagcgcctccagcagcaggagctcgccgctgccgacacccaggccgagtgatccgcgcgtctcaggtcctctcgaactctcggctgcctctgatttggttccaataagatggccacaatgtgcggtcctgaatgttctggacttctggtattgatggaacacgagctgaacactatgctgctgttttttctgttctgttttgaaatttgcccggtgatgatggcgaatgtcctgaatattctgaatattntgaaatgtttgactgttgtattatcatcttatccta

SEQ ID NO: 14959 - DNA, 642 bp, Zea mays
  Clone ID: LIB3279-222-Q6-K6-D2
gttctagatcgctcgcgatctagaacgcgagcggccgctcgcgatctagaactgctgactcaaggtgaactaacacgtcgagcatgggcgaaagatgtgcaggtgatgaatgaaggcccgggtcacatcccaatgcataaaattcctgaaaacatggagaaacagttggagtggtgtaatgaagcgcctttctatacattgggtcctttgacaactgatattgcacctggttatgatcacatcacttcagccattggtgctgccaacattggagctcttggcactgcacttctttgctatgtaacaccaaaggagcaccttgggttgcccaatcgtgatgatgtcaagactggtgtaatatcctacaaaatttctgctcatgctgctgatttggcgaagggtcatccctatgcacaagcttgggatgatgcacttagcaaggcaaggtttgagtttagatggcttgaccaatttgctttatctctggatccagtaactgctatggctttccatgatgaaacattgccctctgagggtgccaaagtggcacatttctgctcaatgtgtgggcccaagttttgttcaatgaaaatcacggaggatatcaggaagtatgctgatgaaaatggttatggaacagta

SEQ ID NO: 14960 - DNA, 665 bp, Zea mays
  unsure (1)..(665): unsure at all n locations; Clone ID: LIB3279-222-Q6-K6-D3
gcctgcggtccggtgccggactcccgggtcgcccagcgtccgacccgtcgcatcccatcccactaccacatctcgtcgtccgccgattnatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaagaagttgagaagttggctgccgctttgccagaaggtggagttctgctcctagagaatgttagattctacaaggaggaagagaagaacgaacctgagtttgctaagaagctagcatctgttgctgacctttatgtcaatgatgcttttggcacggnacacagagctcatgcttcaaccgaaggagttaccaagtatttgaagcctgctgttgccggctttctcatgcagaaggaacttgactacct

SEQ ID NO: 14961 - DNA, 629 bp, Zea mays
  Clone ID: LIB3279-222-Q6-K6-D6
gcaagggactgccctagcgccgacggcggaggcggctatggcggaggcggctacgggggcggcggctacggaggaggaggaggaggcggtggctgcttcaagtgcggcgagcctggccacatggccagggactgctccagcggcggcggcggctacggcggtggcggcggcggtggtggtggcggctgctacaactgcggccaggccggccacatggccagggactgcccaagcggtggcggcggtggcggagggaggttcggcggcggcgggggtggaggcgaccgctcctgctacaactgcggcgaggccggccacatcgcccgcgactgtcccacgtgaggtgtgtccgcgtccgtccagccagccagatcggatcggatcgctccaccacctgctggtctgatggcgccgcccccttctagatctcgcttaaaaaaacatccccctctcgctgtgtgtcggagtaccgctttagttttgccgatccgggcacgagtgcccgctgcctctttcgtaagaggatcccgtccgccgttttcagatttcgttcggttcgtagaagaactctcaagttaagttaagttatcatggtgtgtgcttggtcgtcgtccgtcgttcgtcgtcgt

SEQ ID NO: 14962 - DNA, 649 bp, Zea mays
  Clone ID: LIB3279-222-Q6-K6-D7
gtgccagttcatacaaagattgttgatccaagaactggtgaggaaaagaagatcgtagtctctgcagatgatggaatccgagtggatacttctcttgcagtcctgtcaaaactcaaaccagcattttcaaaggatggcagcactactgctgggaatgcaagccaagtgagcgatggcgctggggccgtcttgctaatgagacgggatgttgctatgaagaagggtcttccagttcttggtgtctttaggacctttgccgctgttggagttgatccagctgtcatgggtattggtcctgccgttgcaatccctgcagcagtgaaagctgctggccttcagatggatgatattgatcttttcgaaatcaacgaggcttttgcatctcagtatgtctactgctgcaagaagttggaacttgatcctgctaaagtcaatgttaatggcggtgcaatggctcttggacatcctttgggtgctacaggtgcacggtgcgtcagtactcttctcaatgagatgaagcgccgcggcaaggattgccggttcggagtgatttctatgtgcataggttctgggatgggtgccgctgctgtgttcgagcggggagacggcgttgatgagctcaccaatgctcggggaatctcgacccaca

SEQ ID NO: 14963 - DNA, 641 bp, Zea mays
  Clone ID: LIB3279-222-Q6-K6-D8
ctggaaacttcaagaatgatgagggtgttgacttgctaaaagataagcaagctctccagcgattgacagaagcggctgagaaggcaaagatggagctgtcatctttgacccaaacaaacataagcttgccttttattacagctactgcggatggccccaagcatattgagactactcttaccagggctaaatttgaagagctatgctcagatctccttgacaggttgaggacccctgtggacaatgcccttagagatgcgaagttgcagttcaaagatattgatgaggttattcttgttggtggctcaactagaataccagccgttcaggaacttgtcaagaaaatgacaggaaaggaccccaatgtgacagtcaaccctgatgaggttgttgcacttggagcagctgtgcaggctggggttttgtctggtgatgttagcgacattgtccttcttgatgtgaccccattgtcccttggtttggagacactgggtggtgttatgaccaagattatcccacggaatacaaccttgcctacctcaaagtcggaagttttctcaacagctgctgatggccagactagtgtggagatcaatgttctccaaggagaaagggagttcgtgagagacaacaagtctctt

SEQ ID NO: 14964 - DNA, 631 bp, Zea mays
  Clone ID: LIB3279-222-Q6-K6-D9
gggttttgctgctctccgaccccgagctccgaaggccgcagcatcaggcgaggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggatctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtaccttgcaaggaagctggctggtgatccgaaccttcactttgttgaagctgttgctcttag

SEQ ID NO: 14965 - DNA, 578 bp, Zea mays
  Clone ID: LIB3279-222-Q6-K6-E1
cggacgcgtgggtgcatggcagttttgctgcagctctgagggaccaaaaggtctgggtcatgaatatcgtgccgatcgattcaccagacacgctgcccatcatctacgagcgcggtttgtttggcatgtaccatgactggtgcgagtctttcagcacttacccaagaacgtatgaccttctgcacgcggaccacctgttctcaaagctcagaaagagatgcaaactggctgcagttttcgccgaggtcgaccgtgtactgaggccacagggcaagctgatcgtgagggacaccgcggacacgataaatgagctggagagcatggccaagtccgtgcagtgggaggtgcggatgacctacaccaagggcagcgagggcctgctctgcgtcgagaagtcgatgtggcggcccaaagaactcgacgctagcacgtgaactgtgttgaggagaactgctaccaagtagggggtgaaattagaggaattttgtcttctagatatgcgtatggctcttgttggtgctgaaaggaccagaaaatatttggtgtaactgtagtagaacaatacatctgttttctgc

SEQ ID NO: 14966 - DNA, 601 bp, Zea mays
  unsure (1)..(601): unsure at all n locations; Clone ID: LIB3279-222-Q6-K6-E10
agcacccttacttggtgctgcgtgtagggggggatgcagatcttcgtgaagactctgaccggcaagactatcacccttgaggtcgagtcttctgataccattgataatgtcaaggccaagatccaggacaaggagggcatccctccggaccagcagcggctcatttttgccggcaagcgggtggaggacgggcgcacgctggccgactacaacattcagaaggagagcaccctccacttggtgctgcgtctcaggggtggcatgcagatcttcgtgaagacacttactggcaagacgatcacccttgaggtggagtcctcagacaccattgacaacgtcaaggccaagatccaggacaaggagggcattccaccggaccagcagcggctgatcttcgccggcaagcagctggaggatggtcgcaccttggctgactacaacatccagaaggagagcaccctccacctggtgctccgcctcaggggtggtatgcagatttttgtgaagacattgactggcaagaccatcaccttggangtggagtcgtctgacacaatcgataatgtcaaagccaagatccaggacaaggaggggcattcac

SEQ ID NO: 14967 - DNA, 625 bp, Zea mays
  unsure (1)..(625): unsure at all n locations; Clone ID: LIB3279-222-Q6-K6-E11
cccacgcttccgaggattcgttagcgcgagtgcggttggcatggcctgtgggccagcgctagctggtttacttcaatggaaattcaagatctacatggttactttcaatcaatcgactctacctggttgggtgatggcagttgcgtggctattgtatttgatttggctatgggtctgattgaaagaaccgaaccgtgctactgaggtgaatgaagccccacaaaatcctgcttctggacaaacggttgatattggacaagtagagaacggacttgcacagcctctgctcatggattccgtagataaacaaaatgaagatgaagatgaagaagttgatgaaagtgaagaagctgcagatgattcacgcaagcctgcaacatcaattggctcagcatacagactgcttactccatcagtaaaggtccagttgttgatatacttcatgctgaaatacgcaatggagattttgctttcagagtctagtgttatcactaatcactatttcagttggaacacaagcgcagtggcaatttttctagcaatccttgggttgacggtgctttctgttaatgctgttgttggaacatacatcnagcatatgtttgaggacaggcaactgctcatg

SEQ ID NO: 14968 - DNA, 624 bp, Zea mays
  Clone ID: LIB3279-222-Q6-K6-E2
cccacgcgtccggaacatagtattccatttgttcaccatcggaccccttttagtagtaggagttatttggattcgtgacgtgcaacaaaccaggctatatttaggactcctagttagttgctggtagttaacctctacgtgctaggtataatttgcaagggtgtcgctatggtactctcaaataactgtggaccatcctttttaaatattatcctatttccagacaggcagcatgcagggagtaccctatttccaatctaaccatccttgtccccggcccctctgttcagaacgtctgaatttgctaagaattcgagtattaaaaaaatccagagcaactccttcaacaaaattttattcaaacgttctttcacatgagccctagtccccagatggtctcgtgcctctcgcctcgccagcctgctgcactcgccgtctgaaaacgaacaaccagagtggcactcgaattgaatgcccaactaattccaaagacagcattcattaccgatagatagatgcagttgcatatccttttcagatctttgaatgcatgtcatactgccatcacacaggttttattgtcaaaaacatatacgagtagtatatacttggttaacagttaac

SEQ ID NO: 14969 - DNA, 634 bp, Zea mays
  Clone ID: LIB3279-222-Q6-K6-E3
cccacgcgtccgggatcatcagggagaggaaggccgccgaggaaggcaaggacctgctcagcgtgctgctggccaggatgcgggagcagcagccgctagcggagggcgacgacactaggttcaacgagactgacatcaaggcacttctcctgaacctcttcacggctgggacggacacgacatccagcacggtggagtgggcgctggccgagctgatccggcatccggacgtgctcaggaaggcccagcaggagctcgacgccgtcgtcggccgcgaccgcctcgtctccgagtcggacctcccgcgcctcacgtacctcacggcggtgatcaaggagacgttccgtctgcacccgtccacgccgctgtcgctgccccgcgtcgccgccgaggagtgcgaggtggacgggttccgcatccccgccggcaccacgctgctggtgaacgtgtgggcgatcgcccgagacccggaggcgtggcccgagcctctcgagttccggcccgcccgcttcctcccgggcggctcgcacgcgggagtcgatgtcaaagggagcgacttcgagctcatcccgttcggcgccggccggagaatctgcgcgggcctcagctggggtctgcggatggtcacgctcat

SEQ ID NO: 14970 - DNA, 597 bp, Zea mays
  unsure (1)..(597): unsure at all n locations; Clone ID: LIB3279-222-Q6-K6-E4
ggctgcctcccgcagccgcccgctgctccggtccttccgaacgctggcctgttcttccctgcctttggcccattcgtcaggcggcccctccgcaggcgacgcaggcgcgggcacgacggcgcgtggccccgactacgtagacagctaaccggtctccgcctccggcccttctcctgtcgcccgattgagtcgctgctgcaactgccaacttcacccccggcgagctcaccacagtcttccggaaaggtgctatcaatttggaagatggcagatgaggagcaggccccaagctctaggaaaagggttgcaggtactcaaatcaacaaggataatccggaacctgatgatgaaggaacagaacaagagatgggtacatttaagaaagctactgaagaagttatggcaacacggaggattgtaaaggttcggcgccagcagacgtcatcagcttcttctaaccctttctctgcaatcagatntgcccccactgattctagtgctcaaacaagtgctcctgtcccagaggtccaaccttcagatgtcaaagttgacgagggaagcaatggtagcgggaaagatactttgtctctgcccgac

SEQ ID NO: 14971 - DNA, 623 bp, Zea mays
  Clone ID: LIB3279-222-Q6-K6-E5
gcaggaccagctagctagctcctcccactgctatcacccgggccccggccagccatctcgctgaaagagaaaagcgcagccatgaagactactagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaatccatacgacgggatggtgatgttcagtgccctgctagcagtaggctgcatctgcactgagtgactagaataaaggatttggtgatgtttgtgctgattggtgtgttcgcctgtaatcgtgtgatgccgtcgttggcttcttatatccgtgtctaatc

SEQ ID NO: 14972 - DNA, 636 bp, Zea mays
  Clone ID: LIB3279-222-Q6-K6-E6
cccacgcttccgtggtgggcgtggtggtggaagcgggggtggaggaggctacaatcgaagtggtggcagtgaccgtggttttgatgaccaccgtggtggcagaggtggcagctatgggggacgagatcaggagaaccaaaggggtagtgaaggtggctacagtgctggtggctatgggcaagctcctccacaagctcctccttcgtatggtggtcctgcgggtgattatgcagcacctccgagctcctatggaggcaacaatgcttatggttcagattctgcagtgccgcctcctaatagctacagtggtggcccaggctcatacccaccaagctatggtgccccgcctccacaccaatatggtggtgccccaggggggcaagggggtctgcctcctacatatgatggtggatatggtggtcggtccatgcctgggggtggaggatctgggggtgcaccaccgccttatcatggtggcggcagcggttatactggtagtgctgaccctgaaccagctggaaaagttaagcagtgcgatgaaaattgtgacgagacatgtgacaacgcaaggatttacatctcagatttgcctcctgatgtcactgttgaggaattacaagagctatttggaggaat

SEQ ID NO: 14973 - DNA, 604 bp, Zea mays
  unsure (1)..(604): unsure at all n locations; Clone ID: LIB3279-222-Q6-K6-E7
cccacgcgtccgcgtgacttcccctcggcttcgggcctctccactccatcgtcaaggaaggaacacggccctaactaaaccctagctaagggaagggaaacaagaccatggatgcctccaagctccgcgagcttcgcgacttcgtcgaggcgtgcaagaagaatccttcgctcctcgccgggggcaacctctccttcttccgggattacctccagagtttgggtgccaaaattcccgccgccgccccctctttcgaaagtcccaagagatcttccatggacgacattgatgacgacggtgatgacgacgacgatttggatatgagggatcccactcctgagcgagacgagctcgatgaagagattgttgagtctgatcttgagctcgaaggagaaattgtacagtctgaccatgatgacccaccacagaagatgggaaatccttcagtggaggtgactgaggaaaaccgtgatgcttcccaagaagcaaaaggcaaggctatggaagcaatttctgaaggaaaacttgaagatgctattgaacaccttaccaacgcaatagtgctgaatccactctcagncatcatgtatggtactagagcatc

SEQ ID NO: 14974 - DNA, 625 bp, Zea mays
  Clone ID: LIB3279-222-Q6-K6-E8
cccacgcgtccggcgccagccgccacgccagcgcctgccatggctcctctcctcctcctccccctccccctccgacccatccccgccgagaactccatttcccggctcgcaccgaggccaaggttccctcgtcccttctccaggcggcgcctacgccttcccgccctcctccaagtccaagggctcgcggccaccggccccgccgcgcccgcgccgcggtggcacgcggcactgtccgccgcggcggggctgtacccggcctacgtcgcagccggcgcctccgtggccttcacgcggcccgaggcgttccggtggttcgtggcgctggcgccggggtcctacaccgctacgctcggctttatcatgctcgccatgggcctcacgctccagctcagtgacttcgccgccctcctccgcgacaggcccctcgccattttgttcgggtgtgccgcccagtacaccataatgcctgtgtttggcgctatcattagccacgcgctggggcttcccccgtcgctctcagctggcctcatcctgctgggatgctgtcctggaggaactgcatccaatgtggtgactttagttgctcaaggtgacgttccattatccgtcgtgatgactgtct

SEQ ID NO: 14975 - DNA, 634 bp, Zea mays
  Clone ID: LIB3279-222-Q6-K6-E9
cttgtcagtcgcccgagccccaagggtggcacccacgccagcggcaccgcacccccacccacctcggcggcgagtccgagccccaggaacgaagggcgatggcggcgatgatgatggccacgtccgagtcaaagtcccccgcccgcgcgctgaggcggctggctggcgccgcggtcgcgggcgtgctgctccgccgcaccttcagcgcctccaagtgcaagacggaggcgcggatggcgacggcgcggatgaagctgctgcggaaccggagggaggcgcaggtgcgccagatgcgccgcgacattgccgcgctcctccgcgacaaacaggaggataccgcacgcatcagggttgaacatgtaattagggaacagaactttatggcagccaacgagatcattgagctcttctgcgagctgattgttacacgccttcctatcatcgcaaaacagaaggaatgtccagcagacttgaaagaaggtatctgcagtttgatatttgcagctccaaggtgctctgagctccctgaacttggtcgcatacgtgacatttttgaaaagaagtatggcaaagattttgtttctgctgcagttgacttgcgcccagatgctgctgttaacaaccttctgattga

SEQ ID NO: 14976 - DNA, 640 bp, Zea mays
  Clone ID: LIB3279-222-Q6-K6-F1
gtccccagacatggcgccctgcgcgtccccgtccgccctcgcgctctccgccagcacgcgggtcagcatcctccggctcccgctggcgctgcggcagcgggcggaggcgcgcgtgcccggcgcccagttccgcccgtcgaccgcgtgctcctgggcgcgccccttgctgcccgagctcgcgggggcggtccctcgtgccggcgcccgcggcactggcaggaggacgcagccgctgttccggcctcgcgcattgacgacgacgtctcagattgccagctgcgccttcaccctgggcacggtcgccgtcctccccttctacaccctcatggtcgtcgcccccaacgccgacatcaccaaacgcaccgtggagagcggcgctccctacgtcgccctgggcctcctctacgcctacctgctctacctgtcctggacccccgacaccctgcgcgccatgttcgctagcaagtactggctccctgagttggcgggcatcgtgaggatgttcgcgagcgagatgaccgtcgcctccgcgtggatccacctcctagcagtcgacctcttcgcggcaagcaggtgtaccacgacggcctcaggaacaacgtcgagaccaggcactctgtctcgctgtgcctgctcttct

SEQ ID NO: 14977 - DNA, 640 bp, Zea mays
  unsure (1)..(640): unsure at all n locations; Clone ID: LIB3279-222-Q6-K6-F10
cggcgcttgggcggaggatttgggtgtgggagaggcttgccttgtcacttcctaaagcagcggaaggggagaggccagggtgcagcagcaggacccccaacggcaacctccgccacgcaccacggagcaaccaagcagcaggtaaggcaaggtaagtgacgagacaaagagtggtcgggaggagatgccgcaggcatggtggttcgacagccacaacctcgcgaggccgtcgccatggctgaacagcacgctctcagagctggatgacaagaccaagcaaatgctgaagctgatcgaccaagacgcggactcgttcgcccagcgcgccgaaatgtactacaagaagcggccggtgctggtggacatgctcggcgacctgtaccgcacgcaccgctcgctggcggagcagtacgacctgctgaagcacggcagcggcgcgcggcacacggtgttcggcctgtcctcctgcacacagagccggtcgtcgacgaacggcaggaccactcctcgctccttctgctcggcctctacgtacgactcggagtccgaagtggacgaccccgggcaggaagaatacgaggcagagcagctggcgcgtgcggngatggccaagacngagcagcagcaagaacagcgtgag

SEQ ID NO: 14978 - DNA, 645 bp, Zea mays
  unsure (1)..(645): unsure at all n locations; Clone ID: LIB3279-222-Q6-K6-F11
gctggcttctccccccctcttaccggtgctcgtcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgagtccagattgcataccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctaccgcggcggtcgcggcggcggcggctatggtggcgggcgccgtgacggcggttatggcggcggtggcggctaccgcggtcggcgcgagggtggtggcggcngctaccgaggcggtggcggctaccgcggtcggcgcgagggtggtggtggcggctaccgcggcngcggcngcggctggagggactgatgtgtgggcccatccttgcttcngccgagttatcttatctatctatagtatcgtgttaccgttcgcttctgcaccgtgttagtgtccgttctacctttgataa

SEQ ID NO: 14979 - DNA, 640 bp, Zea mays
  Clone ID: LIB3279-222-Q6-K6-F2
gttattcagaattctggatccgctatgtgcaatgtatggaggataaagggagtctagacctagcaaacaatgccctggctcgtgctactcatgtgtttgtcaagaagcagccggagatccatctgtttagtgctcgctttaaggagcttaatggggatatttctggagcacgtgcagagtatcagcatctttactcagatttatgtcctggctttctagaggccatcgtgaagcattctaatatggaacaccgactgggagataaagaattatcttgttcagtttatgaaaaggccatcgctgctgagaagggaaaggaacagagccagctcttgccgacgttgcttattcagtactcccgtttcttatttttggccatccgagatttggagaaggcaagagaaatattaactgtgctgcatgagcagttaaatgtaacaaaaacagtgcttgaggctgtcattcatctagagtcaatttttccatgcgaaaagcgtattgattttttagactcacttgtggagaagtttgttacacctgaatcatctcagggagaggtggcaagtctagttgacaaagaggaaatatcttccatatttttagagtttttggatctctttggggatgcaaagtcaatcaa

SEQ ID NO: 14980 - DNA, 596 bp, Zea mays
  Clone ID: LIB3279-222-Q6-K6-F3
aagcaattgaacgagcaagaggctcaggcggtgcacgaacaatggctgctctggcataaatgctcaagggagcaagtgtctccttgtagaaataggactgtgtctcatagaatctgtagtcaccaaggtgcaaaagcttcgccccatctgcatgctcaatctgcacgttcttgcctcgcaaatcatggtaccacacattactttcactgtcctgcagtatgatcttctccctgtggatgaagcatggctgaggaacataccgagatagagatggtgactggatgctatatttcaggaaccacttgtcactttcaagagcccaaatgtcagtcctgcctgaaagctctgcgttgtttcggcgccacctcggtgcatggctttggtatggcatagtcactacgcacactttgtcatctatctcagtcatatagtaagcaactttgatggtggcacaagaggctgtctctttcacctccaatgctggaagatgaatcaaggcaaacatttcttccctgagatcaaacgatacaactgccatgccacagcttgttcctttatcttctgttagccaatacatcactccatccacatttact

SEQ ID NO: 14981 - DNA, 509 bp, Zea mays
  Clone ID: LIB3279-222-Q6-K6-F4
gcaaaatgggattgacctgagcactgttgatgtcagctatgttagtagccggtcatggtatttcctcaatttattcggcttgaggggtcttttcagtctgatccttggtgaagaaaacgcaactgatgatgcacagaagatgatgcaaatgggtggtggatttggatttaacccaacaatgagtttgggagcagagaaagacagcctggatatcatgcagcatgactgggctctacctaagatggagcggcacgcagaagatgtgttgaaacagttgctgaagaaatgactcgaacggttgggcttctgggaagcaacactcgcgtcgcgtcttccagtttttgttgaagccagtttggaccaggaattttaccatttctaaatgtattatttataactagctactataacacccttagaaggtggagacccggtgttgtgatacttaatataagtagaaaaaacgtaattctgttactttattctcctgatatttatgagcatcgttt

SEQ ID NO: 14982 - DNA, 644 bp, Zea mays
  Clone ID: LIB3279-222-Q6-K6-F5
cgcgattcgtctccccagcagctttggcgctgggggtcgaccgtggaattgctgcgactccgctatcaaggacgcctccctgccggcgtggcgctgcaacgacgtggtggacaagtgctccgccgactgccaggactgcgaggcgtcgccggccggcgacggcttcgtctgcggtgacgtggtcttaagcctgaccgagcccccggtctgcacaccgaggccgtgggactgctgcgacagcgtggcctgcacaagggactacatccccaactgcatgtgcctggacaaggtggagtcgtgctcgagcaactgcgaacggtgcgagtttctgtatcattcggaccctcctcgcttccaatgccgagacatcttccacggctatcctggtcccaagtgcaggacatggatcagtacgagcaactagctcagctcagctacttgctaaaagtagcgtagcgcagcgcgcgcggctacttgctagtatacgtacgtccacaaataaaaataaaagtggctagcgtacaaagctaacatctggttgttcgtcccgacatggacgattagcctagctcgatcgctagctgctgccactctcgttcgatttaatttcatccccatgtgtggcggtgtagggagtgtggata

SEQ ID NO: 14983 - DNA, 632 bp, Zea mays
  Clone ID: LIB3279-222-Q6-K6-F6
agcctcgattcaagagagctgctgagctatgcgtggggcttggaagcaacatggatatgcatgagccatcaaatcaagggcttaagaggtctagcctctctgatccacttagtactgttgctccaggagctgagaagtctcttcaaaagggacagtcaagtgcagtgttgtattcacaggagggaaatggttttgagcacatcatgacagagacaaagcttgctgcaggtgatgcttcagacaatatacgtggtggtgatttgccttcacaagtgaatgggggcaacaccaagctgaaaatagaagagcacacttctggtaacaagaggcagaagctagaggatgacacagatatttctcagcctcaatcacagtcaccgccaccgccacccccattccctcatcctgacgcattcgaaccaccaccaccaccaccaccacctgaggttcctccatcaccagagcctagcccaccaccaccgccaacttcaccgccacccaatatgatccccccgccgccgccggcaatgccaccccaaatgatctcacatgtaccacctccagctggtacatttgtaccttttcctgctggaccacctggtccaatgtattccagctacccaccttttact

SEQ ID NO: 14984 - DNA, 642 bp, Zea mays
  Clone ID: LIB3279-222-Q6-K6-F7
tatgttgctaaccttggggactcccgggctgggggggggagacttgtcaagggaactggggaggttttggcaatgcagctctcagcagaacacaatgcatcctatgaggaggttagacgagagctgcaggcatcacatcctgatgatccccatattgtggtcctaaaacacaatgttggtgttgtgaagggtattatccagataacaaggtcaattggagatgtgtatctgaagaaaccagaatttaatagagaacctttgcacagcaagtttcgtcttcagcaaacttttaggagaccacttcttagttctgatccagcaattactgtccaccaaatacagccaactgataagttcatcatttttgcatctgatggactctgggaacatcttagtaatcaggaagtggttgacatggtccaaagtagcccgcgtaatggaatcgcacgaaagttagtaaagtctgcagtgcaggaagcagcgaagaagagggagatgcggtattcagacctcaagaaagttgatcggggggtgaggcggcacttccacgacgatataactgtcattgtggtatttttcgattcaaacgccatgacaactgctgcctggagcagaccctcggtctctctccgagggggtggg

SEQ ID NO: 14985 - DNA, 647 bp, Zea mays
  unsure (1)..(647): unsure at all n locations; Clone ID: LIB3279-222-Q6-K6-F8
cccacgcgtccgcccacgcgtccgcggaggccgggggtgctgcgcgtcgttggaaccaaggattggattagcctcgccgaggaggaggtggtggtcggcgaggggctcgcggggatggggatctcgaggccccttgtgatggcgatggcggtggcgctgctgatcgccgtcgccggtgcggggggcgaggagcaggagcccctgctggcggcggacgcggtggccggcgcggtggaggcggcgctcggggaggtggagaccgcggcgctcagggccgagctggggcaactccgggcgaagatctcggcgctagagtcagacatagaagagcgatctcaagaactgaagaataaggatgatgccatcatgaacctggagaaagccattgaagagaagtcaaaggctattacctctatgctggacgagattgcttccctccaggcaaaagggtctgtagctgccgaggagcaggctaacaaggccaatgccaaggttgttgagcttgagaagcaggttgacaagataaaaaaggatattgaagcacaaagtagccagaaagcagcactagagtatagggccaacgatgcagagaagaaagtggaagtactgaatgaaaagcttaaatacatccanaaggaaagtgatga

SEQ ID NO: 14986 - DNA, 601 bp, Zea mays
  Clone ID: LIB3279-222-Q6-K6-F9
tccctcataactttcaagaaacacagtggacaaggggatccatggtgcagacactggcgagtaggcctggcgctccggaagaacaacgctctggggctcggcagaggggctgcacatcctgggggtccgacatatgatgttggggttctggaacggcgatcccaaacgcaccctgctgggacgagggcgtccccaccaagtgctctaccacgcatcatcaaggacatcttcttcggagaagaaggaggacatcttcggcttgctcaagacctatacaggggctcttccactagcccacctcaacagttacaacatgaatattgacaagttgaaagcaaacggaatcatctctgttatctgtgtctatttgaatgatccgtatgtgctggatgagatgggcaaaaaagctagacgcttacgatacaagacactatctatggtgactttgttggcagtttccacataagcttggattaggagatagacctttctgctgctttgcatttccgccgactctcacaggttgtccatctttgctggaccaggacagatcaagtctttaaatgtaccggaagcacctgacgactttaaggcttctggt

SEQ ID NO: 14987 - DNA, 653 bp, Zea mays
  unsure (1)..(653): unsure at all n locations; Clone ID: LIB3279-222-Q6-K6-G1
cgcgaatccagagccccacgccccgtccgaaccccagagcagagcaaagcctcctcgacctccctgtccccagccttccccgatggcccgcacgaagcagacggcgcgcaagtcgacgggcggcaaggcgccgcggaagcagctggcgacgaaggcggcgcgcaagtcggcgccggcgacgggcggcgtgaagaagccgcaccgcttccgcccgggcaccgtcgcgctgcgcgagatccgcaagtaccagaagagcacggagctgctgatccgcaagctcccgttccagcgcctggtccgcgagatcgcgcaggacttcaagacggacctccgcttccagtcctccgccgtcgccgcgctgcaggaggccgccgaggcctacctggtgggcctcttcgaggacaccaacctctgtgccatccacgccaagcgcgtcaccatcatgcccaaggacatccagctcgcgcgccgcatccgcggcgagcgcgcctaggcggttcggttgcggcgcctgctcgctactgctggaggtgcttagtttagcccgtcatggttgtgttataggtgtgcgttgttttcaagagtaggcttcttgctatgtgctgatgttaacggaggattatgattagcagttctgaaanatgcaatggatg

SEQ ID NO: 14988 - DNA, 310 bp, Zea mays
  Clone ID: LIB3279-222-Q6-K6-G10
cactagtttctcacaacagcataaatctaatgcatatggacaaagattaaagtctgatattaaagcttattgtaaagaccttccatgaagagcccagttgattactcaattcataaaggactatgcaaccacaaaaacgaccatagtgaaagctatagccgaaacttttgctgacgctgggtcataaaatgtcacaaataatctcttggctagcctggcggacaatggcatgctaaaatatattgaacgcattgctgatagatctgttgatcatactatggaacataaggtggagatgaaggctgtggtc

SEQ ID NO: 14989 - DNA, 344 bp, Zea mays
  unsure (1)..(344): unsure at all n locations; Clone ID: LIB3279-222-Q6-K6-G11
cggacgtttgggcggacgcgtggggagcacgagctgnggagttcagatcggatcggaagccttcataagtttccatcgggcttcgccgctcgccggtatggcgatcccgcaaggggtcttcgtacccccgtcgcggcactttctcgcgctctcccttttgtccccccctctccaagggaaggcttgttgcaagaaaaattccaaaattgcttggaaaatccgtgggtcaaatcccaatggaagaaagattaaaacattgcttgtgaattgaaccacacttccggaaaattgaattgagatacccaagacaaaagtattcaaacctcccaagattaccagttcta

SEQ ID NO: 14990 - DNA, 547 bp, Zea mays
  Clone ID: LIB3279-222-Q6-K6-G2
ctcgtctctctccgatccctctcctctccctccccctagccactacccacttgagcgagccctaggccctagcaggcgaaagccatggcgtccttgggtgttcgtgccggcggcgccggttgtttttccttccttcgttcttggcgggacgggaggagggggcttaccggcttgaggggcgggacagggcacttccgggtgcgggttgcgctttctttgttcacattaactttttccaaagaggtcaagggcgctggcctttctggcgatgacagcagtttgggccccggggatgaatattagtttggactctattcttctaaactgtttgcaggtactggagatgattatgtgtctaacccccgcatgccagacaaggatgagttcgaccatttctaccgtgttgtcgccaagaagactgacatgctgctcagatgtcaccttccaaagacgcttgcagtttctgaagaggagaaggccgcgcacgagaagttcaaagagatggcgaacgaatgcatcgacctcctggttgatgcgatgcgccgca

SEQ ID NO: 14991 - DNA, 634 bp, Zea mays
  Clone ID: LIB3279-222-Q6-K6-G3
aaaagatgaggtttcggttattaaagcagggttgaggaaggtaaaaattctcacagatctggtgtcgacacgaaggcctaagaagacttgccagggaggtggcgaagataagttctgtgttaacagtgatggtgctgaatatccatgtgatactgagtctcttgatgacgatctagatgacagagtagaggaagatgaaattggagattcaactatcaggaagtctttcagttatgggtctctgcaatctgtcaactatgtcggtggcctagtttatgcccatgcaaagattgatggggagcatgaggactggatatattatagtaaccgaaaaactgatgtcggtttccaagtagagaaagtattgccatcaaccacagagaatgggttgctaactgctaagcgcagtatacttccttggagaaagaggaaactgagtttacggtcgctgaaggctaaaggtgaacctctgttgaaaaaggcatatggggaagagggaggtgatgatattgactatgatcgacgcttgctaacatcatctgatgaatctgtttcagagagtcagaggcagagctaatcgagtgcacgaagatgctggtcagcgcacactcgtcgtccgccgctgacagcaagc

SEQ ID NO: 14992 - DNA, 651 bp, Zea mays
  Clone ID: LIB3279-222-Q6-K6-G4
ggttgctgaaagagcgctcttcgtatggaacaatgatcacattatcagcttgattgcacaaaaccgccaagtgatcatgcctcttgttgttccagcgctagagcagaacattcagaatcactggaaccaggcggtcctgaatctgaccgtgaatgtcaagaaaatgttatctgagatggacgacgatctcttctcgtcatgcctggccaagtacaaggacgaagaagaaaaacgcgcgtcgctagaagcgaagcgtagacttacgtgggagaagctcgagtcagctgcagctttccagccagtgactggccatacagccgtcctagtaggccaccggccgtcagcaaatctgatcgccaccatgatctagctcatgcatgtatgccgaacaagcgaaggtggtgctctcccccccttttggtgaggcgcagcaagtgtagtgttctctattttgctcctgtttattattattattttccttttgctggcatgggtaatcagtgtagtagtaagttgtaactatttccggatgtttatgttcttaaggcaaggatacctgtaacttaagactgccgagtgctggcactctacatgtatctttgcctgtttatggatgaacaggtgtcctacagtttaatttcactttccatc

SEQ ID NO: 14993 - DNA, 628 bp, Zea mays
  unsure (1)..(628): unsure at all n locations; Clone ID: LIB3279-222-Q6-K6-G5
cccgccgtcgccgccaccaccagcactgccactgcgccaccaccgtcccgaagccccctcccagcgccatcgacttcatctcggattgaagcaatgtcgtcggaccatgagggcagggaggagaaagagcctgaccctttcttcaacgacgttggcaccaagttcaagggtggcggcgggaggcttaacaacgctttgaagaatggtggggcttaatgccagccaaaaggcaagaatggtgacccttgcgagaagggcgactctttcattagagagcaaactgggaatggttaccagaaccccaagagggagattggaaggggtgttgctttcccaacctgtgtattcgtcaatgacacacattgccacttctcaccgcttgcaaccgatgatgccgttctggaagagaatgacatggttaaaattgatatgggctgtcatattgatggctctattgctgtggtggcacatacacatgtgattacacatgggcctgtcacacgaagagctggtgatgtgcttgctgctgccaacacaccagcagaagtcgcaatgcggcttgtgagacctgtgaagaaaataaggatgttactgaagcaatcanaaaagtgctgctgcttatgattgc

SEQ ID NO: 14994 - DNA, 621 bp, Zea mays
  Clone ID: LIB3279-222-Q6-K6-G6
atcaggttattcagacctaggtcctcatagtgctccccatctttctgataggcgagcttatgctgatgatagttatggggggaagttcgaccggcctttaccggtctatagggagggtcgtggccatgattatgacaccgtttctggatcaaagcgtccatatgcagatatggatgatgcgcctcggtatcaagaaattggtgttcgtcagtccaaggcacgcttggactatgacattggtggcagcagtgctcgctatggagatacatacaacgagaggcctggacgaccacatgcgggatatagcagtagtcggtctatccctggtcatgattcagcatatggtagcagccgtaatggcatgagttatggaggttctgctagcagtgctgatgctggtggtatgtacccaccgagttacagtggtagctatgggtctcgtggatctgatgttggtgggagttcatattcttcgctttactcaggccgcaatttgggtagcagcagtggtggctactatggaggtagcggttccggttcatattactaaggtgcaaaatcaaatctcttctgtctttcaccaagcttgtttcactgtgcttaaattatttgcaccgtccc

SEQ ID NO: 14995 - DNA, 654 bp, Zea mays
  Clone ID: LIB3279-222-Q6-K6-G7
cggacgcgtgggcgctcgcatcaggagatcaaggactgagtctccacgactgtcggtcacttcggatggcggcaccaccggaggggaatgtccgcttaggcgaggggtgggacgaggacgacgtgctggagccgcagccgctggaggtcatagcgccggatgtcaagtccaagaagcggagggcggcgcccggagttcgggttgttggtcgccggatctacgatccagagaatggcaagacctgccaccaatgccgccagaagacaacagacttcgcagcggcgtgcaagcaagtcaagaagaagggtccgtgcccagtcaagtattgcctcaagtgcctccttaacaggtatggcgagagtgccgaggaggcggccggcaaggaggactggatctgtcctaagtgcaggggcatctgcaactgcagcttctgtagaaagaagaaaggcgagatgccaactgggataatggcccacatcgccaaggcttccgggtgcacctctgtccatgatctccttaaaaaggggtcagatgtggtttctgctgcacaggcgattctcaaggtgaatggtagtgacaagggcacaaagagatcccgagggacagatgctgctgctgaggtggcgactgaaaagatgtaaatataggcattga

SEQ ID NO: 14996 - DNA, 627 bp, Zea mays
  Clone ID: LIB3279-222-Q6-K6-G8
cccacgctttcgcccacgcgtccgcgcgaggaggccaccacgggaagcgcgacagccagcttgcggctccccgagcagtcgaagcagggcaggaacctcatgccctaagttgaggaagtgaaggaaaccatttggtggtgccaaatgatgcggcggcggtccttcctcgccccctcctgggggggccaagccgaccacacccaccccattccggctacctcttgtggtggtggttgtggtggttcttgggaaaaaaagaaagggaagaagagggaagaaattgaatggccacggtgcgccgtgggttaatgaaggaagaagaagagaagggaattttaaattcaaatggagatggctctgtcgctgtgctccaactgaaggggttggatttcaaccagtcaaagtcaatccacgtggaatgactccagtggaccaccttactccgactgggctctgttttttgctctgagagggccggcccaaacaacactgctgggtcttaactctcaagagttctaagaggcactttcatgagagaattcatgacactaattagtatgtcacatagaaattttgatgacaccacactacatttattattaaatggcgaaactagttttattaccc

SEQ ID NO: 14997 - DNA, 531 bp, Zea mays
  Clone ID: LIB3279-222-Q6-K6-G9
ctcagcccttgacgcatgatttggctgtgtctggtggcgtctcagcttttctgcggcccacagtgccgcctcgctgctccaggcctgactccgccgccacgcgcagggtgagggagtaagagaccgagctcgatcgctcgccgagatggcaggacactaccggagttgggcgctggggctggggcggatctgggactaaagctcggccaaagagcgcatccgcgacttcatctgcgtccccgagctccgggtggcctgggggatgttcatctccggtagcagccccatcggggcacgcatcaatgggcccaggatgacttcgaagaaccttatcaacgagatcttcagggacgctggctctacttatggcgagactggggcaatcatggttcagacaaaggtggacagcgtgacaacaagggaaatggtcatgcggattctcctggagccagatatgcaatgctgagcaactggacgtagcgctgggtcagttaatagcgtttggcgggattgcaagaagataattggaag

SEQ ID NO: 14998 - DNA, 646 bp, Zea mays
  Clone ID: LIB3279-222-Q6-K6-H1
cgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaacagtggaccccgtgaggatgccacccgtattggttccgctggtgttgtgaggaggcaggccgtggatatctcacccctgaggagggtgaaccaggccatctacctcctcaccactggtgccagggagagtgctttccggaacatcaaaaccattgccgagtgccttgcagatgagctgatcaacgctgccaagggctcatccaacagttacgccatcaagaagaaggacgaga

SEQ ID NO: 14999 - DNA, 585 bp, Zea mays
  unsure (1)..(585): unsure at all n locations; Clone ID: LIB3279-222-Q6-K6-H10
cggacgcgtggggaccggcggggggggcctgggggccctgagggcggcgcgcgccgtgaaggagacgacggggatcgtgggccttgaggtggtgcctaacgcgcgagaggttctggtagggctctacgagcgcacgctcaaagagatcaaggccgtccccgaagactagggttaccggaagtctgggaatccttcaccggtcaccgcctccagatctgccaggaggaggaggactggaagcgcatcgaggaccgaatcggatgcgggcaggtcgaggagctcatcgaggaggccgaggacgagctcaagctcatcgctaaaatgattgaatgggatccatggggtgttcccgatgactacgaatgtgaggtgattgaagacgacaccccaattcctaagcatgttcctcagcaccggcctgttgctcttcctgaggagttcttcaaggcactagatgctgtcaaatctgatcctgctcttcaaggcgatgctcctcctcaagtgaaggcgtaaggatggctgttcctggctaacgtcatttcacattttgccgcngtgggtagggactggtttcttgtgtcattt

SEQ ID NO: 15000 - DNA, 400 bp, Zea mays
  Clone ID: LIB3279-222-Q6-K6-H11
ccagacctgccactcctgctcacccggcacggctgtgtcgtcactttttcccagctcggggctgcccccctcacccaaaccccattcccttaaaaccgagttgcagtctcaagtaactccagaccaaagtcatgtctacacctcccgtcacatctcctttttcagtctccgggaccgaggccggtcaacacttcactcaccaaccaacataacagttaagacgcctcccaacacgggcttaaagttaccttgcctgccggggctgacagtcgactcatgcttgctgaacaagacctcacttacctacaaagcggcggctcgtccctccgaagcattgcaggaggctgccaccggaggccctggcttctctcctgcgtcctcttcgcaggatcgacactca

SEQ ID NO: 15001 - DNA, 551 bp, Zea mays
  Clone ID: LIB3279-222-Q6-K6-H2
attgaatttccaaatcctaacgaggattcacgtttcgatatcttgaagatccattcaagaaaaatgaacttgatgcgtggcattgatctgaaaaagatcgcggaaaagatgaatggggcctcaggagctgagctcaaggccgtctgcacagaggctggaatgtttgctcttcgtgagagaagggtgcacgttacccaggaggacttcgagatggcagtggccaaggtgatgaagaaagacacggagaagaacatgtccctgcgcaagctctggaagtgaggctcgtgcctacctttcacagccttcccgaagctagtggcagtgccttcatatccatatcttttaccaaagcagtggaatggcgtaacggcatgctctggacaatgttatctcaagttgcgccgcgcatgcttatgtttaaagttttccttataacgtctgtagtgtgttgttgcaaagttgattggctttatcagatcagctagattacggtactaatacattgctagctcgcgatgtggacactgcataatggttacttgctcggatta

SEQ ID NO: 15002 - DNA, 642 bp, Zea mays
  unsure (1)..(642): unsure at all n locations; Clone ID: LIB3279-222-Q6-K6-H3
gaaggctgtcatcacgctgcagcggctgtccatgtcggccgacatcgcccgcgcaatcgtcggccacagcggcgtccgcgctctgatcgacatgtgccagaccggggactccatcacacagtccgccgcggccggagcgctcaagaacatctccgcagtgccggaagtccggcaggcgctggccgaagaaggcgtcgtgcgagtcatggtgagcctgctggactccggcgtcgttctcggctccaaggagtacgccgcggagtgcctgcagaacctgacgtcaagcaacgacagcctgcggcgtgccgttgtgtccgagggcgggctacggagcctgcttgcctacctggacgggccgctgccgcaggaatcacccgtggcggcggtccggaacctggtgagcgcggtctcagcggacagcctggtgtcgctttgcgtgctcccgcgcctcgtccacgtgctccgtgacggttccgtgggtgctcagcaggctgccgcggcgaccatctgcaagatgtcgagctccatggacatgaagcggctggtgggcgagcacgggtgcatcccgctgctggtgcggctgctggaggccaagtcgaacggcgcacgtgaggcggcggcgcangcggtggcgagcctgat

SEQ ID NO: 15003 - DNA, 640 bp, Zea mays
  Clone ID: LIB3279-222-Q6-K6-H4
cggacgcgtgggttcagttctgccgctgctgctgccgctgccaccctccgtccgcgtccagatcccgccaccccaaccgatctgccggcctccagcatggcggcggcggcgggggcgagggcgagggcgaaggcagcgggagccctggcgctggcgctcgtgctcgcgctagcgggggccaactccgagggcgacgcgctctcggcgctgcgccgcagcctcagggaccccggcggcgtgctgcagagctgggaccccacgctcgtcaacccctgcacctggttccacgtcacctgcgaccgcgacaaccgcgtcacccgcctagatcttggtaatttgaacttatctggtcatctggtgcctgagcttgggaaattggagcatctgcagtacctggaactttacaagaacagcattcaaggaacaatcccttctgagcttggtaatttgaagaatctaataagcttggacttgtacaagaacaacatttcggggacaatacctccttcccttggaaagttgaaatcccttgtattcctgcggctcaatggcaatcatttgactgggccgatcccaagggaactttctggaatatctagtctcaaagttgtcgatgtttcaagcatgatttatgtgggac

SEQ ID NO: 15004 - DNA, 439 bp, Zea mays
  unsure (1)..(439): unsure at all n locations; Clone ID: LIB3279-222-Q6-K6-H5
gtgggatcccagccgccgccgcaagaagaagagctgggggacttccaggtgtcgcgagaagatgccgaagcagatccacgagatcaaggatttccttctcaccgcgaggaggaaggatgcccgatcagtgaagatcaagaggagcaaggatgttgtcaagttcaaggtccgctgttccaaggggttgtacacccttcgcgtattcgacgctgagaaggcaaacaagttgaagcaatctctccccccaggcttgagcgtccaggaggtttgattggatacatggcaacgtcgggtcgaacctctagggcatctttatcattagcagagcatgctgtttatgtagttttggaccttaagctattagacatgtcagtgttggatttgtggatcttgaatttttggagaaataccaatttgcctcgttcaaggacgcacnnna

SEQ ID NO: 15005 - DNA, 592 bp, Zea mays
  unsure (1)..(592): unsure at all n locations; Clone ID: LIB3279-222-Q6-K6-H7
gtctcctcccggcctcccctcaaagcccaccgggggtgcccccacgccacccaccccaccccgcccccgcccctaccgcgcggtgcccgagacccagaggccagacccctttcttcaccttccttcccatcgcaatcgcaagcccccggctccggcgctcggcggtctgccaggttcggggggggacttcntcncngcnaggagggagggggtcgccgttagcgcgcggcacttggatgagaagggcagcggtggaggaggatgcggaaggcgtacagggactccatcaaggtgctcgaagctgacatccagcacgccaacaccctggcctccgagtttccccgggactatgatggtgcgtgcctgcagatgcggctgtcgtacagtcccgcagctcatatattcctcttcctggtgcagtggacggactgcagcctcgcaggggctcttggtctgctgagaatcctcatatacaaggtttatgtggatggcacaacaaccatgtcgactcatgagaagaaagccagcatcaaagattctatgctgggatatttccttctttgctgcaactgcaaagggggatcactgatgt

SEQ ID NO: 15006 - DNA, 592 bp, Zea mays
  unsure (1)..(592): unsure at all n locations; Clone ID: LIB3279-222-Q6-K6-H8
cgcaacccttcgggtcgcgggatcaaggagcgagagagcgggacgcagcgagcgttccgccggagatcgagaccgtagctagggtttgaggcgccgggctgcggtggacgagatgtcgacgcccgcgaggaagcggctgatgcgggacttcaggcgcctgcagcatgacccgcccggcgagatgaggggcgcgccccacgacaacaacatcatgctctggaacgccgtcatattcgggccggatgatacgccgtgggacggtggcacgttcaagcttaccttgcagtttacagaagattacccaaacaagccaccaactgttcgatttgtctctaggatgtttcatccaaatatatatgctgatggaagcatctgtttggatatcctacagaaccagtggagtcctatatatgatgttgctgcaattttaacttctatccagtccctgctgtgtgatccaaacccaaactcccctgcaaactcagaagcagcaagactgttcagcgagaacaagcgggagtacaacncgcaagtccgtgagatcgtggagcagagctggacagccgactagtgcataaggatgctcgtcgtg

SEQ ID NO: 15007 - DNA, 646 bp, Zea mays
  Clone ID: LIB3279-222-Q6-K6-H9
cggacgcgtgggcggacgcgtgggcgcgaaagtgggcgctcccaggtgtgcaaaatccatggcttcagacactggcaagaagctcatccagatcgatgtgagctcggacacagtatgcccttggtgctttgtcggcaaaaagaacctcgagaaagcgatggagcaaagcagggacaagggggggttcgaggtccgctggcatccgttctttctaaaccctgatgcgcctaaggagggcgtcaggaaatctgacttctacaaggcgaagtttggtcctgttcagtatgagcgtgtcatttctcgcatggccgagatatttcgaggactcgggcttgagtatgacatgtcggggctgacaggggatacgatggatagtcataggctcatagcacttgctggacaccaaggctatgacaagcaaaatgctcttgttggagaattattcctttattacttttgtgaaggaaagtatattggtgacaagcaggttttgctggacgcctgcagaaaggtgggcatagaaggggccgaagaactgtttcaagaccctaccaaaggagtcgatgaggttcaggaagaactcaagaagtattcatctggcatctccggggtaccacattttgtgatcaatgataaatatcaactc

SEQ ID NO: 15008 - DNA, 575 bp, Zea mays
  Clone ID: LIB3279-222-Q6-N6-A10
aaaagaaaagaccgcagctgagcaatcacaactcaggagctgctgctgactgcatatcaaaaccaagtcgtgactgttgaaatcttgcaacaacacttccacaaaacacatcgaaacgataggatgtcacatcaaaaccgacatgtaacacatactcaggtgatccaacagcataatccagcacagttcagtccatcggttgctacaggtgcataatgacaaatacgatgatcacagatcagcgacgctcttatttcacgatgtctccgaatgttcaggctcgtctgctggggacggcaggagacggacctctcaggcacccccaagtccggcgatcgttttcagccctggagtccaatgatcccacaagcaacacggccaccggcgtttccagtgctcttgctgagctcgtgcccaccctttccaagatcatcaggatcagcgtgaacaacaacagctctgccaatgattgagtttggcccagtcagtgggatctggctgtcggtgacattgatattagcaacaccatctgctccagctgtcacgtttccaagatcaccagcatggcggttctc

SEQ ID NO: 15009 - DNA, 452 bp, Zea mays
  Clone ID: LIB3279-222-Q6-N6-A11
gccgcctctcctggcctgcttcatcttgctcatccgcgtcttcatccggctgcacaccttctccagctccaccacccgccagtgcatcccgtcaaggagcgaccgcaggttctggttctccaccgacaggtccagccgtctcgcgtacaggatcacctgcccgtcgttctcgccgccgccattgtcgtcgtcatagccgtcgcggcgctttcccgtggaagcggtaggggatggcgacacggacttcagttggcccggttcgcgcagcacgacgctcttcaacaccgtgtgctgcgatgccagcgcttgcaccgccgccgtggtcgggaactcgccgttccgcaacatgtgcttgcagcattccggcgatagcttctcgtagctgagccccctgcagatgttcatcttctcctcgtccgtcagtcgcccgtgaacctgaccggacgcgtggg

SEQ ID NO: 15010 - DNA, 424 bp, Zea mays
  Clone ID: LIB3279-222-Q6-N6-A2
gatcagtcccccgtaaacagtgaataaacatcttattttacaacgactcgtttcttttcaacctttttagcatgagtttttgattttcagtattgcacccaaaacttcataagggggagcaaaaatggaattacagaatggccgcaaccgtactattcgcgaaccagtgtctgctggctttggaagtacacacacagcacatgcagaaatgtatatggtcccataaattagaaagcgacctcgaggacagacttctaaaaggcaagtctctcagcatatgtatcaacatggcaaaccggaacccattagtctctctgcgaggttcgaattcattgttcaggttcagactcggatactctgggcgtaaatgtttgcggcttccctctgcccatgctgaatccccgtgagccatccggcatgcgag

SEQ ID NO: 15011 - DNA, 569 bp, Zea mays
  Clone ID: LIB3279-222-Q6-N6-A4
aataatagttcccgtttattatattatatcacaagatggatctgtctgtcgcttattctgcctttggtcgtcagagctttgatgctgttttgagctttgtgctcgactcaaaagccttgctgctgctgccttgcaccatgcgtgccttcttcacttggaaaaggagctcgtgggcttcctcaaaatgagggctcgtggctttcttcaccttgtccatccagacaaggatcctctcatgagctcccaggaatcggtcacggacctcatcgccaaggatctccaactgcattatctcacagacaaggctcagatctgcaatcgatggctgggggctacctagcaagaacttggcatcgcctttcagccatacggattcgatcacccccagtgactgcatcacaagcttctctgcttgtttcacagcctcatgacttgtcgtaagaccaaggaagggagccaatgcagtgtgcattacaagggttgctgcaccacgccgcaaatttgagtgatgccaatccaagattgactcaattttggctctggtgaacaagtcagaaggataccagtgc

SEQ ID NO: 15012 - DNA, 581 bp, Zea mays
  Clone ID: LIB3279-222-Q6-N6-A5
gaaaaaatggggccaaaatttgatgcgctactttgaacgcataggtatctgcctatctgcgtacatcacatacatagaccatcagcctagtgccctagactcaaccttttctgcacactgtgcggccccgcaaagtttttatttaacctaaaggaccagcactgactctcttaaccatgcctaaactagcagctttagttcctttgtggcgtatggtgagctccatggttctcagatgttgactctcaacttcatccttcacaacagtcccgatattgctgctgtgtaatacttgcacccgcttccacagcaaacaaaagcaatcttcacgagcaaaccgaccacaggcatgaaatgatgaaactttccatgcagcggcatatcattgggtcctcaaatccgatttccggcctatcaatgctatgcaaacttcacccctgcatcacctttcgaaaccgcttcgaatcacatgtttcattgacttttaatggatccaaacagttaatcaatgaaaagaatagaaaggcaggcatagagttcagatcatatcaaactacaatcttaatttgacaggaagtata

SEQ ID NO: 15013 - DNA, 181 bp, Zea mays
  Clone ID: LIB3279-222-Q6-N6-A6
aggcgcagaacactttaatttttagcagaacaaaagataagtacttccatgcataacgatgttcagcacgagataagcagggtcacacaagggactggaataccccatacacttaaaattcatggggcccaaagcaaaataagatggggtaaaccaaaacgggggggttcgcattccaact

SEQ ID NO: 15014 - DNA, 597 bp, Zea mays
  Clone ID: LIB3279-222-Q6-N6-A8
gaactcggcgtgcttggtgcagtactccagcaccgtgaccagggtgggcccgtcgactaaagggactatgacgacttcgtcgtcggtgacgacttcctctatcatgccgctgagaatcaccgacagctgtgccgccgccaccgacgcgcgatgaaccttgccgtccgagctcttcaaggtgataagcctcccgccggccacatccttcggttccgaagtccctatctcagcctccgtggtcgccactgccttctctcccttcccctccaccatcttcacatcctccgcctccgaggtcgccactgccttctctcccttcccatccacaatcttcacatcctccgcctccgaggtcgccactgccttgtctccctgcccctccaccatcttcccaccctctgcctccgatgccgccactgccttctctccctgctccttcatcatcttcccctcctccaccgcggtcgctcccttctcctctcccaccgcctccatcgccctctcgctcacggctcgctccacgacgaaagccttgcttcgctcgctaggtgctctcgcgctcgcggtgggtgggtgactgggtggaccggacgcgtg

SEQ ID NO: 15015 - DNA, 518 bp, Zea mays
  Clone ID: LIB3279-222-Q6-N6-B1
agcaaaattaatggcaactgggttgtcatttgcaaggatggggggatgcatgaaaagaaattctcccgtctcgcccttcagtatttatgtaaacaaaaaaaaggctgataggaccctaagacctcaaaaaatgagagaagccaagacaatggacatggagcaaacaagagctgaaagaaacctgatgctaaatacaaaacctatgggggccccgtctccacagggtatgccccatgcaactttctccaggggggcagctttgaaattattgatcacccaaggacaggaaccaaaatgcatgtccttttttctggagcggaggaataaatctgggctaccaaaccccactggggcataaccactggcatcaaaaggcgggtatctaacatggagaggcatctctattacaagggtacagttgtttgaaaagattcccctgaaaacaaaatggatctcaacaaatgacccattggataaagctgggggcagttcaagggtggcgtctccaaaaacagcaa

SEQ ID NO: 15016 - DNA, 546 bp, Zea mays
  Clone ID: LIB3279-222-Q6-N6-B10
ctcaaaaagccctaagaaagcaagaaaccggcacgttacacttctgtccacaacatagctttttgcagagattcagtacataaggattcttcaaattaaccataccacaccataacatgggacatttgcgaaactacgggtacaggtatcaaaatgcaacgagttcaatactaaaatataagcgtagtgcaatctaatcttcttcctcgccctcgttctcagcaatgttgaagtagcggagctcatagacgtttcggtccttgttggcagcaaccacgcgtagccaatcccgcacgttgtgcttcttcaagtacttcttggtcaagtacttcaggtacctcttggagaagggtccgtcagaggtgacggtgaccttggtcttctcgcgagagatggtgacggagtcgccgaggttgccagccttgccgccggcgaccttgatgcgctcctgcaggaacttctcgagcgaggcgacctccatgatcttgtcctccactggcttggtgcagtcgatcgtgaaggaaaccgaccccttcttcttgcccg

SEQ ID NO: 15017 - DNA, 106 bp, Zea mays
  Clone ID: LIB3279-222-Q6-N6-B11
gacacaaacggccctgcctccatttggggcaagcacagtcccctattaactgagccaagtcagatatgtacagagtggctgcatatgattaaggatgcatgcaggc

SEQ ID NO: 15018 - DNA, 517 bp, Zea mays
  Clone ID: LIB3279-222-Q6-N6-B2
attgtgttgttaaaaattttggtctttgggtggtggggggttttgggggaaaaaaaggggcgaaacccccccggcccgggccccggcggggggggggagaaaagggaaggacccgccggggggcgggggggggcggcggcgggggggggcccccggggggggggggggcccgggggacacggaaaaaaaccaccgggccgggccccccgaccgcgaccaacccagggccccccccccccccggggcgggccaacggcccccaagggggggcacccccccccgggggtgggggagggggggggggggcaccggagccggagcgggaaaaaaaacgggggggggggggggggcggcccggggggggggggcggggccggggggggccccccccccccccccgagggggggaaggggggggccccgggaaaaaagggcccccccccggcggcgggggggggggggggccccaaggggggggccaaaaggggagggccggggcggtgccccctccccaagc

SEQ ID NO: 15019 - DNA, 583 bp, Zea mays
  Clone ID: LIB3279-222-Q6-N6-B3
accattgccaacagccaatatataactactcaagtggcatcaacaagcattattataccactcatcctattttaagaagataaggtaatcacgagaaacgaacattgagcttgatttacgtggaagttcaaccatatccaaattcccacggagaacgtgcttttcatgttccactcattgtatctcgtacatagtaattgaagcttgcaaacattattattcacctcgaccaagtaatacaatctaaccttctacagcttggcaggcttggggaagatgtcaggggtgaacttctgcgccgcactgatgctccccttgattttaatcgcccctcggatgaatgcaatctgtggattcgtcttgccggtggcgattccaaggaaatcgttgtccgtgaaggagaaagtggcatccggctttccctggtacggccctttggtgacctcgcccttcttgaggtcgaccacgaagatctcctcatcaacgccgatcttcttgggggcgatgttgagctggtagacgaggccaaccttcttggtgagctccttgccggcgtcggtggccaggtgctggcgcatcagct

SEQ ID NO: 15020 - DNA, 428 bp, Zea mays
  Clone ID: LIB3279-222-Q6-N6-B4
gctggtagccgagttatgttgctgtgcaaaagcacgagtccgaagtacaacagggttcactcatagcatttacatcagttttcatgctgcgactatatcagctgaaaaaaaggattcactgcgacttggcaactggctccagtgcctcgatcatgacaacactgtttcccctgataaccaccattccaatatctgtcttggcatttccattgacctccacagtgttgtcgatcaccagattcatgaactggtcgaatccccgaagtgtgccaataacaacacggtttgcattcagcttaatctgaagcttcttgtccatgtacttcttgagatccggaggctgccccgagcggctcatggtggcggctacctagcctcgaacgcgagagaggcgaagggatctaggagcgccgaccagcttctcacga

SEQ ID NO: 15021 - DNA, 574 bp, Zea mays
  Clone ID: LIB3279-222-Q6-N6-B5
ttttttttttttttttttttttttttttttttttttttttttttttttttttttttttttttttttttttttttttttttttttttttttttttttttttttttttttttttttttttttttttttttttttttttttttttttgggggggggggttaaaccctgtttttttgtgggaaaaaaaaaaaccctgggggggggctacagggggggggtgggggggggaaaaaaaagaagggggggggaaaggtgggccccaaaatggggggcccccggggtgttttggggggaaaaagggggggcccccctccacggggggggaaaaaaggggggtgggggggggcccgggggggggggaaaaaagggggggaaaaagggggggggggcccaaggggggttggggggggggggcacacccgggggggagaggggggggccccccggggggggaaaaaaagggggggggggggcctaggaaaaaaagcaggggttttgcttctgggggggggggggggccccctcctcgttttgaaacaccgggggggcctttcccccaaaaagggtgtgtcttatt

SEQ ID NO: 15022 - DNA, 592 bp, Zea mays
  Clone ID: LIB3279-222-Q6-N6-B6
acaacgcaaatttatatatattaccacgggtacaacgtgcatctccgttaaagcatacacaggacagaggaaacatagtagtggaatctccaagcacaaagctacgtctagctcgtagatcagagaaaaaagggtagctatggcaataaacacaagaactgaacacaatatatggtggtgctgagaagctccagacttcaatcaccatgtaaagcatttgacggggcctgactttattagtagtacctacgccggtattcgatcacaggatcgagatggatcgtgcatcggttgatatctaaggtcaccgaagcatttcggtgacaggtgtgttgctgtcgagatcagctgcaaaactacactgggaagacctcacctgttacttgacagtgcggagcatccatggtggcaggttgcccctgtttgcttgtgcaggagcaggagacggttcagactcagattctgctgcccctctatgttgacatggccctatatttagagttggcatggaatctggaactattggtggtgaaagtgatggggagcttgttgatgctccattttgctgctcccggagctgcgcgttcattaa

SEQ ID NO: 15023 - DNA, 527 bp, Zea mays
  Clone ID: LIB3279-222-Q6-N6-B7
atctccaggcgcgttgtttactggcacacccggttttgaagggaaaccgaatgcgaaccatgtacgtgccaggatcagtaattcacgtacacagcgattacataaatgactcatcatagcacaatgcttcaaattacaataaagagtaaggaataatattacagactagagccatttacataatataaatcaaagtacacagaatcgaaacgtagccaacgtaaacaacccaccacaggcagctgactgggggaggtcgctagcctagtccttgaactcgtcgaagtcctggaactcctggagatccgcctcgacacctttttttttacctgagcataaattgcaccaaaggcaaccttcaccaaacagatgctcaggatcttcaactttgtaaaactcgaaaagctcgatctcgggaccaggggttcaccaaatctcgatcgtcatttcctcgaagctcaggaacagattgcaatcaaggggaagtcgctgaatatggagtaggttgcgacggttctgctgcttgt

SEQ ID NO: 15024 - DNA, 576 bp, Zea mays
  Clone ID: LIB3279-222-Q6-N6-B8
agcaaaaactattatagcttagcttgttcatagagactggaggagcatgacggctgatcacacgcgatcaactatcccaagtttttacaggcacagaactaccaccgacactcatgctggagctaccgacgaatctagagctactgacaatattacgattggatcaaaatccatgaaagaggggaatctataggcggaattgagggggggatctcgccagcgacaaggcaggcagactacttcttggccttcctggccacgcccttcctggccggggcggcagcagcagcagccttcttcggggttgccaccttcttaggagccgccgctgcctttcccttcttggcaggagcagccgccttcttggctgccttggcgggggaggccttggcggaggtcttggcgaccttgggagggcgcccgcggggcttgggcgacgcggcggcaggagcgacaggcttggccttggccttggccttgggtttgggcgacgccgccttgggcttcgcagcggtcttggccttcgccttcggcgagggcttgggcttgggcgcggccttgggtgccttgggcttg

SEQ ID NO: 15025 - DNA, 528 bp, Zea mays
  Clone ID: LIB3279-222-Q6-N6-B9
ggcgggctaatatcaaaaatcatataaggggaccgattcaacacaaggaagaccgggggaaaaccgaaaccatagtactttgggcaggagcagaaaacccaatcacatgcctgacccaacaaaacaaaggagatcccagtaatagctagaacgaacaacaaagggggatactaggagctacaacggacaccattggaggcccccggccgaccacaaaaaaacttgagctagggcaaaagaaaaagcactggggcaaaaacccaaacacttggaaacttgaggctagggaccgcaaaactcgatcgggtaaacccctaggtagctaggggaccatggctaaaaaggaggggaagcagcaaaaaccatggcatcgatgtcccacttgaccttgctgaaaaccctgtccatcagcacgaaaaacaccactgataaattgctcccaaggcccgggccgggaagcccctcgccgtcaacaccggggaggtccaccttcctggggaacaccatgcttttgtaaaaggggcgccc

SEQ ID NO: 15026 - DNA, 567 bp, Zea mays
  Clone ID: LIB3279-222-Q6-N6-C1
gaccaaacagttcattcaccagctagaaaaagtgttcaaataggagtggcagaaaaaaacacggtttaccagattatactgtcacaaactgttaccgaacacttaaaacaaagactagatgttccccaaaactgatgacaaagcacagctcctcagtacttgataggggcaagaatctccaactgagaccccaacttctcctcggctgccttctcggccttgacacgcagcttggccaattgcttcttcctctcgtaggcaaccttggccttctccttcctcttctcctcaagttccctgatggtgtcatggtagttccacccgacctccttagagagctcgccgaggaggcagtacttgtgtccaggctgtagcctcagaaccttaagagcgtcagggatgaccatacgcttggtcttgtcgtacggcggcgggacgccctcgtacgtcttgagcctcgccagagccgcctcccccctcttggtcttgtgcggaatcatcccgcggatggtgcgccacaggatcttggcgggggcgcggaagtggatgggcccgtgggacggcttg

SEQ ID NO: 15027 - DNA, 570 bp, Zea mays
  Clone ID: LIB3279-222-Q6-N6-C10
ctgcccaacgcgttaggaaaggtcgttcggccggcatcattactttacaaatacggtagggtaacccataccgtatcttcagagatacactgatcctatcattagaactggtttcgacttgacgccccatctcgcatctcttgatgcgaggcgccaccgtaccggatcggtggccctcgcttcgacttccatttcccaggcgcgcgcgatcagcacacggtccgcccgaagcaaatcgaagcgatgtagaggttcttggcccatttctccttgacgtgtgagctggggaaggcggaggtccgcagcgtttcctgtgtctcgtccatcggcttccgtttcggcatgctcaggatgaaagcggcttggtcgttggtggctgccgtggaagttatcctgtagccgctctcccagcgccggtggatgccctcgctggggtacaggaaatccaactctacaacctgagtagagaaccctgaattccttgacatgactacgccccagcgattcccagcggtggccatggatgtcacatggaacccttctttccacttcttattgatccacttgtaa

SEQ ID NO: 15028 - DNA, 556 bp, Zea mays
  Clone ID: LIB3279-222-Q6-N6-C11
aaataaaaaaagccatttgcatggggggtaaattccgtggtttaacaattcaaggggattaaaactcaagtattgaatttaaagaaaaccctgatcaacataacattacagtgtttgcatgactcgagtagctagaggcagggtttaaccaggcgttccaacaagtccacaattgcaaggggttgctcaaaaggcagctaatttagaagtcgtcatcctcctcctcagccatgtgcttagccagttcttcctcctgttgaagcctttctcggcgcttctcggcgctctccttttccttatgagaattaggggggaatctcatcgccttgaccgcctcattgtgcatgttgaggcaaaacgcaatcctggagttgaatgcaatttgtggctcatttgtagagtagacatcaccggtttccttcgataccatccagccatttgcatgatctatggtggcgtcaattgcgccatctcttatggccttggctacaatgctctctgcatcagcaacagggttctcagagtccagtcttagcttcttagcaatgtcagcaag

SEQ ID NO: 15029 - DNA, 158 bp, Zea mays
  Clone ID: LIB3279-222-Q6-N6-C2
gaaacaggcatttcttcttccattctaaatagcaaaggacaacttgcagcaggacacatacacatacaagcacattcgtcccatctgcagcctacgcatcaccgcatactggtaacaaggtactgctaaacatccccacgcgtccgcccacgcgtccg

SEQ ID NO: 15030 - DNA, 500 bp, Zea mays
  Clone ID: LIB3279-222-Q6-N6-C3
gcagcaccaagaaacaccatttttttccttaggatttaacttagaataaagcctgacgggggtaacagcacccatcgatccgcagtccatgctggttgatgcatgggtctgctggagccgagggtgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgttcagttcctccagttcccgtcggagttgccgtagccgccgccacggttgccaccgccgtagccgccgccaccaccaccgtagccgccgccgccaccaccgtagccgtcggcaccggcgtaggcgccggcgccatgacggggcccgccaccggcggagccggcgtcttcacggggcccaccgtacccggcggcggcgccagctccacgggcggccggggggctgg

SEQ ID NO: 15031 - DNA, 487 bp, Zea mays
  unsure (1)..(487): unsure at all n locations; Clone ID: LIB3279-222-Q6-N6-C4
attggggaagaaacagtaggctattgatgttgatgccatggtacttcttgtctaaagagcgaagaatccaagtaacaaaccacgcaacaattctcctactagatgcactgttcactcacacacacacacacacacatgacttatccgggacacaaaggtttgttacccgcagttttaagacactgaactggtacaggtacctttaccacaaattcctgggtgcttattgatgatttaatgagtggttggatgatctgattagagagcagngatacactcaatttaaatccgggcattcagtggcagggccgacacttggtaggttgatcgtgcaggtgctggcgccgggaaatatttgacatagatattgtttactttattgaaatcctggagatcagncaacatgatcgttgtgttgacaactgaagaatagttagcaccactagcttttaatatatggaccatgtttttgataaactgatgagtt

SEQ ID NO: 15032 - DNA, 476 bp, Zea mays
  Clone ID: LIB3279-222-Q6-N6-C5
ggaaaccccatgggttattttttaacaagagcccaaaaaaactaaaactggggaattcggtccggggcgggggcggttaagttaaacccaaaagggcggggggcccaaaaccggggggggccccggggccgggggccccggccacattttttctcagcataaacaagccgcaaaggaggggctgggaccaagggccttgggggcccccccccgatggggggggaaaaatttatttttttactaccccacgggggcttgaacaggggggggaacagggcgaccacccggttggtggacccccacttgggggggacccccgagacgagcttgagaaagggggtgttaagggaaaacccggcctgggggtcaaaaagcttgacctggtgcccccggggaaggggggggaaaccaaatccccccccacggagcccatgaaccccttgggggggccctaagaagggggctaaaaaggtttt

SEQ ID NO: 15033 - DNA, 519 bp, Zea mays
  Clone ID: LIB3279-222-Q6-N6-C6
acaaaacagcatgaacaggacggggctactgttcatctatttatagggacggggcatagcccgagtaaaagtacatttatgccgttgacattcatctataagcataacaagaatcattaaggactgaatagtctttggctcttttcgggcatcatcatacttgggcttcggcatcacattaagctgaaactcttcggctatagcttcgtcgcccattcttattaccttcgggctacatcttcaccctgtcacgagagaaaaccttcatcccgaagccgaagccccccttacacttgcgaaaaccttgtagtccaaatgttgacccaaaagttaggcttcaaattcctcgtcaactcgcctttactccttccaatcaagccctttgatcccaccctgttggtggacatctcggtttttgacgatgaactggaaaacagatcggcaaatcgaaagcgcggggacaaaactctcgccgagccgacacaacgatgttctaggtagccccggaagaaaacggaa

SEQ ID NO: 15034 - DNA, 319 bp, Zea mays
  Clone ID: LIB3279-222-Q6-N6-C7
aaaggtcccaaagcaaaacccctttccctataaaagaacccagaacagaagaactggggggggcggcccaatccccagccaaacatttttttagccccccaggggaagggtttctcccccgggggcgaggggaaacgggcccccccaaacaccccccaaattaactggaagaccgccgagccaataggggccctagcctccccacccccgatgggataatagcaaaggggggaagacccccagaacagccccgggggtccctctttttcccccaaaaaaaaaaacccagcttaggcgaccccccccattttgctctccc

SEQ ID NO: 15035 - DNA, 94 bp, Zea mays
  unsure (1)..(94): unsure at all n locations; Clone ID: LIB3279-222-Q6-N6-C8
tcgcgatctaggcctgctgcctagtggactgatatttttttagctttgggcataacagaatatgagttcattaggnagnaggcttagatggtga

SEQ ID NO: 15036 - DNA, 570 bp, Zea mays
  Clone ID: LIB3279-222-Q6-N6-D1
agacgaagggatacgacaacaacttaagatgaaggttcaggcacacgacttgccgtgaaatttagagacagcttacaaccccatgcaggacgggaagtttgccacagagaaatcaaccatgcgcacaaagcattgcacggggtacacacatgaaatgacaacggttgttcacgattcagacatagcacgcagcaggcaggggaggataactttggtgagcgcaccagcacgggcatcagttgccaccgaacaggtagcccagggaagagccaccgccaggagcagcgtggaccttggttgaaggacggtccgtaaggaagttgccagtgttctgaccatcagccctgtggtagttattggtttggctggtaaccccagcagcaacctgcttggccgcatcagtctttgcagcagatggtttctcaacaggtggagcacttgcagctggtgccactgctggtttggggggctcaccgcttccaaagagataacccagagaactttgaccaccaccggcactaccaccacggctcatcttgattattgaaaagagaaacgagaggcagcggc

SEQ ID NO: 15037 - DNA, 460 bp, Zea mays
  unsure (1)..(460): unsure at all n locations; Clone ID: LIB3279-222-Q6-N6-D10
aatatagaacgagattgttgcaacgacgatatctatgtatttcgtgtgctccctagtgagcagcagccgaccaatcgcgtaggacacataatcgacgatggtgtactagacctactagggacaatagaggtctggcccaccaaatgagcgtcatttgtttggtcttgtcgatcagcatgcccatcacctcatgcgtgagggtcttgagacctgttgtcctcgagagcgcaccttcgccacaatgtgtctcatgtccatgacgttgttcactagaatgttgcagtcatggcgtaggtgctcgacgtcgccccgccaaccagatgatcatccttgtatttagaaaacacatcaaacatccaaatctagaagatattctaacgcgacatgttgatcacgatataactgaagcggcccacgcgtccgccagncccgtncgcccacgcgtccgcggacgcgtggg

SEQ ID NO: 15038 - DNA, 538 bp, Zea mays
  Clone ID: LIB3279-222-Q6-N6-D11
gcggaagtgataaacaagtaaaatcctaaattgggctcatgcggtagtacaacggaaggataagatgataatacaacagtcaaacatttcaaaatattcagaatattcaggacattcgccatcatcaccgggcaaatttcaaaacagaacagaaaaacagcagcatagtgttcagctcgggttccatcaataccagaagtccagaacattcaggaccgcacattggggccatcttattggaaccaaatcagaggcagccgaaagttcgagaggacctgaaacgcccggatcactcggcctgggtgtcggcagcggcgaactcctgctgctggaggcgctcgagcgccttctggtgcgcccacgtctcgattgtaaggtcgggcttcgcgttgaggcccacccccaggatgaccacggtgaggaaggaggtcacgtagcagggcagctcccaatcctcccacttgcgagattccccggaggccgggggcggccggttgaagaggtaccccttggggcgctcctcgtgacctggggtcgt

SEQ ID NO: 15039 - DNA, 573 bp, Zea mays
  Clone ID: LIB3279-222-Q6-N6-D2
acaaagaagacaaaagcataatgataatgctagggagtacaatacagagtttttttattacagtacataatggcattcacaaactgaaggtaagcaacaccagctttattcacatactgcttaccatctcattagataagatggtagaacagctgctgatgccttagccactagccagaacagctgctgatgccttagcctcatttggaatggatggctccgaggaaaccttatttctgagctgcatagctttctggtacatagatctcccctcctgcttcaccatgttgttccccactaattgttttccttgcagccaaaaattcagcactcatagcattcattccttgtatcacagcttcctctactgttccataaccattttcatcagcatacttcctgatatcctccgtgattttcattgaacaaaacttgggcccacacattgagcagaaatgtgccactttggcaccctcagagggcaatgtttcatcatggaaagccatagcagttactggatccagagataaagcaaattggtcaagccatctaaactcaaaccttgccttgcta

SEQ ID NO: 15040 - DNA, 550 bp, Zea mays
  Clone ID: LIB3279-222-Q6-N6-D3
catacaaatccacggggggttttgttagttccaaatttccgaattccagtcacttcacccacagcagcgaggaagtaaaagcttattccacgactcatctagcaaaacacgggggcaagcctatccccaaaatccatgtgcggaggagtaaaccttagccttgcagtgctacaccaaggtccgaaacaagatgacacgcaaagctggcagaacctgagtagcagcagcagcagcggatctaggcgtcatcgagggcaaggacaccaggtagagtcttgccttccaagagttccaagctcgcaccgccgccggtcgaaatgtggctcattttgtcggccagcccagccttctcgacagcagcaacagagtcgccgccgccgatgatggtagtgacacccttcgtggttgtaagctcagctagcttcttggcaatcgcctaagtgccagctgcaaacttctcgaactcaaacactcccatggggcccgttccaaataacagtcttggtggtgtccaatgcttcgttagaagttttggtggcatcagggccaa

SEQ ID NO: 15041 - DNA, 583 bp, Zea mays
  unsure (1)..(583): unsure at all n locations; Clone ID: LIB3279-222-Q6-N6-D6
gggagaaaaatcatctcatctccttcctcagtctgatggaacaaaccacaaaaaagaaaagaaaagcagattggacttcccctcggcaacacaggaccaaatcatctcttaaaaccttaacgacgacgacgaacgacggacgacgaccaagcacacaccatgataacttaacttaacttgagagttcttctacgaaccgaacgaaatctgaaaacggcggacgggatcctcttacgaaagaggcagcgggcactcgtgcccggatcggcaaaactaaagcggtactccgacacacagcgagagggggatgtttttttaagcgagatctagaagggggcggcgccatcagaccagcaggtggtggagcgatccgatccgatctggctggctggacggacgcggacacacctcacgtgggacagtcgcgggcgatgtggccggcctcgccgcagttgtagcaggagcggtcgcctccacccccgccgccgccgaacctccctccgccaccgccgccaccgcttgggcagtccctggccatgtggccggcctggccgcagttgtagcagncgncaccaccaccgcc

SEQ ID NO: 15042 - DNA, 563 bp, Zea mays
  Clone ID: LIB3279-222-Q6-N6-D7
ccaggtaagcaagttcaaataccaatggcggtaaaaatcttcctaaatccccagcaggggtgacaaatacaaaatcattttattgcccaattcgctccatacagcgatctggaaacaatgctaccagttccggcaaattttggtgggtgtagctttacatggcgtccttggaaagccagttgtgggtcgagattccccgagcattggtgagctcatcaacgccgtctccccgctcgaacacagcagcggcacccatcccagaacctatgcacatagaaatcactccgaaccggcaatccttgccgcggcgcttcatctcattgagaagagtactgacgcaccgtgcacctgtagcacccaaaggatgtccaagagccattgcaccgccattaacattgactttagcaggatcaagttccaacttcttgcagcagtagacatactgagatgcaaaagcctcgttgatttcgaaaagatcaatatcatccatctgaaggccagcagctttcactgctgcagggattgcaacggcaggaccaatacccatgacagctggatcaact

SEQ ID NO: 15043 - DNA, 554 bp, Zea mays
  Clone ID: LIB3279-222-Q6-N6-D8
aaagaaaaaaggcctatgtacattcatttgacagtatccgaactccaaatgggaacaaaggtgcaaatctaccaaaaagtcacccacatcctacaaaacaaatctctccctcgcggcaaaacatccccagcgaacagcctcccatctaaacctagcatgccactcatttgctgtcagtgaaatctgcgtctattacatcgccatcgtcacctggcttctcagaagtgcccgccgctgaaccagcagaagcatcagctggaccaggtccggcgcctggggcaccctgctggctgtagagggactgcccaatctgcatgacttcctggttcaatgcactaatggcgtccttcatcgtctgtgtggagccaccagcaacagcatccttgagctcttgcagcttcgactcgaccttccccttgacgtcgcccgggaccttgtcccctagttccttcagttgtttctcggtctggtagatgaccgactcggcttggttcttggtgtcaatggcatctctcttctccttatcctcctttgcaaacttctcagcttcgtcg

SEQ ID NO: 15044 - DNA, 593 bp, Zea mays
  Clone ID: LIB3279-222-Q6-N6-D9
gctgacaatagaacattatattagcactaagaggattgccacaacttcatcttaaaacaggtttatgaacaaagacatgtataaagtagccagcaaattcatggcgactattccaatccatttccacactcaaaagttgcaacaagtccaaggagaaaaagagatccagacaatgataactcaagagagagtccaccctagaacaacttaaatcgtgcaaggcacaactcctgctcaagtccaagactcatgatcctttctactcaatcagatcatcatcgtcatcaggaagaggttgtgcagctgctgcagcaagctcggcttcatgctgctgctgcatagccatgtcgatggtaacttccggaggcttaagagcaacagcttcaacaaagtgaaggttcggatcaccagccagcttccttgcaaggtacaggaaaggtttctcaaagttgtagttgctcttggcagaaatttcatagtactgcagattcttcttcctgtggaaagtaacctgcttggctttgacctgcctgttcttcacatcaaccttattaccgcagaggacaatggggatgttttcacagaccctgcac

SEQ ID NO: 15045 - DNA, 581 bp, Zea mays
  Clone ID: LIB3279-222-Q6-N6-E1
gcacaacagttcaaatataacatatgcagcacaaaatcgttcgactgctatccgacaagcgaacaaggcgcccagtagaactgaatgtacctgtgatttccagcactaacttacagcaacgttgtgaaaaacaaaaacaaaaacaaaaaccaaacggcagaaaacagatgtattgttctactacagttacaccaaatattttctggtcctttcagcaccaacaagagccatacgcatatctagaagacaaaattcctctaatttcaccccctacttggtagcagttctcctcaacacagttcacgtgctagcgtcgagttctttgggccgccacatcgacttctcgacgcagagcaggccctcgctgcccttggtgtaggtcatccgcacctcccactgcacggacttggccatgctctccagctcatttatcgtgtccgcggtgtccctcacgatcagcttgccctgtggcctcagtacacggtcgacctcggcgaaaactgcagccagtttgcatctctttctgagctttgagaacaggtggtccgcgtgcagaaggtcatacgttcttgggtaagtgc

SEQ ID NO: 15046 - DNA, 487 bp, Zea mays
  Clone ID: LIB3279-222-Q6-N6-E10
aaaagggattaaacccatccgggggcaaaaaagtttggggtccaacaaaggggacacaacgggcccataaaaccaacgaagccacacccacgattaaggacacaaaacccacagttgtttattaaacaacaacaacccaaatccccaggaccagaagcagttaaaaaaaaccagggtttactgaccaccacggggggggaccaccagggggaaagggctctcctttgggatgttgaaaccggttagggggcaaccatcctccaattgtttgccaaaaaaaaaaaaccctgttggttgggggggaagccctttttgcccggaatctttgccttaacgttgccaaggggggcggacctttaaacccccagggttatggttttgccagaaaaggtcttaaaaaaaatttgaaaaccacctcgaaaggggagcaccagggggggggggctctccttttggaagttgaaaccgggaagggtacggccatcct

SEQ ID NO: 15047 - DNA, 558 bp, Zea mays
  Clone ID: LIB3279-222-Q6-N6-E11
agctaccatcattttatcaatcaatttatagcaatcaaatcgacgaacatataataatagtaatacaatagccccttcgggcaatggcaatggggggctcccagctgccttgatttgcgctaatatggaacgaatcatgatgacacaaatacattgggaagctccatcagaaaagcgagttatatgtcaggaaggggcaggcaatggacgcaacacatatcaccagggatgggagcagggggacgttgagaagcttccccacgcccaggtaccccgccgcagtgatggggcagtcagcgaccaccctcgccagggtcccggcctccgtcgagaggaggccaccgttgtatgtgccacgggagaggcgagatgacatcacgcttgataggagggaaaggttcacaccttcaagaacttctgcagaaacaaatgtgacaagggctgagacaacatactggacaacagagtatgtactcgtaaccttgaagctgaaaaaatgcctactagcaacgtaatttgcgagaccatgagcagttgcctgtcctcaaacatattgct

SEQ ID NO: 15048 - DNA, 580 bp, Zea mays
  Clone ID: LIB3279-222-Q6-N6-E2
aataaaaaaaacagttcgtgtgtatacttgcttatactagttttaaaatcattatgtccagtaaaaaagtttcttaatgatactagggcatgctttacatcaacagttcttctaagaaattttcaaaactacaagtcttgtgctttgaggtatattggaggaagccagcgtcctgtgttttttttcctttgttctgaagatgaaagattccctcacgcatcttcgaaattcaaccgcgtgtatgtattacatgtcaaagtcagagaccagtccaatcgacaattataatactaattattaagcttctgttaactgttaaccaagtatatactactcgtatatgtttttgacaataaaacctgtgtgatggcagtatgacatgcattcaaagatctgaaaaggatatgcaactgcatctatctatcggtaatgaatgctgtctttggaattagttgggcattcaattcgagtgccactctggttgttcgttttcagacggcgagtgcagcaggctggcgaggcgagaggcacgagaccatctggggactagggctcatgtgaaagacgtttgaataaaatt

SEQ ID NO: 15049 - DNA, 576 bp, Zea mays
  Clone ID: LIB3279-222-Q6-N6-E3
acaaaaaaaaaacggacgcttacacacgccactgacgaagcaatacatgatacacattgtgagtttgtgacactgatacccacgtacaacgtttatttatttgaccatgcatccatgcatactgacggcatggatggccggcgagcatccatttctactctgcgtaagcagacggcagcagtctgggtgctgggcggaccattaacggcacggcgcgctgcagggtgagcccgtaggcctcctccatgtccagcttgtccgcggtcatgccgtcggcgaggtcccagtccagggcgtgcaccagcgtggccgtcatgagcgtgaccatccgcagaccccagctgaggcccgcgcagattctccggccggcgccgaacgggatgagctcgaagtcgctccctttgacatcgactcccgcgtgcgagccgcccgggaggaagcgggcgggccggaactcgagaggctcgggccacgcctccgggtctcgggcgatcgcccacacgtttaccagcagcgtggtgccggcggggatgcggaacccgtccactcgcattcttggcggcgacgcggggcagc

SEQ ID NO: 15050 - DNA, 574 bp, Zea mays
  Clone ID: LIB3279-222-Q6-N6-E4
atgtataattgcatacatttattcatgacataatagcgtcacgcgcaacttaaccgatagaacataacggagcacaagacgagcaaatagataaaacgagtcccttgtccaggatcccaagattatgcgcctgtagtaatggtaagttcccaaaaacagcaccagggaacccgtacgcaaaatacaactcaggacatcatatgtcatgacgcgacattcttaaaaactccgcaacaacagaaactctctcagttccttccttcctggacacgtacaaaagacacgagcaagcgtgactcgggtgcggcttcagacttctgctgccttcggagagttctcgggcgtcttcagcggcagttcctgtgccttgcttgtcttgtgagactccaccgcatccttgaattcctccctggtggccgtgtccttgaacttcagagcaaatgtagcgaggctgctcggcgactccccaatgctgttcatacaggcaaatgtcacgcccttcttgtccatgtccttgagcgacatgtcgttgtagaggcttgcattcaggaccagccggtagttgccttttgtc

SEQ ID NO: 15051 - DNA, 565 bp, Zea mays
  Clone ID: LIB3279-222-Q6-N6-E5
gcgagaatagacacggatataagaagccaacgacggcatcacacgattacaggcgaacacaccaatcagcacaaacatcaccaaatcctttattctagtcactcagtgcagatgcagcctactgctagcagggcactgaacatcaccatcccgtcgtatggattctggtaagggaacagtatcccttcattcgatcttgtcgcagtcgatgtcgggggtgatgttgtaggacagcgagaggccgcagtcgccgggcagctcctgcgccgcggagagcacagcgtggacctgaacgtaggccgccttgaggcaccggcacgtggcctgcctgtcgggcctggtgtccgccgccgcgtacagggtcctcacgccgtcgcagcactggttgttgctctcgctgggtttggctgccttgccctgcaggaagggcaggcacggcgacaggtcgttgagcacgtcggagcacgagatgtcggccaccgcggactggactgccagcatcgccaccaggaggacgactgcaatgcccgagctagtagtcttcatggctgcgcttttctctttc

SEQ ID NO: 15052 - DNA, 494 bp, Zea mays
  Clone ID: LIB3279-222-Q6-N6-E6
gggggaaaaggggccaccccctggtgggtttccaaaaatcattacccttttttacaagggaaggggcgtttcccaaggggggggcccctttgaaaaaaccggccccccctggggggggccacaaagggaaaattttggaacaaataaaaaggggcaacaacccccaaatttaggaggggggggaaacattttttttagggaagaccccggaagcccggggatatgcttgaaccggttcctttggggcaaaggggttcccattcgggggaagggctgtaagtaacaaactcccagccccaatttgagagggatcacgggggcaaaagaaacaacaattcactcaattcagctccttttttacttaaagatcaccacttcaacacacgttatattttgttgctggggaccaaaaattagggcacaagggagggggctgcaaccttgataaaaaaaagggttttttaccaaaaaagatgagggcccaaaaacaaaaa

SEQ ID NO: 15053 - DNA, 607 bp, Zea mays
  unsure (1)..(607): unsure at all n locations; Clone ID: LIB3279-222-Q6-N6-E9
canaccaacctttatatacccgacagttcaaatgcagcaatagtttgaaacgacaaatccgtaggctcagcaaaaatcaaaatcattagacactataccctactataacatgtcatattatacagaaacagcaagaaggaattgtaacatccagtgatgctgttctttttgtttcactacggaagcttgccagatttgagagcctcaaagcgtgcagtgagagtttcatagtcaagaggcatatttggatgaacacgagaacgaaggtttgtctttggcaattcagggaaatcttgatcatgctcttcgtcttctgagtgacggttttctgaaaacagctcactcttaggaggcaatagcctttccacagactgaatctccacatcattttcaccttcggattctgaacacagtccctcagaatcatcaaactttatctcggagtgcaccttccgagcagcacggcagttccttctccgtgtcttcgtagagtccaaatctgcagggtagccgtctttgtcatattctacatggttctttccactgaaccttcttgtactgtatgttttcccttcatgaggtttttgttcatcaaaggcatttgcat

SEQ ID NO: 15054 - DNA, 573 bp, Zea mays
  Clone ID: LIB3279-222-Q6-N6-F1
tcgcagccgcgtactaagctggaccctagacggcgcctttttttttttttttttttttttttttttttttttttttttttttttttttttttttttttttttttttttttttataaaattataccccggtttcgagggggaaacgtctcttaacatttacgtcatttggggaaaaaaagggaaacctatcattccgctaaaaccaaatttccaaatgggaacaagggaagaatcctagaacaatacaaccccccaattgcaatcatcagggggggggggcaactgcccctgccagtaccttgggcagcacatgagccaggatcccaaccgggcaaaaaagcaggcacagggagacaaagggcctggtctcaacgttgttcctgaggccggcggggaacacctgccttgccccaaaaagggccactgttaggagggggaaccacgcgggaggggaagggaattttgttcggaaacatcctcacaaagccccccaacttagggagccagtacttgctaacaaacatggcgcccagggggtcgggggtccaagacaggtaaaacaggtaggcgtaa

SEQ ID NO: 15055 - DNA, 563 bp, Zea mays
  Clone ID: LIB3279-222-Q6-N6-F10
gaagaggaactgacaaaataatacttaaacaataattaacgccatcatacacacatgcatccatatgactagtaaatatttaactacagttaactactactacgccatcatagtaagaaacgagtgctccctctactttagttgaacctgagaaacagacagcggagggaatatcgatcgatgccatgccatcctataatatgcacatcactcgcctacaacaaatgcatatctacgctgtctctcttcacgatcccatcctgctcagagcgcgacgatggggcccgtaggcctgcagtgcgcggtgaacagcctcgcggagaagatgcccctggccaccttcctgagatcgaacgcagctcccgcgcggggcgcaaaggaacgcttcgacggtcccctgctgatgtgctcgcgcagcgtgaggttctcctgcctcatcacgtccatggacgacgccagctgcctgatcacctcccgcttctcctcgtccttcccggccagctccgccctgagcgccgccgcgctctcctcggccgccttctgcagcgccgcgttctgcgcct

SEQ ID NO: 15056 - DNA, 548 bp, Zea mays
  Clone ID: LIB3279-222-Q6-N6-F11
gcgaacaaaaccttgctcattcttctctcgtctcgtttcatagcgggagcaaccaaagggaacaacaggggtaccaacacctaatccaaaggtagaacggacactaacacggtgacagaagcgaacggtaacacgatactatagatagataagataactcggccgaagccaggatgggcccacacatcagtccctccagccgccgccgccgccgccgtagccgccaccaccaccctcgcgccgaccgccgtagccgccaccgcctccgtagccgccgccaccaccctcgcgccgaccgccgtagccgccaccgccgccataaccgccgtcacggcgcccgccaccatagccgccgccgccgcgaccgccgccgtagccaccgccgccaccgccaccgccacgggactgggcctggttaacggtgatgttacggccgtcgagctccttgccgttcatgttctcgatagcgtcgagcatggagttctcggaggagaaggtaacgaagccgaagccgcgagacctccccgtctcccggtcggtgatgacct

SEQ ID NO: 15057 - DNA, 595 bp, Zea mays
  unsure (1)..(595): unsure at all n locations; Clone ID: LIB3279-222-Q6-N6-F2
aaagtagattatgctattgcnatgaaaacaatggcaactcctagcgacaaaaagctgattgtacgaatctcagatttgttctcaagtgatcatctcgtcgctagcattcgtctaaaggcgagctaaacaatggcagtacagagcaaccacacatgcgaaaaggtagattaacaggctcatcggatcaccatccacgactactctacttatcagtagtaggttgtgccataataaggttgagctgccgcaggttgttgaggataagctgacggcgctgtaggtgctggtactggtgctgctggaattgctgcaggctgtgggtagctttgttgtgtataagcctgtgcagagtatgttggaggataagcaccataggcagctgcttgaggagcaggctggggcatttgatggctgtagtcgtaagttccatatgcaggatatgcagcctgctgtgcataagaagctccccattgttgcccagatgcttcagaagttgcaggccaaacaggaggattggaagcatttggatcagttcccgtggctgactgagtaaccacagttttagcaaatttgtccctgtctgagacaacagcgt

SEQ ID NO: 15058 - DNA, 412 bp, Zea mays
  Clone ID: LIB3279-222-Q6-N6-F3
agtaaatgtggatggagtgatgtattggctaacagaagataaaggaacaagctgtggcatggcagttgtatcgtttgatctcagggaagaaagtttgccttgattcatcttccagcattggaggtgaaagagacagcctcttgtgccaccatcaaagttgcttactatatgactgagatagatgacaaagtgtgcgtagtgactatgccataccaaagccatgcaccgaggtggcgccgaaacaacgcagagctttcaggcaggactgacatttgggctcttgaaagtgacaagtggttcctgaaatatagcatccagtcaccatctctatctcggtatgttcctcagccatgctttatccacagggagaagatcatactgcaggacagtgaaagtaatgtgtggtaccatg

SEQ ID NO: 15059 - DNA, 511 bp, Zea mays
  Clone ID: LIB3279-222-Q6-N6-F4
aaacgatgctcataaatatcagggagaaataaagtaacagaattacgttttttctacttatattaagtatcacaacaccgggtctccaccttctaagggtgttatagtagctagttataaataatacatttagaaatggtaaaattcctggtccaaactggcttcaacaaaaactggaagacgcgacgcgagtgttgcttcccagaagcccaaccgttcgagtcatttcttcagcaactgtttcaacacatcttctgcgtgccgctccatcttaggtagagcccagtcatgctgcatgatatccaggctgtctttctctgctcccaaactcattgttgggttaaatccaaatccaccacccatttgcatcatcttctgtgcatcatcagttgcgttttcttcaccaaggatcagactgaaaagacccctcaagccgaataaattgaggaaataccatgaccggctactaacatagctgacatcaacagtgctcaggtcaatcccattttgc

SEQ ID NO: 15060 - DNA, 591 bp, Zea mays
  Clone ID: LIB3279-222-Q6-N6-F5
aacaaaatgagatggatgtatattaatatgatcaacgactattcattttcagtagactactttattggatgatcatatccacactccctacaccgccacacatggggatgaaattaaatcgaacgagagtggcagcagctagcgatcgagctaggctaatcgtccatgtcgggacgaacaaccagatgttagctttgtacgctagccacttttatttttatttgtggacgtacgtatactagcaagtagccgcgcgcgctgcgctacgctacttttagcaagtagctgagctgagctagttgctcgtactgatccatgtcctgcacttgggaccaggatagccgtggaagatgtctcggcattggaagcgaggagggtccgaatgatacagaaactcgcaccgttcgcagttgctcgagcacgactccaccttgtccaggcacatgcagttggggatgtagtcccttgtgcaggccacgctgtcgcagcagtcccacggcctcggtgtgcagaccgggggctcggtcaggcttaagataaagtcaccgcagacgaagccgtcgccggccggcgacgcctcgcagtcctggc

SEQ ID NO: 15061 - DNA, 574 bp, Zea mays
  Clone ID: LIB3279-222-Q6-N6-F6
ttttttttttttttttttttttttttttttttttttttttttttttttttttttttttttttttttttttttttttttttttttttttttttttttttttttttttttttttttaaaccggggagaaaaagtttaaaccatggggggggggtaagggaattttttaaaaaaaaaaaaaaaattccccgccaaaaaaaaagggggaaaagggaaaggttttggggaaatcgggaaaaaaaaaaaatgggaaaggagaaaaaaaagggaaggcccccgggttccaggcttttttttaaaggggggggaaataaaagtttttaccccaaaaaaaccaaaatttataaattgggggaaggaatttgttccgggtttaaaaaaatccaaattttttttagaaggaaaaaaaaaaggggttaaaatttttactcgagaaaaaaaaacaaaattggttaaaaaaaaaacgggggggcacggggggggtaaattaaaaaaaaaaaaaaattttttggagccccaaaaaaaagggggggggggggcccccccccccaaccccccgggaaatattttttggggg

SEQ ID NO: 15062 - DNA, 577 bp, Zea mays
  Clone ID: LIB3279-222-Q6-N6-F7
ggcgatgaactattatcacaagttgaaccaaagaagtacaagcacctgatatcggatatcccatgagtgaatctaaagggtaaggacgagaaaaaaaaagagataaaaagctaagaatatctaatcttataccttgctatcagtgcactggtcaccaggttgagacttgagaatctaaaaaatgttttaaatgaacatgaacggtgaaatacactacaactgatcacaacagctgtttttccttctccgttttcctttactttttttttatcctcttgcctggctccttcacataccgcgtggtttcagtaggagttgtttagctctgtaggaaccgagaatggagcaagggtgtttgaatggattggaaacccaccccctcggagagagaccgagggtctgctccaggcagcagttgtcatggcgtttgaatcgaaaaaaccacaatgacagttatatcgtcgtggaagtgccgcctcaccccccgatcaactttcttgaggtctgaataccgcatctccctcttcttcgctgcttcctgcactgcagactttactaactttcgtgcgattccatt

SEQ ID NO: 15063 - DNA, 580 bp, Zea mays
  Clone ID: LIB3279-222-Q6-N6-F8
agctaaaccaaccactgtatacataagtattaagttcgaatgtaggtcgccgacaagaacaagcatacaaattcaaacgcattcacaagttacaataaacaaatgaccaatcaaacaaaggccgaggcataaccacatgaacccagcaaagtgcagataaaaggtctgctgcactgaagtccatattacacctgggacgaaaatgcaaaagagaagagtatgttggtggtgtacaatgctttcaaggtaagggtgcccatgacccaatcctgctcaaagatctgccacggtacacagcatactgaaccctaaagtgttcagtaaactgatctacttgtcagcatgtcgccgcttgtatctcttgtggccatggttaccattactactacgaggccttttattctttttggagcagaaggtccctactagaagcctgtatataatgaagacaggcagagccagcaaagcagaagccaggaaccaaactaactccttagttgccaatgattttgttatatcacgctggtgaaggtagtccatgatgcttgcttgagcctgtcgatggtatgtggttgccgac

SEQ ID NO: 15064 - DNA, 509 bp, Zea mays
  Clone ID: LIB3279-222-Q6-N6-F9
gacaactgaccaatggattccataaaaacctaggccgagggcatacaccttggggcgcttcgtgtatttaacatattacacgggtcgttagaagagaaaacttattggtttgatcgcaagggggattgccccacaaactgaatatggacctaattcattgcggacctcacatatggcgcaggatgactgcgcacctatatgccttacttcggacggcgcttgctgagcatggaaggacttgatcttacctccacgaacaacagcgtgccacctgctgagaacggcggctctgcaacgcaatcaaatggtttatctgccaaccaatctcttgcggaaactccgatcaaagtaagaatacaactcacttgtgttttcagcgcatagcttctttgcccatccatccaggacatacggatcatttacagctacacagataacagagtccctttcttttgctttcaacttgtcaatattcttcttgtaactaggaacgtgcgcttgagaacaaa

SEQ ID NO: 15065 - DNA, 551 bp, Zea mays
  Clone ID: LIB3279-222-Q6-N6-G10
ccatggcatgcatccttcatgttcttagggcatgcttctttttaagaaaagaagaaatgaacataaattgttcagcaggcatctggggcccacgagacaataaaaacagggcccttcacttgttagaggaaacattttattcaaaaggacagattaaaattgcagacccaggaaaaccttcaacaggacagcctctgcattccgatgatgcttttatccaaaaggctgttaaaagtcaagtggttgcctaaagaacgcctccatttgcttcgccctgttcctgattgagatatcaagcaccttctgcccgaattcaatcactaatcctcccatgatgctgtagtcaatcttctgttcaaccaaaatagttttgttttccccaaggatatcctgcaaggtttccttgagttctttctcctcctccttggggagggaaataactgtcctgaccacaaccttcatctcccccttatgttccatagtcaaatcaacaaatctctccgcaatgcgttcaatatatttcagcctgccattgtccgccaggacagcca

SEQ ID NO: 15066 - DNA, 582 bp, Zea mays
  Clone ID: LIB3279-222-Q6-N6-G11
ctcggcctcatcaaaagcagccttttctgcctccttgtgcttgccccaagtctcctctgcaaaagtcttggccaacgcagggtcatcagtgatgatgatgttgtcaaacagagtgcccgatttaacctgccacagctcaatgccaatgtacttcaagctgtcgaaggcgtaaatgtatggatcatccttaaaatctgggttgtcaatcataggtgccttccatttaccctggtagttcgggttcttgattttcttttgtttccatggtcccttgtattctgggttgggaatggtaggggcagtccattcaccatcttcctcatcgtcccagtcctcaggcttcttagcatcagggtcaggaatttccttgggaatatcatcatagccctctggcttcttgtcctcagggtcaggaatgtactccttgtcatcccagtcctcaggcttcttagcctctgggtccttgattttcttagggggaagaatatcccagtgctcgtagatgctgccagtttgcttctcttcattatcaatgagaatgctgtatgttgcatcaggacggatgatcaaagtgtaaacatg

SEQ ID NO: 15067 - DNA, 566 bp, Zea mays
  unsure (1)..(566): unsure at all n locations; Clone ID: LIB3279-222-Q6-N6-G2
aaaaacagaagattgaagggcatcattattatcagaaatcatgtaatgtgactgatccaacacagtgaagtagccatctactgggtagaacagaaaccatagtactagcagaacccaatcacatgcatgatccaacataaccaaggtagatactagtagtagctagaacggacacatcaagatttgcgctagggcagtagtaagagcactgtagcagagatccaatcacttggagacttgaggctagtgactgcaaatctgtagacacgtaggtagctaggtgacgatggctaataaggagtggaagcagagaccatgccatcgatgtccgacttgacgttgctgaagacgttgtggagcagcacgaagatcaccactgataagttgctcccgaggccgtggccggcgagcgcctgaccgtcgacaccggtgaggtccaccttcctggcgaacaccgtgcctctgtcaagaggggtgccgccgnaagcgctcgacaccatcttgcgcacgatctccagcttctccatgatctgcagcgccatccaccacttggcacaccccccctc

SEQ ID NO: 15068 - DNA, 579 bp, Zea mays
  Clone ID: LIB3279-222-Q6-N6-G4
gcaataacactatatggccatttcaagattaaattacagctgtaagatgaaacagtggatggaatacagacctaagcttcagacattttgaaaacatatagcacttgatgattctgcataccagtcatctatatatatagcctataggcaagatggaaagtgaaattaaactgtaggacacctgttcatccataaacaggcaaagatacatgtagagtgccagcactcggcagtcttaagttacaggtatccttgccttaagaacataaacatccggaaatagttacaacttactactacactgattacccatgccagcaaaaggaaaataataataataaacaggagcaaaatagagaacactacacttgctgcgcctcaccaaagggggggagagcaccaccttcgcttgttcggcatacatgcatgagctagatcatggtggcgatcagatttgctgacggccggtggcctactaggacggctgtatggccagtcactggctggaaagctgcagctgactcgagcttctcccacgtaagtctacgcttcgcttctagcgacgcgcgtttttcttct

SEQ ID NO: 15069 - DNA, 583 bp, Zea mays
  Clone ID: LIB3279-222-Q6-N6-G5
gcgataataggatgcttcatttcttagaagctagaaatagtactcaatttttccacaactgaatgtaatataacaccatcagatgcagcgaagaaacaagaaaaagctggtggcagtaattccaaaaatcagaattattcttggcttgtagcaccgtttgtcgcctcctccatgggatctgcttctgctgcatctcctttcttgcctttcttcttcttcccaccacccttcttctttgatttcgtccccaaagcaagccatgcctttatctctgcattgtcttcaatggatttggtgggctttaactcctgtagaggatgtgatgttatcttatctgatccattgggcatcagcagcacagtgaactttatgtgtgcaacaagatcgcctggcttctcatgaagtacagggtacggctgcaatagttcatggttcatgcattccaccaagcctaaacgcgcacgcttctcttctaatgccctagcagtaaaaggcatgattgggaacttctggctgatctcactgaaaataaaccttgacgctttcatcttcaagtgataattcttgtctacggcccttttgt

SEQ ID NO: 15070 - DNA, 572 bp, Zea mays
  Clone ID: LIB3279-222-Q6-N6-G6
aacacttaaaacaccatatctggctcttatgttcataactcttgatcagataaagcaaatccttacattacataagcaagccagaacatcctcgggactactgcttcaaccaacttaatgatctggcttcgttgaaatgtcttatttgaaatcattgcctcacttgggtgcttgggatttcttttccagatctgtagggcttaaatcaaggagctccacaaaatgcagggcctacaccaacgtcctataatgccaaatctgttccacaaagacgaggtgatgccaaatctgtgtaattagagttttatggttctggacttcccgcatcttacacaaaggggaaacatttctcatccccaacaatagcaccatgatgtgtgcatgtgtgatagaggtgagggacggtgcaaataatttaagcacagtgaaacaagcttggtgaaagacagaagagatttgattttgcaccttagtaatatgaaccggaaccgctacctccatagtagccaccactgctgctacccaaattgcggcctgagtaaagcgaagaatatgaactcccaccaacatca

SEQ ID NO: 15071 - DNA, 572 bp, Zea mays
  Clone ID: LIB3279-222-Q6-N6-G7
gcattacttctgcaataatgagcactttcataacatcagctttcaaagaaagaaagaaggaagacactgttcttctaattgttagtgaacaactttacatgttgtaacaggtcatagctaccaaaatactttcactgccattcttgttctagaaattgcagtatactactgctataataaacaagggttcatagtcactagctcgccataaaatggttgttatagtgtttggatacgattggagaggtacagtaggcagctaaatccagagtgatgtgtagcaactcatcagtgcaaggcttatattaagcctcgtgtgacaaattctagcattcttttagctcagatcctttcatctggatgaacaagttatatcaaggtgttaacaaaaccaggcatgcaccattatatttataaaagtaaggtcattctttcttgcctttgactacctctgtaaatgcacggcagaattctataaactgaattgcagccccagtatcctcgtcatcaagctctgcgcctgcaattttagtgactggggtacccctgggtcgcacagttttactattgag

SEQ ID NO: 15072 - DNA, 583 bp, Zea mays
  Clone ID: LIB3279-222-Q6-N6-G8
ggtaataaaactagtttcgccatttataataaatgtagtgtcgtgtcatcaaaaatctatgtgacatactaattagtgtcatgaaatctctcatgaaaatgccacttagaacacttgaaagttaagaaccagcagagttgtttgggccggcccactcaaagcacaaagcagaggccagtcggagtaaggtggtccactggagtcattccacgtggattgactttgactcgttgaaatccaaccccttcagctgcagcacagcgaccgagccatctccatttgaatttcaaattcccctctcctcctcctccctcactcacccaccgcgcaccctggccattcaatttcttccctcctcttccctttctttttttccccagcaccaccaccaccaccaccaccagcagtagccaggatggggtgcgtgtcgtccgccttgctcgaggaggacggcgccgaggacgaccgccgccgcatcatctcgcaccaccacatcgtctccctcacctcctccacctacggcatgaggttcctgccctgcttcgactgctcggggagccgcaagctggctgtcgcgcttccc

SEQ ID NO: 15073 - DNA, 511 bp, Zea mays
  Clone ID: LIB3279-222-Q6-N6-G9
ataatctacaaccgtttacttagtatgccaacaggtattacagcaaacatgggatacctgcggccgttgcgagtgccatctatacattcatgggcgctacacgcgccggattttatgtgccgtcaaacacgacgccacaataacggatcaggaataagcataacgaccacctgcacctgtcgatgcattcgagtcccgataatttacaagagctactataaggggccaaataaagcctgatggtaggccatgtaacttgtgctatgacttgagaggcgtccacaatgactctcgacacacccacatcacgatgaactaagatcttattgacaaaactattggccaagagcggtgaatgcttagcattaaaaagtgacaccctggcttcaaatatacggaggcctaccctggacacatgaaaacatactcctttgtcagccattacctgtgaccgaataaacaggtcttacagacttcggagcaaacatctgtgatggactgacaaactgaa

SEQ ID NO: 15074 - DNA, 576 bp, Zea mays
  unsure (1)..(576): unsure at all n locations; Clone ID: LIB3279-222-Q6-N6-H1
aattgtgncactgaaaaccaaaaccgcatataggtctcnaaaaaactctaaacattggtaaaacaagaaccgatacgactgccagcgacataaaagtttccagcgcagagtgcaccaggatacaagctcagttcaacggttggccttggcaacacgctcaatctcgtccttcttcttgatggcgtaactgttggatgagcccttggcagcgttgatcagctcatctgcaaggcactcggcaatggttttgatgttccggaaagcactctccctggcaccagtggtgaggaggtagatggcctggttcaccctcctcaggggtgagatatccacggnctgcctcctcacaacaccagcggaaccaatacgggtggcatcctcacggggtccactgttgatgatcgcgtcgacgacgacctggatggggttggcatcggtgagcaggtgaatgatctccagggtatgcttgatgatgcggacagncatgacctttttgccgttgttgcgcccgtgcatcatgagggagtttgtaaggggctcaacgatcgggcactgggccttgcggaaccgcttctt

SEQ ID NO: 15075 - DNA, 572 bp, Zea mays
  Clone ID: LIB3279-222-Q6-N6-H10
cgtcaacatcgattataacgtcaaaacaaacgatgttcagggcatcgagtatttcatgggcaacaagtttactgtgccgaatcactaagttcaaattcacactttgatggtactcaccagaaatttattctgctcagagcaagcgcattgctggcaaatgacacaagaaaccagtccctacccaccgcggcaaaatgtgaaatgacgttagccaggaacagccatccttacgccttcacttgaggaggagcatcgccttgaagagcaggatcagatttgacagcatctagtgccttgaagaactcctcaggaagagcaacaggccggtgctgaggaacatgcttaggaattggggtgtcgtcttcaatcacctcacattcgtagtcatcgggaacaccccatggatcccattcaatcattttagcgatgagcttgagctcgtcctcggcctcctcgatgagctcctcgacctgcccgcatccgattcggtcctcgatgcgcttccagtcctcctcctcctggcagatctggaggcggtgaccggtgaaggattcaacggccttgcggtaacc

SEQ ID NO: 15076 - DNA, 530 bp, Zea mays
  Clone ID: LIB3279-222-Q6-N6-H11
cgccaagcaatggatttttcatgtttcagcaaaggtctagatgcaacaatacagacgcgatagtcagacttttacaaactaaaagcttaaagcctgcgcatcccgggtgtgaatatttctgtcaatccagcatcatcagaccactacgaacgaatgaaatctgtccaagacgggggagccacctccaatgaatgaaaccaaccgagcacgggctatcttccacttccagagggcagcaatgagttgtccgatccctggccgagcagggacccaggcaaaggaagccacgggcctcccggggcggcagcctccttggcaatggcttccgcgagggggacaaggccccccggcttgtcgtaggtgaagtgcaggtccctgttctcagccaaggccatgagctccgactcgtccagcccccgcgcaggcccgaggctacacctttaagccccgtgcttggggagcgcgtccttaaacttgttgatcgttgcgttggtgcagctaaagctgttgacccggccctcggttccccg

SEQ ID NO: 15077 - DNA, 249 bp, Zea mays
  unsure (1)..(249): unsure at all n locations; Clone ID: LIB3279-222-Q6-N6-H12
ctcctgcgccgccgcccccgtgttgtgcggctgcgtcgccgggtgcgcgccctatatggcctgccccgcctctttttttttttactccnncnccacccatattcggggttaggagggcatcttcctccccctnnnnccccttcccctctgcgcctgcatcacccccctcgtgtgcagcctgtacttttgtagatggcttttcacctcatccttcttcattccctccacccttctcacctcgctatattc

SEQ ID NO: 15078 - DNA, 521 bp, Zea mays
  Clone ID: LIB3279-222-Q6-N6-H2
ggataatccgagcaagtaaccattatgcaggggccacatcgggagctagcaatggattagtaccggaatctagctgatctgataaagccaatcaactttgcaacaacacactacagacgttataaggaaaactttaaacataagcatgcgcggggcaacttgagataacattggccaaagcatgccggtaccccattccactggtttggtaaaagatatggatatgaaggcactgccactagcttcgggaagggtgtgaaagggaggcacgagcctcacttccaaagcttgcgcagggacatgttcttttccgggtcttttttcatcaccttggccactggcatttcgaagacctcctgggtaacgggcacccttttttcacgaaaagcaaacattccaacctttgtgcaaacgggcttgagctcaactcctgaggccccattcattttttccgcgatctttttcaaaacaatgccacccatcaagttcatttttcttgaatggatcttcaaaaatcgaaa

SEQ ID NO: 15079 - DNA, 582 bp, Zea mays
  Clone ID: LIB3279-222-Q6-N6-H3
agcattgcgaggggaccgctagaaagaaatcgtttggccattgttagggacttcacatgaacgaacagctgcctgccgcacttcacttcatcatagtcatagaggctatgacacaaacaggacggacgggatctttgtacatgaagaacgatcgatcgcctggtggctacttcctgccgaacaggctgcgtagccttcctcggtccagcttctcgagcagcttcttcgcgccggccacgtccttctccgactccgagagcttcttcaggtacccgatagcgccgtgggagatcatcagcttcttgcaccgcttgctcgtcgaaagcgccagcaggcaggagatggcgtacttcttggccgtgttctgggggctcgggtccagcagctgcaccaggttggccacgctcttctcgtccttcttcatgtccctcgcgttcggggggcaccccatcaggctcgccaccgcctgcgccgccgcctcacgtgcgccgttcgacttggcctccagcagccgcaccagcagcgggatgcacccgtgctcgcccaccagccgcttcatgtccatggagctcgacatcttgc

SEQ ID NO: 15080 - DNA, 246 bp, Zea mays
  Clone ID: LIB3279-222-Q6-N6-H4
ggcaaggggaaataacatcatcatttcactcataaaaagcagtttcaagtttactttcacgggcaaaaagcttctgctaaaacatccaccaactttcgggccaaccgcaagttacaaaaaaaagctttgcaggggggattacagaggggcagcaaaacccgacctaatatatgggaaccttgttcccccattactttctagcgattcttttggtcggggggccccttctaacagttggggtcatat

SEQ ID NO: 15081 - DNA, 433 bp, Zea mays
  Clone ID: LIB3279-222-Q6-N6-H5
gcgtccttgaacgaggcaaattggtttttctccaaaaattcaagatccacaaatccaacactgacatgtctaatagcttaagggccaaaactacataaacagcatgctctgctaatgataaagatgccctagaggttcgacccgacgttgccatgtatccaatcaaacctcctggacgctcaagcctggggggagagattgcttcaacttgtttgccttctcagcgtcgaatacccgaagggggtacaagtacttggaacagcggaccttgaacttgacaacatccttgctcctcttgatcttcactgatcgggcatccttcctcctcgcggggagaaggaaatccttgatctcggggatctgcttcggcattttctcgcgacacctggaagtccccgagcttttttttttgcgggggggggtgggatcccac

SEQ ID NO: 15082 - DNA, 564 bp, Zea mays
  Clone ID: LIB3279-222-Q6-N6-H7
gacacaaacggccctgcctccatttggggcaagcacagtcccctattaactgagccaagtcagatatgtacagagtggctgcatatgattaaggatgcatgcaggcactaaacaagtttctaaagcaccaccggaaggcttgcggttccaaatcagttcaggcacttccaaaagcttgagcaaagcatgaaaatggaggacatgggggcataagattaactggagctgggcactggctgaaggtcgtcaggaaggtcgcgtcggaagtcatttgatgtgggaatcatacacactgaagatgacgtctgggacaatcagaggcagcttgcttatgtacatgaacagccgtctgaggttctcgctcgacaccgtctccatgtcaaccacatcttggtcctcaacatagatccacaggtcaccaggacaggtcttcttcaggttgtcacggcagaatgggcaggactgcgatcttgaactccagtcctggtaacatctgatacacatagcatgggtgcagttgggcaacacaactttgctgttcatctccatgcaaatcccacactc

SEQ ID NO: 15083 - DNA, 570 bp, Zea mays
  Clone ID: LIB3279-222-Q6-N6-H8
gtccatgaaacaaccattcccacgctataatttttgtacataggcaggatcctttcaattcatgagaagataggtcaacaaccgctacattacgacagccaccaccatgagcaaccggggctcttgatcggggcagaacgacgacgacagactacaaaccaatcactggggttcttcaatgtttcgacaagcctggcgaaccagaaacacaaggagtgggtgtgttttttttcacgctttcttattgtgcccctatcgggcacgacgagcatccttatgcactagtcggctgtccagctctgctccacgatctcacggactttgcggttgtactcccgcttgttctcgctgaacagtcttgctgcttctgagtttgcaggggagtttgggtttggatcacacagcagggactggatagaagttaaaattgcagcaacatcatatataggactccactggttctgtaggatatccaaacagatgcttccatcagcatatatatttggatgaaacatcctagagacaaatcgaacagttggtggcttgtttgggtaatcttctgtaaactgc

SEQ ID NO: 15084 - DNA, 581 bp, Zea mays
  Clone ID: LIB3279-222-Q6-N6-H9
aatctaaatgcagctgtgtatgctagcttttttttattcctttcgaatatcaaatctgaactttgctgttttctgatatcttgcacacatcctatcgaaccaaatgtaaatacagaccgggctctgtttatggggcattctaacccatatgccatatccgatcgcctagaattttattcaaaagtgaacatccacaccatcttcaccactaattatcaccatatcagaactacggaaatacaactgattccacatatttttcgcaaatcagcgatgagctgtgctggaactttattgttaaattcggctcctattcctttttaacatatgcgaagactactggaggagctccttttaaatgccattaagctccatcttttgcagccatctcaaacgccctcatgaatacatttggaggctggccaccactgagttgatatttatcattgatcacaaaatgtggtaccccggagatgccagatgaatacttcttgagttcttcctgaacctcatcgactcctttggtagggtcttgaaacagttcttcggccccttctatgcccacctttcttgcagcgtcc

SEQ ID NO: 15085 - DNA, 599 bp, Zea mays
  Clone ID: LIB3279-223-Q6-K6-A1
ggtccacttcgctcgcaaccttccccagccatggcgaccgcgacgcggaggctgctccccgcgctcctcaagaccctagctccagccggcgcgcgcggcctctccaccgagaaggctgttggtgcagccgccgtcgtcggcagccacaccgctaagtggatgcaggacacgagcaagaagtcgccaatggaactgatcaacgaggtacctccgatcaaggttgatggtcgcattgccgtctgtgaaggggcttctgaaggtgttggacttggccacccaattgagtacatctgccttgatctggaggcacctaatgtgtgcaagtactgtggtctccgttatgttcaagttcaccatcactaaattgggaagatactgccgtctaccgctgcagaagctgagttgaggagtttatgtgcacacacatttgttccacaatgttctgtagtgtactttgtactatgcttgcgggcaaaatattacctttgatgatcatcctcttctcgggcgatcgtttattaatcctgtcttagtatgggtcatttttctacagatgaattgtgctcctttttcagaatctatacaagctgtgtgtattg

SEQ ID NO: 15086 - DNA, 517 bp, Zea mays
  unsure (1)..(517): unsure at all n locations; Clone ID: LIB3279-223-Q6-K6-A10
gaattcgggtcgaccacgcgtcgctctcgttcccagcaaagaaaagggctggtgctggcgtgaacgaatgacgancagggcggaacaggtnacnacgacgctggtcgccgccgtggccgtagttctggccgtggcggcggcgtcgtccctggccggcgtggcgtccgcggagaaggcgggcgggttcgtatgtacggggcgcgtgtactgcgacccctgccgcgccgggttcgagacgaacgtgtccaggagcgtggccggcgcgacggtggaggtggtgtgccggcacttcngcgcgtccaaggagacgctcaaggcggaggcgacgacggacgacagcgggtggtacaagctggagatcgaccaggaccaccaggaggagatctgcgaggtggtgctggcccggagccccgacccggggtgcgcggagatcgaggagttccgcgaccgcgcccgcgtcctgctcacctncaacaacgggatcaagcagcagggcgtgcgctacgccaaccccatc

SEQ ID NO: 15087 - DNA, 639 bp, Zea mays
  Clone ID: LIB3279-223-Q6-K6-A11
cccacgcgtccgctcctcctcctcaggtgccgccgggcccgaccagccgccggctgtctcggccgtcgccgccgccgccgccgccctatcccggtccttcaggtgaaccaggttggccatggccttcaacaagatcaaggtcgccaaccccatcgtcgagatggacggcgatgagatagcatggtgttctggaaatctatcaaggacaagcttatattccctttcgtagacctcgacatcaaatattttgacctcgggcttccacaccgtgatgctaccgacgacaaagtcacagtggaggctgcggaggccacactcaagtacaatgtggctatcaagtgtgccaccattacaccagatgaagcaagggtaaaggagtttggcttgaaggctatgtggaagagcccaaatggcacaattaggaatattctgaatggcactgtgttcagagaaccaatcatctgcaaaaacatcccacggcttgttccagggtggacaaagcccatttgcattgggaggcatgcattcggcgatcagtaccgggcaactgatgcagttatcaaggggccggggaagcttaaattagtttttgagggaaaagaagagcaagttgagctggaggtgttcaacttcactggt

SEQ ID NO: 15088 - DNA, 554 bp, Zea mays
  unsure (1)..(554): unsure at all n locations; Clone ID: LIB3279-223-Q6-K6-A12
accttctactgtggtttatgaggacgagaaggagctggctttcagggacataaaccctcaagctccaacacacattctcatcatccccaaagtcaaggatggactaactggcctggcaaaggctgaagagaggcacatagaaatacttggctatctcctctatgttgccaaggttggtacgtatgaggaaggacttgaagatggctatcgcatcgtcatcaatgacggcccaagtggatgtcanatctgtttaccacatccacgttcatctcctcggaggcaggcaaatgaactggcccccaggctaagaatatcttgtgattgatcagtgctaatgccaaggactgctactccatttctctagaataatccctgtaatttccataaaagctagtgcgcagtgcgctgaccttgtgctatatttgtggaattaccggaagcatgctgctgtgatctatgattggacacaagaaacttgtaactggtactcctatcatcgattgacttgtccttattgatcagctgatgggggttgcccactggccttgctgatc

SEQ ID NO: 15089 - DNA, 645 bp, Zea mays
  Clone ID: LIB3279-223-Q6-K6-A2
ggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacattgctgagaacgagggcgaggaagaagattagattgcactacgcttatattttagtattgaactcgttgcattttgatacctgtacccgtagtttcgcaaatgtcccatgttatggtgtggtatggttaatttgaagaatccttatgtactgaatctctgcaaaaagctatgttgtggacagaagtgtaacgtgccggatttcttgcatttcttagggct

SEQ ID NO: 15090 - DNA, 631 bp, Zea mays
  Clone ID: LIB3279-223-Q6-K6-A3
caacagcgaaggagaaagcagaccaacctagccacccagggagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacaacaccggcgctccgctccgacgctacgagggggccgagtcggaagacgatagcgtccgcgagtacgatgggcggcacggcggccgggactacgctgtgcccagcctgttctcagatattttccgtgatccgcttagtgcgccgcacagcattggccgcctgctgaaccttgtggacgacttggcggtggcggcgccaggtcgtgcggtgcgccgtggctggaacgcgaaggaggacgaggaggcgctgcacctgagggtggacatgccaggcctggggaaggagcacgtcaaggtgtgggcggagcagaacagcctggtgatcaagggcgagggcgagaaggaggatagcgaggacgaggccgccccgcctccgagatacagcggtcgcatcgagctcgcgccagaggtttacaggatgg

SEQ ID NO: 15091 - DNA, 576 bp, Zea mays
  unsure (1)..(576): unsure at all n locations; Clone ID: LIB3279-223-Q6-K6-A4
actttccccgtgcttctccgccgtcgaggccgcgtcccagtgcgaagagactccgactcagatggccagccgctgggtccggcccgaggtgtacccgctgttcgcggcgacgggcgtggccgtcggcatctgcgggtttcagctcttccggaacatcactggcaacccggaagtcagggtaaacaaggcagggagggcagctggtgtgcttgagaaccatgaggaggggagacgttacgccatgcatggcctaagaagctttgtgcacgacaagactcctgagatcatgcctgcagttaacaagttcttcactgaccctaagtgaagcatgttgattggcatactactactactacttgctactggggattttacactttgctggcaactcaatatgttggggacatccatgacctctaaaagtactttgagcgcttggtgatgacttggtatatgtatgatggtggatgagtttgatcgtccatgcttgatgttcatattcatctgtcatctggatttgccgcacttcagtgataaaattgtcatttggatactggtgaaaaaaaaaaanaaaaa

SEQ ID NO: 15092 - DNA, 364 bp, Zea mays
  Clone ID: LIB3279-223-Q6-K6-A5
tgtgcaactccatcgtgtcggccgtgtaccagcggtcgggcggcgcccctggcggtgacgctgacggcggtgttgacgacgaccacgacgagctgtagatggttgtagatggacgatggtggtggtgacgtggagtgccgggagccgagccaaattttgtaacggtgtttagcggcggacaatacttattactaatcttggtgctgctctgccaatagccgtgctgagcgtagaaactgtttgtttgtaattttttttcttctacttccttggttgttcaggattcggattcgaattttatgtgaaaaaagaagtcgcgcttttaaaatcttgcatttgcccccttgtggtaataatgctaatt

SEQ ID NO: 15093 - DNA, 632 bp, Zea mays
  unsure (1)..(632): unsure at all n locations; Clone ID: LIB3279-223-Q6-K6-A6
gctccatggatctcccggccaagggcgggttcagcttcgacctgtgccgccggaacaacatgctggagaagaacggactcaaggtcccgggattcaggaagaccgggacaaccatcgtcggcctcgtctttcaggatggggttgttcttggggcagacacaagggcaactgagggccccatagttgctgataagaactgtgagaaaatccactttatggcaccgaatatatactgctgtggagcaggaactgctgcggacacggaggccgttacagatatggtgagctcccagctacagcttcaccgttatgcaacgggccgcgaatcaagagttgtaactgctcttacactactgaagtcacacctcttcaagtatcaaggccatgtcagtgctgcccttgttcttggtggagtggattgtactgggccacatttacacactgtttatccacacgggtccactgatactcttccttttgccaccatgggctctggttctcttgctgcaatgtcagtgtttgaatcgaagtacaaagaaggccttactagggaggagggaatacagattgtgtgcgaagcaatctgtgctggtattttcaatgacttgngtagtgggagcaacgtggacgtc

SEQ ID NO: 15094 - DNA, 569 bp, Zea mays
  Clone ID: LIB3279-223-Q6-K6-A7
atccggagcttccgcagtcccaccgagcccgccgggggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccaggtgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgctcaccaaagttatcctcccctgcctgctgcgtgctatgtctgaatcgtgaacaaccgttgtcatttcatgtgtgtaccccgtgcaatgctttgtgcgcatggttgatttctctgtggcaaacttcccgtcctgcatggggttgtaagctgtctctaatttca

SEQ ID NO: 15095 - DNA, 612 bp, Zea mays
  Clone ID: LIB3279-223-Q6-K6-A8
caaagataaggaacatgtatcaagaaaaagccgcgcaaaaggtcgtgatagcagagatttatcaagttccagtgatggtcttcaaaatgatggaaaacatcagttggataaaactattcagatgcgcgaggaccttgaaaatgaggttaaccagattaaggataaaatatctgggaaagagcagcacattgcagatttgcagaagaaagctcagaaactagaggatgaactggttgccgcacggaaagtatcttcagaacgacagttggcggttacagacctgtacaaacatttcctccaacttcaggactacaatgatagggtcaaaacagctgaacagaggctgcagtctctcgttgatgctgccttggtcgagctcgacatggccgaagatgctactaccagagatggctcgatgtacgagaacggcgtgctttgaacacccaactgccatgggtttgtgtggttgctgatttgttagatttgtagtttgcgtctgccatgtaatagaactgcattgtaactagaaacaggaaaaatgttgtgtaagggtcggagaatctgctgtcgtggtccctgagcccggatttctctttcgaagttggattcatt

SEQ ID NO: 15096 - DNA, 83 bp, Zea mays
  Clone ID: LIB3279-223-Q6-K6-A9
tgtacagtggcctgttcaatgcttcatagaagcgtataggctgatgtctttttcatcactgtgcaacttgccaccaatattcc

SEQ ID NO: 15097 - DNA, 654 bp, Zea mays
  Clone ID: LIB3279-223-Q6-K6-B1
cgctccctgcctctggtcacctcgcttccgctcccggctcccctccggctacccagacatcgtccgtgcgctcgccaagagacaggaccggagaccatggcggaccagctcaccgacgaccagatcgccgagttcaaggaggccttcagcctcttcgacaaggacggcgacggttgcatcacaaccaaggagctcggaactgtcatgcgatcactgggtcagaacccaaccgaggctgagctccaggacatgatcaacgaggtcgatgcggacggcaacggcaccatcgacttcccggagttcctcaacctcatggcccgcaagatgaaggacaccgactccgaggaggagctcaaggaggcgttcagggtgttcgacaaggaccagaacggcttcatctctgcggcggagctccgccacgtgatgaccaacctcggcgagaagctgaccgacgaggaggtcgatgagatgatccgcgaggccgacgtcgatggcgatggccagatcaactacgaggagttcgtcaaggtcatgatggccaagtgagtaaagcctgcggtaacggtatagtaccccgcgggaattgaaggaggaaaccaaaccgtgcatcgcatattagaaaggcagtgcaggtcttgtttccttcgtcttccc

SEQ ID NO: 15098 - DNA, 646 bp, Zea mays
  unsure (1)..(646): unsure at all n locations; Clone ID: LIB3279-223-Q6-K6-B10
gaagctgaaattcatgggattgatgtgtgtgagcgaaaactggtagcgttgtcggagatgctgatccaattcctgagctcatcgagactatgggccacactggtgagtcagctcctggacctgcattgatggatgagtttgtccctgaagaagttggtcgagaaggtcctaatggtgatgggcaagatatggcatctcggttagcggttcgagctgacagtggttctaaaatttgtggttcaactaaagctgattcagttgagagtggagagaagacgagccgtgagaatagcgcacatccttctctttcttgcaatgcaagagttttttctggcattgatgcatcaaaagacgaagtgactggtataatgctaactaatgatgactatgatccaggaagtggtctaggagcaacaaatggaggaaacgattatgaaacaggtctcccagacttcgatccaataaggcaccacaacgattactgtccttgggtgaatggaaatgttgctgctgcatgttgtattagtaccggttcgagcacagctctntcaggctggcagctcacggtagatgccatcgagactctgcagtctcttggtcaggcccaaaatcagacgatgcagtcagactctgcggcttcattata

SEQ ID NO: 15099 - DNA, 642 bp, Zea mays
  unsure (1)..(642): unsure at all n locations; Clone ID: LIB3279-223-Q6-K6-B11
agcacaagcccctctccgcccccagccggcccgcgtgagatctcaatcccggcgctccctccctccctcctcgcctcgggacagcgagcgccgccgtccgccgtccatggagcacgacgccgaggcgcgccgcgggttcgccaggatgggcttcgggtgcaagcactaccggaggcggtagctnatccgcgcgccctgctgcggcgacgtcttccactgccgccattgccacaacgagtccacgaaagacgggcacgagctggatcggcacgacgtccaatcggttatctgcctcgtctgtgacaccgagcagccgatcgcgcaggtgtgctgcaactgcggcgtctgcatgggggagtacttctgcgcagcctgcaacttcttggacgatgacgttgacaaggagcagttccattgcgacgattgcggcatctgcagagtaggaggaaaggagaacttcttccactgccaaaagtgtggatcctgctactcgacgacccttcgcgacaggcactgctgcatcgagaactcgatgaagaacaactgccccatctgctacgagtacctgttcgattcgctgagggagacgtcggtgctccgctgcggccacaccatgcacctgcagtgcttcacgagatgttg

SEQ ID NO: 15100 - DNA, 450 bp, Zea mays
  unsure (1)..(450): unsure at all n locations; Clone ID: LIB3279-223-Q6-K6-B12
acagaaccaactaccttgtggaagtgcgcatggagggtgaagatggctgaacttaatggccatacctctcgcgtcctcttcatggctcagagtcctgatggatgcacagtagcgtcggctgctgctgacgagaccctccggttctggaacgtttttggaacccctgaaacncccaagcctgcaccaaagcttccacaccgggatgttcaacagcttaaacatatccgataggatgagtgagtcaagactattattggatattgtctatacttgacttgatgatggcctgtcgttttcggaaggtcagaaatcaatgacacagggtttgcttcagaaatcagatgtaatgttttttcctcatttttggttggaacatcaagggcgcttgtttgatgtaccaattattgtaataagacagcaatatatataaattgatattttgtcggttgg

SEQ ID NO: 15101 - DNA, 641 bp, Zea mays
  Clone ID: LIB3279-223-Q6-K6-B2
ctgacccccgtaccgcagcgtaaaccctagtccccggcggcgaccttgcggcctccgctgcgctctgactggtgcgcgcttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttcagcgcattgatgagaggttatctgcccttggcaattgcatagcctgcaatgaccatgttgcacttacgcaccctgaccttgacaaggagactgaggagttcattgcagatgtgcttggggtcgaggtgtttaggcagactattgctggaaatatccttgtggggagttactgcgccttctctaacagggtggtttggttcatcccatacatccgttgaagaccttgacgagctctccacgct

SEQ ID NO: 15102 - DNA, 451 bp, Zea mays
  Clone ID: LIB3279-223-Q6-K6-B3
attccatattctccatgaacaggggattcctgtagctcctctctgggactcattcagaggtcaatttgttggtctccttagcccattggatttcatactcatattgcgggagctagaaactcatggctcgaacttgacagaagagcagcttgaaacacacactatatctgcatggaaagaggctaagcggcaaactaatggaagaaatgatagtcagtggcgaccgcaacagcatctagtgcatgccaccccttatgagtccttgagggacattgcagtaaagcttttgcaaaatggcatttctacagtgccagttatttattcatcatcatcagatggatcattcccgcagttattgcatcttgcatcactttctggaattttgaaatgtatttgtagatacttcaaaaactcaactggtaatttgcctattctgaaccaaccagtgtgc

SEQ ID NO: 15103 - DNA, 228 bp, Zea mays
  Clone ID: LIB3279-223-Q6-K6-B4
atcaaatccaaatcctccatttgattagcgtgaccgtttgggtggatggatcgcccttgcagtttgctcggatttgttttgtttgtgatgtaaaaaaatgatgtcgtcatcgtcggcgagatgaatgaaccggctttgttgtgatgaatccgctgggagtcaacttatttattatagggttttccgtcatgccttttgtgatgtatagctgaagtattttcccggttg

SEQ ID NO: 15104 - DNA, 340 bp, Zea mays
  Clone ID: LIB3279-223-Q6-K6-B5
gggaacgatgtgaccaagtactttgtgagcagtggatttgctttcgtccatgcaaactccattgctgatattgtggctgttgaggctgtccctgtggatcagatcgacccagcttttgttcagaagggtctcgctgaattcactgccaagcttggttcggcctctactgacctggagaaggctgaggctcagatcggtgtcgatgttcacagtgcgctcaatgctgcattgaccggttaattggtgtcatcttaaattgtctgtcttttagattgagtttaactttgcaaatcctaaataaattatagtccatctaaaacatggacatatgtttcttgtt

SEQ ID NO: 15105 - DNA, 428 bp, Zea mays
  Clone ID: LIB3279-223-Q6-K6-B6
cccacgcgtccggctgctcgttgccggctgcccccgcccactccaccgctgatatttgtcatcgtctcgttcctgccctcggccctcccctcgctcgctccccaactccagcaggcagatcagatacatccattcgcggaccggaagtaatcatcaggaaaggaaggggcgttgaactatgagcgccgtggcggtttcgtcgtcgctgaacccggacgcgccgctcttcatcccggcggcgctactacaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcaggggccccgtc

SEQ ID NO: 15106 - DNA, 558 bp, Zea mays
  Clone ID: LIB3279-223-Q6-K6-B7
cgagacgaagggcctcacgctttccacatcgacacaaaaaccaaccgccgccacctccctccgctcgcgctagctgtgtgcgttccttgcctgccacaactctagcactcggagtcttcgacgacgacgacgacgacgacgacgacgacgacgacgacgacgacggcaggggaggagaaagagaaacaggcgggcgggtcatccatggagacggaggaggagacgacgcccaaggcgaagaagcggtcgcagtcgctgctcgggagcctgcgggaggcgatcaccaaggtccggttcctgctctcctccagcgcgacgcggtggatgctgctcaggtccctggcccgcggcggcggcggcggcggcgccccggcgcggcgcctcagcttcgacgcgcggccgggcctgctcgacaccatcgccgcgtcgccggactcctcctcctgcagctccaggacctccaggtcggccagcctgggcacggcgaccacccggaccctgtcgcgggccagcagcgccgcgtcgccggaggccctgacgagggcctcgtcgtcgtcc

SEQ ID NO: 15107 - DNA, 496 bp, Zea mays
  unsure (1)..(496): unsure at all n locations; Clone ID: LIB3279-223-Q6-K6-B8
gcctgtcttgctgaagctgaactgctgatccgtcttccaagctgtggtgtcatcccctgagttctgatccaagatgtatctccagtattacatcaatgagaagggggacaaggtctacaccaccaagaaggagtcacctcttggggtgccgacgcagtctgctcacccagctcgcttctgaccagatgacaagtactctcgccagcggtacctgttgaagaagagatttggacttctgccaacgcagaagccagcactgaagtactgaagcttcaactttccaaccatggatgtgcagtttgtgtcactgcttgatgcttgttggttggaatgtagaataggtatctgaggaaacatatcaaacactgctaggcactactatgacatctcagcgcattcaggcactatatgtaatgctatgtgtttgacaggtcttgttcttattatgtacttggtgtgtgggccaaaaaaaaaaaaaaaaaaaaaaaaaaaaana

SEQ ID NO: 15108 - DNA, 407 bp, Zea mays
  Clone ID: LIB3279-223-Q6-K6-B9
catctcctcgcatttcttcccatccgagccccggtgcgcaaccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccggtggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctgaggccgccaagctcgcgcgctataacaagaagccta

SEQ ID NO: 15109 - DNA, 622 bp, Zea mays
  Clone ID: LIB3279-223-Q6-K6-C1
ctctcctctctcgcatccgcagcctctcgagctctactccatcccctcgatctcgaagcgcagcagcagcagtcaggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctcctggccatccgcaacgacgaggagctcggcaagctgctgtccggcgtcaccatcgcccacggcggcgtcctccccaacatcaacccggtgctcctgcccaagaagaccgctgagaaggcggcggccaaggaggccaagtcgcccaagaaggccgctaagtcccccaagaaggcatagaggggcgcctttaccgctgtgatgttgaatgctcgtgttcagtagatctttacttctgtagtgtcgtcg

SEQ ID NO: 15110 - DNA, 622 bp, Zea mays
  Clone ID: LIB3279-223-Q6-K6-C11
ggatggaggttcctcgtgcgtgtgtgagtcttacggacacctcgcgttcaactattttaattggatttgaagtttcttccttctcctcaagtggtgttcacgataaaccaatcagctcccgtccccgtcccacaccacacacatgagagaagagaaagagccacgcgatgtcggtgggcttgcacaagcccggaggagccccaaacgcggcggcggacggaatgcggctgcgcctgcctcagtcagtgaacattctgctgtgatggcgaaggagtactacactacgagcagccttgtggttgggtacgcgctgtgctcgagcctgctctcgatcatcaacaagtacgccgtgacaaagttcggtttcccaggcctcctgaccgctctacagtactcgacatccgctgctggtgtctggatcctcggaaagctaggcttcctcacacatgaccccttcaacctggagaccgcaaagaagttcgcgccggcggctctcgtcttctacctagccatattcaccaacacgaacctcctctgccacgccaacgtcgacaccttcatagtcttcagatccctgaccccgctcctggtcgccatcgccgacacgacgttccggaagcaa

SEQ ID NO: 15111 - DNA, 620 bp, Zea mays
  Clone ID: LIB3279-223-Q6-K6-C12
caccactccacagtgcacttcactctagagcagggacagaaaagtgagcagcagacagcagcagctgctgcatggaggcgtggagatctctcctcgcgagcttcgtgctcgccgtgctggccgcgcaggccttggtggctgtggtcgagtccaggaccggccccgtggagcaggctaacgaatgtgacgacgtgaagaagccggactgcgtgccggggatagacccgcgctcgttcccggggaccggcggcggccacggcatcacgcccgtgacgccatcgcacggaggctccagctccccgacgccgtcccacggcggcggcggcgggtacgttccaacgccgtcgcatggcgggacgctgccttccccgtcccacggcggctccagctccggctcctctccgacgtcgccctccaccggtggcggctcgtacggtggatccccgtctactcccggaggcggcgcgtacggtgggtctcctccgtccacccccagcggcggcggcgcgtacggtgggtctccgtctacccccagcggtggcggcgcctacggaggcgggtccccctcgcctgctcatggtgctggtggcgcctatgggagctctccgacgcccgcatac

SEQ ID NO: 15112 - DNA, 632 bp, Zea mays
  Clone ID: LIB3279-223-Q6-K6-C2
gccatctcaccaactatgttggagtactgcaaactgaccgtagccatcaaaatgctccccgtaagcgctcctggtctgtgtatgtttcggcaagttctgcgaaaccatgctctgctcccaagtggaaggagatgacaggaagcggtatatttgcagctgggggcgagggtgaagaagatgaatccgccaatgtctctgcaacttccgtccggacggctccaaagaattatcaggcaatcagtactataagccacatctcatttgccgaggaagaaagcatctctccaaagaagccaacttcgatagcagaggtcgcaaagcagcgcgagctaagcggcacgcttctgagcgaggacgacagcaagatgaagaggcagatatcggacctgaaatccaaggagctgagcggccacgacatctttgcccctccggaggatccgaggccacgcaactcggagaacggctcgacctcgcagactccgggcaaaaatgcacacgtaagcaacttcaagttcggcgaggccgacgaggacagcgcggtgaagaccgcgaagaagatccccaccaagaagttcactgacctcgcgggcaatatcttcaagggcgacgacgaggcacccgggacggcggag

SEQ ID NO: 15113 - DNA, 612 bp, Zea mays
  Clone ID: LIB3279-223-Q6-K6-C3
caactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtaggctgcagatg

SEQ ID NO: 15114 - DNA, 650 bp, Zea mays
  unsure (1)..(650): unsure at all n locations; Clone ID: LIB3279-223-Q6-K6-C4
gcagttagtgctggcaacaactatgaaattggtaacatgatagcagaggccatgagcaaggtcggtcggaagggcgttgtcacccttgaagaggggaagagttctgagaactttctctatgttgtggagggaatgcaatttgaccgtggttacatctctccgtactttgtaacagacagtgagaaaatgactgcagagtacgagaactgcaagctgcttttggttgataagaaaatcaccaacgcaagggatcttatcaacgttttggaagaagccatcagaggtgcatacccaatcctgataattgcagaggatattgagcaggaggctcttgctacccttgtcgtcaacaagctcagaggatcactgaagatcgctgccatcaaagcccctggttttggagagcgcaagactcagtacttggatgatattgccatccttactggagcaactgtaatcagagatgaagttgggctgtcacttgacaaggccgacaaatcagttcttggaacagctgcaaaggttgtccttacgaaagagtcgacaacaattgttggtgatggcagcacccaggaagaagttactaagagggttgcacagattaaaaatctcattgaggcagcagaacangaatatgaaaaggaaaagct

SEQ ID NO: 15115 - DNA, 569 bp, Zea mays
  unsure (1)..(569): unsure at all n locations; Clone ID: LIB3279-223-Q6-K6-C5
cccacgcgtccgcccacgcgtccgggaacaaccacaataaaagcttctcaaattaagtggaaggatggaatgggacctgcaaatggaaatggtattaacaagaagggaaacaagcggccattagtagtggaaagttttttctcctggtttagtgatacagagctcaagagtcttgctgatggtgtgcaagatgaggtggcggagatcatcaaggaagacttgtggcctaatcctttgaagtacttcaacaatgaggttgaagatgaatttgaaggagatgaagaagatgatgacgacgacgacgacgatgataatttggatggtgatgacaatgacgatgatggggaccaggagaactgagccctcgcgtttaggcggggaattatgtgacccgtttgggggatttttttggttgtttgacttagctggaactcaacttagggaactgtttagtgccttatgaagtcaaccaacttgaaaggagactgctatatcataatctcggtatatctatcaacgcagtttgacctgtgattcaaaaaanaaaaaaaaaanaaaaanaaaaanaa

SEQ ID NO: 15116 - DNA, 612 bp, Zea mays
  unsure (1)..(612): unsure at all n locations; Clone ID: LIB3279-223-Q6-K6-C6
cggacgcgtgggcggacgcgtgggggaggcggcgcaccagggggtggaagctgaggagcgggaggttggagatcgtacggaagcggagcagaagcagaagcccctgaccctccccatccccatccccgtggtggcgctggcggaggaggaactcgtggagaatactaagggaaggcagaagcagcagcagcaggaggaggagcaaacccagaagccaccgccaccgccgccgcctcctccccaggttgccgggtgcgacctgtaccggggtcggtggacgttcgacgcggccggcgagcaggcgccgctgtaccgcgagtcggagtgcgagttcctgacggagcaggtgacgtgcatgcgcaacggccgccgcgacgactcgtaccagaagtggcggtggcagcccgatggatgcgacctgcccaggtacgatgctcggttgctgcttgagcggctgcgcaacaagcggctcatgttcgtgggtgactcgctgaaccgcaaccagtgggagtccatggtgtgcctggtgcagtctgtggtgccctgnggccacaagacgctgcacaagttcgtcaacaacggatcgctcaacgtgttcacggcgcatgatta

SEQ ID NO: 15117 - DNA, 656 bp, Zea mays
  Clone ID: LIB3279-223-Q6-K6-C7
gcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcggcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagagtgacatgaagctatggcctttcaaggtcatcccaggtcctggtgacaagcccatgattgtagtcaactacaagggcgaggagaagcagttcgctgctgaggagatatcctccatggtcctcatcaagatgaaggagattgctgaagcctaccttggttccaccatcaagaacgcagtggtgacagtgccggcctatttcaacgactcgcagaggcaggccaccaaggacgccggtgtcattgcgggcctcaatgtgatgcgtatcatcaacgagcccactgctgctgc

SEQ ID NO: 15118 - DNA, 624 bp, Zea mays
  Clone ID: LIB3279-223-Q6-K6-C8
ctcactccggcctccagcttttcctttgcgccccagggccggaagagcccacacaccaccaccaccactagatagccagcgacgatcgagccgcgcgccggtggacgcgcacatacacgcggtagcttccttctcaagcctagctagccccatcctgcgcgcaggcggcggcagcgagaatggacgtgcgacgacgagcttgtgcttgctagctagagagcgaggatgtcgagccggaggccgtcgtcgcgtggcaacatctccgaggacgagatcaacgagctcatctccaagctgcaggccctgctccccagctcccgccgccgcggctccggccaggcgtcgacgacgaagctgctcaaggagacctgcagctacatcaagagcctgcaccgggaggtggacgacctgagcgaccggctgtccgacctcatggccaccatggaccacaacagccccggcgcggagatcatccgcagcatcctccgctcctgatcgcccacgcgcctcctactgcggcggcgccggccggcgcgcgagagagcgaggtcggcgacgacctcgatcgccgacaacgacgaccgcgcgcgcccgcgccccccgggccatctgttctctccaccg

SEQ ID NO: 15119 - DNA, 613 bp, Zea mays
  Clone ID: LIB3279-223-Q6-K6-C9
cttaattgtgacgaactgctcatgtgtctgcttagtattatgctgggcagaagccggaggtttcttttctactgcctgagccatattatgtagaccaggtgataaataatactggttaagttatcctgaaagctttgccaacatttgctgtaagtgacaacttgttctattttttatctgcgtacctccataagtttgcaagttaaactttgctgaagctgccttgcctgtaaagtatgactcccctttctcttggaacgttgtcgctgacttcatgtatgtcaaaatatcatcatttctaccgtcaataaataaaatacactgccaccttgcaggagcagagaaataaaaggagaccgggcaaagctgaagatgatagacgatcaagagagcacagcaaggatcgcaacggccggtcgtccagggatagagaaccagaaaggagagacagggttgagtctcgagatggtagaagagattatgaaagggatcgtgatagacgtcatgatagggacaggcgccatgaccgtgatcgggatagggattatgaccgctcccgtggacatgattcaaggaggagagagcgttcacgctccagggagcgcagcaggcg

SEQ ID NO: 15120 - DNA, 482 bp, Zea mays
  unsure (1)..(482): unsure at all n locations; Clone ID: LIB3279-223-Q6-K6-D1
gttccagttacctatatgctcttcttgatcatgaatggaaagagggaatgagtcaggaagaggcagagaaatttgtggtgaaggtagtttcccttgctatggcccgtgatggtgctagtggaggggttgtccgtacagttacaataaatgcggatggcgtgaagaggaacttttaccctggcgacaagctacccctgtggcacgacgagctggaaccccagaactcgttgcttgatattcttgctgctgggaaccctgatcccatggtgcagtgaactcgccctccacttactttgtgaacttttcactgtatctgacttgttcttgattatttctccctgaactatgtcagaccagagtaatttacgaattgttgttatcgcaccttaataaattcatgtttagctgggtgaaaaaaaaaaaaaaaaaanaaaaanaaaaaaaanaaaanaaaanaaaaanaaaaanaaaaaaaaaaaana

SEQ ID NO: 15121 - DNA, 543 bp, Zea mays
  Clone ID: LIB3279-223-Q6-K6-D10
aagaaaactagaaaaggctcctcccgagcgaggcgcgcctcatctccctcgaccccgacatccccgacccgatggcgcccaaggcggagaagaagccagcggagaagaagccggcggccgaggagaaggcggagaagacgaccgcagggaagaagcccaaggccgagaagcggctgccgggggtcgaagtcctcggcaaggagggcggcgagaagaaggggaagaagaaggccaagaagagcgtggagacctacaagatctacatcttcaaggtgctgaagcaggtgcaccccgacatcggcatatcctccaaggccatgtgcatcatgaactccttcatcaacgacatctttgagaagctggccggcgaggccgccaagctggcgcggtacaacaagaagcccaccatcacgtgccgcgagatccagacctccgtgcgcctagtcctccccggagagctcgccaagcacgccgtctccgagggaaccaaggccgtcaccaagttcaccagcaactgagcgcgctgcgggatccgcggatctg

SEQ ID NO: 15122 - DNA, 616 bp, Zea mays
  Clone ID: LIB3279-223-Q6-K6-D11
aaaacccatatgctggtttccagacgccgggcgctggctcccttcgcgcctcctccaccgccggcgcccgctcctctgcagcgaagctcgcggtcgccagcgccgtccccagggacctcgcctccagcaccaaggtggtgcgtaagtgtctggactacgacggcgacaccaccctcccgtctgccgcagcctccacgacgcctctggatgacgtcctggaggacgacctcgcgcctctgctggacctgccagaccctgacgtctccggcgattcctcctcctccgtcatcttcgctgctccggatgacgcggtgatatcttccgccgactccactgtcaccgagctacaggtcgccgcgcccaccgactccaccaccaacagcgacgcagacctcccagtcctggagcaaatcaacctcgccatgtctgagctgcatgcagccgacagcctcagcccgcgctccaagcgcctccttacggcgctcgccgaggctgctaaggccgagctcatcccctcggccaccgcccgccgcctacgtggcgccgccttctggggcaaggtgcgcgtttgggtcctcgccgcgacggtcaccaccgtgaccaccatcgacgtcgc

SEQ ID NO: 15123 - DNA, 629 bp, Zea mays
  Clone ID: LIB3279-223-Q6-K6-D12
gcctgggccctggtggtcaggaaagaggctcgggctttcctctcacctcgccgtgcttctccagtcaccacccccctcgtcgttgcttcttccctccccttccctcgtcgtcgcgctatcccgccggtgcgcgggcgtggggccaagcgccgccgaaaggtacagcagaggggaagactgacacggacgcaatagcgtccacccccgtaggcgccccccgcccaaagactggtggcaggcctcctacaggcagatgctagagccatgtgactccctaccaaagaatatcctggcaaaaggtgcttctcgctgaccatcgaaacacagagcttcatgtctgtccagtccaaggtggttgcgcttggtgcactgatcttcttccttgtctcgtatggctcttgcactaggattgtcaactttaatgcctcccacatcacgaccgacccctactgggtggctgccagggccacttggtacggtgcgccaaccggcgctggcccctatgacaacggtggtgcttgtgggttcaagaatgtgaacctacctcctttctcggccatgacatcgtgcggcaaccagcccctgttcaaggatggcaagggttgtggctcgtgctccagatacgttgt

SEQ ID NO: 15124 - DNA, 646 bp, Zea mays
  Clone ID: LIB3279-223-Q6-K6-D2
gcagtacagcaccagaaacagaaaggtagtagatcaaggaacgccagtgcggcgacaatgaccggcagtggaagcacgggcgccaatggcaagagccagagatccagggccaaggcaatgctgctcgccttgggcaagagctttcctgaccaagttctgcctcaggagaaggttgtggagagctacctccaagaaagcagctgcgacgatcccgccaccagggccaagcttcagcgcctttgtaagcttctttgtttcatcacagttgctgttctataaattcatcttgtcttcacgttgaaaattttaggttgacaaatgcagcttagctctagtcataaacatctatggtctaaacaacaacgctcactgaataaggaaaggacaatgagtacaatagatcaccatatacagccttcagtatttatgtgatgattcgatttgcctccgataaacagatgagtattgcccaaatgattttattttccaggcacgactacaacagtgaagacaaggtacactgttatgtccaaggagctattggataagcacccagagctgaagatggagggtactccgacactgacaccccgccttgacatctgcaatgccgcggtgatcgaccttggtgctgccgcagctcgcg

SEQ ID NO: 15125 - DNA, 636 bp, Zea mays
  Clone ID: LIB3279-223-Q6-K6-D3
cccacgcgtccgagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttctttg

SEQ ID NO: 15126 - DNA, 530 bp, Zea mays
  Clone ID: LIB3279-223-Q6-K6-D4
caaacatctattagctaagctctgaagccaagggttgtagaaaactgccgctatcagtagccgccactgcaaaatcaagcggagtactcctacatggattagagtaagatacttagcttggccaaggagggaactccgagctaaaacttgggcaattgaatttgagaaatggatggaaccaaatttgattgagaaagaaaaggcaatacttggtttcctccaattttctcatgttcggttgatcggatgtgtaggtggcagtgcagcaagatgagacctgtctgaagaatttggaagctgaaggtgagcgttggcggaaaccaagtctccaactgcacgcaaagcacaagatttagttccctccaatgtctcatcttcaaatgtctcaaatcaatgcaaatctcgaggcgttagtaggatcattattatcctccaaatacggtgttcctagttaagcaaagtaatgggctctttgtttgcaccaatttggcgtttcgtgttagacaatttcatatcgggtgaacatttcc

SEQ ID NO: 15127 - DNA, 645 bp, Zea mays
  unsure (1)..(645): unsure at all n locations; Clone ID: LIB3279-223-Q6-K6-D5
cccacgcgtccgtccactcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtagggacttcatttgcactgtgtgctgtagcatgctcgtgtctagatctgtggatgggatgtgtnctgctctagtttcgtcctt

SEQ ID NO: 15128 - DNA, 630 bp, Zea mays
  Clone ID: LIB3279-223-Q6-K6-D6
cccacgcgtccgctccgtctccaaaagagagcccaatcctaaattcccaatccctcaaaggaaggaggattcttcagcgtctcgcttgccggccccgaatcgcagtcgccgcccggatccgaggaaacaagtcgtcgtcttgctccaccgtccgcccgccgccatgagcttcatcttcggcaagaagaagactcctgctgagctgctgcgggagaacaagcggatgctggacaagtccatccgggagattgagagggagaggcagggcctgcagacccaggagaagaagctcatcaacgagatcaagaaggtggccaagcagggtcagatgggagctgtaaaaattatggcaaaggatcttatccgcacgagacaccaaatcacaaaattctatgcactcaagtcccagctacaaggtgtatctctacgtattcagactctgaaatcaacacaagccatgggtgaagccatgaagggtgtgacaaaagccatggggcagatgaaccgacagatgaatctgcctgccctgcagaagatcatgcgggagtttgagatgcaaaacgagaagatggagatggttagtgaagtgatgaacgacgccatcgatgatgccttggagggcgatgagga

SEQ ID NO: 15129 - DNA, 659 bp, Zea mays
  unsure (1)..(659): unsure at all n locations; Clone ID: LIB3279-223-Q6-K6-D7
cgcattcgttccaactcctgagcactttctcctcgtgccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctggaggtccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgncaagtcccctaagaaggcatagactgactgtccggagtgatctgatgtttagcagtaccttgttaccagtatgcggtgatgcgtaggctgcagatgggacgaatgtgcttgtatgtgtatgtgtcctgctgc

SEQ ID NO: 15130 - DNA, 646 bp, Zea mays
  Clone ID: LIB3279-223-Q6-K6-D8
cagaaaatcaactcctccccaaatccaggctgccaccaactcgccgtcctccgcgccaagcaccaaagctccgatggcccgcactaaacagacggcgcgcaagtcgacgggcggcaaggcgccccgcaagcagctggcgaccaaggcggcgcgcaagtctgcgccggccaccggcggcgtgagagaagccccaccgcttccgccccggcaccgtcgcgctccgggagatccgcaagtaccagaagagcacggagctgctcatccgcaagttgcccttccagcgcctcgtccgtgagatcgcgcaggacttcaagaccgatctccgcttccagtcctccgccgtcgccgcgctgcaggaggccgccgaggcctacctcgtggggctctttgaggacactaacctctgcgccatccacgccaagcgcgtcaccatcatgcccaaggacatccagctcgcgcgccgcatcaggggagagagggcctgagcgaggcgagctcctctcaccgcaggcggcgtcgttgttgcttcgggcctgcttgtaggacttgtgcttctcttggtttcctttctggtggcagtggcatcttggtaccattgtgcttgttcttagaatcttagggatagagagttgttcagttgctgggt

SEQ ID NO: 15131 - DNA, 635 bp, Zea mays
  Clone ID: LIB3279-223-Q6-K6-D9
attcactcacacagcaaatacccacagtgcacagcaagaaccgaagatgttcggaaacatcggaaagatcccgatcatcggcgacctgacgggcagcaacaagaatgcgcacctcaagggcaacctggtgctcatgcgcaagaccgtgctcggcttcgacgtcaccagcatcgccggctgcctcatggacggcctcggcgagttcctcggccgcggcgtcacctgccaactcgtcagctccaccgtcgtcgaccccaacaacgggaaccgcgggaaggtgggtcaggaggcgagcctggagcagtggctgctgcacccgccgccgcttctggccggcgaggaccagttccgcgtcaccttcgactgggaggtggagaagcacggcgtcccgggcgccatcatcgtgaagaacaaccacgcctccgagttcttcctcaagaccatcaccatcgacgacgtccccggccacggccccatcgtcttcgtcgccaactcatgggtgtacccgcagtacaagtaccgctacaaccgcgtcttcttctccaacgacacgtacctccccagccagatgccggcggcgctgaagccttaccgcgacgacgagctccgcaacctgaggggcgacgaccagcagg

SEQ ID NO: 15132 - DNA, 655 bp, Zea mays
  unsure (1)..(655): unsure at all n locations; Clone ID: LIB3279-223-Q6-K6-E1
cggacgcgtgggcggacgcgtgggtgaagatgcaaaacggtgcctcttgaatgacttgcacattcttgatcttgaaaccatgacatgggatgatgtggatgcaatgtaagtacaagaatcttgattcttaatgcacacctaatgagaagataaggccattatttgtttcgtgaatctttgctatgtgagcttaaaatgtatttttttaaaagctcctagatttggttggcgcactggtaacccagcatgattggtttacatggtaactttagcgctatcaagcattagcttttactaacataaaaatgcaaaataaatatagattgtatcaagaccttaaacatatttttcgtagttaggtaaggttatcttgtatttacactttcattatgaaggtgtaatatacgccccctcccccaatgtattttttttatgaaaggctgtattttaataacatgtatatgtggtttgtggaataatctctctaggtcatcatgcacatgttctgaatcacaaagcaatggtcttttttaaagccaaccttgtgttattgtattttgaattcagttcatcgtggtgttggcttttgtgttttagaggcacccctcctncgagatcggatcatgctgctgcttgccatgctgaccgctatctt

SEQ ID NO: 15133 - DNA, 529 bp, Zea mays
  unsure (1)..(529): unsure at all n locations; Clone ID: LIB3279-223-Q6-K6-E10
aaactatcgaaattcttttctctttttgctccagcantttacattaacaaaaaatttccttctgttgaatttctttgccttgatgtctgggatggatttctttgtcttgactcttgagtatagtgtatttctgactctcatttgtcaattttgttgaattttatgctcataagttgagagagttttattataagtgtacactgttttattttttaatgttgttcgactgattactgcaaggaaccttgtggaggtattgaatatgcttgcttgatggattgaagatccaactcgaatgccttctaacttcatatcccacgagtctatgattacttgtggcttgctgaagatggcatgaagatacaggcgattattgcttgttctgtggctcatttccttttacttagttaacttcctattaggtagctactgcaccagcaaacctgtcaacatattattttttactacctcttaatgagattgacaaattgttttggaatcttcaatactggaacagattgtttatggc

SEQ ID NO: 15134 - DNA, 457 bp, Zea mays
  Clone ID: LIB3279-223-Q6-K6-E11
gaattccggtcgaccagcgtcgtactttgttctttacgttcaggtggttgggggatacttttactgttaaaacacctgaaagtggattgccaccaagatttagctcatcgcatgatgtaccgagccgcttcttgtggaagttgaccaaatctatcaccttgcttgccctgcttcaccaatcgttgtacaggcacaaccctgttaagaccatcaagacaaatgttattggtaccctgaacatgcttggacttgcaaagagagttggagctaggattttgttgacatcaacctctgaagtttatggtgatccacttgagcatcctcaaactgaggcctactggggcaatgttaacccgattggtgttaggagttgttatgatgagggtaagcgtgtagcagagacgctgatgttcgactatcacaggcagcatggcattgaaatccggctagatcgcga

SEQ ID NO: 15135 - DNA, 481 bp, Zea mays
  unsure (1)..(481): unsure at all n locations; Clone ID: LIB3279-223-Q6-K6-E12
cccacgcgtccgggacgatcggaagagaggctggagatccaaaaagatcgagactgataaccatctggttacttttccccattcctggcgcccaaagtcccttcagacaatggtgacagtaaggaaagcaagatggaaacatctgagaaccttgaagaccgctgtttccctgtggagtcagaagcagatgcctctgcttaggctcatcactgaaccaccgacgtcgccataagatttggccaaaacctggtgctgtcagcattagcgatcggcgtgctctcagtacacgtttgctcccctaaccagttagtgtttttttttcttctctagatatgctacaagggcattcgtatttgctgttttgcactgacatcatttttgcgaaggccctaaacgagtgtttggcataatccaggcctcccgctatgtataatactgtgcgacgttcattactggcagcaatatacacanccccttgttc

SEQ ID NO: 15136 - DNA, 623 bp, Zea mays
  Clone ID: LIB3279-223-Q6-K6-E2
cagcgagcgactgtgtcgagcaggagagagcgcgatggggaagatgcggcagctgatctgcctcgtggccgccgtcgccgccgcggccatcctcctgacagcgtcggccaagaagtccggcgacgtcaccgagcttcagatcggcgtcaagtacaagcctgagtcatgtacgctgcaagcacacaaaggagacaaaattaaggttcactatcgtgggacactgactgatggatcagttttcgattctagctatgacagaggtgacccgtttgaattcacccttggaaatggccaagtgataaaaggttgggaccaaggattgctcggtatgtgcgtgggtgaaaagaggaagctaaagatacctgcaaagatgggttatggtgagcgaggctccccaccaaagattccaggtggagcaactctgatcttccacacggagcttatcgccgtcaacgggaagacatccggcggtgcaaaggcagagagtgatagtgagctctgatacaatgcattggagagttccaaagctcgagaggagtagtagcagcgtcgcatagttcattaggtgaaagggttgctgtttcctccacatagcagtttatgctacagagatgtaacagaaa

SEQ ID NO: 15137 - DNA, 628 bp, Zea mays
  Clone ID: LIB3279-223-Q6-K6-E3
ctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatggtacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgaatccaaggtgaacgagactaaggcaaccgtcaagttccagctcaagaaggtcctttgcatgggcgtcgccgtcggcaacttggcgatggaggagaagcagatccagcagaacatccagatgagcgtgaacttccttgtttcccttct

SEQ ID NO: 15138 - DNA, 656 bp, Zea mays
  unsure (1)..(656): unsure at all n locations; Clone ID: LIB3279-223-Q6-K6-E4
tagggttctagccatggcgtggagcgccgccgccgtctccaggttcgccgccgcctccccacccgcggcacccatctccgtcaggcttggagccgccgcttctcgctcctccctgtccttctccagtgggcgccgacgccccgtggccgcgtccctctcgacctctgccaccgttgtaaaggaggctgttcagacagagaaggcaccaccagcactaggcccttattctcaggccatcaaagcaaataatcttgtgtttgtttctggagttcttggcttgaatcccgagaccaggaagtttatctctgaaaatgttgaggagcaaactgagcaggttatgaaaaacatgggcgagatattgaaagctagtggtgctagctattcttcagttgtgaagacaacgatcatgttggctgatctgcaggatttcaataaagtaaacgagatctatggcaaatatttcccggcgccagcacctgcacgatcaacctaccaagtggcggcgctgccactgaatgcccggattgagattgagtgcatcgctgctctctaatcagatcatccaaccactcattaaatcatcaataagcacccaggaatntgtggtagaggtacctgtaccagttcagtgtctgaaaactgcgggtaacaaacct

SEQ ID NO: 15139 - DNA, 623 bp, Zea mays
  Clone ID: LIB3279-223-Q6-K6-E5
cccacgcgtccggttctagatcgcgagcggccgcccgcgatctagcggacgcgtggggctttctctctacttctgtctgagcccttctgtcaactttcactggttaaaaattattcaatgggagaaagttgctcatctgctcagcaatctggcacaagccaaagtgctgagttgatgccagattcagacaagacagtgcatctaagagaggaactttcagacttaatcgagttcccaacatctgaacttctcaaaactgatctgacagctcgagatagggttgatgtattcattgcctggtcattgttgctgtcccacctgcaaacactaccagcatcttccagtatcaagggagatgtgcttcaatacatacaagaaaaggtcagtccgtgcatattggattgcattttccagcatatcccagtaaaggccgctgcgccgagtgggaagaaaaaggacaccgagctagcgcctgaagcagaagctgctgccaaagcttcgaagaatgccatagctacttgttctttgcttccgtacttggagtctctttggcccatcgggactttgcagatggcctcacttgtaggctcactgtacgggatgatgattaggctgctgccttc

SEQ ID NO: 15140 - DNA, 630 bp, Zea mays
  Clone ID: LIB3279-223-Q6-K6-E6
aggagatctaggttacgcaagcagcaagagtgtgaggaattagccaggaaggtagctgacctaacaactgagaatagtgctctcagagcggaacttgacaacctgaggaaggcttgccaagacatggaagcagaaaattcacgtctattggtgagcacggtaccaagtgtcacaaccacactgggaatgagcatcgagccgccaaaggcgcagcagcatcatgacgacgagggccagctccacaagaaatctagtaataacagcaacgggaaaggaagccacaaaccggaggctaacactaggtgagagacaggtgaatgagaaagtgacagagatgagatgaggtgtttcctatctaaccacaacacccatcatcaaccagtgcgttttcacagcccgctggggggccatgtagagtcgccccccactgcagccatgtattatttatggctcgccgcggtgtgcgttgtgtgtttttttgtgtgtgtgtcgtgtaaacctattgatgtagctattgtaacaaaaacctagagagcctagaatttttatgtctgctaactcctgatgagggggggatgtaaccggccaatttggtgcctggtcgatcgtttagatgaaatgcgagcaaat

SEQ ID NO: 15141 - DNA, 317 bp, Zea mays
  Clone ID: LIB3279-223-Q6-K6-E7
tgctcctccacacctggggaaggggaagggatgggacggggatttgcttgtgtgcttgctttgtgtttaattttgtacgtaggctgggaacatgtgtttggtgggatgatgatgatgatgctgctgctgctgcttataaactcaacattctttataccttgtattgtacaagtgcatgtacaagatgtgagtcgacccgtttgggttgagtaactctcgagtgttttttcttccatggtgtagcgttttcctgtttctccagaattttctgagcaatgtacagacagacaaacttttgtgtgaaacacctgttgtcc

SEQ ID NO: 15142 - DNA, 626 bp, Zea mays
  Clone ID: LIB3279-223-Q6-K6-E8
caagtttctctctactgctgataaaatagatggagcaccactggtatttcagctgactgcagagatgattgaactagaggagcacggtagttcacatcataaagaaggtggtttgaatcttgtgccaacattagaatctgaaaaattttctgaggatgaatcaaaactctatcaaaggctcgtgaatgttaggatgaagattgctcaagatattggcactgctccgtatgctgtatgtggcgatcagacaataagaaactttgcaaagatgagaccttctactggagctagacttgctaatatcgatggtgtcaaccagcattttatttcacgtttcagtaacattttcatccaaaatattgcggaattgtcgaaggagttaaacctcccgttggataattcaccatttccaccaccaccaccaacaaatccagctgcagaaaatattgctggtataccaaaacctgtacaaaacaatcttcctgggatcttgggtgatgcaaagctgactgcatgggaattgtggcataagcaggagtactcattcctgaaaattgcttatttccgcagagcagtgccaataaaagagcaaacagttattgcgtacattcttgatgctgctcgag

SEQ ID NO: 15143 - DNA, 623 bp, Zea mays
  Clone ID: LIB3279-223-Q6-K6-E9
gcctgctcgtctccaccacgcccaagtgcgtcgtcgtcgtcgaggacatcgactgctccctcgacctctccgaccgcaacaagaagacaaagaagggtgctggcgtcggcgtcggcatcggcaccgccggcgacgaagacgccgcagcacagctcgccgtcatgtcggtgtcgccggtcgcggcggccgtgatggggcgcgagtccgtcagcctctccggggtgctcaacttcgtcgacgggctctggtcgtcctgcgtcggcgagcgcctgatggtgttcacgaccaaccacccggagcggctcgacccggcgctgctccgcccgggccgcatggaccgcaagatcgagctcggctactgcacgccgcccgcgctgcgtgtgctcgccaagaactacctcggcgtcggcgacgagggctgcgacgacgccgacgcggaccccgacacggtcaacgccctcatggcggaggccgagggcctgctcgccgccgccgaggtgcaaatcacacccgccgacatcgccgaggtgttcatgggctgcgacggcgcgggcgccgccgccgcgctgaggaagctcgtgggcgagctgcggcggaggcgggatgctgctgcccttgccacg

SEQ ID NO: 15144 - DNA, 648 bp, Zea mays
  unsure (1)..(648): unsure at all n locations; Clone ID: LIB3279-223-Q6-K6-F1
cccacgcgtccggccgccatgtctgggaggaagaagacgcgggagcccaaggaggagaacgtgacgcttggccccgctgtccgcgagggagaacacgtctttggcgttgcgcacatcttcgcctccttcaacgacactttcatccatgtgacggatctgtctggaagggagacgctcgtccgcatcactggtggcatgaaggttaaagctgatcgtgatgagtcctcgccttatgctgctatgcttgcctcacaggatgtcgcgcaaagatgcaaggagcttggaattactgcattgcacattaagctccgtgctactggtggaaacaagaccaaaacccctggccctggtgctcagtctgctcttagagctcttgctcgatctggcatgaagataggccgtattgaggatgttactccagtccccacagacagcacacgcagaaagggtggtagaagaggaaggaggctgtaatttcgagtcctgacgtggtgccctgtcagatgtagcagttcaagtctgtctgcatctaatatactgagttattaggttttgtatcgattgaagttntgagtgaactcttgaatgcttaccaatactcattcttgacatggcatacaacatagcagcacaattacaagaggccct

SEQ ID NO: 15145 - DNA, 669 bp, Zea mays
  unsure (1)..(669): unsure at all n locations; Clone ID: LIB3279-223-Q6-K6-F10
ccggattccggtcgaccaccgtcgtatctgaaagcaggaaaaagatggctnggtggaantctgaaaagatttccaagttcttgagttttaaggatcaaattatatggatagatcaaggaccctgttaaagtttaagactttaacgagtttttataagaggactgagagcctggtgctagaccaattgcacggggtgatcaaaacagtattgctacctgtgctgctgatagccgattaatggctttcagttccgttgatgagagcacaaggctttggatcaagggccgtaaattttcaattgagggtctcctaggtaccagtgcacactcgaatgctttaacaacggatcgttggtcattttccggctcgcacctcaggattaccacaggtttcacgtaccagtctcaggaactgtggagaaatttgtggaaattcccgggtgcctgtacacggtgaatcccatcgctgtgaatagcaagtattgcaatgtattcactgagaataaaagagttgtatcaatgatatcaacttcagagtttggaaaggtagcatntgttgcgattggagcaaccatggtaggaagcatcacgttcttgaaaaagagggtgactacgtncgcaaggagatgagtttnggtatttcttctttgagggagtcagtatatgcgtc

SEQ ID NO: 15146 - DNA, 637 bp, Zea mays
  unsure (1)..(637): unsure at all n locations; Clone ID: LIB3279-223-Q6-K6-F11
cttgtgccttgacccttgagttgcagtggntgtgcatctttaaccctccaattactgatatcttgatctaacttttgtgcctatgtttagaatgttttgttttttagagaaatgggtgttgataagaaaacaacaggaaaaattttgtgtcgttcgcctgaaatatttgcttcaaatgtnagtaacactctcaagaagaaaattgactttcttatcaanctttggtgtttctaaacaccatcttcctcgcatcattaggaagtatccagaacttctattgttggacctaaattgtacattgctccctaggtattgactgcaacttggtgtgatataaaattcagctagaaagagagatttggttttcaaaaatcagtgtgcctcataattgtgccattctacttttaagttttctccaagctgcaaacttttggtgcacttattgttaattttgttggttccctacaacctgcattaacggctccgccttttggggacaccttttgcaatattggaaggatctgtagtcattgcagttaatggcatgttccatttgcgttgtctgtttcttacttgtggtacttaaattctaattcaacatttattgacatatttcactagttaagtatggagtata

SEQ ID NO: 15147 - DNA, 630 bp, Zea mays
  Clone ID: LIB3279-223-Q6-K6-F12
aatccattccgcctccaaacccgaactgcaagtggcgccgcatcgatggcgcccaaggccgagaagaagcccgcggcgaagaagccggcggaggaggagcccgctgccgagaaggcgccggccgggaagaagcccaaggcggagaagcgtgtcccagcaggcaagtccgccggcaaggatgtttgtgagggaaagaggggccggaagaagggcaagaagagcgtggagacctacaagatctacatcttcaaggtgctgaagcaggtgcacccggacatcggcatctcctctaaggccatgtccatcatgaactccttcatcaacgacatcttcgagaagctcgccgccgaggccgccaagctcgcgcggtacaacaagaagcccaccatcaccttccgtgagatccagacctccgtgcgcctcgtcctccccggggagctcgccaagcacgccgtctccgagggcaccaaggccgtcaccaagttcacctcgtcctaggctgcgtggcctccgcttgcaggcttccctcgtatgttcgcgtgtcttgctgtagttaggtgctgctgtgtctggtctccttcggtagcaactgttatctgatggaacagtaacaatgcttattgaatccaa

SEQ ID NO: 15148 - DNA, 639 bp, Zea mays
  Clone ID: LIB3279-223-Q6-K6-F2
gcgaaatgtccctgtgattgagcctgaaaagcctatcatcaggaatttcattactcagactggtgttgtcaaagggctgcagcaatgtaaaggaagggactggtttgactacatttctgcacttcctctttcagacttaggacttccatttatgtccattgatgaggttatcaccgtcaacagtgatgatcttatcttagaagctttcaagtgcatgaaggataacaagattggtggtgtcccagtagtagaaggccccaaaagaaaacttgttggcagtgttagcataagggacatccgctttctgttgcttagacccaacttattttcaaatttcaggcagttgacagtcattgaattcatgaagactctaggctccactcttcctgattcagagagcaattgcctggtgaagccaccacccacttgcactcctgacgcttcccttggtagtgttattgacagcattgcatcaagaataacacacaggatatatgtagtggatgatgaccttgaggttgttggtgttgtgactctgcgtgatgtgatctcatgctttattcatgagccacccggttattgcgacaactatttggcttcagcgatggagaagcttgaggggaaaggagtcagatcagt

SEQ ID NO: 15149 - DNA, 608 bp, Zea mays
  Clone ID: LIB3279-223-Q6-K6-F3
cccaacaacctacgctcacgcgtgcaaagcgcgtcacctactatcagagctgcctattttcaagcgctatagcgtgccacatctttgctctctgcgtccaggctccacgcaccggcgatcgcacggcgtaaggctgacccacgcagctttgggagtccaagactacataacgaacccactccgagatttgttacaaacgcaaacaactacaccgcatccatgcttgcactgataattcatgataatggagaccatgaggggcggcgctatcttacttgtgctaatcttaacaaagaggaagaagcacgaacggcgtgaacacatacggtaactcatacactaccaacagcgcctacactgcctgtgtggcacctaacatgcagacttcctcgtgacactccttgaccctgcaccatgaagcgtgctacaacatcctgcataagaaaaggataactaaaaagaaccttagggctgctgagtaccacaagatctttgcccacaggctgaaggaacagactgaccgtcagagcgagagctcggtcaataggagatccaagctgtctgccggcgaaaaggtttctgctggcacctgtgcttaagaatattca

SEQ ID NO: 15150 - DNA, 664 bp, Zea mays
  unsure (1)..(664): unsure at all n locations; Clone ID: LIB3279-223-Q6-K6-F4
caaggccaaggcgccctgcattgtcttcattgatgagattgatgccgttggaaggcagcgcggtgccggacttggtgggggtaatgacgagagagagcagaccattaaccagctcttgacggagatggatggcttcgctggcaacagcggtgtcattgtgcttgccgccaccaacaggcccgatgtgctggactccgcgctcctacgaccagggagatttgataggcaggtcaccgttgacaggccagatgttgccggacgcgtcaagattcttgaggtccactcccgaggaaaggctttggcgaaagatgttgattttgataaaattgctagaaggacccctggtttcactggtgctgacctccaaaacctcatgaatgaggctgccatccttgctgctcgccgtgatcttaaggaaattagcaaggatgagatctctgatgctcttgagagaatcattgctggccctgagaagaaaaatgctgttgtttccgaggagaagaagaggctcgtcgcttaccatgaggctggccatgcccttgtcggcgccctcatgccagagtatgatccagtagccaagatttccatcatccctcgtggccaggctggtggactcacattctttgctncaagcgaagaaaggctagaatctggattgtacagc

SEQ ID NO: 15151 - DNA, 463 bp, Zea mays
  Clone ID: LIB3279-223-Q6-K6-F5
cggcgcggtacagctaccgcatcggcctctcctcccaggctttcaagatggaccagatcaaggctgacatgaagaacggcgtgctcagggtcaccgtcccgaagatcaaggacgaggagcgcaaggacgtcttcgagatcaagatcgagtagggtgtgtgcatcggatgggtcctcccaggtctcctagttgcagtccatatccataccgtagttgcagtccatatccatatcgtagttgccatgagctagtcgtattagtagtttcaattactggagtgcagtagtcgtttctgttgcagagcagtcgtagtactagtagctttctggtggtgctccgtctctgcctgatctgaggcagcgtttacctttctgttggtcttgcaaagttcagttccctggatggcgacgatcactgacgatcttgtgatgaacttcaaatggtaatggaatctgcagttaat

SEQ ID NO: 15152 - DNA, 575 bp, Zea mays
  Clone ID: LIB3279-223-Q6-K6-F6
gttatagatgccactcgggttggaagtatagcccgtctgatcaatcactcatgcgagcctaattgctattcacgtgccataactattcttggagatgaacacatcatcatttttgcgaaacgggacatagatccatgggaagagctgacatatgattataggtttttttcaagtgatcaacgacttccatgtttttgtggattccccaaatgccgtggagtagttaatgatgttgaggcagaggaacagtcggctaaaatcagagttaagagaagtgaattatttgaaaaaagtgaaaagtaaaggtacatcatattggttgggatatgacatgcttgtgtgatatgcttgccagtgcctaaaggcaaattctaaaaaatggttgagtttcattcttgaatcctgataattcttctcattatttgagtggaagacgaatctaattgtataggtacccaatataggatcggcaatccaatttggggacataagttgaatcaattgtcgtgtaccattgaaatgttagttgttacacatatttcggccatttatcttgttgaacctaccctattttc

SEQ ID NO: 15153 - DNA, 96 bp, Zea mays
  unsure (1)..(96): unsure at all n locations; Clone ID: LIB3279-223-Q6-K6-F7
ggttttgggtttttttttttgntcaaaaaaaaaaaaaaaaaaaaaaaaaaaaaaaaaagggcggggagggtnngggatntaaaanngggaccgcct

SEQ ID NO: 15154 - DNA, 642 bp, Zea mays
  Clone ID: LIB3279-223-Q6-K6-F8
gaaaagttgatggtacaaattaatcttaacgaaggcattgaagaggatatcccaccgagccaatatactaccaggtgtgaagagaaattaactatgactcaagctgccatctcaagggaagctggacctccaggttatggtcctggagaaaactttcttcaggtcagttcaaggattacggggtgtgagcagagtgtgataatggctcctagcgctatcgcaagaggagttggtccaccaggatatacgcctggagaacaccagggcaatggggctccatggaatacaagctatgagcgaagaccgtttacgagtcctgcgactagctcaagagaagtcggacctccaggatatgggcctgaagaaaaccaaggcagtggcatttcctgtaatacaagcagagagcaaatattgtttatgagccctacaaccatctcgagagaacttggtccaccaggatatttgcccagagaaaaccagcgcagtgacacttcatggaatacaagctgcgagtcgggactatttatgagtcctgcgaccacctcaatagaacatggtccaccaggatatgggcctggagaaaaccaggagaatgacagtacaagctgcgagttgagaatgtttaccagtcctacaatcgtc

SEQ ID NO: 15155 - DNA, 485 bp, Zea mays
  Clone ID: LIB3279-223-Q6-K6-F9
gtcgcaagagcctgaccaccgtccagggattgaagaaggagttcagctacagcaagatcctcaaagatctcaagaaagagttctgctgcaatggtacagtggtccaggacccagaacttggacaggtcattcagctccagggtgatcagaggaagaacgtctcgaatttcctcgtccaggggggcattgtgaagaaggagcacatcaagattcatggtttctgagcaaccgccgggtccatagcaaaccaaccctgcatgcagggccagcttattatatataatatctgaggtggagcatatctatctggctgtgtactgcaagcaggcctagtacgccgcctgcgcgttcctcctattacacatataggcccctccctgcgtgtatgcttgttaccgtcgtgtcgaaccttgtactacgaggctccatcgaacatcgatggcttgcttctttatcagaacatgtttgaataaacgctatttggt

SEQ ID NO: 15156 - DNA, 194 bp, Zea mays
  Clone ID: LIB3279-223-Q6-K6-G1
catgcgctcagtctctatatatgggtgaggtcatcacatgtacattatcactttccatatggcctgcgaggctgcgactagctagcaccatgcataccatagaaacattactagatgtggatcgccattgctttgtttggcttctcttctgcgtacgtacgtactcgaccactgcacagccagtcactgtgtgc

SEQ ID NO: 15157 - DNA, 468 bp, Zea mays
  Clone ID: LIB3279-223-Q6-K6-G10
cggacgcgttggccgagaagaccaggcgtactggagcgagtacataagaaggggattgaggccgatgacatggaagctctgacaagaaggtcatgctgcatccgtgctgatctgcatggcaagtaacaaaggcgcaccaaaggagccaagaggacatccccaagaagtggagctatgagcagaggaaggccagactcgtggaaaggctcaatgccctcaattcctcgggtggtgtcgatgatgatgaggatgacgaatgaagtgctagtcgcggcacagtagtgctatcctatttggcgatcagaacttgcgcaatggcatttgttgtccctttactctgaacaggcatttttttttgtttgagtttagagctggatatatggagttcacgatgtgctgccggttgaccttgctctttttatccctggattttgtcagtctttgggctgagacacaaatcttggaatc

SEQ ID NO: 15158 - DNA, 474 bp, Zea mays
  Clone ID: LIB3279-223-Q6-K6-G11
gcggcaattgcggcaaggggcttgggggagggcggcgccaagcgccaccgcaaggtgctgcgcgacaacatccagggcatcacgaagccggcgatccgtaggctggccaggaggggcggcgtcaagcgcatttctgggctcatctacgaggagacccgcggcgtgctcaagatcttggtatgtaacggtatccgcgacgccgtcacctacaccgagcacgcccgccgcaagaccgtcaccgccatggatgtcgtctacgcgctcaagcgccagggccgcacgctctacggcttcggcggctaggccgcctccccttctgatgctttgatgtgacggccgtggtcggttgtgtgtctagttggccggtctactgtagtttgttctgtatcttcgtttcgaggtgttccagtttctagcccatttggtgtaatattttcactgctattatcaatggaaagccctcggttctatccc

SEQ ID NO: 15159 - DNA, 615 bp, Zea mays
  Clone ID: LIB3279-223-Q6-K6-G12
ggaggactacccgtacgcgtcggacgggggtggccgtctggcacgccatcgagcagtgggtgacggagtacctcgccgtctactaccccaacgacggcgtgctgcgggcggacgtggagctgcaggcgtggtggaaggaggcgcgcgaggtcgggcacgccgacctcaaggacgcgccctagttgcccaagatgcagacggtggccgagctggtcaaggcctgcaccaccatcatctggatcgcgtcggcgctccacgcggccgtcaacttcgggcagtacccgtacgccgggtaccttccgaaccgcccgtccgtcagccggaagccgatgccggcgccgggcagcgacgagtacgcggagctggagcgcaagccggagaaggtgttcgtgcgcaccatcaccagccagttccaggccctcgtcggcatctcgctgctggagatcctgtccagccactcctccgacgaggtgtacctcggccagcgcgacaccaaggagtggacgtcggacgccaaggcgcaggaggcgttcaagcggttcggcgcgcggctgaccgagatcgagaaacgcgtcgtcaccatgaacgcggacccttccctcaagaaccgcaacg

SEQ ID NO: 15160 - DNA, 641 bp, Zea mays
  Clone ID: LIB3279-223-Q6-K6-G2
gccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgaatccaaggtgaacgagactaaggcaaccgtcaagttccagctcaagaaggtcctttgcatgggcgtcgccgtcggcaacttggcgatggaggagaagcagatccagcagaacatccagatgagcgtgaacttccttgtttcccttctgaagaagaactggcagaatgtgagatgcctctacgtcaagagcaccatggggaagccatacagggtgttctaagtatgctcttttgtgaagtctgctaggttctggcaccgaggttttattgaattaaactcttgttaaggatatgtttttggacgatcctatatttcgtcctggcgctactatgtttcagaatggtggtactactataagtatcctggcgctc

SEQ ID NO: 15161 - DNA, 405 bp, Zea mays
  Clone ID: LIB3279-223-Q6-K6-G3
agatcgcgacggccgccctttttttttttttttatgtcacttattagcattatgtcactcgccacaagctggattactggaaatacagatgaaggatgagtaacgctgaaaaggtattactggcaacacatgtcctggaagcctgagttcagctacgatcaaccatggagggcacatcacttccacttcttgaacttgccgccgccgaacatgccgtgcccgtgcttgccatgcttgaacttgccgtgcccgtgcttgaacttgccgtggtggccgtgaccatgcttgaacttgccgtggccaccatacccgtggccgtaaccaccgtgaccatagcctccaaaggccccatgtccaccgtgtccgctatggccatgagaaagcttgtgtgctccataagcggca

SEQ ID NO: 15162 - DNA, 657 bp, Zea mays
  unsure (1)..(657): unsure at all n locations; Clone ID: LIB3279-223-Q6-K6-G4
cggacgcgtgggcgagagtgctctcccaggtcgaggtggtgtaggtgtttggcggagcagccggggcgttggaatctgaggaggagaagatggtggtgctggtggtggccacgacgtcggacccggcgtccattgggcccgccgccgccttcctcgccatgcccggatggtcccccggcccgcccatcgccgaggcgatggagagttttactaatgggaatgttcgattactgaagcatgaatgtagcattgtcgcagaggatgatcttgaccagcgatggcaggaagccactggagagtctgtttctgaggtcatattcctcagcaaacacactgcagtctccaaacgtccagcactcacagtgcatccaattggtgtgccacatctgaaggaggatgaaaccccaccccaaggaggaactcctggatgggcagcaattccaagtcctcgaattggaccttggctccggttgatgcaaaagatagctgtagaacaaggccttgttccagagtttgaggttacgcttgaggctactcaccatggaccagttaccagcacacccaccatgtttgttgagatangaagtacagaagaccactgnggtcgacaagatgctgcacaggcaattgctctagttctatggaaaggtcttggta

SEQ ID NO: 15163 - DNA, 642 bp, Zea mays
  Clone ID: LIB3279-223-Q6-K6-G5
tccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaacagtggaccccgtgaggatgccacccgtattggttccgctggtgttgtgaggaggcaggccgtggatatctcacccctgaggagggtgaaccaggccatctacctcctcaccactggtgccagggagagtgctttccggaacatcaaaaccattgccgagtgccttgcagatgagctgatcaacgctgccaagggctcatccaacagttacgccatcaagaagaaggacgaga

SEQ ID NO: 15164 - DNA, 635 bp, Zea mays
  unsure (1)..(635): unsure at all n locations; Clone ID: LIB3279-223-Q6-K6-G6
gttgagttgtagggtttcagagcgctgtcgtggttgggttgggagcgtctgcggcgatcgcgttggctgggctggcgtggcgcttcccatcctccaggaagcgatccatgttccatatttgaagttggcttaccactgcttgtttcatgatataatccttttattgcttactccttcagatcggcttgaaaaatatgattacaagaggtatacaacaactcattgttgcaccattacactatgttcaagataaattgtcaacaatggagtcaacagagataatcaaggaggatgcaagtgagagggaatctgatgaaatcgaagtttctagtgcaacacatgataagaaggctgaagcaataactgacgattcaaggcaaaattacaggacagcaatcgccagccattttctattcagagttcatacagatcctgtacatgaggaggctttctctatattgaagaagcttcagataattgagaaagatgttagctccagtgatttttgtacacggagggaatttgcaagatggtttgttaagttaagctcanagtttgagaggaaaaggatgtgcaggattgttcctaataaattaacttctgacacagtccaatgtgcctttgatgatgtaaat

SEQ ID NO: 15165 - DNA, 575 bp, Zea mays
  Clone ID: LIB3279-223-Q6-K6-G7
gtcggttcacttctccaggaaagggggggtgctgatggcgccgccgcagccaaagtcgggcctcttcgttggcatcaacaagggtcatgtcgtcaccaagcgcgagctgcctccccgcccgtgccaccgcaaggggaaatcaacgaagagggtgtctatggtcaggggcctgatcagagggggtgctgggtttgctccttatgagaagcgtatcactgagcttctgaaggttggcaaggacaagcgtgccctgaagcttgctaagagaaagcttggaactcacaagagggcaaagaagaagagagaggagatggcgggcgtcctcaggaagatgaggtcggctggtacgcacactgacaagaagaaatagagagcatttcaagttcatggagcctgccagagattatgttccagtgtctgattttccatacatgtagaacctaatagacatgtcaaagtattatgtatcgaaccagctcatgggattttgctccttccaatgcatccagggtttatgtatcgaaccagtttatgggatcttgctcctattccaatgcatccatggtttgtgaatc

SEQ ID NO: 15166 - DNA, 663 bp, Zea mays
  unsure (1)..(663): unsure at all n locations; Clone ID: LIB3279-223-Q6-K6-H1
gctccggcatggccttcagcaagctgaccggcggcggcccgacgaccccggcgggcctgatcgcggcggcggtggcgcacgcgttcgcgctgttcgtggcggtgtcggtgggcgcgaacatctccggcgggcacgtgaacccggccgtgaccttcggcgccttcgtgggcggcaacatcaccctgttccgggggctcctgtactgggtggcgcagctgctggggtccaccgtggcgtgcttcctgctccgcttctcgacgggcgggcaggccacgggcaccttcgggctgacgggcgtgtcggtgtgggaggcgctggtgctggagatcgtgatgaccttcgggctggtgtacacggtgtacgccacggcggtggacccgaagaagggcagcctgggcaccatcgcccccattgccatcggcttcatcgtgggggccaacatcctggtgggcggcgccttcgacggcgcgtccatgaaccccgccgtgtccttcggccccgccctcgtcagctgggagtggggctaccagtgggtgtactgggtcgggcccctcatcggcggcggcctcgccggcgtcatctacgagctgctcttcatctnccacacccacgagcagcttccctccaccgactactaaagccgaagccgaccgacccaggggt

SEQ ID NO: 15167 - DNA, 593 bp, Zea mays
  Clone ID: LIB3279-223-Q6-K6-H11
ggtcgtgcgttccccgcgacccttgccgtgtgcggcgcctgcccctgccaccccttcgattctctcccgagttgcttctctcccgagtctcgtccttcccgttaacacctcctcccaaaaccctaacccctcgacctcccaagatggcatcgcctccacccccgcattcgtagctgcacgtcattcgaatcgcagccgccacggatctagtggcccgacgtggaaggcagaactccctgaccttttctctccaccctaagcttctgcacgcgcgcaccgcccctcaccgtggggctcttctcctcttcatccgccacaggatctcgcctcgccgaggccatgtaccgtgccgccggggaccacatccgctccctcaaggtgaatagacaaaaattcgggtgagacaaattttcctggtgttgtacgaggagagggcagccagcggccaccgggagttcgggtcctaggagccaccgacttcagtcgcctgctcaaggacggcgagggcggtgcctacctgacaagcccgcgcggcggcatggtagttgccatcaagaaactcactcccaatgacataaggttcgaatgctcca

SEQ ID NO: 15168 - DNA, 612 bp, Zea mays
  unsure (1)..(612): unsure at all n locations; Clone ID: LIB3279-223-Q6-K6-H12
cgccgtccgacctaaccctagactacaagcccagcggcaacggcaacggcgccgcgtacgcagtgacgatcccgaagccgccgcaggagacgctcgtggtggacggacaccaccaccaccaccagcaccaccatctgacggcgccggagcagacgacgcanaagctcctggagttcctcgggggcctggaggaggagcggctcaagatcgacgccttcaagcgcgagctccccctctgcatgcagctcctcaaccacgccatggagtcgtaccggcagcagctggaggcgtaccagatggggagcctgcagggcgcgccggcgaggccgctggtgctcgaggagttcatgccgctcaagaacatcgggatcgacgccgccgccgacaagatggggaacccgacgtcggagaaggcgagctggatggagtcggcgcagctctggaacgggcccgctgcaacggcggacgtggccgccaggggcccgcagacgcccaaggagagcgcggagtgcgcgcacggcgccgcaggcgccggccacgggcagcgcaacggcggcggcggcggcgcgttcctcctgttcgccaaggacaagaccgcgtncgtggcggaag

SEQ ID NO: 15169 - DNA, 614 bp, Zea mays
  Clone ID: LIB3279-223-Q6-K6-H2
cccacgcgatgactatttactgcacaaacattgacaagaaggtcagtcaggcagatctgaaattgttctttgagtctatatgtggagaggtctttcggctgaggttgcttggtgactaccatcattctactcgcatcgcttttgtggaatttgtgatggcagaaagtgctaccgctgccctgaactgcagtggcgtgatactgggatccttgccaataagggtgagcccctcgaagactcccgtgcgtccccgtgcgcctcgccagctgatgcactagaggtgtcctaggtacaggaggtgcggaaggcactgcttatatatcatcatcatatatatataatagagaatagacatatatgaaagaggggaggggaaaagtggcgtcacttgttctaagttatgggctcggcctttttgttttgggttcttgcttcaccaccgtgtgactgagtactaaagtgcctacgtacgccccgggtcgacgccggctggcagggcccttttgtttactaccttgcacatagaaggagaggagatggagagcttctcactagaaggatcggaagcgcgcgcgggggggtctgcctgatgctcttgtccttgatgcaacaac

SEQ ID NO: 15170 - DNA, 595 bp, Zea mays
  Clone ID: LIB3279-223-Q6-K6-H4
cggacgcgtgggcggacgcgtggggaagtttgttgctgcctacctgcttgctgtcctcgctgggaacgccagcccctccgctgacgatttgactgccattctggagtcagttggctgtgaagttgacaatgaaaagatggaactcctgctgtcccaactgagcggtaaggacatcaccgagctcattgccgcgggcagggagaagtttgcttcagtcccatgtggtggcggcggtgtcgctgttgcggcagctgcacctgctgctggcggagctgcttctgcagctgaggcaaagaaagaagagaaggtggaagagaaggaagaaagcgatgatgatatgggcttcagcctcttcgactaggctgcacagtcatcacagtattgttttgggcagtgaaaccagaggaaaaccagagtcatgtttagattttaagcttgttttatgttggaaagtactggaaagactgctacttgtctttatatttggtaattcagccgtagattgctatgctggttgggatttactcgtgaaccagagtttttctgtcttatatatcctgaattggttatcccaaagtttcttggctttttaact

SEQ ID NO: 15171 - DNA, 557 bp, Zea mays
  unsure (1)..(557): unsure at all n locations; Clone ID: LIB3279-223-Q6-K6-H5
cggacgcgtggggccgngtgctcaagagccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctgaggggagcattggatggaggcctggatattcctcacagcgagaagaggtttgctggattcaagaaggacgacaagcagttggatgctgatacccaccgcaggtacatctatggtggccatgttgctgactacatgaagaaccttgctgaagaggacccagaaaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaac

SEQ ID NO: 15172 - DNA, 612 bp, Zea mays
  Clone ID: LIB3279-223-Q6-K6-H6
atttgcgcggctacgattcgctcctgcaactgcagcatagaaagtgacgtcgccgtcgccgcattcgcgccgccctgggctccgtccaactaccgttgcaaacccaggcttgcctgacaccagaagctgctcccctctccgatccagcggcgccctgttcgactgcggcggcggcggctagcatcccgatccggtggcgccccggccttgctcgattcctacagctgctatccttttctacctgcagcgccctgctccactctagtggctgctcccttcccaatctgagccccgagatgcctgagtccagggacggcaggagtgaggacctagctgacctttctggtggtgttggtggtggagggttctttatcaggagggtggcctcgccgggagccctatcggtgaggggtgtcaggaagccgttggcgcggcgttatatttcaccctcgaggaacaaggagaacctgctgccggtttgggcgttgagggtcacaccgacaaagaggagcccgcttcctggatggtaccccaggacgccgctccgtgatattacggccattgcaaaggctattcagagaagtcgttcaaggattgctgcagctcagcagc

SEQ ID NO: 15173 - DNA, 297 bp, Zea mays
  Clone ID: LIB3279-223-Q6-K6-H7
ttggtgttgatgaggaaccaagcaagggcacactgacgaagatcggggagattccagcgatcgaagagtttgttttcctcaagctctaggcgcgaatgtatgtttgaagttgcaagcatggtgtgcaattttgatgtagctagcaatccggaggacggatggttctccttgaaataaggtggggggagtatttttgtagtggcgctcttgaatatggtctggtatcgatgcctacttttgaacggggtgtttattaataaaaacttatatatcaatgcttggctcattggttgattc

SEQ ID NO: 15174 - DNA, 600 bp, Zea mays
  Clone ID: LIB3279-223-Q6-K6-H8
gtccctcttctctcgaggtattagcagtggagggggtcctcggagcacgatgaagtttgttgctgcctacctgcttgctgtcctcgctgggaacgccagcccctccgctgacgatttgactgccattctggagtcagttggctgtgaagttgacaatgaaaagatggaactcctgctgggggagctgagcggtaaggacatcaccgagctcattgccgcgggcagggagaagtttgcttcagtcccatgtggtggcggcggtgtcgctgttgcggcagctgcacctgctgctggcggagctgcttctgcagctgaggcaaagaaagaagagaaggtggaagagaaggaagaaagcgatgatgatatgggcttcagcctcttcgactaggctgcacagtcatcacagtattgttttgggcagtgaaaccagaggaaaaccagagtcatgtttagattttaagcttgttttatgttggaaagtactggaaagactgctacttgtctttatatttggtaattcagccgtagattgctatgctggttgggatttactcgtgaaccagagtttttctgtcttatatatcctgaattgggtattcc

SEQ ID NO: 15175 - DNA, 613 bp, Zea mays
  Clone ID: LIB3279-223-Q6-K6-H9
gcggcgaccacccgattcgaagcgtgcggagagaccgaagaagcgggagagatggctcgtaccaagcagactgctcgcaagtccacgggagggaaggctcccaggaagcagcttgccaccaaggctgcccgtaagtctgcccccaccactggtggagtgaagaagcctcaccgctaccgggggggaactgttgccctccgtgagatccgcaagtatcagaagagcactgagctgctgatcaggaagctgcccttccagaggctcgtcagggaaattgcacaggacttcaaaactgatttgcgtttccagagccatgcggtgcttgccctccaggaggctgctgaggcataccttgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgagtagggtttgttttgtggatcgcaagtttctcttctgctactgttgctgctacctttgctggtgttattgcta

SEQ ID NO: 15176 - DNA, 583 bp, Zea mays
  Clone ID: LIB3279-223-Q6-N6-A1
caatacacacagcttgtatagattctgaaaaaggacacaattcatctgtagaaaaagaaccatactaagacaggattaataaacgatcgcccgagaggggatgatcatcaaaggtaatattttgcccgcaagcatagtacaaagtacactacagaacattgtggaacaaatgtgtgtgcacataaactcctcaactcagcttctgcagcggtagacggcagtatcttcccaatttagtgatggtgaacttgaacataacggagaccacagtacttgcacacattaggtgcctccagatcaaggcagatgtactcaattgggtggccaagtccaacaccttcagaagccccttcacagacggcaatgcgaccatcaaccttgatcggaggtacctcgttgatcagttccattggcgacttcttgctcgtgtcctgcatccacttagcggtgtggctgccgacgacggcggctgcaccaacagccttctcggtggagaggccgcgcgcgccggctggagctagggtcttgaggagcgcggggagcagcctccgcgtcgcggtcgccatggctggggaaggttgcg

SEQ ID NO: 15177 - DNA, 426 bp, Zea mays
  Clone ID: LIB3279-223-Q6-N6-A10
aaaccattaaaaacttcagggggcccccccccccccccccccggggtaaccccaaaccccaaaaccccccgaagccctagggggggcccccaccccaaaggggaaccggggcgggcccccatttgacccaacagggggaagggaaagggggggggcccccttggttctgggggggccccaaggggcccccaatcggggggggaaaaaaacccattcccttcagccctttttcccccccaaagggggccttcaccccaacaaaaccctaagggaccccaaaaggggggggaccgggcctaaacaaacaaaaggggtccctttgcataaaaaaaacaaaaggggtccccttcccccccgagggggggggggggggaaaaccgggagtttataaaattaaaaaaaaggcctttaaaagggcggaggggg

SEQ ID NO: 15178 - DNA, 517 bp, Zea mays
  Clone ID: LIB3279-223-Q6-N6-A11
ctgaagggggaccttttatttcaaacgtttcaaataatcagggaaaggagttcccataatcgcggaaatctacgggaatccccaattgggaagggcaacgggaatgaaaatgatttggcatactggtgcggcctgcaaatgttcccctagctcaggcctttttaattcagggggggggcccagggaaaaaaaaggcgacataataaaaacggttcaaaagcgtcccccagaaaagcaccacaacttcggcaaggatttcaaaggttcaagttggcccccacccttaatctgagctcgtaaacaacagcgtaaaaaaacccctccgggttcaggaaagggctcctcgggatatttaaaaatccctgaacaaaaagggcaagggccttggtaattttcccaaactcgacgggtccaacccaggcagcctaaagcttctgggggaagtcaagtagtctaacattgtcataaagctttgccctgtgggcaagtccttttgtccacccaaaaatgaggcaac

SEQ ID NO: 15179 - DNA, 540 bp, Zea mays
  Clone ID: LIB3279-223-Q6-N6-A12
gatcagcaaggccagtgggcaacccccatcagctgatcaataaggacaagtcaatcgatgataggagtaccagttacaagtttcttgggtccaatcatagatcacagcagcatgcttccggtaattccacaaatatagcacaagggcagcgcactgcgcactagcttttatggaaattacagggattattctaaagaaatggagtagcagtccttggcattagcactgatcaatcacaagatattcttagcctgggggccagttcatttgcctgcctccgaggagatgaacgtggatgtggtaaacaaattgacatccacttgggccgtcattgatgacgacccgatagccatcttcaagtccttcctgcttcgcaacaaccttggcaacataaaggagatagccaagtatttctatgtgcctcttttcaacctttgccaggccagttagtccatccttgactttggggatgatgaaaatgtgtgttggagcttgagggtttatgtccctgaaagccataccttctcgtcctcataaacc

SEQ ID NO: 15180 - DNA, 519 bp, Zea mays
  Clone ID: LIB3279-223-Q6-N6-A2
aaaaaaaagggttctcaaaatagccctaaaaaagcaagaaatccggcacgttacacttctgtccacaacatagctttttgcagagattcagtacataagggttcttcaaattaaccataccacaccataacatgggacatttgcgaaactacgggtccaggtatcaaaatgcaacgagttcaatactaaaatataagcgtagggcaatctaatctttttcctcgccctcgttctcagcaatgttgaagtagcggagctcataaacgtttcggtccttgttggcagcaaccacgcgtagccaatcccgcacgttgggctttttcaagtactttttggtcaagtacttcaggtaccttttggaaaagggtccgtcaaaggtgacggggaccttggtcttctcgcgagaaaggtgacggagtccccgaggttgccagccttgccgccggcgaccttgatgcgctcctgcaggaactttttgagcgaggggacctccatgaacttgtcctccctggcttgggg

SEQ ID NO: 15181 - DNA, 571 bp, Zea mays
  Clone ID: LIB3279-223-Q6-N6-A4
accagtatccaaatgacaattttatcactgaagtgcggcaaatccagatgacagatgaatatgaacatcaagcatggacgatcaaactcatccaccatcatacatataccaagtcatcaccaagcgctcaaagtacttttagaggtcatggatgtccccaacatattgagttgccagcaaagtgtaaaatccccagtagcaagtagtagtagtagtatgccaatcaacatgcttcacttagggtcagtgaagaacttgttaactgcaggcatgatctcaggagtcttgtcgtgcacaaagcttcttaggccatgcatggcgtaacgtctcccctcctcatggttctcaagcacaccagctgccctccctgccttgtttaccctgacttccgggttgccagtgatgttccggaagagctgaaacccgcagatgccgacggccacgcccgtcgccgcgaacagcgggtacacctcgggccggacccagcggctggccatctgagtcggagtctcttcgcactgggacgcggcctcgacggcggagaagccggggaaagtcggacgcgtgggtc

SEQ ID NO: 15182 - DNA, 363 bp, Zea mays
  Clone ID: LIB3279-223-Q6-N6-A5
aattagcattattaccacaagggggcaaatgcaagattttaaaagcgcgacttcttttttcacataaaattcgaatccgaatcctgaacaaccaaggaagtagaagaaaaaaaattcaaacaaacagtttctacgctcagcacggctattggcagagcagcaccaagattagtaataagtattgtccgccgctaaacaccgttacaaaatttggctcggctcccggcactccacgtcaccaccaccatcgtccatctacaaccatctacagctcgtcgtggtcgtcgtcaacaccgccgtcagcgtcaccgccaggggcgccgcccgaccgctggtacacggccgacacgatggggttgcaca

SEQ ID NO: 15183 - DNA, 596 bp, Zea mays
  Clone ID: LIB3279-223-Q6-N6-A6
cttgttctagctgatccactaagcaaagttacacagattcagaatatgcttgtatgaatgcaggatgcaagatcactcctccatagcatcaccaccctcggcgacctcaaccttctgctttagaagtgtgacctttgaagacagtacctcagtctgccccttggtgaaactgtatccctttgaactagcataagtcctgggattcggcaactggtggtttctcaagtattctgtcttccccttggttatcacgcagacgtccacgttgctcccactacccaagtcattgaaaataccagcacagattgcttcgcacacaatctgtattccctcctccctagtaaggccttctttgtacttcgattcaaacactgacattgcagcaagagaaccagagcccatggtggcaaaaggaagagtatcagtggacccgtgtggataaacagtgtgtaaatgtggcccagtacaatccactccaccaagaacaagggcagcactgacatggccttgatacttgaagaggtgtgacttcagtagtgtaagagcagttacaactcttgattcgcggcccgttgcataacggtgaagctgtagct

SEQ ID NO: 15184 - DNA, 477 bp, Zea mays
  Clone ID: LIB3279-223-Q6-N6-A7
gggggagaaaccaaaccaaaccattagggggggcaacccaaacaaggagagggggtaccaccaccacttaaaaagaaggggcaggcccacaacttgccgggaaaattaaagacaggttaaaaccccatgccgggggggaaggttgccaaaaaaaaaaaaaccatgcccccaaaggattggccgggggacaaaaaaaaaaagaaaacgggggttcaaaaataaaaaaaaaccccccgcagggggggggggaaaactttggggagggcaccaaaacgggcaaaaattgccccccaaaagggggcccagggaaaaaccacccccaggaacaacggggacctttgttaaaggacggccccaaaggaaaatgccaaggttttaaccaaaaaccctgggggaaataatgggttgggtggaaaccccaaaaaaaacccggttgggcccataaatttttggcaaaaaagggttttaaaaaggggg

SEQ ID NO: 15185 - DNA, 581 bp, Zea mays
  Clone ID: LIB3279-223-Q6-N6-A8
aatggaatccaacttcgaaggagaaatccgggctcagggaccacgacagcagattctccgacccttacacaacatttttcctgtttctagttacaatgcagttctattacatggcagacgcaaactacaaatctaacaaatcagcaaccacacaaacccatggcagttgggtgttcaaagcacgccgttctcgtacatcgagccatctctggtagtagcatcttcggccatgtcgagctcgaccaaggcagcatcaacgagagactgcagcctctgttcagctgttttgaccctatcattgtagtcctgaagttggaggaaatgtttgtacaggtctgtaaccgccaactgtcgttctgaagatactttccgtgcggcaaccagttcatcctctagtttctgagctttcttctgcaaatctgcaatgtgctgttctttcccagatattttatccttaatctggttaacctcattttcaaggtcctcgcgcatctgaatagttttatccaactgatgttttccatcattttgaagaccatcactgggaacttgataaatctctgctatcacgaccttttggg

SEQ ID NO: 15186 - DNA, 82 bp, Zea mays
  Clone ID: LIB3279-223-Q6-N6-A9
ggaatattggtggcaagttgcacagtgatgaaaaagaatcagcctatatgcttctatgaagcattgaacaggccactgtaca

SEQ ID NO: 15187 - DNA, 550 bp, Zea mays
  Clone ID: LIB3279-223-Q6-N6-B1
gaagggtaccaaaggagtctgggcagattcgatgaacagatagaactacaaactggattcaactgcaatcagggtccaaaacacgcaaagccgtacagattcacacagcaggggaagcaaggagtttcgatgacacaaatggagataagggtggcagcagggggactcaaacgttcagcagctacagctagtacggtttcttcatggggaagacgaaggaaacaagacctgcactgcctttttaatatgcgatgcacggtttggtttcctccttcaattcccgcggggtactataccgttaccgcaggctttactcacttggccataatgaccttgacaaactcctcgtagttgatctggccatcgccatcgacgtcggcctcgcggatcatttaatcgacctcctcgtcggtcagcttctcgccgaggttggtcatcacgtgggggagctccgccgcaaaaatgaagccgttctggtccttgtggaacaccctgaacgccttcttgagctcctccttggagtgggggtcctttattttgcgggccatga

SEQ ID NO: 15188 - DNA, 568 bp, Zea mays
  Clone ID: LIB3279-223-Q6-N6-B10
ggctgggtcaatattattcagtaggacaaaccatcaacgaaatggcacgttacatgttacagactccaggagactgaaataacataacatgtatgtagatagatacaatcaacctgacataaacaattttgcaagatggcgggggacaagccatgtcacctgcacacatcacggcctaagaattatctcttatcacgcgtgtccatggtttctaagctcttccggtaaatgcagcacgaccacactaagaccaaatttcacagaaatgcaagccattgcccctgctcaggttagggcctcgacaagacaacttttctatgagcattgaagaatcttgctccaaagctcagctcttgctgtggttcgcacttttcagcagcttccggctaggccggacgtgatcgtccttatataatgaagccgcaaagtctgactgcatcgtctgattttgggcctgaccaaaaaactgcagagtcttgatggcatttaccgtgagctgccagcctgaaagagctgtgctcgaaccggtactaatacaacatgcagcagcaacatttccattcaccca

SEQ ID NO: 15189 - DNA, 587 bp, Zea mays
  Clone ID: LIB3279-223-Q6-N6-B11
aataaataaatgttatacacactccaagggaaataccactcgttcaagcatcctaaaaaaagtttcgtatccagatctggtattacaatagtgtaacacgtgttttgttgtggtacaaataatgcgtcccgagtcggataaatcttccgatctccaataacagtgtacgtacatacctgcatggcacgaaactatgcagttcatcgtggactggaacggagcggtgtgtaaaagcgcaggcgctactggtaataatagcgtagctgctgggggggtatcttggctggctgcatccaattccaacaacaatgacgtggttggtggtggctacgggaggacggggggtgccacccggcaggtgttgtgagactggcagtggcagcacttgtggcccgccacgccggagaagacctgcgtcgtgtccctgcagtcgttgcacacgacccatccctttcccgtgtacaagtagcttgcctccatctctgcgtcgagggccttgaagaacttgtccatgtcgaagatgggcgtggcgcatatggggcacgagaacttgtcgtgcttcaacatctcgtggaagcactgcaggt

SEQ ID NO: 15190 - DNA, 456 bp, Zea mays
  Clone ID: LIB3279-223-Q6-N6-B12
ccaaccgacaaaatatcaatttatatatattgctgtcttgatttacaataattggtacatcaaacaagcgcccttgatgttccaaccaaaaatgaggaaaaaacattacatctgatttctgaagcaaaccctgtgtcattgatttctgaccttccgaaaacgacaggccatcatcaagtcaagtatagacaatatccaataatagtcttgactcactcatcctatcggatatgtttgaagctgttgaacatcccggtgtgggaagctttggctgcaggcttgggcgtttcaggggttccaaaaacgttccagaaccggagggtctcgtcagcagcagccgacgctactgtgcatccatcaggactctgagccatgaagaggacgcgagaggtatggccattaagttcagccatcttcaccatcgatgggtacttccacaaggtgagttggttctgt

SEQ ID NO: 15191 - DNA, 582 bp, Zea mays
  Clone ID: LIB3279-223-Q6-N6-B2
gccggcgtaacactgagaaagccatgtatctgcatatagctgttggtgtgaacaaacaatggaaaacaaacagtagcacgagcttcaacgcagaagtctacaattcagaaaccacggataaaccacgaacatatcagagggttatgttgtgctactgataattcgactatagcttgcaatacatcttttagcaaaggcaaactctgacccacatctgctggccccccagttacacgtaactgtctatcagagacttcctcatgtcctccacaatcgcagtgggctgcccttctctcagcttgaagacgctttcgatgactgagagctcggtggctgtcgtgtccgagccacaaaaggcagtccagtcgttcactgtcatgcctgcagcaatgacctcgcttcctctgttcacagttcctgcgacaagaggaacttggaggagcgtggagagctcgtcaaggtcttcaacggatgtatggggatgaaccaaaccacccctgttagagaaggcgcagtaactccccacaaggatatttccagcaatagtctgcctaaacacctcgaccccaagcacatctgcaa

SEQ ID NO: 15192 - DNA, 568 bp, Zea mays
  Clone ID: LIB3279-223-Q6-N6-B3
caaggaaacatccaatagataaaaacacctgatgtatgttttgttaacaacgggagggccaaatggtaaaaaacgaaacaaaaaaaaggaactttacagaccatgaaccctgagtccctgacgatagccaattatccgcaaggacccaaaggcccagagggttgctactgttaaaaaactccgccatgctcctctctcctcacaagctcagcaagaacttgaaaatgtcacttagtgatatgatgccctccacacgtttgctcccagcttccacaatgaacacccgccgcaccccaggattagccagtcgctccatcaccttcagcaaaggatcagaccggaggcacatctggcatctctggccgttaaagaatccaaaaggtgtattggcatcttgtccaagctgcaaagcctggtgaatggtcatctcatccagccgaacatgtgtgtagaccttgtcttttgctagggctgtgatgtcacttctagagtaagtgtcaagcagggagtcgttgtcatccacaattggtattgagcttactccagcttgaaccaacatgttaagggc

SEQ ID NO: 15193 - DNA, 229 bp, Zea mays
  Clone ID: LIB3279-223-Q6-N6-B4
caaccgggaaaaaacttcagctttacatcacaaaaggcatgacggaaaaaccctataataaataagttgactcccaggggattcatcacaacaaagccggttcattcatctcgccgacgatgacgacatcatttttttacatcacaaacaaaacaaatccgagcaaactgcaggggcgatccatccacccaaacggtcaccctaatcaaatggaggatttggatttgat

SEQ ID NO: 15194 - DNA, 339 bp, Zea mays
  Clone ID: LIB3279-223-Q6-N6-B5
aacaagaaaatatgtccatgttttagatggactataatttatttaggatttgcaaagttaaactcaatctaaaagacagacaatttaagatgacaccaattaaccggtcaatgcagcattgagcgcactgtgaacatcgacaccgatctgagcctcagccttctccaggtcagtagaggccgaaccaagcttggcagtgaattcagcgagacccttctgaacaaaagctgggtcgatctgatccacagggacagcctcaacagccacaatatcagcaatggagtttgcatggacgaaagcaaatccactgctcacaaagtacttggtcacatcgttccc

SEQ ID NO: 15195 - DNA, 582 bp, Zea mays
  Clone ID: LIB3279-223-Q6-N6-B6
caccaaaaagactagttgtaacatttagactgccggccggccattgtacatcatacatttgcttacagaagaagtgcatccttaattatgacactgggatgggattccaccttcaccatttttatggggtttccctagactagacacactggatgactgaacacgacttagagagcagcagtaaacttacagctgcattttgttatattttttggtcatttttttttttacttgcttgctatacaaaaggaacttctacagttgagccacactatccactagctcgaaccaccgttacttcgacttgaaagagcagaccacgagtccacgacagcggcggcagccaggagcaaggctgcaagaggggcagcagccttcctgatgagttcccccagcgaacctagcgaggctggtggatcacgcggggggcgctgctcttggggctgccggcgtacttggtcggcttctcggcgttcctgggtttctcccggaaccccggggggggtttggccgccgccccttcggggaggtcatgttcagcgccttgagcaccgaatctgtcttaagggcggcggcgacggg

SEQ ID NO: 15196 - DNA, 558 bp, Zea mays
  unsure (1)..(558): unsure at all n locations; Clone ID: LIB3279-223-Q6-N6-B7
ggncgacgacgaggccctcgtcagggcctccggcgacgcggcgctgctggcccgcgacagggtccgggtggtcgccgtgcccaggctggccgacctggaggtcctggagctgcaggaggaggagtccggcgacgcggcgatggtgtcgagcaggcccggccgcgcgtcgaagctgaggcgccgcgccggggcgccgccgccgccgccgccgcgggccagggacctgagcagcatccaccgcgtcgcgctggaggagagcaggaaccggaccttggtgatcgcctcccgcaggctcccgagcagcgactgcgaccgcttcttcgccttgggcgtcgtctcctcctccgtctccatggatgacccgcccgcctgtttctctttctcctcccctgccgtcgtcgtcgtcgtcgtcgtcgtcgtcgtcgtcgtcgtcgtcgtcgaagactccgagtgctagagttgtggcaggcaaggaacgcacacagttagcgcgagcggagggaggtggcggcggttggtttttgtgtcgatgtggaaagcgtgaggccctttgtnttg

SEQ ID NO: 15197 - DNA, 464 bp, Zea mays
  Clone ID: LIB3279-223-Q6-N6-B8
ggcccaacaccaagtacataataagaacaagacctgtcaaacacatagcattacatatagtgcctgaatgcgctgagatgtcatagtagtgcctagcagtgtttgatatgtttcctcagatacctattctacattccaaccaacaagcatcaagcagtgacacaaactgcacatccatggttggaaagttgaagcttcagtacttcagtgctggcttctgcgttggcagaagtccaaatctcttcttcaacaggtaccgctggcgagagtacttgtcatctggtgagaagcgagctgggtgagcaaactgcgtcggcaccccaagaggtgactccttcttggtggtgtagaccttgtcccccttctcattgatgtaatactggagatacatcttggatcaaaactcaggggatgacaccacagcttggaagacggatcagcagttcagcttcagcaagacaggc

SEQ ID NO: 15198 - DNA, 525 bp, Zea mays
  unsure (1)..(525): unsure at all n locations; Clone ID: LIB3279-223-Q6-N6-B9
gcagcctaggccgaggtgaacttggtgacggccttggtgccctcgngaacggcgtgcttggcgagctccccgggaaggacgaggcgcacggaggtctggatctcacgggaggtgatggtaggcttcttgttatagcgcgcgagcttggcggcctcagcagcgagcttctcgaagatatcgttaatgaaggagttcatgatggacatggccttggaggagatgccaatgtccgggtgcacctgcttcagcaccttgaagatgtagatcttgtaggtctccacgctcttcttgcccttcttcttgcccctcttgccctcgccgccttccttggcagcggacttgccagcggggacccgcttctccgccttcggcttcttcccggcgggcgccttctcggccgcgggctcctcctccgccggcttcttcgccgcgggtttcttctcggccttgggcgccatcgatgcggggcgagttggggttttggttgcgaaggggggatcggatgggaagaaatgcgaggagatg

SEQ ID NO: 15199 - DNA, 584 bp, Zea mays
  Clone ID: LIB3279-223-Q6-N6-C10
ctcaaattctaaactctattattgcagttcaacaggcaacaagttactagtaatgccagcatcagtgcgaatattactactactgcaaaagggtaacaccgacggtgacattcacaaatggagcaggaatcttgcgagaatcgagcgtgatctgaggtcgggggcagactgtcggtggcgccggcatgcggcgggcatcccttcagatgacgcaacggccgccgctgaggatgtcgagcgcggcgagggcggccttctggactctctcccgttcgtcgtgcagcgctcgggcattctccgccacggcatccctcgcgcgctccagctccgcgtcgatctcgccgtcgcaccgcgcgatctcgctgctcgtcttgagcatgctctggagaccgtcctgcacctgctgcgacacgtcgaagaggagcgcggagagcttggagtctccgccgtcctcagccaccgcgtcggtgaaggcctcgttcccgaccgacgtcgccgctacgtgcgatcctgacggcgagtgggccatgtctcccccgttcgtgcgctcgctctcttcgtgcggtggggtggcgtgggcgtgg

SEQ ID NO: 15200 - DNA, 555 bp, Zea mays
  Clone ID: LIB3279-223-Q6-N6-C11
atcagctaaagtacacattcgcagggaacaaaacgttgcaatcttgatgcaaattcaaacaatagcagggcttccattgacggaagggctacttccactagtatagtattccctcatgtttgtttcgcagacacataaacgagcccattcaaaggccaaagaataaacctgcaaacggatcctatcattgcaagggatccgttgcaccgtattatttagctgaagaaactaagctttgtttctcctcgtcaacctcctaaggttgctcgggcaccagctaacgctgtgccacaactgcaccgtttcctttcaccgtaaccgattgctggtagagcaccccaccgaggatggggaacagcaagcagaccgaaccatacgcactggcatgcttgtcccaaatcatgacattgatggccacggggaggaacttgttcacgaccccggtcacggggaacgcggtcgccgatacagctctcctggctgcgaagccaaagaaactgatgagcagcccgaagacgcacgacagcgccaccgccacgacggggtccagttgaa

SEQ ID NO: 15201 - DNA, 588 bp, Zea mays
  unsure (1)..(588): unsure at all n locations; Clone ID: LIB3279-223-Q6-N6-C12
gccgtcgggcccggccgccgccgcctgccgcgacgcgtcgcggacctgctccgtggtgtaggggaacccggcgcgggtcatggagttgagcagcgcggcggcgctctcgcgcagcagcgcgcccgtgccgtccgcccgcgtgttgcccaccgcgtcctggatgctcatcacgtccgccccgcccacgctgcccgccgccgcgccgaagaagtggcccatcgacgatgacgtgctcgggaaccggccgccgaccgccgaccagatctccatcgggtgcgacctccagtagtcgcaggtgccgaagctgtgggggtccatggggacaaatgtcgtcggtgacgaggtcccgatgccgccgtgcaagggggaatcgccgtatgcgggcgtcggagagctcccataggcgccaccagcaccatgagcaggcgagggggacccgcctccgtaggcgccgccaccgctgggggtagacggagacccaccgtacgcgccgccgncgctgggggtggacggaggagacccaccgtacgcgccgcctccgggagtagacggggatccaccgtacgagcccccaccggtggagggcga

SEQ ID NO: 15202 - DNA, 469 bp, Zea mays
  Clone ID: LIB3279-223-Q6-N6-C2
gggccaggccaaatcaaggaaaaaccacaaaaaaaggagataccagggaaaaccacaaaaaagccaccgcaaaggggaaagccaaccaaaagcagacaaagggcagggggaaaaggaaaaaaaaaaaaagggggggaggaaaaacccccccaaagaaggaaaaaaaaaaggggaaaaaaaaaaaaaaaaggaaaaagggaaggggaaggggggggaaaaaaaaaaaaaaaaagagggggaaaaggaggaaaaaaaaaaagagaagggggggcgggaggaaaaaaaaaaaaaagaagggggggagggggggcgggtaggaagaaaagaaaagggaggccggaaaaggggggagaaagggcgggaaaagggggggggggggggggggctcgaaaatagaggggggggggggggagaaatagcgccaaaaagagagaaagaggaggtttaaaaaaaaaaaggggggagaaag

SEQ ID NO: 15203 - DNA, 588 bp, Zea mays
  Clone ID: LIB3279-223-Q6-N6-C3
cagagaaacaggcatttcttcttccattctaaatagcaaaggacaacttgcagcaggacacatacacatacaagcacattcgtcccatctgcagcctacgcatcaccgcatactggtaacaaggtactgctaaacatcagatcactccggacagtcagtctatgccttcttaggggacttggcggccttcttgggcgactttgcctccttgctcccgccactggacgccttctccgccgtcttcttgggcagcagaacagggttgatattggggagcacaccgccgtgagcgatggtcacgccgcccaacagcttcccaagctcctcgtcgttccggatcgccagaagcacgtggcgcggaataatgcgagtcttcttgttgtccctggcagcattaccggcgagctccagaacctcagcggcgaggtattcgaggacagcggcgaggtagacgggggcgccggtgccgacacgctgcgcgtagcggcccttcttcaagtagcgcccgatgcggccgacggggaactggagaccggccttcacggacctcgacaccgactttttccttggcccgccgaccttgcgccc

SEQ ID NO: 15204 - DNA, 537 bp, Zea mays
  Clone ID: LIB3279-223-Q6-N6-C5
gaatcacaggtcaaactgcgttgataggaataccgagaatatgatatagcagtctcctttcaagttggttgacttcataaggcactaaacagttccctaagttgagttccagctaagtcaaacaaccaaaaaaatcccccaaacgggtcacataattccccgcctaaacgcgagggctcagttctcctggtccccatcatcgtcattgtcatcaccatccaaattatcatcgtcgtcgtcgtcgtcatcatcttcttcatctccttcaaattcatcttcaacctcattgttgaagtacttcaaaggattaggccacaagtcttccttgatgatctccgccacctcattttgcacaccatcagcaagactcttgagctctgtatcactaaaccaggagaaaaaactttccactactaatggccgcttgtttcccttcttgttaataccatttccatttgcaggtcccattccatccttccacttaatttgagaagcttttattggggttgttcccggacgcgtgggcggacgcgtggg

SEQ ID NO: 15205 - DNA, 594 bp, Zea mays
  Clone ID: LIB3279-223-Q6-N6-C6
ggtactgctagtcaaaattaaatcagggatgttttttatagaaattacaagagaagacctgcatgcatttgtcaaaatgaaacgaagatctacagcagcagcagtagtaataggtatccagggtgggtgggtggtctagggagaggagttgaaaggaagcgcttgacattgtgaggctgggcaaaaatggttagtgatcctgggcggacgaggagagcgagaggatgtgcgcgtagaggaagtggttccaggtgtcggggagtcccgggaggcaccagtggatgcagtcggcgtaggtcttggggtcggcctgctgctccggtgtgagcagcttcccctgccgcagcgtgtgcacggaggtgtgcgcgtccttgcgcagctccgacagccccgtgatgtcgacgaagtgcaccggcacgcggcggaggtagcgcgccagcaccccgcgcgccacgccgtgcaggcgccaatccgtgccgatgtccagtcgccccgtccggttgttgctgatgggctgcgtctccatggcgcacttgatgccgccgtcgttaccccacgcccacggcgtgacgtggttgggcgacatgcccatga

SEQ ID NO: 15206 - DNA, 580 bp, Zea mays
  Clone ID: LIB3279-223-Q6-N6-C7
aggaacgaaacttatttatttctgagaagttcaacacaggccgcagctattgcgaccacttcgtaagatcacttatctcacaaacaaccttcagagttcaggcacttgacacctcaccaaaccaaacctcgaacactaaccaatttaatccacctcctcgatcttgggaccagcaccgctcccaccagacggggcatcctcatccatgccagcagcagcgcccatgcccgcgccctcgccctggtacatcttcgcgatgatggggttgcagatcccctcaagctccttcatcttgtcttcgaactcctccacctcagccagctggttgctgtccagccagctgatggcgccgtcaacggcatcttcgatcttcttcttgtcctcagccgggagcttggaggcgatcttgtcatccttgatggtgttcctcatgttgtaggcataattctcgagcgcgttcttggcatccaccttcttcttgacctcctcgtcctctgccttgtacttctcagcctcctgcaccatcttctcgatctcctccttgctaagccggcccttgtcgttggtgatcgtgatcttg

SEQ ID NO: 15207 - DNA, 514 bp, Zea mays
  Clone ID: LIB3279-223-Q6-N6-C8
gcgcgggtagctagtacattttgatatgggagagctagccacatgatctcagatctagggaggagacaggcaggggaaaggaaaagaaagggcacacacatgtagagcgagcgagagagagagagagagagagggtgagatataccctagctaattgagctcggctcccgggggccagccgggggaaaaaacaaatgggccggggggcgcgggcccccccggtcgtcgttgtcggcgaacgaggtcgtcgccgaccttgtttttttgcgcgccggccggggccgccgcaataggaggcgcgtgggcaaacaagaacggaggatgctgcggatgaactccccgccggggctgttggggtccatgggggccatgagggcggacagccggtcgctcaagtcgtccacctcccggggcaggcttttgatgtaactgcaggtctccttgaacagattcgtcgtcaacgcctggccggaaccccggcggcgggaactggggaacaaggcctgcaacttgg

SEQ ID NO: 15208 - DNA, 412 bp, Zea mays
  Clone ID: LIB3279-223-Q6-N6-D1
aacccagctaaacatgaatttattaaggggcgaaaacaacaattcgaaaataactttggtctgacatagttcagggagaaaaaataaaaaacaagtcaaatccagggaaaagttcaaaaagtaaggggggggcgagttcactgcaccaggggatcagggttcccagcagcaaaaatataaagcaacgagttttggggttccagctcgtcggcccaaaggggaagtttgtccccagggaaaaagttccttttaaccccatccgaatttattgaaactgaacggaaaacccttccattagcaccatcacgggccatagaaaggaaaactaccttaaccaaaaatttttttgccttttcctgactaattccctttttccattcatgaccaaaaaaagcatataggtaactggaac

SEQ ID NO: 15209 - DNA, 580 bp, Zea mays
  Clone ID: LIB3279-223-Q6-N6-D10
agcaaggcggagagaacaactatattccacaacagggacatcaaatctaagaggaccattacaatccggcgcgccggatttatagagcaggcaagctagctactaggcgggtagggtgggggactggggaaaggcacagcaaagaacccttctaacagatccgcggatcccgcagcgcgctcagttgctggtgaacttggtgacggccttggttccctcggagacggcgtgcttggcgagctctccggggaggactaggcgcacggaggtctggatctcgcgggacgtgatggtgggcttcttgttgtaccgcgccagcttggcggcctcgccggccagcttctcaaagatgtcgttgatgaaggagttcatgatggacatggccttggaggatatgccgatgtcggggtgcacctgcttcagcaccttgaagatgtagatcttgtaggtctccacgctcttcttggccttcttcttccccttcttctcgccgccctccttgccggaggacttggacgcgggcagccgcttctcggccttgggcttcttccctgcggtcgtcttctccgccttctcctcg

SEQ ID NO: 15210 - DNA, 584 bp, Zea mays
  Clone ID: LIB3279-223-Q6-N6-D11
aacttcaaaactccaacaatgattatctcaaatgtgggcaagatctgagagttctctgccatatgatagatatgctaaatcgtactcttctgaatatacttttctgacccgtagtcctccaccagggtgccacactgccaccaatgctaatgtcttaatgatgcaacgcgctagaattatagaactaaacaactgagggggatcgatcacagtttcgtctgggcgatcgacccgatcgtggtcgaggcgcacgggcggcggcggtcggggtacgtcgtgctgggatcaggttgggggcatgacgtggtaccggttgttgacgcggcgcgcatagaggtaggcggcgagcgcgacgtcgatggtggtcacggtggtgaccgtcgcggcgaggacccaaacgcgcaccttgccccagaaggcggcgccacgtaggcggcgggcggtggccgaggggatgagctcggccttagcagcctcggcgagcgccgtaaggaggcgcttggagcgcgggctgaggctgtcggctgcatgcagctcagacatggcgaggttgatttgctccaggactgggaggtctgcgtcgc

SEQ ID NO: 15211 - DNA, 642 bp, Zea mays
  unsure (1)..(642): unsure at all n locations; Clone ID: LIB3279-223-Q6-N6-D12
tatgagtcgctgcacgctcgtaactggatcttaacggcgccttttttttttttttacgaaatcataggaaaatatttgggttcaaaacttttntcgaaaagatgaaactctggaccgacgacgcctccagcagacacacagcaccacctacagcgtaggacacccaacatgtcaagtgctaattaaaactaaggcacctcaatcccttgcaaatgatacaacaataccaaacagatcaagccaatgatcctgataattaacgtgtgcagtcgagcagcagagctaatgaccagtccaacagcagagccagcagcctgtccagcagcagagccaaaagcctcgtactggatgttggagcggtagtagctgttgggcgcccagtttgccgggatgacctggtaagccaccaatgtatcgcctgactcgttagtgatgcgcagcgagaagggcccctgtagccggcgcttggagtccatcctccagatggatccccacgactcccgcatcggcatccaccacccagagttggcctccattatgtccacctggaccacatcgccatcgccgtcttcgaactcgacgagcactgctaagtagttggggtttgagccgtgctcgatgtggaaggtcaccgtctgcccg

SEQ ID NO: 15212 - DNA, 581 bp, Zea mays
  Clone ID: LIB3279-223-Q6-N6-D2
gcactgtaatcagttcactcatccatacaagcagtattaaagtaatcctgcaatcattgcatagtacagtggaacaacactacaacaggctgtatagtgccttatttgtacaatgtctaggaagcaaactcaagtaccttacactgtttgatagatgaagaacacaaatacagtaaaatattagcgatgtgctatgtggtgctcagcttccaccgagacatctatgctctttatgtgatgtttctgtatatataattaatctttatgcttgccatgtacccaccattatattagcttgtgaaggttttctttacacctcgaactagcagtccttcaaaggtgatgcctgggccaaaagccaagatcaatccccactcttcacttattgcccctttctttaactcgtccctcaagtactccagcacatagaagattgtattgctgctcacatttccatagttcattaaggcttttctgctaatcttgagcttctctggctgaagtttaaggcagaactcaagcctgttcaatattgctggtccaccaggatgcacagcccaaaaatatcgttgaaatccttt

SEQ ID NO: 15213 - DNA, 595 bp, Zea mays
  Clone ID: LIB3279-223-Q6-N6-D3
gcaaagaaagaaattggtccatttgaaaaaggttccaagatacagatcataatcttttcgaaaacattgctaaagcacaaatggtgacatgcttcctctggctctcaaggtttgatgtgaaactttccatgtttacttctcgtagatccaggggtgctggctgctctgccaatcagcagggccctcggggaaccacagggcaatctccttattagcactctcaatgctgtcacttccatgaatgacattcctgccaatgtcgacagcaaagtcgccacggatggtgccgggctcagaagccagggggttggtggcgccaatgatcttgcggccagttgtgacgacgctcttgccctcccagaccatggccaccacagggccagagatgatgtagtccacgaggccctggaagaagggcttggaggcgagatcggcgtagtgcttctcagcaaacgacctctccacgttcacaagcttcaaggccttgaggtagaagcccttcttctcaaaacggctgatgatctcaccaatgaggcccctctggacgccgtcaggcttgatcatgatgaaggtgctctccattgcggcgactgcg

SEQ ID NO: 15214 - DNA, 531 bp, Zea mays
  unsure (1)..(531): unsure at all n locations; Clone ID: LIB3279-223-Q6-N6-D4
gngaaatgttcacccgatatgaaattgtctaacacgaaacgccaaattggtgcaaacaaagagcccattactttgcttaactaggaacaccgtatttggaggataataatgatcctactaacgcctcgagatttgcattgatttgagacatttgaagatgagacattggagggaactaaatcttgtgctttgcgtgcagttggagacttggtttccgccaacgctcaccttcagcttccaaattcttcagacaggtctcatcttgctgcactgccacctacacatccgatcaaccgaacatgagaaaattggaggaaaccaagtattgccttttctttctcaatcaaatttggttccatccatttctcaaattcaattgcccaagttttagctcggagttccctccttggccaagctaagtatcttactctaatccatgtaggagtactccgcttgattttgcagtggcggctactgatagcggcagttttctacaacccttggcttcagagcttagctaatagatgtttg

SEQ ID NO: 15215 - DNA, 583 bp, Zea mays
  Clone ID: LIB3279-223-Q6-N6-D5
agtacacaacgagctctgattgctgaagatcttctcgatgaagacgaacatacaataagacacaagggacgaaactagagcaggacacatcccatccacagatctagacacgagcatgctacagcacacagtgcaaatgaagtccctactttctaagccttcttgggggacttggcgcccttcttgggggacttgggctccttgctgccggcgctggccgccttctccgccgccttcttgggcaggagcacggagtggatgttggggaggacgccgccgtgcgcgatggtgacgcctgccagcagcttcccgagctcctcgtcgttgcggatcgccaggagcacgtggcgcgggatgatgcgcgtcttcttgttgtctttcgccgcgttccctgccaactccagaacctcggcggcgaggtactccaggacggcggcgaggtagacgggggcgccagtgcccacgcgctgcgcgtaccggcccttcttcaggtagcgcccgatccggccgacggggaactgcagcccggccttgacggaccgcgtcaccgacttcttcctggggccgcctgccttgcgcccgg

SEQ ID NO: 15216 - DNA, 592 bp, Zea mays
  Clone ID: LIB3279-223-Q6-N6-D6
aaaaagaagatgccataataaatggctatatttttatggtacaaaactacaaacaaagcgtgtggatatgttttgttaggctccagccagtgatcacatcttcctgaggttatcgagccgcgcctgcaggtcatcatctatgccgccatctggcccacctgcggcttcagcctgagcaggaactttccccgctgcgacgggcttcgcaactgcagttgcaggagccttgacaagctctgagttgatatcgatgccaatttcgtcaaggacttgactaaccagctcctctgtctcttcctcctcctcatcgccctccaaggcatcatcgatggcgtcgttcatcacttcactaaccatctccatcttctcgttttgcatctcaaactcccgcatgatcttctgcagggcaggcagattcatctgtcggttcatctgccccatggcttttgtcacacccttcatggcttcacccatggcttgtgttgatttcagagtctgaatacgtagagatacaccttgtagctgggacttgagtgcatagaattttgtgatttggtgtctcgtgcggataagatcctttgccataattttt

SEQ ID NO: 15217 - DNA, 581 bp, Zea mays
  Clone ID: LIB3279-223-Q6-N6-D7
gaaacaggcatttcttcttccattctaaatagcaaaggacaacttgcagcaggacacatacacatacaagcacattcgtcccatctgcagcctacgcatcaccgcatactggtaacaaggtactgctaaacatcagatcactccggacagtcagtctatgccttcttaggggacttggcggccttcttgggcgactttgcctccttgctcccgccactggacgccttctccgccgtcttcttgggcagcagaacagggttgatattggggagcacaccgccgtgagcgatggtcacgccgcccaacagcttcccaagctcctcgtcgttccggatcgccagaagcacgtggcgcggaataatgcgagtcttcttgttgtccctggcagcattaccggcgagctccagaacctcagcggcgaggtattcgaggacagcggcgaggtagacgggggcgccggtgccgacacgctgcgcgtagcggcccttcttcaagtagcgcccgatgcggccgacggggaactggagaccggccttcacggacctcgacaccgacttcttccttggcccgccgaccttgcg

SEQ ID NO: 15218 - DNA, 587 bp, Zea mays
  Clone ID: LIB3279-223-Q6-N6-D8
aaaagcaaatatcatttccattaagacagcagacaaccattacagaggcaggaatgcaagataaacaatcaggttacccagcaactgaacaactctctatccctaagattctaagaacaagcacaatggtaccaagatgccactgccaccagaaaggaaaccaagagaagcacaagtcctacaagcaggcccgaagcaacaacgacgccgcctgcggtgagaggagctcgcctcgctcaggccctctctcccctgatgcggcgcgcgagctggatgtccttgggcatgatggtgacgcgcttggcgtggatggcgcagaggttagtgtcctcaaagagccccacgaggtaggcctcggcggcctcctgcagcgcggcgacggcggaggactggaagcggagatcggtcttgaagtcctgcgcgatctcacggacgaggcgctggaagggcaacttgcggatgagcagctccgtgctcttctggtacttgcggatctcccggagcgcgacggtgccggggcggaagcggtggggcttcttcacgccgccggtggccggcgcagacttgcgcgccgccttggtcgccag

SEQ ID NO: 15219 - DNA, 599 bp, Zea mays
  unsure (1)..(599): unsure at all n locations; Clone ID: LIB3279-223-Q6-N6-D9
ggcgcgggtaggggtggtgcttgngaccgccgaggacggggcgcgggtttttggcgtcggggttgccgaggtcgttgtagacgtcgtagcggtagacgcggtcgtgctcctggtacgggccctgctggtcgtcgcccctcaggttgcggagctcgtcgtcgcggtaaggcttcagcgccgccggcatctggctggggaggtacgtgtcgttggagaagaagacgcggttgtagcggtacttgtactgcgggtacacccatgagttggcgacgaagacgatggggccgtggccggggacgtcgtcgatggtgatggtcttgaggaagaactcggaggcgtggttgttcttcacgatgatggcgcccgggacgccgtgcttctccacctcccagtcgaaggtgacgcggaactggtcctcgccggccagaagcggcggcgggtgcagcagccactgctccaggctcgcctcctgacccaccttcccgcggttcccgttgttggggtcgacgacggtggagctgacgagttggcaggtgacgccgcggccgaggaactcgccgaggccgtccatgagggagccggcgatgctggtgacgtcg

SEQ ID NO: 15220 - DNA, 565 bp, Zea mays
  Clone ID: LIB3279-223-Q6-N6-E1
caaacgaataacatatattggaaccatgtcgtcaaaaggaggaccaatacatgatgacaatgttgaaatctagcttttcaagaaaataatgttgaaacttcctgatacatttgagtgattgcaatacgccaaaacaaggcataaaactaatgatttccttatcttctgtggtcaaaatgaacacgaattcagtaactgtaaaaaaaaatcaacgggtatataaatgttacaagtataatatatgaatcacggcctgtatgaactaaagtgctgccctcacgacgcgatcacgattcagatttatcatcaggaggggtaccaacgagccagctccacatgcccccagaactttgccgctgctttgcgtccagcgctgcttgctctgacgcggttctgtgtcgtcaaagcagctcgacctccttttccaatgcatccatactttgaagcttctgtcgtagttccgcaacatcgacctcaagtttgaaacatcttgactgctcagcagcaagttggccacggacggcttgaagttcctttgtgagttccacatttctggattctgctt

SEQ ID NO: 15221 - DNA, 528 bp, Zea mays
  Clone ID: LIB3279-223-Q6-N6-E10
gccataaacaatctgttccagtattgaagattccaaaacaatttgtcaatctcattaagaggtagtaaaaaataatatgttgacaggtttgctggtgcagtagctacctaataggaagttaactaagtaaaaggaaatgagccacagaacaagcaataatcgcctgtatcttcatgccatcttcagcaagccacaagtaatcatagactcgtgggatatgaagttagaaggcattcgagttggatcttcaatccatcaagcaagcatattcaatacctccacaaggttccttgcagtaatcagtcgaacaacattaaaaaataaaacagtgtacacttataataaaagtttctcaacttatgagcataaaattcaacaaaattgacaaatgagagtcagaaatacactatactcaagagtcaagacaaagaaatccatcccagacatcaaggcaaagaaattcaacagaaggaaattttttgttaatgtaaattgttggagcaaaaagagaaaagatttcgatagttt

SEQ ID NO: 15222 - DNA, 453 bp, Zea mays
  Clone ID: LIB3279-223-Q6-N6-E11
tcgcgatctagccggatttcaatgccatgctgcctgtgatagtcgaacatcagcgtctctgctacacgcttaccctcatcataacaactcctaacaccaatcgggttaacattgccccagtaggcctcagtttgaggatgctcaagtggatcaccataaacttcagaggttgatgtcaacaaaatcctagctccaactctctttgcaagtccaagcatgttcagggtaccaataacatttgtcttgatggtcttaacagggttgtgcttgtagaagattggtgaagcagggcaagcaaggtgatagatttggtcaacttccacaagaagcggctcggtgacatcatgacggatgagctcaaatcttgggtggccaatccacttcttcaggttgtcttttgaaccagtgaaaaagtatcaacaacaatgacctgaacgtaaaagaacaaagtca

SEQ ID NO: 15223 - DNA, 479 bp, Zea mays
  Clone ID: LIB3279-223-Q6-N6-E12
gaacaggggtgtgtatattgctgccagtaatgaacgtcgcacagtattatacatagcgggaggcctggattatgccaaacactcgtttagggccttcgcaaaatgatgtcagtgcaaaacagcaaatacgaatgcccttgtagcatatctagagaagaaaaaaaaacactaactggttaggggagcaaacgtgtactgagagcacgccgatcgctaatgctgacagcaccaggttttggccaaatcttatggcgacgtcggtggttcagtgatgagcctaagcagaggcatctggttttgcatccacagggaaacagcggtcttcaaggttctcagatgtttccatcttgctttccttactgtcaccattgtctgaagggactttgggcgccaggaatggggaaaagtaaccagatggtttatcagtctcgatctttttggatctggagcctttcttccgatcgtcccggacgcgtggg

SEQ ID NO: 15224 - DNA, 578 bp, Zea mays
  Clone ID: LIB3279-223-Q6-N6-E2
atagacaaattcgagttttcatgagatgtaaaggaaactgttctgggagtacgtaggcagtcggggttgcatagactgatagaccatcgggcaaaacctgacttgtttctgttacatctctgtagcataaactgctatgtggaggaaacagcaaccctttcacctaatgaactatgcgacgctgctactactcctctcgagctttggaactctccaatgcattgtatcagagctcactatcactctctgcctttgcaccgccggatgtcttcccgttgacggcgataagctccgtgtggaagatcagagttgctccacctggaatctttggtggggagcctcgctcaccataacccatctttgcaggtatctttagcttcctcttttcacccacgcacataccgagcaatccttggtcccaaccttttatcacttggccatttccaagggtgaattcaaacgggtcacctctgtcatagctagaatcgaaaactgatccatcagtcagtgtcccacgatagtgaaccttaattttgtctcctttgtgtgcttgcagcgtacatgactcaggcttgtac

SEQ ID NO: 15225 - DNA, 570 bp, Zea mays
  Clone ID: LIB3279-223-Q6-N6-E3
gggtatgacacgcaaattatattgatcctttcaagcaatacttagagcgccaggatacttatagtagtaccaccattctgaaacatagtagcgccaggacgaaatataggatcgtccaaaaacatatccttaacaagagtttaattcaataaaacctcggtgccagaacctagcagacttcacaaaagagcatacttagaacaccctgtatggcttccccatggtgctcttgacgtagaggcatctcacattctgccagttcttcttcagaagggaaacaaggaagttcacgctcatctggatgttctgctggatctgcttctcctccatcgccaagttgccgacggcgacgcccatgcaaaggaccttcttgagctggaacttgacggttgccttagtctcgttcaccttggattcgagggattcctggtgagtaaccagggtcgggaacttgcctgccttgttgagaccaggaccaaggagacggggaatctgcttgatgatggcctctgatgccaaagaaagctggtactttttggcaagcctcttaacaagcttcttgttcttggt

SEQ ID NO: 15226 - DNA, 577 bp, Zea mays
  Clone ID: LIB3279-223-Q6-N6-E4
attgggaagaaacagtaggctattgatgttgatgccatggtacttcttgtctaaagagcgaagaatccaagtaacaaaccacgcaacaattctcctactagatgcactgttcactcacacacacacacacacacatcacttatccgggacacaaaggtttgttacccgcagttttcagacactgaactggtacaggtacctctaccacaaattcctgggtgcttattgatgatttaatgagtggttggatgatctgattagagagcagcgatgcactcaatctcaatccgggcattcagtggcagcgccgccacttggtaggttgatcgtgcaggtgctggcgccgggaaatatttgccatagatctcgtttactttattgaaatcctgcagatcagccaacatgatcgttgtcttcacaactgaagaatagctagcaccactagctttcaatatctcgcccatgtttttcataacctgctcagtttgctcctcaacattttcagagataaacttcctggtctcgggattcaagccaagaactccagaaacaaacacaagattatttgctttgatgg

SEQ ID NO: 15227 - DNA, 531 bp, Zea mays
  Clone ID: LIB3279-223-Q6-N6-E5
acgggaactgtagattataagacctctgaactcagtctctgcaggtcccgtcctgtttcgaggagtatctaacagccaaaacgctgaacactgggctgcgtacacacgccatttacatcgaaggatcgaacggggcggggccaacaaacaagcatgtgtctagagctaggactagaacggagtctggcacagcgggcaagtcgatttgttggacgtggaaaaccacttgtagaggcaggcgccgtggaacttgtgcttgcacgttttgcacgccagccgcggcaggttgtggttgctggtgtggaaaatgctgtaacaaattgggcactcctccacgccctcaaactccttgtcgaaattatctcttccacgtgcggatcgcctttgctatcgcgccattctggctgcggacgaatgacgtgagggaaagcagccattttctgcacttgacttcactgatacccaaacttctcgtgcattcgacatcaacgtggcgcaaagggtaacagctcgggaggcgtatgacaaggt

SEQ ID NO: 15228 - DNA, 552 bp, Zea mays
  Clone ID: LIB3279-223-Q6-N6-E6
atcaaatgatatttgctcgcatttcatctaaacgatcgaccaggcaccaaattggccggttacatcccccctcatcaggagttagcagacataaaaattctaggctctctaggtttttgttacaatagctacatcaataggtttacacgacacacacacaaaaaaacacacaacgcacaccggggcgagccataaataatacatggctgcagtggggggcgactctacatggccccccagcgggctgtgaaaacccactggttgatgatgggtgttgtggttagataggaaacacctcatctcatctctgtcactttctcattcacctgtctctcacctagtgttagcctccggtttgtggcttcctttcccgttgctgttattactagatttcttggggagctggccctcgtcgtcatgatgctgctgcgcctttggcggctcgatgctcattcccagtgtggttgtgacacttggtaccgtgctcaccaatagacgtgaattttctgcttccatgtcttggcaagccttcctcaggttgtcaagttccgc

SEQ ID NO: 15229 - DNA, 318 bp, Zea mays
  unsure (1)..(318): unsure at all n locations; Clone ID: LIB3279-223-Q6-N6-E7
ggacaacaggtgtttcacacaaaagtttgtctgtctgtacattgctcagaaaattctggagaaacaggaaaacgctacaccatgngaagaaaaaacactcgagagttactcaacccaaacgggtcgactcacatcttgtacatgcacttgtacaatacaaggtataaagaatgttgagtttataagcagcagcagcagcatcatcatcatcatcccaccaaacacatgttcccagcctacgtacaaaattaaacacaaagcaagcacacaagcaaatccccgtcccatcccttccccttccccaggtgtggaggagca

SEQ ID NO: 15230 - DNA, 573 bp, Zea mays
  Clone ID: LIB3279-223-Q6-N6-E8
gacgctcaaacccacgaaaatcgcggggtcaattagtccaagatactcatatgcgagatgacagaaaggatcccagctccaaacacacacgttcgtacatctgctagttctgcccaatccccaaaatgagcacatgcacaccagccaacaaccttgctaccatagtccaaagtcagtaagtcacccaccatcgtatagatatatatatatacacacacagctgaggcatatccccttcccagactacgcgggcaagtttgtcacaggaccatgtagttcccgtttttcttgtaaattgtgaattcagattcaaggccctccaatatctccaggaccgattctctcttggatcccttgaagtgcttggcaacatcctccagcgataccccattgcagctcgcaaccagatctagcacagaatctacagtagcagtcgccgtgccagttaactcagctccatgctcgtatgtcctttgcagttttgttgctggctcctcagcacaaacagtttgacctcattttgctgaagggtttgcatcactggcctctgccgctgctgggacaccatttccg

SEQ ID NO: 15231 - DNA, 441 bp, Zea mays
  Clone ID: LIB3279-223-Q6-N6-F1
gtaattgtgctggtatgttgtatgccatgtcaagaatgagtattggtaagcattcaagagttcactcaaaacttaaattgatacaaaacctaataactcagtatattagatgcagacagacttgaactgctacatctgacagggcaccatgttaggacttgaaattacagactgcttccttttttaccaccctttttgcgtgtgctgactgtggggactggagtaacatccttaatacggactatttttatgccaaatcgagcaagagctttaagagcaatatgagcaccagggccaggggttttggttttgtttccaccagaagcacggaagcttaatgtgcaatggagtaaattaaaaggtacttaaatttttgtacgacatactgggagggaagtataataagataaagaaaggactttaaaaaatcagataaaacct

SEQ ID NO: 15232 - DNA, 532 bp, Zea mays
  Clone ID: LIB3279-223-Q6-N6-F10
gcatatacatgtaggcttggcttatgagataatagtgttgcctaccaggggcagttgctagtatcaaatatacgctactgtaaacctgcacacagtttacagctttgtctgtcattcaagcaaaactttctgaagatccgggacttgcatctccttgttccttgtcgagatgcccagggtaataccaacagaaacaagggtctccagtgaccttttgctgtttgccacgagtatcagcgttaaattggatggggtccttctcgaaaatgatataaatgtactcccttcaaaggagaaatacccaaactcatctcctttgtggacgtagtcaccctttttttttaagaacgtgatgcttcctacaatggttgctccaatcgcaacaaatgctacctttaaaaaatatgaagttgatatcattgatacaactcttttattatcagggaatacattgcaatacttgctattcacagtgatgggattcatcgtttacaggctcccgggaattgccacaaatttttccacaagtcct

SEQ ID NO: 15233 - DNA, 582 bp, Zea mays
  Clone ID: LIB3279-223-Q6-N6-F11
ggggagaatttgcaagcctttcaccaccaatctgcaaacgattgctcctgggaccccaacacatggtcaatataccccagccgggagaaaactctaaaccagaaccctcgagaaaacacaggaaaacaaaatgtgattagtattctcctcttccaggtcgcaaagaacgtaatgaactaggtgtgccagtcctctccaaggcaatcggtctgcagtccaacagcgatttcggacagctagccaaatgaaaatcttgaacttaggtggagcccaagtttttgaaacacgcttccaaggatcaaaggagaccaaaccatggaagaaactataggccgatatcgccgagaattcaaccgaaccagagaatctccagatatggcaaccatcatcaatggttaaataaacttcatgtgtggcatcccatagctgaaaaaaatgaacagaccaatcatggacagtcctccattaatatctgatacctaactgttgtttgagagtgcgtcagccacagcccttgttttaattatttttgctggtaccatagcaagaacagctggcgccacatctccgatagaggaacca

SEQ ID NO: 15234 - DNA, 573 bp, Zea mays
  Clone ID: LIB3279-223-Q6-N6-F12
aagcaactagctggattcaataagcattgttactgttccatcagataacagttgctaccggaggagaccagacacagcagcacctaactacagcaagacacgcgaacatacgagggaagcctgcaagcggaggccacgcagcctaggacgaggtgaacttggtgacggccttggtgccctcggagacggcgtgcttggcgagctccccggggaggacgaggcgcacggaggtctggatctcacgggaggtgatggtgggcttcttgttgtaccgcgcgagcttggcggcctcggcggcgagcttctcgaagatgtcgttgatgaaggagttcatgatggacatggccttagaggagatgccgatgtccgggtgcacctgcttcagcaccttgaagatgtagatcttgtaggtctccacgctcttcttgcccttcttccggcccctctttccctcgccgccctccttgccggcggacttgcctgctgggacacgcttctccgccttgggcttcttcccggccggcgccttctcggcagcgggctcctcctccgccggcttcttcgccgcgggct

SEQ ID NO: 15235 - DNA, 572 bp, Zea mays
  Clone ID: LIB3279-223-Q6-N6-F2
caaaaatctctactattttttttcaatcacatccaatccatttggtgtaggaataaccgaacaaggcctaatggttaccacacatttgttcagaaaaccgtccaaagaaatgacatagtaaaatatttttaacagcacagaagccttgttacttaacctacacaggatttgctggattaacacgacacgaatgcaccgttccaaccaaataaaccttcctcacatactgacctgttattatcaacattcacgctacagaaaagctcaaattttctccactgatctgactcctttcccctcaagcttctccatcgctgaagccaaatagttgtcgcaataaccgggtggctcatgaataaagcatgagatcacatcacgcagagtcacaacaccaacaacctcaaggtcatcatccactacatatatcctgtgtgttattcttgatgcaatgctgtcaataacactaccaagggaagcgtcaggagtgcaagtgggtggtggcttcaccaggcaattgctctctgaatcaggaagagtggagcctagagtcttcatgaattcaatgactgtca

SEQ ID NO: 15236 - DNA, 521 bp, Zea mays
  Clone ID: LIB3279-223-Q6-N6-F3
aatacataccaatgagcattggtcaaggtctagcgaacacactcatgtgttgctaacattatataagaccctaaatcggatacacgagatgggatacatgttggaccattctaaatatccatagcaaagagctatgcttggcaaaggagcatccgaaatcctaaaacatgggcaaaacctggtaggctttcttggctagctgctctattgaactaccaataaccaacagttagctacttcttatatatgctggcctcggattgcattccaaacattttgaacatatacttaagtgactgcgacatagcctactgctgttcctgcataattttaatggactgcagggccttcctttctaccagccgcttctcattttccaggcaatgaatcatctgtatctgattctgcatgacctgcgccttcccttttcttcaggtactcattcttggtcatgacaaagaaaaaacatacctctcattgtgcaacccgtcatagcgcatcagtctacagttccatatact

SEQ ID NO: 15237 - DNA, 578 bp, Zea mays
  Clone ID: LIB3279-223-Q6-N6-F4
cgagaagagcatatttgttttcacagatgaaccgtgtgctataattgtgagcagtaacattttacttgctcaaattagtcagtacatgcgtatcaactactatacatcgatgtggttcctacaagctgggctctccattgctttgtgattgctcgctctgacacaaaacaccgaaaagcatacgcaccgcaagccttgtgacatctcaagcgacaaacagctcggcctggccgtcaatgaacaagctcatgaattcctccccgtccacggtctccttctcgatcaggagctgggcgagcttgtggaggatgtcgatgtgcgtggtgattatctgccttgctctagagtaggccttctccacgagttccctcacctcggcgtccacaacatccgctgttgccatagagtagtccttctggcttgacatctgttgccccaagaaagggtttccacccggtcccccgatcgcaacttggccgatcttcttactgaatccaaatctttcgaccatctgccttgcgacacgtgacacttgcatgaagtcgttggaagctcctgttgtcacgttgtcttggcca

SEQ ID NO: 15238 - DNA, 463 bp, Zea mays
  Clone ID: LIB3279-223-Q6-N6-F5
attaactgcagattccattaccatttgaagttcatcacaagatcgtcagggatcgtcgccatccagggaactgaactttgcaagaccaacagaaagggaaacgctgcctcagatcaggcagagacggggcaccaccagaaagctactagtactacgactggtctgcaacaaaaacgactactgcactccagtaattgaaactactaatacgactagctcatggcaactaccatatggatatggactgcaactacggtatggatatggactgcaactaggaaacctgggaggacccatccgatgcacacaccctactcgatcttgatctcgaaaacgtccttgcgctcctcgtccttgatcttcgggacggggaccctgagcaccccgttcttcatgtcagccttgatctggtccatcttgaaagcctgggaggaaaggccgatgcggtagctgtaccgcgccc

SEQ ID NO: 15239 - DNA, 573 bp, Zea mays
  unsure (1)..(573): unsure at all n locations; Clone ID: LIB3279-223-Q6-N6-F6
gaaaaagggtaggttcaacaagnataaatggccgaatatgtgtaacaactaacatttcaatggtacacgacaattgattcaacttatgtccccaaattggattgccgatcctatattgggtacctatacaattagattcgtcttccactcaaataatgagaagaattatcaggattcaagaatgaaactcaaccattttttagaatttgcctttaggcactggcaagcatatcacacaagcatgtcatatcccaaccaatatgatgtacctttacttttcacttttttcaaataattcacttctcttaactctgattttagccgactgttcctctgcctcaacatcattaactactccacggcatttggggaatccacaaaaacatggaagtcgttgatcacttgaaaaaaacctataatcatatgtcagctcttcccatggatctatgtcccgtttcgcaaaaagatgatgtgttcatctccaagaatagttatggcacgtgaatagcaattaggctcgcatgagtgattgatcagacgggctatacttccaacccgagtggcatctataac

SEQ ID NO: 15240 - DNA, 563 bp, Zea mays
  Clone ID: LIB3279-223-Q6-N6-F8
gcagaaaaaggcaactgcacaaattcacagcgcattgaatacttcaggttcaagagggttcacataagaaatccttgacaaaccaagcaagtctgtaaaaggaagataagcagctgatacaacaagggttttgcttgatggcaactaaggtcgcccactcattcagccatcaagactggatatattgtcttgtcttgaagactggatatattgccttcacctgaacttctgccgccgtctcagctcccgctgtatagccttttttctagcctcgtccgaaaattctacattctctgcagaccgagcttgggggcttatgacactccctgaagcaccaccaggtccgtatcccggtggaaaggcttccaagtccatactccttgagccaccagttctctggattcctgcaagcattctctgctggcaggtcgaaatccacgaagtggtattgccctgactttccccgggcccgtatcctggcggaccgacttctcttgagatgcctctagtaggactcgtaaacactccctgctcacaactcgtgttccaagaaccaccattgc

SEQ ID NO: 15241 - DNA, 483 bp, Zea mays
  Clone ID: LIB3279-223-Q6-N6-F9
accaaaaagggtttattcaaacatgttctgaaaaaaaagcaagccatcgatgttcgagggggcctcgtagtacaagggtcgacacgacgggaacaagcatacccgcaggggggggcctatttgtgtaaaaggaggaacgcccaggcggggtactaggcctggttgcagtacacagccagatagatatgccccacctcaaatattatatataaaaagctggccctgcatgcagggttggtttgctatggacccgggggttgctcaaaaaccatgaattttgaggggctcctttttaacaatgccggcctggacgaggaaattcgaaacgtttttcctttgatcaccctggagctgaaagacctgtccaagttttgggtcctggaccactgtaccattggagcaaaacttttttttggaaaactttggaggatcttgctggaactgaactcctttttaaatccctggacgggggtcaggcttttg

SEQ ID NO: 15242 - DNA, 497 bp, Zea mays
  Clone ID: LIB3279-223-Q6-N6-G10
ccctgggaattgaggagattccaagatttgtgtctcagcccaaacctgacaaaatccagggataaaaagagcaaggtcaaccggcagcacatcgtgaactccatatatccagctctaaactcaaacaaaaaaaatgcctgttacaggagtaaagggaacaacaaatgccattgcgcaagttctgatcgccaaataggatagcactactgtgccgcgactagcacttcattcgtcatcctcatcatcatcgacaccacccgaggaattgagggcattgagcctttccacgagtctggccttcctctgctcataggtcaacttcttggggttgtgcctcttgtgctcctttggttgcgcctttgttgacttggccatgctaggatcagcacggatggcagcatggaccttcttgtacagagcttccatgtcatcggcctcaatccccttcttgatgtactcgctgaagtgagcctggtacttctcggcccacgcgtccg

SEQ ID NO: 15243 - DNA, 484 bp, Zea mays
  Clone ID: LIB3279-223-Q6-N6-G11
ggggaaaaaaccgggggctttccattggtaaaagcaggggaaaaattacaccaaaggggggaaaaaccggaacaccccgaaacgaaaatacagaaaaaactacaggggaccggccaactagacaaaaaaccgaccacgggcggcaaaaaaaaacataaaaagggggggggggctaacccccaaaacccaaaagggggcggccctggggcttgaacccgtaaacaaaatccaagggggggacggttttggggggggcgggcccggggtaagggacggggtcccggataaccttctcaaggaaaaacttgagcaccccgggggtctcctcgaaaaaaaacccaaaaaaggccttgaccccccccctcctggccagcctaaggaacgccgggttcgtgaagccctggatggtggcccgcaaaaacttgggggggggcttggggccccccttgcccaacccctttccccccttgcccccggaacgggg

SEQ ID NO: 15244 - DNA, 567 bp, Zea mays
  Clone ID: LIB3279-223-Q6-N6-G12
aaacacaaagtaacttcattattgaggaactgaatagagccttattacaacagtcctcacgtagcgacttccgtaaggagtacttggctatttgcacaataccgcgcaagtgagaaccacacttcacgggaacggaacggggaaacgcaaacaactagtgcgacgaccgtacgtcctcagctcagacagaactcaaatggagatgctgtttggaatgcccttggcggtgatgccggcggcgtcgcccttcgtgtcggaggtgttggggtagagcagcgtgtaggggaactcggccgggccgttgcggttcttgaggcgagggtccgcgttcatggtgacgacgcgtttctcgatctcggtcagccgcgcgccgaaccgcttgaacgcctcctgcgccttggcgtccgacgtccactccttggtgtcgcgctggccgaggtacacctcgtcggaggagtggctggacaggatctccagcagcgagatgccgacgagggcctggaactggctggtgatggtgcgcacgaacaccttctccggcttgcgctccagctccgcgtactcgtc

SEQ ID NO: 15245 - DNA, 506 bp, Zea mays
  Clone ID: LIB3279-223-Q6-N6-G4
aaaagccctggaaccgaataaaggaccgagtttaactatccgtctaaaattaattaagcgcccccggggggggcccagggaaataagctaaagcattaaaagccttttccacctgccctgcccaaaactggtggcgaaacacgtaaaagaaaatcgctgggctttccaatccggaggttctgccccggaaaaaagcatgaaaaagcatttttttgccaccccttaaagcttttggaaaaaaaaggcccaaaaacttcaccaccaaaaaaggcggcctttgtggcttaaaaaaaaactttgagggagggtttccaaattccaaaaaccttttaaaaacttttaacattaacttgcaacggcatgtccattggcagggagtaaccagagagtaaaggaccgccccaaacaccatttttgagaacaaaacccatgggacgagaaacatagggaccacctcctataccaaaaaaaaccttttaacaattcgaagttaacaactaaggggg

SEQ ID NO: 15246 - DNA, 576 bp, Zea mays
  Clone ID: LIB3279-223-Q6-N6-G5
acataatacagactatagaataaagaaaaagacaagagaactggagttcggtaaaccaggcaccaaacatttctgttcccaatcaactacattactcagtaattttaattgtgcactgaaaaccaaaaccgcatataggtctcaaaaaactctaaacattggtaaaacaagaaccgatacgactgccagcgacataaaagtttccagcgcagagtgcaccaggatacaagctcagttcaacggttggccttggcaacacgctcaatctcgtccttcttcttgatggcgtaactgttggatgagcccttggcagcgttgatcagctcatctgcaaggcactcggcaatggttttgatgttccggaaagcactctccctggcaccagtggtgaggaggtagatggcctggttcaccctcctcaggggtgagatatccacggcctgcctcctcacaacaccagcggaaccaatacgggtggcatcctcacggggtccactgttgatgatcgcgtcgacgacgacctggatggggttggcatcggtgagcaggtgaatgatctccagggtatgcttgatg

SEQ ID NO: 15247 - DNA, 576 bp, Zea mays
  Clone ID: LIB3279-223-Q6-N6-G6
aaagttaaatagcctactttattaaatagattataatttctccaaaatgaagggatacagacggcccctaagatggcaacaagatgccaagaagcaccaaaggataatgaaccatctcaaagaacattatggcacgaccattccattccattgagaatttttcagatctgatggcagatgctctggaaccaagtagctccaaaaactttgaacaagacttttcctatgcaaagcacagttagtttggagggatcaatcttctgggattcgccatcttctcaaagccttctcaagtgtctcagctcgttcatggacacgtcctgcttcatcttccacccaagtcctgaaataagccggtagatgtgtaagatcagttccaaaagaaattattttttctcgatttatcccaagagtaccagtacaacaagtgtgtttgaacttataaatgccccaggctagataaataaaggcggtatagttggtacccagagcgaacacatttttagaatatatcatcaatagcatagtgctgacaatgaagcaacaccatgtaacagtagaatcagtggcaatctt

SEQ ID NO: 15248 - DNA, 479 bp, Zea mays
  unsure (1)..(479): unsure at all n locations; Clone ID: LIB3279-223-Q6-N6-G7
gattcacaaaccatggatgcattggaataggagcaagatcccataaactggttcgatacataaaccctggatgcattggaaggagcaaaatcccatgagctggttcgatacataatactttgacatgtctattaggttctacatgtatggaaaataagacactggaacataatctttggcaggctccatgaacttgaaatgctctctatttcttcttggcagggggcgtaccagccgacctcattttcctgaggacgcccgccatctcctctctcttcttctttgccctcttgggagttccaagctttcttttagcaagcttaagggcacgcttgtccttgccaaccttcaaaagctcagggatacgcttctcataaggagcaaacccagcaacctttttgatcaggcccctgaccatagacaccctcttcgttgatttccccttgcggnggcacgggcggggaggcagctcgcgcttg

SEQ ID NO: 15249 - DNA, 517 bp, Zea mays
  Clone ID: LIB3279-223-Q6-N6-G9
gatcaggatgggaacatttattcctttttgcctgcttgcctacagagaaggtttcaccttgtcctaggtgatttgcttcctatgaaccaatattaatcagacatgtcacgagcatgcagcttcaactgcaaggctttttgtgacccctgtacatggatttccaaaataattcgatgacactggcacgctgcagctgctcactccgatgcaagcctcctgaacaactgaaagagcctgagtgctgctgcattcgccatggctgtagcttccacatgtgccactcggtgtcccaaagcttgcaaacttgatgctgctgatgacctggccttcttttgggcattccaggcgaagtgcaggtccatatctctgcatcggctgttgagaactccaactatcaatttgggctggatgtgcctctgatacttgtgcgcacacacttcctgtctgcctcatcacaaaggatatcttgcttgggtcaccaccaaaatgctcgaaaaggactagatcattgctgcct

SEQ ID NO: 15250 - DNA, 425 bp, Zea mays
  Clone ID: LIB3279-223-Q6-N6-H1
actcaggcaaatgcacaaatcttacagaagcaaacgggtccggtttcacggttacaagcagctcagcctgacggcgacgactgctggtccaaggaaaagcaaacgatgcgagcggcgccggcgcagcggcggtctgagacagtcgacgatgcatgcacgtgcacgagagaaactaaacgatcgacggcgagcggggagagagagctggatgctagctgcgcacccctgggtcggtcggtttcggcttttagtagtcggtggaggggagctgctcgtgggtgtgggagatgaagagcagtttgtagatgacgccggtgaggccgacgtcgatgaggggcccaacccagtacacccactggtagccccactcccagctgacgagggcgaggccaatagacacgaagaggttcatggacacgccgaaa

SEQ ID NO: 15251 - DNA, 589 bp, Zea mays
  Clone ID: LIB3279-223-Q6-N6-H11
aattatgaaattactatgttggaataggtaaaaagtaattagcatcattgtgtttcatagtggagtatgatgttcattgccattactaacagatacatgctgatattaatttatctgaccctgcataatggtaccctgcatacagatagtggctgggaaaccatggggaagaagttgaagaaacccaggcaagtcggggggagaaagtgggcaccatggagttccacaaatgtgacacctaacacagcaaggccagcatggggtggcagtggttcctcgcacccttctggaaccagctgggctcaagctctagaccatggtgctgctaccagaggcaatcctagaccgccatcacaaacatcgcgccctgttctgactccacctctagcaaatggttggcagtggcaatccaggcctcgcccatctggatctgaagtcaagaaggatgatgctcctccatctggttctgtccctgatcacaaaagaaagttcactttgtgtttgtgtgcaagggaaagcacaaaaggaccacctacaaaataaacaacatcctgtatgaaaggactggaagtgctagtggtgtgttgtt

SEQ ID NO: 15252 - DNA, 592 bp, Zea mays
  Clone ID: LIB3279-223-Q6-N6-H12
gggtggtgctggaggtggtgcaccgcggcgggggacgggtagtactcctgcgccgccgccgccgtgtagtgcggctgcgtcgccgggtgcgcgccgtagatggcctgccccgccgcctgcgacgcgtactccggcgggacccagatgccgccgaggaccaccagctgcggcgcggcggtcgccggtgcgggcggcgccggcatcggccgccgcgtgtgcagcctgtacttctggagatggcttttcacctcatcattggtcaatccatccaccttcatcagctcgcggatctgcttcggggtcgccacttgagcaccgccgaggatctggagggcattgacgaagcggcggtgcagctccggcgaccagcaccgccgcgccttgcggtgcgtctgcggcggtgccgcctgctgcccttccggcgcgggcttgacgaccccgctctggacgacgtctctccgcgcgcccaggacgccaccgttgttgctgccggccgcggcggcgtcaaggtacggcttcctgtcagcgtcggccgcgtccttgtctgcgggcgcgagagcgagctccggcagcgccgccgccgcgccttccg

SEQ ID NO: 15253 - DNA, 487 bp, Zea mays
  Clone ID: LIB3279-223-Q6-N6-H2
gttctgttgggaaaaagaacagggatttttaatcccggggcggggttaaggaacagaagctggaagcccaggcacccggacaagtttccggtggggcagggcaaaagggtaccaacggtctccttgaaggggcgggggacccagcaaaaggggcctgcgggccaatggggacccagggcggacgggggcactttaaaaattaataaaacggaggagaggggtgtacgggggggaaaaagacaagcccataaatttatacagggggggggggttttccccagcggtcccccaaagagtgcctatactctattatatatatatgaggaggatatataagcagggccttgcgaacctcctgtacctaggacacctctagtgcatcagctggcgaggcgcacggggacgcacgggagtcttcgaggggctcacccttattggcaaggatcccagtatcacgccactgcagttcagggcagcgggagcactt

SEQ ID NO: 15254 - DNA, 582 bp, Zea mays
  Clone ID: LIB3279-223-Q6-N6-H4
agttaaaaagccaagaaactttgggataaccaattcaggatatataagacagaaaaactctggttcacgagtaaatcccaaccagcatagcaatctacggctgaattaccaaatataaagacaagtagcagtctttccagtactttccaacataaaacaagcttaaaatctaaacatgactctggttttcctctggtttcactgcccaaaacaatactgtgatgactgtgcagcctagtcgaagaggctgaagcccatatcatcatcgctttcttccttctcttccaccttctcttctttctttgcctcagctgcagaagcagctccgcaagcagcaggtgcagctgccgcaacagcgacaccgccgccaccacatgggactgaagcaaacttctccctgcccgcggcaatgagctcggtgatgtccttaccgctcagttgggacagcaggagttccatcttttcattaggaactagacagccaactgactccatgatggcagtcaaatcttaagcggtagggctggcgttcccagcgaggacagcaagcaagttaggcagaaacaaacttccccacgcgtc

SEQ ID NO: 15255 - DNA, 588 bp, Zea mays
  Clone ID: LIB3279-223-Q6-N6-H5
gatgaaccagtccatgattaggttgatattaaaggcacaatactccaccgtcacataagcaagacaagcaggtgtagaactcagaaaaaacatgtccaaacgacagcatttcaatgtaaagagtaaacattgagagctcaagctcgaaactaacagaaacagttttgttcacctcgcaaaactttaaaacaaaaatgcctattgcagtactacaggtccccgcataagacagtacacaattgctgatcgctggattgagatagcactacttcgatggcaattaactttactcgtcgtcctcatcgtcgtcatcagcaccaccggaggagttgagttggttgagcctttcaatgaggctggccttcctctgctcatatgtcagcttcttggggttgtacctcttatgctcctttggtggctgcttggttgacttaacaatggaaggatcggcacggatggcagcatggaccttcttgtacagcgcttctatttcatcagcctcaactcccttcttaatgtacgcactgaagtggctctggtacttttctgggtcctcttcagcaggttcttcatgtagtcagcaacatg

SEQ ID NO: 15256 - DNA, 598 bp, Zea mays
  Clone ID: LIB3279-223-Q6-N6-H6
gaccaaacacctatgtcatgcatagatactatgctaaatttctcatggtgccgactggcttacatattgaagttcatataatacaagcggccacaacagaaaatattcatacactaatacctagtggttatggtattagtggcttagtgcggcagaaaagtaaattaaagatttatttgttcaacggcccacagggatacacagaaaagtatgcatacatcagcaatagcatgaaccagatcacacctcacactagtagctgcagtcctagaacctcaagcagagagccaatggcttccatattcttgtcctcgagaagggaacaaggaatgaccgtgagcatcacgccacggcaagtattggaagaagagcagcacagacaagaggaaggaggacaagcctgaggtggactttctcttcccccagcaaagtacagcaataaattcatcgcatggacataagattgcgcctttgggtggccctcctggaggcctgggcagccctcgatgttcgcttcaggtttttcctcaccaacttctctaccttctctattgaaccggaaagtttcttgtcagcaaggcaggatccattggtttgg

SEQ ID NO: 15257 - DNA, 300 bp, Zea mays
  unsure (1)..(300): unsure at all n locations; Clone ID: LIB3279-223-Q6-N6-H7
gaatcaaagcaagagccaagcattgatatataagtttttattcaataaacaccccgnttcaaaagtaggcatcgataccagaccatattcaagagcgccactacaaaaatactcgctaaaagcttatttcaaggagaaccatccgtcctccggattgctagctacatcaaaattgcacaccatgcttgcaacttcaaacatacattcgcgcctagagcttgaggaaaacaaactcttcgatcgctggaatctccccgatcttcgtcagtgtgcccttgcttggttcctcatcaacaccaa

SEQ ID NO: 15258 - DNA, 583 bp, Zea mays
  Clone ID: LIB3279-223-Q6-N6-H8
gggataaccaattcaggatatataagacagaaaactctggttcacgagtaaatcccaaccagcatagcaatctacggctgaattaccaaatataaagacaagtagcagtctttccagtactttccaacataaaacaagcttaaaatctaaacatgactctggttttcctctggtttcactgcccaaaacaatactgtgatgactgtgcagcctagtcgaagaggctgaagcccatatcatcatcgctttcttccttctcttccaccttctcttctttctttgcctcagctgcagaagcagctccgccagcagcaggtgcagctgccgcaacagcgacaccgccgccaccacatgggactgaagcaaacttctccctgcccgcggcaatgagctcggtgatgtccttaccgctcagttgggacagcaggagttccatcttttcattgtcaacttcacagccaactgactccagaatggcagtcaaatcgtcagcggaggggctggcgttcccagcgaggacagcaagcaggtaggcagcaacaaacttcatcgtgctccgaggaaccggtcgactgctaatacc

SEQ ID NO: 15259 - DNA, 583 bp, Zea mays
  Clone ID: LIB3279-223-Q6-N6-H9
acacgcactgtaacacaattcttgacattaacgaacaaatcggccacagcattgcgcgcaaggtccagcagcgcacataacactgctagtccagactgtcagcgcatagttaacttaagtattcgaccctagcaataacaccagcaaaggtagcagcaacagtagcagaagagaaacttgcgatccacaaaacaaaccctactcatatgtccttacaatggcaccagattaacaataaccccaggacttcatgtttttgtcacgatgtttgaggtggcgattaggccctctcgccgcggatcctccttgccagctgaatgtcctttggcatgatggtcacacgcttagcatggatggcgcacaggttggtgtcctcaaacaggccaacaaggtatgcctcagcagcctcctggagggcaagcaccgcatggctctggaaacgcaaatcagttttgaagtcctgtgcaatttccctgacgagcctctggaagggcagcttcctgatcagcagctcagtgctcttctgatacttgcggatctcacggagggcaacagttccagggcggtagcggtgaggcttctt

SEQ ID NO: 15260 - DNA, 434 bp, Zea mays
  unsure (1)..(434): unsure at all n locations; Clone ID: LIB3279-224-Q6-K6-A1
ctgagcccggacgacgagtccctgttcatcggagtgtgcgaccgcgtctatgccagcctgttgcagtacaggatgatccgcggattcgactatcttgactcatacgtgtgaagaactgagctttggtgaccggtgttgtgctaggtgctggctgaaggttctgatgcgcggttcagggaatatatctgcctgctcttagttcatggcgaatgatggttcggtgggactcgacgccagcgaatctgccgtgtaaatagtttagaatttgaagcgtagtgtagtgctgtggaccaatgctgtctctgaacatacatatgatcagagtaatgtgtgtttgcgctgttagtttcagactccggaatacaaatagttttggaccaaattcctaaagcctgtttgtactgtggaacacatgaaagggctagtttgtnttc

SEQ ID NO: 15261 - DNA, 259 bp, Zea mays
  Clone ID: LIB3279-224-Q6-K6-A10
gcgagtcaatcccgttgggttgaagaacgtctggagtgttttcttccattgtgtaggttttttttttctttagtttctgaaaaagttctgagctctgtcatacattttggctagaagtcaacctagttatggggatattgtgagcaattataagtcggttcagcgagaagcacaggtgtgtaattcatggatatggagggcaacccttcacggtttgttaaaacaatgaacaaactgatccctaggttctagatcgcga

SEQ ID NO: 15262 - DNA, 612 bp, Zea mays
  Clone ID: LIB3279-224-Q6-K6-A11
gtgcgcgaaccgcaccgacgcatgcgtgcgtggtggactgctccggcggcagatgcgcgcacgacccagtccggtacatgcgccccatgctgcgcgcggtccaggttctgcctgcagccgccgggggggacgccgacgcggcgctccacgttcgacgccatcctcgccggctgcgtgcccggttcttcgaggacctgcggcgcggaggcagtacgggtggcacctgcccccggtgcggtacggcgagttctcggtgcacatgcccaaggaggccgcggtgttcggcggcgtccggatcgtcgagacgctcgaggccgtgccggaggaggaggtgcggcggatgcggcagcgcgcgctggagatggcgccgagggtggtgtaccggcggcacgggagcacgcccgagctgaggcaggccgtgaacgacgccgtcgacctcgctgtggacggcgtgctgcagagaattcgaaggcggacgcacgcactggaggaaggactgccggagaggctttacgcgcaagaggaggatagcgttagcgttgacatataggatcaggagcacgcccttcggctgcatcagggcattattcagtgaaatagagtgtgtacatg

SEQ ID NO: 15263 - DNA, 410 bp, Zea mays
  unsure (1)..(410): unsure at all n locations; Clone ID: LIB3279-224-Q6-K6-A12
gtgacacgcaaatcagatgtgtacagctgtggcgtgctgcttctggaaattgtttgcgggagatcaaacagcgatcaagattgcatcggagatagatactctnaaaagttccagagataccaacggggctctcctcttcagacgtggatcactanagcagggttgctggggagatcatagacaggtccttgggcggcggcgacctggacgtggcgcaggcctgcaggttcctgaaggtcgggctgctgtgcacgcaggacgtgacgaggcaccggcccgacatgccgagggtcgtcgccatgctgacgggcgagtgggacgtcgagccggagacggtcagcaagcccgccataatcagcgacttcatggaccttaaggtcaggagcacgaggaaagcgagcgacaacgtg

SEQ ID NO: 15264 - DNA, 529 bp, Zea mays
  Clone ID: LIB3279-224-Q6-K6-A2
atcgccacatccgagctcgccctctccttcctcatcgaggcccaagtcctgctgtgatgacgaccgacgtggctgagactcccgcgccgttggtggatgcggcccctgaggcgcccgcggacaccccggcggcgcctgctgctgatgcgaagccggccaaggccaagaaggccacagcgccgaagaagcgcgccagcccgacccatccgccgtacgccgagatggtatcggaggcgatcgcgtcgctcaaggagaggacggggtccagcagctttgctattgccaagttcttggaagacaagcacaaggacaagctcccgcccaacttccgcaaacttctgaacgttcagctcaagaagctcgtcgccggcggcaagctgaccaaggtgaagaactcgtacaagctgtcgtccgccaccaagccaaaggccgccccgaagaagaccaagaccggcgtgaagaagcccaaggccgctgccaaaccgaaggccaagtcccccgcgaagcccaagcccgccacaaagcccaa

SEQ ID NO: 15265 - DNA, 655 bp, Zea mays
  unsure (1)..(655): unsure at all n locations; Clone ID: LIB3279-224-Q6-K6-A3
cccacgcgtccgcacatctggcgcgccgtctcccgcgcccggggcctcggccccgccgacatcaccgccttcgccgtcttcgccgactgccgcgcccgcctcgacccgcccctcccgccggcctacttcggcaacctcatccaggcggtgttcacgggcgtgcccgcggggatgctcctgggcgggccccccgagctgcccgcgggcctgctgcagaaggccatcgacgagcacgacgccgccgcggtcaccaggaggctggaggagtacgaggcggcgcccaagctgttccactacagcgacgccggccccaactgcgtggccgtcggcagctcgccgcgcttcagggtctacgacgtcgacttcggcttcggacggcccgagcgcgtccgcagcggcgggaacaacaagttcgacggcatggtgtacctgtaccccggccgcggcggcgacggcggcatcgacgtcgagctggcgctgcagccggagcccatgcagaggctggagaaggacgacgacttcttcctgcgccaggcggcagcctaagcccgagtcgtcgatcgtcgtgtcagtgtccactgtccacacccatncagttcgttgatcatgctttattttagtagtaagtattgggtacgttcctgcttgctatatt

SEQ ID NO: 15266 - DNA, 658 bp, Zea mays
  unsure (1)..(658): unsure at all n locations; Clone ID: LIB3279-224-Q6-K6-A4
ctggtataaaggaaggttccatcagcagagatggaataaaatgcatgtgttgtaatgaattattcactgtggagaattttgaggttcatgctgggagcagtacaccattaccttcgtctcatatgtttttaaaggatggaaggtccctatcacagtgtttagttgaattcatgggtggaaacaagcccagagatccactgcatgtgcgcttgaaggggagtagttctgatctggaaagtgattcgatatgctctgtgtgccatgatggtggggatttattactttgtgacaattgcccatcatcttatcatcatgattgtgtcggcttggaggtagaggccattccagaaggaagctggtattgtccatcctgcagatgcggtatttgtaacttgagtgattatgatcctgataccagccaattcactgagaagaccatagtgtactgtgatcagtgtgaacgggaatatcatgtcggttgcactagaaatagtgaccatcagcttatctgccgaccagaaggttgttggttntgcagcaggggatgctcaaatgtatttcaacatttgcaagaagtcattgggaaacaagttccaactccaatcgaaggcttatcttgcactatcttgaaattttgtagagcgaacggcggtgacca

SEQ ID NO: 15267 - DNA, 644 bp, Zea mays
  Clone ID: LIB3279-224-Q6-K6-A5
aacatcatcagctcactctcttctccatcctcttctcggttatcccaccaactccccaaccccaccccaaagatcaggtttcgatccgcgaacccactcccaatcctccaaagatcaccgctctcagacccctcctccccggcaatggccgccggtggccccgcgctgctgcgtgccctcctcgtcgcggccctctgcgccgtcccgtggcgggccgaggcggcgatcgggatgaactggggtaccgtgtccaaccaccgcgcgccgcctggcgtggtggtggacttgatgcgcgcgaatcggatcagcaaggtgaagctcttcaacgccgacccgggagtcctgcgcgcgctcgccggcagcggcatccaggtcatggtcggcgttaccaacgacgagctcgcaagcatcgcggggtcgcaggcggctgcagacgactgggtcgcgcagaacgtgtcccgttacgtcggccgcggcggcgtcgacatccgatacattgctgtgggcaatgagcctttcctgacaagctaccagggtcaattccaatcatatatcattccagcgatgacaaatattcagcaatcactggtgaaagctaatcttgctagctatgtaaagctagtagttccctgcaatgctgatgc

SEQ ID NO: 15268 - DNA, 480 bp, Zea mays
  Clone ID: LIB3279-224-Q6-K6-A6
agaggggaacagagaccaaacagtttttttcccccagagggcaaacttgtcgcccaacataagaggttccaagtcaaattaaaacatcgcagtcgcagcaacatattgatgcctacctaggctgctctggcctgtcaaagctgacgtgcattttctttcctatcataacacttattaacacctttttctttcctaacagaaattaacacgaattgacccaacgaactactcgatggctactgcaaaaagagaaccttttgggcgcacgaccctttttttctgccagtcgggagtcataccgcgccaagctttgaaagggtggaaccggcctgctactttgccttggatcctttgccgaccaggcttgcgaaccctttcctggcttttctgtgctttttgtgaagtactttgaaactctggtcttgcttttcccgaagaagcattcagtccaagggcaagtcgtactcgatcgtgttgggc

SEQ ID NO: 15269 - DNA, 655 bp, Zea mays
  unsure (1)..(655): unsure at all n locations; Clone ID: LIB3279-224-Q6-K6-A7
cccacgcgttcggctctgcaacctcgagctctggacgcagcgccgcctcgaggcgctcaggcccatccgcgaggacgaggtcaccgccatggtcgagtccgtctacaaggccgtcaccgcgcctggcagtgcagggaagccgttggtggtaaagaaccacctctcgatggtggccttcaacaacatcacgcggctggccttcgggaagcggttcgtggacgcgaccggcgagctggacgagcaagggcgcgagttcaaggggatcgtccacaacggcatcaagatcggtgcgtccctctccatcgcgcagcacataccgtggctgcgctggctggccccggtcgacgagcaggccttcaaagcccacggcgaacggcgcgaccgcctcaccgtgaagatcatggaggagcacgccagggccctcaagcagcgcggcgcccagcagcacttcgtcgacgcgctcttcactctcagggacaagtacgacctcagcgatgacaccgtcataggcctcctctgggacatgatcaccgccggcacggacacgacggtgatctcggtggagtgggcgatggcggagctgctgangaaccccagagtgcaggagaagctgcaggaggagctggaccgtgtcgtcngccgcgaccgggtcctg

SEQ ID NO: 15270 - DNA, 646 bp, Zea mays
  Clone ID: LIB3279-224-Q6-K6-A8
cccacgcgtccgcgtagttctcaacactccttcgtggggcgtgctcgctcctagaatcctagggtccgcttctgcgtcaccgatcggtagtaagcacagagtcaccgcaccgccgcgtctaggtcaccgccatggccggggactggcaggagctgggccaagcggcggccatcggccgcctcttcgccttcctggtcgccaagctcatctccaccgtgatcgccttcaaggaggacaacctccgcatcacgcgctcccctccgacctcccccactgccgccgccgcagccgcgcctcccgtcccctcccacgacggctccaccgacggcggcagcggcagcgacagcgacagcgactgggagggcgtggagagcaccgagctcgacgaggagttcagcgccgcctccgccttcatcgcggcctccgccgcctccggcaccagcgtccccgaggaagcgcagctgcgcctctacggcctctacaagatcgccaccgaggggccctgcaccgcgccccagccgtccgcgctcaagctcaaggcccgtgccaaatggaatgcttggcataagctgggtgctatgcctacagaagaagctatgcaagggtacatcacaattgttcaggagctattccctaactgggatgc

SEQ ID NO: 15271 - DNA, 572 bp, Zea mays
  Clone ID: LIB3279-224-Q6-K6-A9
gcagcagcaggaaccctagcaccgccgcatccgcagccatgggtatcgacctcgttgccggtgggaggaacaagaagaccaagcgcacagcgccgaagtccgacgatgtttatctcaagctccttgtcaagctctaccgtttcttggtcaggaggaccaagagcaacttcaatgctgtcatgctgaagaggctcttcatgagcaaaaccaatcgcccaccaatctccatgcgccgccttgtcaagttcatggaaggaaaggagaagaacattgctgtgattgttggcacagtcacagatgacaagaggatccaagaggttccagcaatgaaggttactgccctgaggttcaccgagacggcaagggccaggattgtcaatgctggtggggagtgcctcacatttgaccagcttgctctccgtgctccacttggcgagaacacagtcctcttgaggggccccaagaatgcccgtgaggcggtgaggcacttcggcaaggctcctggagtgccgcacagccacaccaagccatatgtgcgctccaagggaaggaagttcgagaaggctcgtggc

SEQ ID NO: 15272 - DNA, 659 bp, Zea mays
  Clone ID: LIB3279-224-Q6-K6-B1
gcaggatctaaagctgtgtctgatgaacatgcaatatgtcaccgtatggtattggtatgtgggacatcaacctgccacatggctgtttcaaaggacagattgtttatacctggtgtctgggggccgttttggtctgcgatgatccctgagttttggctcacagaaggtggccaaagtgcaactggcgctctgctcgattacattattgaaaaccatgttgcttctcctcttctttctaaccatgctgcttctcaaagtatatccatatttgagctactgaacaagatgttgctttctatgtcacaagagcagaatagtccgtttctttctgcattaactcaagacacccatgtgcttccggattttcatggaaatcggtctcctgttcctgatccaaaatccaaaggagtgatttatggcttgacacttgatacaagtgagaagcatttagctcttctatacctagcaacaattcagggtattgcttatggtactcgtcatattgtggagcattgtaatgctcatggccacaagatagacacacttcttgcttgtgggggacttgcaaagaattctctgtatatccaagagcatgcagatattacaggatgtcctataatacttcctagagagagcgagtcagtgcttttgggtgccgc

SEQ ID NO: 15273 - DNA, 344 bp, Zea mays
  Clone ID: LIB3279-224-Q6-K6-B10
gccacgcgtccgccacgcgtccgacagtgctcgttttcgtctcagatatagcgtactcacttgaataaactgtacatcacgcctgttttgtgaaactcgtgccttgctcaattgtgccactttagcagacatccccagctcacctcatcctggctggagatcatatcatatgcggatatgaaatggaacgttggatcagagttttagtggacgctcaattttttttgaggtagcagcactgatttcagtttctgttggataatgattgtttggctgcttaacgagaaaaatatagtatgcacgtacaaaatgttagattttttaataactaaaatgttttcttc

SEQ ID NO: 15274 - DNA, 610 bp, Zea mays
  Clone ID: LIB3279-224-Q6-K6-B11
cccacgcgtccgcggacgcgtggggtgctggtgcgcttcctggtcagctgaattctgacctcggaagcttgagtgacctgatccccttccacgtctgacttcttatggttggatttgtcactgacctccggggctccagcagtccgcctctaccgtgccagaggagccagcagatgtgggactccaagaacatgatgtgtgctgctgaccctcgtcatggccggtacctcacggcatctgctatgttccgtgggaagatgagcaccaaggaagtggatgaacagatgctgaacgtgcagaacaagaactcttcctacttcgtagagtggatccccaacaacgtgaagtcgagtgtgtgtgacattccaccaattggcctgaagatgtcctccacattcgttggcaactcaacctccatccaagagatgttccgccgcgtcagcgagcagttcacggccatgttcaggaggaaggctttcttgcactggtacacaggcgagggtatggatgagatggagttcaccgaggcagagagtaacatgaacgacctggtggccgagtatcagcagtaccaggacgccactgccgaggatgaggagtacgaggagga

SEQ ID NO: 15275 - DNA, 70 bp, Zea mays
  Clone ID: LIB3279-224-Q6-K6-B12
gaaattttcttgggcgttcttcggctggattgtgacaaggttcgagttcgtcaccgtctagtacgactgt

SEQ ID NO: 15276 - DNA, 651 bp, Zea mays
  Clone ID: LIB3279-224-Q6-K6-B2
cgcatttcctcccaatccatcccgcctccaaacccgaactccaagtcgccccgcatcgatggcgcccaaggccgagaagaagcccgcggcgaagaagccggcggaggaggagcccgctgccgagaaggcgccggccgggaagaagcccaaggcggagaagcgtgtcccagcaggcaagtccgccggcaaggagggcggcgagggaaagaggggccggaagaagggcaagaagagcgtggagacctacaagatctacatcttcaaggtgctgaagcaggtgcacccggacatcggcatctcctctaaggccatgtccatcatgaactccttcatcaacgacatcttcgagaagctcgccgccgaggccgccaagctcgcgcggtacaacaagaagcccaccatcacctcccgtgagatccagacctccgtgcgcctcgtcctccccggggagctcgccaagcacgccgtctccgagggcaccaaggccgtcaccaagttcacctcgtcctaggctgcgtggcctccgcttgcaggcttccctcgtatgttcgcgtgtcttgctgtagttaggtgctgctgtgtctggtctcctccggtagcaactgttatctgatggaacagtaacaatgcttattgaatccagctagttgc

SEQ ID NO: 15277 - DNA, 140 bp, Zea mays
  Clone ID: LIB3279-224-Q6-K6-B3
cccacgcgtccgtgcagggctacgtgaaggacacgagcttcgtcgccggctgcaactcggccgcctgcaacgtcacgacgatccccgaggcggtccaggcggcgagctcggcggactccgtcgtcttgttcatgggggct

SEQ ID NO: 15278 - DNA, 594 bp, Zea mays
  Clone ID: LIB3279-224-Q6-K6-B4
cgtctacagtttcgccattgtcctgtgggagttggtaactgggaatgtccctttcgcaaacatgactgcagtgcaagctgcatttgctgtggtgaacaagggtgtgcgaccagccataccccacgactgcctccctgcccttggggagatcatgaccaggtgctgggacgcaaaccctgaggtccgtcccccattcactgagatcgtgaggatgctggaacaggtggagatggaggttctgaccaccgtccgaaaggctcggttccgctgctgcatcgcccaaccgatgacgctggactgagtcatccacaaaatccaggaaaataacctggagtgccgtttactcctatgtatttataatatatattattagagttgtgcttcagaagcagggagctgactcctcagtctgccttctgtctttgacatgtcaccgtagagtacaccagagtggttgtaatagaggtagctttatgcttgaccaaatacccttctccgttgtaaaagtgcctgttcttgctggtcgctgtttgcgtgtttatcatcatgcggcaacatgtgggagtcttgatgcttcatggtatatataatatg

SEQ ID NO: 15279 - DNA, 645 bp, Zea mays
  unsure (1)..(645): unsure at all n locations; Clone ID: LIB3279-224-Q6-K6-B5
ctggaagtggaaagaagtgggttcttgcttgagctgagctcttgctgcccttgaatctgtttgggagtggagaacggagtatggggcgcggcaagatcgagatcaagaggatcgagaactctaccaaccggcaggtgaccttctccaagcgccgggccggactggtcaagaaggcacgggagatcggcgtgctctgcgacgccgaggtcggcgtcgtcatcttctccagcggcggcaagctctatgactactgctcgcccaggacctcgctgtccaggatcttggagaagtaccagaccaactccgggaagattctgtggggtgagaagcacaagaacctgagtgcagagatcgacagagtcaagaaggagaacgacaacatgcagattcagctcaggcatctgaaaggcgaggacctgaactccctgcagcccagggagctgatcgctattgaagagggcctccagaatgggcagaccaacatgcgcgagaagcagatggactactggaggatgcacacgacgaatgggaagatgctggaggacgaacataagatactgacttttaggatgcaccaacaggctgttgatctgagcggcggcatganggagctggagaccggataccatcaggttcagcacgaca

SEQ ID NO: 15280 - DNA, 300 bp, Zea mays
  Clone ID: LIB3279-224-Q6-K6-B6
agatcgcgaacaggcgccagagtgggatccagcagttgctggctgcggagcaggaggctcagcaaattgtgaatgccgctagagctgccaagtcagcgaggctcaggcaagcaaaagaggaggctgagcgggaaatagccgaataccgtgcccagatggaggctgagtttcagagggagggttgcagagagcagccgcgaactccgggccaaccgtaagccgtttgaaggaaaaacgggggggaaaaatcaaccacttaacccagaaggccgaaggcttttccccggaggtaattaaaat

SEQ ID NO: 15281 - DNA, 540 bp, Zea mays
  Clone ID: LIB3279-224-Q6-K6-B7
gctggagaactacttctacaacatgcgcaacacgatcaaggacgagaagattgcgtccaagctgccggccgatgacaagaagaagatcgaggacgccatcgacgcggccatcagctggctggacgccaaccatgctcgccggaggcaggacggaagttcgcatggacaagcatgaaaggagctgggagagcctaatgcaaccccatcatacgccaatatgtaccagggctgcggctgaagacatgggcggcgctggcggcatggacgaggactcccccgctggcagcggcggccctggccccaagatcgacgaggtggactaagcggattgatgacagtcttagagcgtagctgcaggtgctggctgcaccattcgctgccgcaagttatcgtcatcggtcggtgcggagtgtccgcttaaactttatgtgaggcggactggtactttcgtggtggttattacttctggaccttgtgataggcagtcggctccatgttatcacagatactggcaaaccttaagtgatacagcaatccttc

SEQ ID NO: 15282 - DNA, 287 bp, Zea mays
  Clone ID: LIB3279-224-Q6-K6-B8
cgacatctttgagaagctcgccgccgagggggggagctcgcccgctacaacaagaagcccaccatcacctcccgggagatccagacctcggtgcgcctcgtcctccccggcgagctcgccaagcacgccgtatccgaagggaccaaggcggttaccaagtttacattctcttaggggggcggggcacgttgctacgatcctgtttaattctcatatttaggcctgtgctaggttgcttctgcaacaatgtagaatttgttataattgctgaatgaatcagttacccc

SEQ ID NO: 15283 - DNA, 167 bp, Zea mays
  Clone ID: LIB3279-224-Q6-K6-B9
cgcatccacacctcgcagccgtattcttgtctcgaatcctctctcgccgctccgatggcccgcacgaagcaaacagcaaggaagtcgaccggcggcaaggccccccggaagcagctggccactaaggctgcgcgcaagtcggccccggccaccggcggcgtgaaaga

SEQ ID NO: 15284 - DNA, 498 bp, Zea mays
  unsure (1)..(498): unsure at all n locations; Clone ID: LIB3279-224-Q6-K6-C1
ctgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacattgctgagaacgagggcgaggaagaagattagattgcactacgcttatattttagtattgaactcgttgcattttgatacctgtacccgtagtttcgcaaatgtcccatgttatggtgtggtatggttaatttgaagaatccttatgtactgaatctctgcaaaaagctatgttgtggacagaagtgtnnnnnaaaaaaaanaaaanaaanaaa

SEQ ID NO: 15285 - DNA, 570 bp, Zea mays
  unsure (1)..(570): unsure at all n locations; Clone ID: LIB3279-224-Q6-K6-C10
cgtcgaagatgtaatgcatatggtaacagagttccaagaggatttgatggagttgttgccactgaccagatatgcagcggacatgaaaacattgatatggttggaaaccagtatccatctgaaaatgcaattcaaggtaccgaagataagaaattctctatagcgtcaacttcccagcgtgaggtctcagaatttactgaatcaaagacaccacttagattccagttcaccaagcaatattacttcggagtcctatccaggaaagttcggtccatctagctgttcttctgcacaaagaaactcaaaagtgcagaagaaaactgtcaacatacaaccaagacagccagcaaatgataatgttatgaacacaangcagagcttcttacctcttgtgagaactatgaaactgaaagaagaggattagggaaaagaactctgggggatcctcaagttacaatgggtagttcaatggtagtggatggctcatttgtatcatctatgtcctctgataactcagtcgaagaaagcagctttcaacaactgcaggatgctgttagtcagcttgatgtg

SEQ ID NO: 15286 - DNA, 626 bp, Zea mays
  unsure (1)..(626): unsure at all n locations; Clone ID: LIB3279-224-Q6-K6-C11
gttctagatcgcgagcggccgcccgggagctgggcgccatcgcggcgccgcccacgccgccggcgccatcggcagcggccgggcggcagacgcgtgcggcagaggcggtgcgtctggagcaccaactggtgcgcgtgcctctcgagtccctccgcgccaccgtcctctcgaaccaccgtcgctccgagaaggagatcgccgccgtcctctcctccgcctccgcggcccccgcagagagcagtgccgccgccgtcgaccacctcacctccctcgtctctcgcctccacggcctcaagcgcaagatggaggagggcgcacgagcggaggaactgcaggtgcagcggtgccgggcgcgtctggaccggctggcgactgccagcaccggcgacgatgccgagtgggaggacatgcggttgaagaggatcctggtcgattacatgcttcggatgtcctactacaattccgccaccaagctcgctgagacttctggtattcaggacctcgttgatattgatgtctttctcgatgcgaanagagtaattgattctcttcagaataatgaagtttctcctgctttagcgttgntgtgcagaaaacaagtctcggctaaagaaatcgagagtagc

SEQ ID NO: 15287 - DNA, 633 bp, Zea mays
  unsure (1)..(633): unsure at all n locations; Clone ID: LIB3279-224-Q6-K6-C12
ccacgcttccgcnaaaaggaagaggggatgggttacttctgcatcagcttcgaaggggcccatgggacctgtgtttagcagtttgatgtacgaggaagacgaaggaaatgattcagaacttgctacatccatgttttagcgagggaaggagcaactgaggatatagtgaagtttgttcggcgggtgtggaagtcaacatgagagatactgaaggtagaactccgctgcactgggctgttgaccgtggccatcttagtgctgttgaggttcttgcaaaagcaaatgcggacctgaatgccaaggacaacgaagggcaaacggcactccactacgctgctgtttgtgaaagagaagacatcgcagaattgctcgtgaagcatcatgccgaccttcagatcaaggatgaggatgggaacacggcacaggacctgtgccctccgagctggtcttttatgaaccgggcgaactgacaaccaacatgctaccttacattagctgtactctaagctggtaccgcacttggtcaatgtgttttttatttatgggggacatatggtgtgccctgtgtgaagtgccgtgcgtggcgcccgctatgacgattgggaaatcagatgagctgttttattttaaaaa

SEQ ID NO: 15288 - DNA, 655 bp, Zea mays
  unsure (1)..(655): unsure at all n locations; Clone ID: LIB3279-224-Q6-K6-C2
ttcaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggccaaagttacagatgttccagtgtttaccaacagagtttctcgtacgtaccgggcaaaatcagtgacagttccagatcacggagttgatgtgtgtcctttggaatacaatgagtatgtcccctgccatgatggagcctatataagcagcttgaagagcctggatacatctaggcatgtggatcttgaaagtatttgtcctccatgggagaagcggttgttttgtttggtgccccctccaaatgactacaagataccaataagatggccaacaagccgagactacgtatggcgtagtaatgtcaaccattcacatcttgctgaggtcaaaggaggacagaactgngtgcatgagaagggcaaactttggtggtttcctggaggtggcactcacttcaaacatggtgcatcagaatac

SEQ ID NO: 15289 - DNA, 525 bp, Zea mays
  Clone ID: LIB3279-224-Q6-K6-C3
catctcctcgcatttcttcccatccgatccccccttcgcaaccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctgaggccgccaagctcgcgcgctataacaagaagcctaccatcacctcccgtgagatccagacctccgtgcgcctcgtccttcccggggagctcgccaagcacgccgtctccgagggcaccaaggccgtcaccaagttcacctcggcctaggctgc

SEQ ID NO: 15290 - DNA, 652 bp, Zea mays
  unsure (1)..(652): unsure at all n locations; Clone ID: LIB3279-224-Q6-K6-C5
ctcccactgccgtctcggcaacctcccctgttccacgcttcgtcctcgcctgccaggctgccatggccgcgacgtcccccttcgactgcgtcctcctagacctcgacgacaccctgtacccgggcgacaccggcatcggcgcggccctgaggcgcaacatcgacgagttcctccaggccaagctcggcgtgtcggccgacgaggccgccgccacgcgcgccgagctcttccgcgcgcacggcagctccctcgccgggctcatcgcgctcggctacgacgtgcacccggacgagtaccacagctacgtgcacggcaggctaccgtacgacaggatcgcgcgcgacccgcagctggcgcggctgctgcagagcatcccgcagcgcaaagtgctgttcaccaactcggaccgcgcgcacatggagcgggcgctggagcggctgggcgtggacgaggccgccttcgacgccgtcgtgtgcttcgagaccatgaacccgcacctgttcggcgacgacggtggcgaccggcgcccggccgtggtgctcaaaccggcggtggacgcaatcgtcgccgggctgcgcgccgntggctncaacccacgccggacgctgttcctggacgacagcgagaggaacatcngccgcgggaaagcgct

SEQ ID NO: 15291 - DNA, 642 bp, Zea mays
  Clone ID: LIB3279-224-Q6-K6-C6
cgtcatcgcaaaatgcaggctctcctgctccccgcgcgggccgcgccgccgacgccggcgatgcttcggcagcgtgcggtttctgcctccgcgtgtgcgtcgcaggtctgccgccccctattcggtgccgccagttgcatctcctgtggggtccacggaagcgttcggcggcacctcacagtggcggtggcggcggccccgccctcgccttcgtcctcaccttcgtcgggaccgctctacccgacgcctccacccaccgagcaggaggtggagagggtcaagctcgagcaggttatgaggagactagagaaaacagcaaggtatttcaagaatttgggtaccctggggttctggtcccaattggtgtgcacaattatttctgctggaattttggcattctctacagttgtaacggggaaggtgacatcaccctttacattctatgcaactgctgctggtattgctgctgcttttatttcagtcttctggtcatttggttacatccgtctctctgaaaggcttagaaaaacatccaaagaacctgctaaggctcctccacgtgctgatgttgttaagagccttaaaaatggcatcgtggttaatattcttgggatgggcgctgctgttctcggcatgcaagct

SEQ ID NO: 15292 - DNA, 564 bp, Zea mays
  Clone ID: LIB3279-224-Q6-K6-C7
cctcatccgaggttccgatcgccgcccgcacctgcgtctccgtcggcgaggtggcggtgggagcggtggctacaagcagcggcgaccgggtggcggcggattgcggggtgtgcgccatctgcctcgacaggatagcgctccaggagacggccctcgtcaagggttgcgaccacgcctactgtgtgacctgtattttgaggtgggcatcctacaaggagaaccctctctgtccacagtgcaagcatccattcggattcctcagcgtgcaccgctctctcgacggctgcttacatgactacctgtttgaggagagtgtttgcctccttctgagggcagcttggtttgaacctctgatcgtagaggctcaggaagaggctctggaagaagaagagtttctccaccagcagtaccaatacgatgatgacgaagatgatcttgacgaggaattttattacatgagcaggtccccaagcatccgtattggtaacaggagatggggtgacaatgggtacatcaggggaggcaggaaagaggcgaggccagtgaatactgatgtggctgctg

SEQ ID NO: 15293 - DNA, 654 bp, Zea mays
  Clone ID: LIB3279-224-Q6-K6-C8
cggacgcgtgggctccccccctaccggctaccctgcccatcacacacaaacagccactcctcacctcccccgtcctccggttcatgtcctgctgctccccatgtcgcccccactcgacctcgactacataggcctctcgccggcggcggctgccgccgctgcccacgacgacctgaagggtaccgagctccgccttggtctgccggggtccggttcgccggaccgccgtgttgtggctgccaccgcaaccaccctggacctgctcccggctaagggcgccaagcgcgggttttctgacgaggcgccgacgccatcgcccggtgcagcttccgggaagggaaagaaggtagcggaagaggaggacgacaagaaggttgcagcgacgccgcagccggtcgcaaaagctcaggtggtgggatggccaccaatccgaagctaccgcaagaacacgatgtctaccacccagctgaagggcagcaaggaggatgctgaggccaagcaggaccaggggttcctgtacgtcaaggtcagcatggatggcgcgccgtacctcaggaagattgacctcaagacttacaagaactacaaggacctgtcgactgcgcttgagaagatgttcagtggcttcagtactggcaaggatggcttatctga

SEQ ID NO: 15294 - DNA, 640 bp, Zea mays
  Clone ID: LIB3279-224-Q6-K6-C9
gtcacgcgcaccatcgtcgaggtcgtgcagctctgccaccgccacggcgtcatgcaccgggacctcaagcccgagaacttcctcttcgccaacaagaaggagaactcgccgctcaaggccatcgactttggtctctccatcttcttcaagcccggtgaaaagttttcggaaattgtgggagggccatactacatggctcctgaagtcttgaagaggaactatggacctgaaatagacatatggagcgctggtgttatcttgtatattttgttatgtggcgttcctccgttttgggctgagactgaacaaggagttgcacaagctattctccggggaaatatagattttaagcgagaaccctggcccaatgtttctgacaatgctaaagatcttgttcggcagatgcttcaacctgatccaaaactcaggctaacagcaaagcaagttcttgagcatccctggcttcaaaatgctaagaaagctccaaatgttcctcttggagacattgtaaagtcaaggctgaaacagttttcaaggatgaacagattcaaaagaaaagctctaagggttattgctgatcacttgtcagctgaagaggttgaggacataaaggatatgttcaaggtgatggatactgata

SEQ ID NO: 15295 - DNA, 641 bp, Zea mays
  unsure (1)..(641): unsure at all n locations; Clone ID: LIB3279-224-Q6-K6-D1
atcgcttcgtccccgcgtctcgccgcgtagcggcgtaggcgccacagaaactcgcacgccgctccccgccgtccggcccgagtcgccgtcgctgccgaatccaatccatggctccgcccgccgcacccaccgcgctgcaccaccgcacgcccctcctcctcccccgccgcaccgtcgccttgggtgccaccgccaccgcgcgcgccgccagggccgcttctctcgccgtcagggcccagccggacaccaccgccgcagccgtctccacctccgcgcctgagccggcgcccgagttcaagcctccgccggggttcaaggcgcccgagcccaagacgtacgaggtcaagtccggccaggtgggcagcgtcctcggcgcctcgctcgccatcccccttcgcctcggcaccggcgtcttcgtcctcgggtactcgccatctcttgtttctccatcagagataccatcagaccagtatgcactggaatttggagcttggaaggtgaaagaggaatcaaaaataggacagtgcaaacgaccagaaaagcctatcgagatatatgaatttgaaggttgtccattttgtcggaaggtcagagagatggtaacagtcttggacctagatgtattattttaccnctgtcct

SEQ ID NO: 15296 - DNA, 92 bp, Zea mays
  Clone ID: LIB3279-224-Q6-K6-D11
cccacgcgtccgtgagggcattgtctgtgtggagtgctctatacctgattgggcaaaggacactgataatctggctgatgcagtcagtaaag

SEQ ID NO: 15297 - DNA, 418 bp, Zea mays
  unsure (1)..(418): unsure at all n locations; Clone ID: LIB3279-224-Q6-K6-D2
cccacgcgtccggcagcacccatcactggaaaagaagttagaacaggtttggaaggacctgggctttctgtttctcaaaagatattttattgtattagctntgttggtggccaatatgtatggtcacgattacaatctttttctgctttccgtcgatggggcgattctgaacagagaccactagctcgccgtgcctgggccttgatgccgaatgcttgagttttttattagggtggttcattctttaacccattattggttctttattggggaagggtccaaaccggtgttgaaaggattcttaaagccagaattggttattggagcccccaccttgattgaactggtaattttgagttccttaattcgcagcttgtcttgaatgagttttcggaaatggtgcttttgcttctttccc

SEQ ID NO: 15298 - DNA, 387 bp, Zea mays
  unsure (1)..(387): unsure at all n locations; Clone ID: LIB3279-224-Q6-K6-D5
atttcttaggtttcggcgcctcagtgggacgaaactcactggctccctctcctcccccagtccgcggcgctcgcttccgttcacctcggccccgcggcgaccccttcgaggggcgacgaggacganntgctgcggcttcttcccgctttcctccccctccgcctgcaggagggggttttgatctaaaaagaatctctttggagtgggtcattgacatttcaacaagctggtttcaattgcagcaacaaatcttgatgggaacttggctggccaaaaggttggaaggtattccgtggtcaaaggaaagggttgactttctattcattctattctggccaagttcaacaaattaaaattccgaagatcttgagtgaaccaaaatggatc

SEQ ID NO: 15299 - DNA, 317 bp, Zea mays
  Clone ID: LIB3279-224-Q6-K6-D6
gcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttctgttttatcattgtctctgtttctgtaagctagcaagtgatgctgtgatgcttttattaagattctgatgagtggtgacgttaagagaaaattggcagtactgtgttgtacccc

SEQ ID NO: 15300 - DNA, 584 bp, Zea mays
  Clone ID: LIB3279-224-Q6-K6-D7
cggacgcgtgggtcagataggtgttagtatgtgtattgtcactacaggaaacgcctaaattttcgtgggccaaaaacccacgaaaataagcctaaaccgacgaaaatagagtattttcgtcggcaggccgacgaaaatagccgccgaaaataagttcgacgaaaataggcacctattgtggtgggtaccgacgaaaataacctattttcgtcggctttcccaagggccgacgaaaatcaatggtcggctgactattttcgtcggcccggtgatggccgacgaaaataagtgccagactattttcgtcggccatcaccgggccgacgaaaatagtcagccgaccattgattttcgtcggcccttgggaaagccgacgaaaataggttattttcgtcggtacccacgaaaataggtgcctattttcgtcgaacttattttcggcggctattttcgtcggcctgccgacgaaaatactctattttcgtcggtttaggcttattttcgtgggtttttggcccacgaaaatttaggcgtttcctgtagtgacaatatacatagtaacacctatctgacccacgcgtccg

SEQ ID NO: 15301 - DNA, 162 bp, Zea mays
  Clone ID: LIB3279-224-Q6-K6-D8
cccacgcgttcgcattggatttggaagcttctgcatgggacaccgagcctcgtagacgaagcagaggggaccagagaaaccgaggagcaagaagcagggagccatggcgttcctcctacccaagctcacaacgccgtcctgcaagttgccccccgagccccc

SEQ ID NO: 15302 - DNA, 576 bp, Zea mays
  Clone ID: LIB3279-224-Q6-K6-E1
ggaggccagggtctgaaccttgtaggagctgacacagtcattatacatgatatggattttaacccccagatggatcggcaagctgaggaccgttgccatcgcattggacaacagaaacctgtcactatctataggctagtgacaaaggattcagttgatgaaaacatctatgagattgcaaggcggaagctagtactagacgctgcaattcttcattctggagcagagttggacaatagtaccgatgtaccagagaagacaatgggggagattttggcatctcttctcctggtctgaagttctaaccctggagtttcttgaaggtatacaattctacccgtgggatatcttcaacaatgggtttttggccttcatttaagcttaccattcaccctggttaatgtcttgaatcttgaggtcctaagatgtgcatccatgtatcctttttgctcttgaaacctcccatcttttagtctgccttatccatcttttgttctatgaatggcgtgctataaactgctggatttccgaagtttttttggttctacataatgacataatgtttaaggttactgt

SEQ ID NO: 15303 - DNA, 587 bp, Zea mays
  Clone ID: LIB3279-224-Q6-K6-E10
cggacgcgtgggcgtcggttcacttcgccaggtgaggaaagggttcgtactcatggcgccgccgcagccaaagtcgggcctcttcgttggcataacaagggtcatgtcgtaccaagcgcgagctgcctccccgcccgtgccaccgcaaggggaaataacgaagagggtgtctatgggcaggggcctgatcagagaggttgctgggtttgctccttatgagaagcgtatcactgagcttctgaaggttggcaaggacaagcgtgccctgaagcttgctaagagaaagcttggaactcacaagagggcaaagaagaagagagaggagatggcgggcgtcctcaggaagatgaggtcggctggtacgcacactgacaagaagaaatagagagcatttcaagttcatggagcctgccagagattatgttccagtgtctgattttccatacatgtagaacctaatagacatgtcaaagtattatgtatcgaaccagctcatgggattttgctccttccaatgcatccagggtttatgtatcgaaccagtttatgggatcttgctcctattccaatgcatccatgggtttgtg

SEQ ID NO: 15304 - DNA, 625 bp, Zea mays
  unsure (1)..(625): unsure at all n locations; Clone ID: LIB3279-224-Q6-K6-E11
ccacgcgttcgccacgcgtacgggcacggcgtgcggccggagaggcggcaaccgccgccgtagagaccatggaggacgcgttgggctccagcggtgggtccccacttcagcggcctccgtctcgactcgcgccgcctctccctctccccttcctactccccctccctctccgccaggatagcatagacgctcgtcgccgcgccggggctcgcgttccccaaggcggaggacgggaccaggaagcccttcgtcataggcgtgtgtggaggcaccgcgtcnggcaagacgactgtgtgcgacgcgatcattcagcagcttcacgaccaccgcgtcacgctcgtcaaccaggattcattctaccatgggttaactgaggaacagtctgagcatgtgcaagactataattttgatcatcctgatgcattcgatacagatcgacttttggagtgcatgggaaagctaacaagtggacagtccgtgaatattcctatatacgattttaagaatcacaggcgatgctctgaaaaatttaggaaggtcaatgaatcagatgtcatcattttggaggggatcttggtttttcatgatcagagggttcgtgatttgatggacatgataatttttg

SEQ ID NO: 15305 - DNA, 582 bp, Zea mays
  unsure (1)..(582): unsure at all n locations; Clone ID: LIB3279-224-Q6-K6-E12
cgtcgctggtctctctggtcagttttcgagtgggagagcgcgtgaggactatcaacaccttttccgaggaagaccgcanggattttagacatgttagatatgctgttagtgatgtgctacttatcaactgaagttcttgggggtgactccaccgctaaagccacctttccaccaatctagctcaggcgtgtgggagcctcaacaatgagcagaaccccaagtggcaacctgtagaggctgctctgttctgtatacaagcaattgcgagatcaatctcaattgaagagaaggaaattttaccacaagttatgtcaatgtcttcctgtctctctcaccatgagcagttgctacaaacacagttgttcaaccacttggagcacttttcaaaaatggagttgatgcgtgcaccacactgaattatctatatctaccacactttagttgatattctcaataaaggtatgagtacactctgaggatacacctgcggctgcttctataggctctaagacatatgtgaagactgtaggagaaagttctcagggtccctggatggcctcttccacatataccatattgcaa

SEQ ID NO: 15306 - DNA, 662 bp, Zea mays
  unsure (1)..(662): unsure at all n locations; Clone ID: LIB3279-224-Q6-K6-E2
cgaaaagagggagggagagagagagagagagagagaggagttgcaagttggtgagatggatctgttggagcggaatattaagacggagacgggggagacgcgcaaggaacaggagcgtaaggaggaggtggaggcggaggcgggggagaggaagacccaggagccgccgcagcaaggccagggcctcagcctctcactcgccaacggcagtggcaggtctggaatgttgccgatgtcaaacatgtcagctaatccttcacagcttacaattttctatggcggatcagtatgtgtgtatgactcagtgccaccggaaaaggctcaagcaatcatgcttatagctgcagctgcagcggcagcggcagctaccaaaagcagtgctgcccctactgttaagcctccaatggtgcctgcagccactgttgccccagcagctgtcgtttctcctgtgcttacacggtctccatcactgcagagcacttctgtagcaactgggcaacctcaggttgttgctgaacctagctcgatatgcaaacttcaggctgatctccccattgccaggaggcactctcttcagcgtttncttgagaaacgccgtgacagggtcgtgagcaaagctccatacagcaccgccaagtcgtccgatggcatggagtcaccga

SEQ ID NO: 15307 - DNA, 488 bp, Zea mays
  Clone ID: LIB3279-224-Q6-K6-E3
ggaagcaatgactgggtgcacttagggcaatacatgtgattccttgttcaacttcacacctagttgtggccttggggcaactcctattattttaatgcgttgaccggacaaaacctgcaacaaatgccccattcatagagtgcttaattggatttgaggaataaaaacctttatttgggataaatttttttggaacattttcacattcacttttaaaagcaaatttcggatgccttttaacaaaaacaggaatcctctttttattttttttaaggtcaatcgaacaccttctgtaaattaatataccacctggctttaccaacatttattcccaatcaaaaaactcttcttgtaaacacataaactcttccaaattttcaaattgtctattccagcgtaagtccgccctcttggaaagcactcccagaccagagcatggagcgtccaacaatactttgtcatatttaactgtggtttccttagcatat

SEQ ID NO: 15308 - DNA, 654 bp, Zea mays
  Clone ID: LIB3279-224-Q6-K6-E4
gccacactgcatgtaaaggatgtacggttagatcttcaatctggatttgatcacttgggcaaaggagatggacggccagctttgagtttattccctctggttattgctccttcttccaaagctggaattttattcatgttacggttaagtggtacaaaggatgtggacgacgcagaaaatgcagacagcacgctgaatatcacctacgggatatctggtgacagaaaaactggagcacattctcctatacctgtcaaatctggtgattctgaagaacttgtgttcaagattgcactcagactgaagcgacctgtcctggatccatgtgtagcagttggattccttccattttcaactgactgcctgagggttgggcagttagttaatatgaggtggagggtcgaaaggctgaaaaccccggaggatgcatccatatccattgacgaaatactttatcaggttgaggcaaacccgcagaactggatggttgctgggaggaaatgtggtcacgtatcgttgtcaaatgagcaaggtaagaaccatggtaccagatgtttcaatccatgcctgtggcagagaatgacaacttccaatccaatctgaaacaattttcacatcacactgcactcgctcataggttcaaggatggagatc

SEQ ID NO: 15309 - DNA, 663 bp, Zea mays
  unsure (1)..(663): unsure at all n locations; Clone ID: LIB3279-224-Q6-K6-E5
gtttcctattacttgaagaggaagatcatgggaaagaaacatatcgtggatgctatagcagaggttgatctgtacaagtttcctccctgggatctatgtgacgagtcctctcttcgaagtaaagatcttgaatggttctttttttgtcctcgtgacaagaagtatcctaacgggtctaggacaaatcgtgccacaccaaatggttactggaagactagtggaaaggatagaataattatgcttaactcccgcaccgttgggatgaagaaaacattgatatttcatgaaggcaaggcccctaagggcgacagaactgattgggtgatgtatgaatacagaatggaagatgaggatttggtttctgctggtttctcaaaggatgcttatgtactctgcaaaattttcaagaaaagtggccttggtccaagaatcggagagcaatatggggctccatttaatgaagacgaatgggataatgcagaagtcgaaacttctctgtttcctttgacttgttcagaagtgaatccaacagagggacaacgtgctcagcctactgtcctggctggtgctcttctggaacccgaaccacctctacatnattcatcttctacatgtgctggagaggaatcatcatttggtcatgccactgctgangacttaact

SEQ ID NO: 15310 - DNA, 627 bp, Zea mays
  unsure (1)..(627): unsure at all n locations; Clone ID: LIB3279-224-Q6-K6-E6
cggacgcgtgggcgacaccgcgttcagccgctctagaaccctagctccccgccccgcgagatggccactgccgacggcgagccccagcccgtggccaccgaccccgcccaggtccaggctccggcttcggcaccggcaccctaccccttcccggccaagcgcaagcccgaggcggatgcggaagccgacgccaaccttgcgccccctaaaggcgcgcgttccgacgtcgaccaggaggccgccgctatggccgaggctgccagggccagtgctcgcgcggctgacaagggtaagggcaagatggtantccaggaggaagaggaggaggaggaagaccacacccaggagagcagcgaccaccaccagggcggcggcggcggcagcagcagcgatgacaacaagctcgttgaagacccgatggccgaggtagacctcagcaacattctcccctcgcggacccgccgccgcgcccccccgcagaccggggcgtacctcgtcactccggaggaggctgccgcggaggaggacgacgacnacgctgtcgtggttnctgaggaggatgagggagcggagggagaggagagcgattaaggctacctctgcacggactcactangaatgatgaat

SEQ ID NO: 15311 - DNA, 573 bp, Zea mays
  Clone ID: LIB3279-224-Q6-K6-E7
gcaaaacacgcccaaggagcaaatggcaaaccaccataacgtcaatgatccagtctctgatggcaattgcgatggccagggtaacattgattcgaaaatgatcgatcttaatatgcgcccggctcgtactcatgggcaaggatcaaattcccagactcagggggtggatcttagtgtgaacaaccatgactctccaggggtggtgccaacaagtaattccgaaagagacgccatcaagtaaacattggaagattggaatgtacatttcaactacatattctgttctataggagctcctgggggcagaaatggggttattcagtggtctctctgttatcactagtaagcgtatttctggcagagttggagctaataactgcatctcaattcggcttgtcgtgccctagacggtattgctgtccaattgcattctctttgcgattgttagaactctgtatagaagcgcagcggctgccgcctgtgctctggagccggagtattgtgtgccattagaaactgtacaaaagattaatagaccgctcatttttctctggtcgcacaagttcaattcag

SEQ ID NO: 15312 - DNA, 650 bp, Zea mays
  unsure (1)..(650): unsure at all n locations; Clone ID: LIB3279-224-Q6-K6-E8
cggacgcgtgggcggacgcgtgggggcgagacgaggagaggactggaccatggctgcctcttcggctctcaggctaatcctgggctcctcgtcggcgtcgcgtcgccagattctgtccgagatgggatacaaattcacgcttcttgttgtttttttttgcgccctatcgtttgagatgggggctttagtaatttcttctcccgcacctttcagttcattcattttcttttttctccgggggctttagagtgcggatatcgatgagaaagcgatcagaaaggagaacccagaggaactggtggtcgccttggctcatgcgaaagcagacgctattctggagaagatgcagaacaatgggatgatgaaagagattcttgattctcaagatactactctgatgataactgctgaccaggttgtgttgcatgatggagtgattagagaaaaacctagcacaccagaagaggcacggaaattcatcaaagggtactctgaaagccatgctgcgacgattggatctgtgcttgttacaaatgtgaagactggagctagaagggaaggatgggataaagcagaagtttatttccacanaattcctgacgaagttgtggagagtttgatcgaggagggcgatgtgttctatgtcgctg

SEQ ID NO: 15313 - DNA, 628 bp, Zea mays
  unsure (1)..(628): unsure at all n locations; Clone ID: LIB3279-224-Q6-K6-E9
cggacgcgtgggctgtcccattgttctgcgtgcgccccgtcgtgtcctccttgatccttcttcgagtggcaagtgctgacctcgcctcctattcctccggtagccctactggagcgccgggcgcacagatctgcccacccctggacgctaggcgctgcccaactctttcctgccaggcggggggggggggtgccaaccagcacgggagggctggtggtgcctgctcttgtcctccggcacaacgcaaggtggcggggtcgctcccaactgggcattctcttgggccccttgttgcacaacgaggcaatggtcaagggtaaacagtcgggaccctcagatgattctatttgctgaaggaggtgaaattgtcaaaacatatttggtgaataccccctttcctctcacgctccaccactgatcatggggctactcagcattattcgcaagatcaagcgcaaggagaaggagatgcgcatcctcatggttggcctggacaactcggggaagacaaccatcgttctcaagatcaatggggaggacaccagcgtcattagcccaacccttggattcaacatcaagaccatcaagtaccacaaatactctntgaacatatgggatgttggaggac

SEQ ID NO: 15314 - DNA, 608 bp, Zea mays
  Clone ID: LIB3279-224-Q6-K6-F1
ctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagctgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccacaaaggatgctggggtgattgctggccttaatgtgctgcgtatcatcaacgagccaacagctgcagcta

SEQ ID NO: 15315 - DNA, 328 bp, Zea mays
  unsure (1)..(328): unsure at all n locations; Clone ID: LIB3279-224-Q6-K6-F10
attccttgctcccttttcccttccccagtggtggagaccctagccccgcctcgccgcngcacgccggatcggtcggcgccatgtccaaggccagggtctacgccgacgtcaacgtgctgcgccccaaggagtactgggattacgaggcgctcaccgttcaatggggtgagcaggatgaggtgtggaagttgtcaggaaggtcgggagaggaaaatacagtgaagtatttgaaggtattaatgttaacaataatgagaaatgcatcatcaagatcctcaagcctgtgaagaaaaagaagatcaaaagagaaattaaaattcttcagaat

SEQ ID NO: 15316 - DNA, 518 bp, Zea mays
  unsure (1)..(518): unsure at all n locations; Clone ID: LIB3279-224-Q6-K6-F11
gtttgctctagggtttttgccacgcgggcggcgctgctgccccttcaccccaccgatataccaagatgacggcgcatgctgcggaggagctcgccgcccanatcgagcagcagaagctcgaggagcataagaccgaagcataagaggttgtggtggaggaggatgaccaggatgatgaggaggaggatgatgatgacaaggatgatgatgaactggatggacaagaaggggatgggagtggcaagtcgaagcacagcaggagtgagaagaagagccgcaaggccatgctgaagcttggcatgaagcccatcactggtgtgagccgggtcactgtgaagaaaagcaagaatatgctttttgtcatctcgaaggcagatgtgttcaagagcccaaactctgacacctatgtcatattcggcgaggcgaagatcgaggacctcagctcccacctgcagacccaaactgcagagcagatcaaggctcctgacctgagccaaatgatccagaagcctgagaca

SEQ ID NO: 15317 - DNA, 630 bp, Zea mays
  unsure (1)..(630): unsure at all n locations; Clone ID: LIB3279-224-Q6-K6-F12
tccatttctgcagattctgatgctgcaggtgtggtgggaactctttctactggcaaagatgaaccnagtaaatgttgaccctttctgttgatgaaaccaaagtcagcacaatgaacagtcgttccagagttgctgtttttaaggatactgaaaaggatcgtagtgacccagactacgatgtagactgcaaaaggtatgttaggagctcagtgcctggcttcaacttgagcccaggtgtttttaactttgttgtgcctcagtttatgcagtatgacattggttatgtgcaatctcctggcatgtccacaaaccagcatactatgtactttggccagcctgatctaacaatagggtcttctggagctgctgtttatcgacattggccaaccccaacaatgatgtatccccattgctatgataatgttagtccaatgatgtctcaggtgagcataatcatataaggtcccgtttgtttccttttatttcgagaaattgaaatcttactaatggaataagctatttttttagaatgtgatattccaccacttttcaaagttatcatataaggctatctcaaattcatggggcgagagatgaaaattgattatacagatttacatgctatttttc

SEQ ID NO: 15318 - DNA, 563 bp, Zea mays
  Clone ID: LIB3279-224-Q6-K6-F2
gagcattgatgcggacaaagtaagcagcaatcgcaggaaccctaacgcctccgaacccgcaggaatgggtatcgacctcgtagccggtgggaggaataagaagaccaagcgcactgcgcccaaatctgacgatgtctacctcaagctcctcgtcaagctctaccgcttcttggtcaggaggaccaagagccatttcaacgctgtcattctcaagaggcttttcatgagtaaaaccaaccgaccaccaatttccatgcgccgccttgtcaagtttatggaaggaaaggagaaaaacattgctgtcattgttggcacagacacagatgacaaaaggatccacgaggttccagcaatgaaggttactgccctgaggttcacggagacagcaagggccaggattgtcaatgctggtggcgagtgcctcacatttgaccagcttgatcttcgtgctccacttggcgagaacacggtcctcttgatgggccccaagattgcccgtgaggcactgaggcactatggcaaggctgctggagtgccgcacagccacaccaagccgtatgtgc

SEQ ID NO: 15319 - DNA, 633 bp, Zea mays
  Clone ID: LIB3279-224-Q6-K6-F3
cggacgcgtgggttgagagctcgggcaccagatctgaagccctcttgttctgtggttgtgtgcctttcggctggtgtagcattgagaggaggcgctgttccagttccagttccaggatgagcaaggaggatgtgctcaaggtgcaggtgggtgtgcgcgccatttgctggcctccctcttctcaactcagccacccttcgtttttcccctccaggcaggcaggcaggcagctttgcttgtgtttgcagcaagtgttccccttgccgcgcctcctctgcagctgccctgccaatgtttgttgctgttcccttcaaatccctcctcttctgttgtttcagactttgatgctgagagtgaacatacactgtgacgggtgcgagaagaaggtcaagaagaccctccacaagatcgacggtacaaggacgaaccaccgatgccttctttttttttttctttgtacgtcagaccgtttggtttgctctgcatgcggaaacgtgatggaggttgaccttgccactgtaggtgtctaccagagcagcatcgacgcggaacaggggaaggtggacggtgtccggcctgctggatccggacaccatcatcaggaagctcaacaaggcccgcaagccggcccaa

SEQ ID NO: 15320 - DNA, 369 bp, Zea mays
  unsure (1)..(369): unsure at all n locations; Clone ID: LIB3279-224-Q6-K6-F4
cccacgcgtccggctggaggagagcaaccaggttatatggcagcatgcgtgggagcaaagcgagcggcattctgaagtgcagccgcagcagctcaatggcaataacttcttccatcccctcgatggtgctggtgaacccacccttcagatagggtatggtcctcatatattttccgtgaatctcgtcttcctaccctaaatattgtgtgatactatttcgatgcctagctagcaggcttgggaagatgcatgaacatccaaatagtttttatcatatagaaatgatcttcaaactaaatggtgttttcttttaactagattaattntaccctatgctcgtttgatcgtcctaccaacgtacacgatcat

SEQ ID NO: 15321 - DNA, 634 bp, Zea mays
  Clone ID: LIB3279-224-Q6-K6-F5
gctctccagaaccccgcgcgtcccctcgcatcgtccctctctccgccgactccaaaccctaacccgcgcgcttacctcctcgtcccctcaggccatggcgtcgtcccctacccccaagaaggtgctggtcccgatcgcgaatgggacggagccgatggaggcggtcatcaccatcgacgtgctccggcgcgcgggggccgatgtcgccgtcgcttccgtcgagccgggggcgacgtccgtagctgcctcatggggcatcaagcttaccgccgacgcgctcctcgccgacctcgcggacgatgagttcgatctcatctctctaccgggaatgcctggttcttcgacttttggagagtgcaaagttttggagaaaatggtcaaaaaacatgtagagaagggcaagctttatgctgcaatttgcgctgcaccagcaatgactctaggaacttggggtttgctcaatggcttaaaggcaacatgttatccttcgttcattgataaacttccttcagaggtacatgctgtggaatcaagagtgcagattgatgggaagtgtatgaccagtcgtggaccggggacagccatggagtattctgttattttggttgagcaactatatggaaaggaaaaagct

SEQ ID NO: 15322 - DNA, 253 bp, Zea mays
  Clone ID: LIB3279-224-Q6-K6-F6
ggcgaaagaggcccacgtccaagctagccgcgacatagacgtggatatgtcgggtctgtttgttcccgcgcccgacatcctaactaaaacgacggggatagctcgacatgaaaacaccggattctactcgagatagtaaaagatgtttgctactaattaggagataagtaggaagactgcgatcgatacttgtgcgggaagacgcccatggttgtgtatataaggctaaggaggaccccatctatttttatct

SEQ ID NO: 15323 - DNA, 592 bp, Zea mays
  Clone ID: LIB3279-224-Q6-K6-F7
gggaaaataccctaggctctcgccagtctccggggcggctcaacaccgaccgaacccgtgaaaaattcgttctcctttcgatccgtttggcggggggctcggccggatccgaccggaggggcgccgccgatccatccagtcgcagccgcatctgatttggtgcggattttggcgagataccccgcccctagctccgctgtttcaaggataacaaagatggcgtcgccgcggggcgggttcgatgagcaagatcgccggacggagaagggcaccgaggtgttcgtcggcgggctgccgcggtcggccacggaaagcacgctccgagagatattttcttcatgcggagagattattgacgcgcgcataatgaaagatcagagtggtcactcaaagggatatggttttgtgcggtttgcaaagagggattatgctaatactgccaaaaggcaaaagaatggtattgaggttcaaggaaagaggcttgtggttgagctttcaatggatcaagatacagttttctttggaaatctttgcaaagagtggactttagaagaatttgaagaattgattcacaaggcattcaaagatgttg

SEQ ID NO: 15324 - DNA, 636 bp, Zea mays
  unsure (1)..(636): unsure at all n locations; Clone ID: LIB3279-224-Q6-K6-F8
ccgacgccaacatcctcatcaacaccgggcgcgtgcaggcccaacgctacgcgctctcctaccaggaacccatccccgtcgagcagctcgtccagtccctctgcgacaccaagcaggggtacacccagttcggaggcctccgccccttcggggtctccttcctattcgctgggtgggacgggggccacggcttccagctctacatgagcgacccatccgggaactacggcgggtggaaggccgccgctgttggggccaacagccaggccgcgcagtccatgctcaagcaggactacaaggacggcttgacccgcgaggaggccgtcgccctcgcgcttaaggtcctcagcaagaccatggactccaccagcctgactgccgagaagctggagctggccgaggtgtttctgcagccgggctccggggaggtacagtaccaggtgtgctctcctgaagcgctggggaagctgcttgcaaagtccggcctgacacagncaacacccgaggcataatgctctgttttgctgtggcttgtgatgcctactactgctcttagacatggnttaagcatttgtgcttctgntgtgtgaacttgaatattcgacgattatgtggtctaattttatgttgagcatc

SEQ ID NO: 15325 - DNA, 628 bp, Zea mays
  Clone ID: LIB3279-224-Q6-K6-F9
aaaaactttgtggtgatcaatcagaagggcattgaccctccatctctggacctccttgctagagcggggattattgctcttcgaagagcaaagaggagaaatatggagaggcttgtgctagcatgtggtggtgaagctgtcaattcagttgatgagttgactgaagattgtctaggctgggctggtcttgtctatgagcatgttcttggagaagaaaagtacacatttgtggagaatgtgaaaaatcctcgctcttgtactatactgattaaaggacctaatgaccataccattgcacaaatcaaggatgctgtccgtgatggtctaagatctgttaagaacacagttgaggatgaagcagttgtgctgggtgctggtgcttttgaggttgctgcaaagaagcatcttatcgacaatgtgaagaaaaccgtcaaaggacgagcacaacttggggtggaggcgtttgcggaagctcttcttgttatacccaagactttggctgagaactctggtttagatactcaagatgtgattgtttctctccagaatgagcatgaccgtggattagttgtggggttgaaccatcactctggggatccgattgatccccagatggaaggcatcttcg

SEQ ID NO: 15326 - DNA, 644 bp, Zea mays
  Clone ID: LIB3279-224-Q6-K6-G1
cggacgcgtgggtccgccctttttttttttttttttttctcaaagcagctgtagagcatgtagcttccttcatcgtttcaaaagcattacataagcagcaaaaccagaaataatcctctaggtgaataagcagacacaatacgaccccgcacacgtaccacttattaggacagtgacagtacagtacaaatgataagcaaggggcagatcaagaatcacaacacgtaggagccataaaaaagcatgatagagcgcaggcagaccagaccaaaagcttcttccgaaacagaggaggcgcctcatgcagaagacggcttctccgccttgaggggcttcaccacctcccaggtgaagtcggggtcgtccctcccaaagtgcccgtaggccgccgtcttgaggtagcgcccgttgccgcctttcttgaggtcgaggttgatgatgatcatgccgggcctgaagtcgaagttctccttcacgatcttcaggatctccttgtcggggatcgcgccggtgccgtacgtgtccacgaacacctataggggctcgggcacgccgatggcgtaggagacctggacgatggcgcggcgggcgaggccggcggcgacgatgctcttggcagcctgcctcgcgacgtaggccccgct

SEQ ID NO: 15327 - DNA, 656 bp, Zea mays
  unsure (1)..(656): unsure at all n locations; Clone ID: LIB3279-224-Q6-K6-G10
ttcggtcgaccagcgtcgctttcggtccaccacgaaccactgtgctacggagatacctgccggcctggcctttcgtagctcaaccgaagccaccaccagcagtcccgcacgactagcggaataatatccaccggcgacgggaacgggaggcggcgcggccggagattcgaagcgatggngttcangatgggggcggtgaaggtgcctccgaactcggcctcgctggaggaggcccggcaccgcgtcttcgatttcttcaagcaggcatgccgctctatccccaccgtcatggagatctacaacctcgacgacgttgtcacgccctctcagctccgctcgaccatcgctaaggagatccgtaaaaaccagaacgtcaccaaccccaaggtggttgatatgcttctgttcaacgcgacggaggagctgaacaacatagtcgaacatgcaaagcagcgccatcatgtgattgggcagtatgtgatcggccaagagggcctggtgcatgagctggggtcgaaggatctagggaactctgacttcctgaagaaattctacacaagcaattacttctgatctgtgttgcagatttacaacatctggtatactccgggtggtgctctgaatagacgacactgaggacctatcangaccgattg

SEQ ID NO: 15328 - DNA, 640 bp, Zea mays
  unsure (1)..(640): unsure at all n locations; Clone ID: LIB3279-224-Q6-K6-G11
ggcctgttcccctccatggctggcgcagaggtgctctgaatatgggagtgattactggggtctcctgcttctgtcccatgcatggtaaagttattgcagcaccgacatcagctccttcgtcaaattcacgtgatattgttctcagtgatccgactatacaggatgggagagaacgtaggagacaaaaacggaagcaatcaaatagggaatcagctcgacgctcaagattgcgcaagcaggctgaatgggaggaagtagccaatcgtgcagatttgctaaagcaggaaaatagttcacttaaagaagaattgaaacaacttcaggagaagtgtgatggcttgacctcagaaaatacatctctacatgagaagcttaaagcgcttgaggatgagaaatcaaatggaaattggtacaaggattaaaggctgaaacttctctctttctgactgctgatataatttggtggtaacctgataggacgacaactaaagagattcttcttccagttgtgctgctgtgctgtgttgtctttcttccctcttcgtgctagatgctacagaggtacaactatgtagaaacccccnagntggtgtttgaagcctgngggggcttagcgggtgtgtattggtatagctgttgt

SEQ ID NO: 15329 - DNA, 427 bp, Zea mays
  unsure (1)..(427): unsure at all n locations; Clone ID: LIB3279-224-Q6-K6-G12
gtaggatttctctttaccattgtgtgggtggtgcgttctaaccagtagcttgtatggtatggtgcgtgtgttgtttagttgctgttcactgggcctctcccttgccattctcggttgctttcatgttatcctgtgaatttgtgatctaccaggtaatacagtggataaatgtgtcagtctgctntagcgttctccttggctgtgtgggtcatggagttgccggttacggaggaagaaggatagcttgcaggaaaacggtggcaccagtttcctgtgcgctgccgaggatgcgaagtattcgggggagttttagaaaaatactttggttttgtgaaacaatttggttttagagtgtcttgatgtgtttggacgcaacaaactttgtagttttgaaatttatagtattgctaaattgtaggcttccttc

SEQ ID NO: 15330 - DNA, 648 bp, Zea mays
  Clone ID: LIB3279-224-Q6-K6-G2
cattggcctcgtagaggccattattagtagtgtactttcaacaggacgtgttgaccttcaaaagaagctgtttggtagcattcagttggttggtggtgcagcttctacagctggccttgcacaagtgctggagcaaagggttcgcactaaaatttcagcaaaccaatctattgagaaagttgaggtgttgcaatctaggacttatccattatttgttccatggaaaggtggagtgattttgggcgtccttgatattggtaaggatgcgtggattcatagagaagattggattaaaaatggtgtccacatcgggagtggcagaaaatataaggattcctattttcttcaggcgcaagtaatgtgctactacaacgtataacagtatcttatttccgagctacacacgaagacttgcacttatacaggttgttcgaccgtccaaaccatcctagaatatgattggtggactgcgattaaattgcgtacatgatgcatcagttctatgcatgctcgctgctgtctgttcggaggtcatcaactcgggacctggactaagggccttgtcgttcgctcaacccctatgaaaaagtttggctttctaaagatgtagtagaagtactcatttattccctgccaattgaacatttc

SEQ ID NO: 15331 - DNA, 525 bp, Zea mays
  unsure (1)..(525): unsure at all n locations; Clone ID: LIB3279-224-Q6-K6-G3
ggggaaggaagaggaactggttgaccgttcttcattacagtttgtttttttgcaggattcttaaaagttggacggcgctgctagtattccatgtttcgtgttttcatattggaggacgtctgtagatgtaaaaaatcctcgggcgcttgtgctcggcttgaggaaatatccttgtacggttgtaccctggacccgctatagctggttggttcttcaaattgtgttcctatagaagccaaagttactacacgatcgatatgttctttttgcagaataacaatacttgtctcacatttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaanagggggggccccttttaaaaaacccaattttaacacccgggggttgaaaaaaatattttttttttttgg

SEQ ID NO: 15332 - DNA, 642 bp, Zea mays
  Clone ID: LIB3279-224-Q6-K6-G4
cccacgcgtccgcccacgcgtccgttcagccctcccttccttggcttgggccacgtcgccccttctcctccccacacatccatactgaagcctcaaaatcctccgcttcactcccatcccatgccctcctctcaaccctagtccctccccatcccttactcatggcgctctcttcccacgccaccacagctgctgcggcggcggccgtcggcacctttccccaatccactcgctcctcttcccggcgattccccgcgtcgtctgtctccccccgtcctccgccgcccccgcgctccctacgcctcgaccatgccgtggcgccgtccctctcccccgccaccatgcccgcgcccgacggtctcctcgctgcagccatcgaacacctggagcgcgagccagcatccgtcgcagccgacgaggctccgctcgcggcgctgtccccgcgggagctgcagctggtgctcgtctacttcgcgcaggaggggcgcgacacctactgcgcgctcgaggtctttgactggctccggcgcgccaaccgcgtcgacggggagaccatggagctcatggccgccatcgcctgcggctggatcgagcgcctcgtgggggccggcggggacgtcgccgacgttgctgcgctgctcg

SEQ ID NO: 15333 - DNA, 649 bp, Zea mays
  unsure (1)..(649): unsure at all n locations; Clone ID: LIB3279-224-Q6-K6-G5
cccacgcgtccgggcgccggcctacaaccgttttcgtgctcacacacccaaaccttagtcgcgatcaggccccaaggactcgagatgaagtcgagggcacggtccaccgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgaggtgaacgacgaggacgaggagggtgacgagtgatgtatgacggatgaaactctgtccaagtgtttgcagtcagggaaaaaatctcgtcgttgtcggcctaaccgggttttctcgaaggactttctagatgcagtagattagtgccgtcttctgagtagtttccttgcaagtgtcgtcccgtccctggagtgaggcagnttagtntgtagtttcttcg

SEQ ID NO: 15334 - DNA, 601 bp, Zea mays
  unsure (1)..(601): unsure at all n locations; Clone ID: LIB3279-224-Q6-K6-G6
cacgtctcccagatctaactccccccgactcacgaatcccagagagcctccatggcgacgcaccgccactgcctcccactcctcctcgtggccgccgccctcgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccgccgcgtggtgcgcggcgagcagcangtcgtgtccgggatgaactaccggctctacgtngacgccggcgaccccgccgggcgcaccgtgccctacgtcgccgtcgtgtacgagcaggtctggacccgcacccgccaggtcggctccttcaacccggtgccccgcgccccctgaaaccatacggacacgggtgggccgaagcgaccacgacgatgttctccgtcaattacgtgtcgagccaatcttattattgggtctattattataataaagcttctccctgttcctatggacctatagtaggatactagtatgttgcgagggagcgagt

SEQ ID NO: 15335 - DNA, 646 bp, Zea mays
  unsure (1)..(646): unsure at all n locations; Clone ID: LIB3279-224-Q6-K6-G7
gcaaggtcaaggcctcagcctctcactcgccaacggcagcgacagcggcaggtctggaatgttgccgatgtcgaacccttcagctaatcccacacagcttacaattttctatggtggatcagtatgtgtgtatgactcggtgccaccagaaaaggctcaggcaatcatgcttatagctgcggctgcagcagctgcggcagccaccaaaggcagtgctgccactgcttttaatcctccaatggtacatacagccactgtcgccccagcagcagtcttctctcctgtgcttacacggtctccatcactgcagagcacttctgtagcagctggacaagctcaggttgttgctgaccctagctcaataagcaagcttcaggctgatctccccattgccaggaggcactctctccagcgcttccttgagaaacgtcgtgacagggtcgtgagcaaagctccgtacagccccgccaagtcgttcgatggcatggagtcagcgggaatggagatgactgcggacggcaagcagggcgcaaggcccagtatcttgaaaggttggggagccgcgaagtctgaagtctgaacggtgaaaggctggctgccgctgtgggggaggaaggggcagngacgtgctgntggttntattata

SEQ ID NO: 15336 - DNA, 649 bp, Zea mays
  Clone ID: LIB3279-224-Q6-K6-G8
acgaaacgaattaatccccaatcaacacagcaaggcagcaacaagcaaagcagcgacccgagagatggacgcgaggatgttcgggctggagaccccccgggtggcggcgctgcatcacctgctggacgtgcccgacggcgacaaggcgggcggcggcgccacgcgcacctacgtccgggaggcgcgcgccatggcggccaccccggccgacgtcaaggagctcgcgggagcgtacgcgttcgtggtggacatgccggggctgagcacgggcgacatcagggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacgtggacaaggtcgccgccgtgtgcagggacggcgtgctcacggtgaccgtcgagaagctgcccccgccggagcccaagaagcccaagaccatcgagattaaggtcgcctgaggggagaccgttgtcggagcagtgccagtgagctgggtggcaacctgcgggactctggtgaggaagagcaaatggtagaaagcagtagctgtgcttctgaacattgtgtgtgtttgtttc

SEQ ID NO: 15337 - DNA, 583 bp, Zea mays
  Clone ID: LIB3279-224-Q6-K6-G9
gttccccgcctcaccccgagccagccgtgtcgctagggtttcgccgccgccgccgccgccgccgccgctatgcctcgccgcagctcaggaaggtctgccccacgcccagctccccgtgctgctccagtgaggaacccgccacagccagcacgccaggctcctcctccagctcctgttcgagagggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgacgcttgcagcatccattctaaggctttccaagattgtctcaacaactatggcagcgagatcagcaagtgccagttctacctagacatgctgaacgagtgccgccgtggtggtgtgtctgcctaagctgcttctggggttattcgtggattttctttcggtgatgctatctcattaataagataccgcgaaacttttgtctccacagcttgaagctaaa

SEQ ID NO: 15338 - DNA, 514 bp, Zea mays
  Clone ID: LIB3279-224-Q6-K6-H1
cggacgcgtgggcggacagttgtgagagagaggggaagggatcgagagcgcggcggaggcgatggcgagcggagggaagggactcaacgcgactggggagttcttccggcggagggacgagtggaggaggcaccctatggcggggaaccagctgcgccacgccacacccgggctcggcatcgccatcgtcgccttcgggatctacctcgtcggcgaggccgcctacaaccgcctctaccgcccctccggcgacaaccaccactagatcgccggcaggatccgtgactcggtcaagaagctggagccaactttaccaagcactggtgctgttgatgtttttacagttttgagctcataaggtcagccatgaccatattgtaatctgtgaccaggtagacttgcccactggtccgtccaactattgtcttgggaccctgtgttaatccttgctatatggatctgacagtgctcatgtaattcaagaatcctggactatcttttatgtgcttatttg

SEQ ID NO: 15339 - DNA, 415 bp, Zea mays
  unsure (1)..(415): unsure at all n locations; Clone ID: LIB3279-224-Q6-K6-H10
agagctgaagtgcactttcaaccttgcgtagggctgtgaaaaaacccaaatggtccaatgtcacttctcttggtgttatgacaaggggaacgatcattgaggtanatgtcagtgagcttggtctggtaactcccgctggaaaagttgtttgggggaaatatgctcaagtgcaggcgagcccggagaacgatggctgtatcaatgctgttttgctagtgtagatccatagtgagattttgttgatggtggtgaatcgtcccatttgtatctgctccgatatgctattttttgaccatgtcatggctaatcccagtagtttgttgtgcaccatgggcataatgagcattctgtattctcgctgtgtgctacaaacatatatggagtaatataaattagcagtatttttttttgagct

SEQ ID NO: 15340 - DNA, 589 bp, Zea mays
  unsure (1)..(589): unsure at all n locations; Clone ID: LIB3279-224-Q6-K6-H11
ccgggtcgacacgcgtccccagctctcgtgctgcttactgaggagcctgcgcagccagcacgccaggctcctcctccagctcctgttcgagatggtggtggctccatgtttggaggaattgggtccaccattgctcaaggtatggcgtttggacgggtagtgcatggacacagggctgttgactctgggtagttcccggaccatccagcatgagactcttgccacagaagctcctgctgctgcccctgctgctccagcgatgaatgctgatgcttgcagcttccattctaaggctttccaagattgtctcaacaactatggcagcgagatcagcaagtgccagttctacctagacatgctgaacgagtgccgccgtggtggtgtgtctgtctaagctgcctctgggattattcatggattttctttccggatgggggtatctcattaataaggcaccgtgaaacttcgaccatctccacagcttgaaaccaaacttcctgggattaatttattntgttatcctatggtgttggaacagactttntgtctcttgatcataaatatttaaacgaacctgttattgttgagt

SEQ ID NO: 15341 - DNA, 631 bp, Zea mays
  unsure (1)..(631): unsure at all n locations; Clone ID: LIB3279-224-Q6-K6-H12
ggcggcgttcttgcggcctccgctgcgctctgggtggtgcgcgcttagacgaggagctgcggcggccaagaccaatcgaccatggctacccgtatccagtttgagaacaactgtgaaattggtgttttctccaagctgacaaatgcttactgtctggtacntattggagggtcagagaagttgtcagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttcagcgcattgatgagaggttatctgcccttggcaattgcatagcctgcaatgaccatgttgcacttacgcaccctgaccttgacaaggagactgaggagttcattgcagatgtgcttggggtcgaggtgtttaggcagactattgctggaaatatccttgtggggagttactgcgccttctctacaggggtggtttggttcatcncatacatccgttgaagaccttgacgagctcttcacgcttctncaagttcctcttgtcgcaggaa

SEQ ID NO: 15342 - DNA, 617 bp, Zea mays
  Clone ID: LIB3279-224-Q6-K6-H2
cccacgcgtccgtgccgattgtacgaactggagaatgttagtacaatcatcatgaagattgctggcatttatcgttggaagcatggacgaaaaggaactggtgtatactggttccagcaagctcgtgataaagtttgtcttgatagaattgctcaacagttattcgaacacattgggaagtcagtgacagacgatagttttaagcaatgggaagggctgctcgagctccttggttctgacattggtagtgcaggcggtcttgagttccttcacaggtaccgggatttcaagaggtctctgcaacaagctctagacagaaggtgtggtgaggctgctcgacaaactgtggattttttaatacagcttatgaaaaacccatccacacctcaacgtttctggctaccccttctacatgattcggtggagctacttaatagcaaactcagccctcttatggatgttgctgagacgacattgttgctcaacaagctgcaagagctgtcaatggccaagctgcgccctgatttttccagtaatcacctaccaagccatgcgatgagctctgtgagattggctcttgcatcaaatctggcacgtgccgttcttgaagaccgtag

SEQ ID NO: 15343 - DNA, 667 bp, Zea mays
  unsure (1)..(667): unsure at all n locations; Clone ID: LIB3279-224-Q6-K6-H4
aatggaatgaaagtgaaggagcagtgaagagaacatatcagggatttcgtaagcgatccatgggtgtcgtgcaattcgataccacacggaacaggtttttggccgctggggatgaattcatgattaagatatgggacatggacagcacgggtcttctaactaccattgatgcagatggtggcttaattgcaagtccacggatacgcttcaacaaggaaggaactcttttggctgtctctaccgttgacaatggcatcaagatcttagcaaatgctgatggacttcggttgctgcgcacgctggaaaatcgttcttttgatgcttctcgtaatgcatctgaggctgtaacaaagcctctaataaatcccttgactgctgcggcaaatgcagctgcagcaagcagttcaggagctggtgctccgtcagctgtaactgcaatgaatggggataccagaagtttggttgatgtaaaacctagaatagctgatgagtcactggacaagtcaaaggcgtggaagcttatggagataactgagtcaactcagtgcagatcaattaaactggcagacaacatgagaacgagcaagatctcgagattgatttacacaaattctggtcttgctatcttggctttacttcaagtgctgntcatctactctggaaatgg

SEQ ID NO: 15344 - DNA, 85 bp, Zea mays
  Clone ID: LIB3279-224-Q6-K6-H5
ctggtgctggcggtaaccacttattaccagggatccttgtaatttttcctgttggtttcccaataataatgtgaatatattggtc

SEQ ID NO: 15345 - DNA, 633 bp, Zea mays
  Clone ID: LIB3279-224-Q6-K6-H6
gttgtcttcccctttttttcctcagccacctctctccctcgctagagcaaaaaccttgccacgaatcgccgacactccaacccggaagaggcaacgaggtgactccgcgcctcggtaatgggtgacagccaatactccttctcgcttaccactttcagcccgtcgggaaagcttgtgcagatagagcacgcgctcacggctgtcggatccgggcagacctccctagggatcaaagctgccaacggtgtagtgattgccactgagaagaaactgccttctattttggtggatgaaacatctgtgcaaaagattcaggcactaacaccaaatattggagttgtctatagtgggatgggtccagattttcgtgttctggtgagaaaaagtcgaaagcaggcacagcagtattatcggttgtacaaggagcatatacctgtaacacagcttgtgcgggagactgctgctgtgatgcaggagttcacacagtcaggtggtgtaagaccatttggagtatcgctgttgattgctgggtatgatgacaatggcccacagttgtatcaggttgatccctcaggatcatacttctcctggaaggcatcagccatgggaaaaaatgtgtcaaatgcaaagaca

SEQ ID NO: 15346 - DNA, 645 bp, Zea mays
  unsure (1)..(645): unsure at all n locations; Clone ID: LIB3279-224-Q6-K6-H7
ccagtttccatgcagagcagaaaagagcggctggggagagaagcaatggcgtcggctcctgcgttctgcgtcgcgctgctgctgctgctggcttccgccgctgccgtccaagcggtgccgccccaggccggcacgtcgtccacctgcagcactgacctcctccgcctcctcccctgccgtgcggttcatcgagggcaccgccaccgtgccggcggacacctgttgcgccaacctgggcagcatggtgcacgacgagccgcagtgcctctgccaggctctcagcaaccccagcacggcccccgtcgccgtcaacatgacgcgcgtgatggccatgcctcggctctgccgnctcgacctcccgcccgccaccggcgcctgcgcagttgccggtcttcttccccatggaccatcaccgccgctgccaccgncgccgncgccaccggnggtcactccacacgcaagcgccaactccagtgctccagcgaccctcaccacgccagcgacgccaacgccgacgacaccacgtatgataccgtcaccatcggtgagcagtcagacgccgccgcgatacagcccggggtccaagatgatagctgacggcttctctgtcactcttggtttcgnggcatttgtgtcagtcctagc

SEQ ID NO: 15347 - DNA, 613 bp, Zea mays
  unsure (1)..(613): unsure at all n locations; Clone ID: LIB3279-224-Q6-K6-H8
ttgttgtgcttctcgtttcaccgtgcgccggaggcgcacaactagggcgaccgccgccgacctacggccagctgtgcccatgtcttcgtcgggccctttgctggcgacgggaacccaccacaccggccgccaacctgaggttttgtgggctcagcgctccgagaagattttcttgagtggggcgttgccagatgcgaaagatgttgtgttaaagaccgatcctaagggcctctttaacttctctgctgttgtccatggggaaccttttagcttcactttggagctttttgattcaatactgtcagagggaagtaaaacgaagacaaagatgggcctgcgaaacataatctgctcaatccagaaagaaaagaaaggttggtggaagcgcttgctaaagtcagaggaaaagcatccatacatcaaagttgactggaacaaatggtgcgatgaggatgaagagtctgagttctctggggattcagatggtggctttgatgaggcaaatgaaggagatgaaagtgatgatgatgatgggatgctttatctccccgaccttgaaaagctaaggggcaagtgatctgnctgcttcngtgaagggagtagggntgatgta

SEQ ID NO: 15348 - DNA, 435 bp, Zea mays
  Clone ID: LIB3279-224-Q6-N6-A1
gaatacaaactagccctttcatgatttccacagtacaaacaggctttaggaatttggtccaaaactatttgtattccggagtctgaaactaacagcgcaaacacacattactctgatcatatgtatgttcagagacagcattggtccacagcactacactacgcttcaaattctaaactatttacacggcaaattcgctggcgtcgagtcccaccgaaccatcattcgccatgaactaagagcaggcagatatattccctgaaccgcgcattaaaacctttagccagcacctagcacaacaccggtcaccaaagctcagtttttcacacgtatgagtcaagatagtcgaatccgcggatcatcctgtactgcaacaggctggcataaacgcggtcgcacactccgatgaacagggacttgttgtccgggctcaaa

SEQ ID NO: 15349 - DNA, 261 bp, Zea mays
  Clone ID: LIB3279-224-Q6-N6-A10
tcgcgatctagaacctagggatcagtttgttcattgttttaacaaaccgtgagggttgccctccatatccatgaattgaagacctgtgcttctcgctgaaccgacttataattgctcacaatatccccataactaggttgacttcttagccaaaatgtatgtacagagctcagaactttttgcagaaactgaaagaaaaaaaaaacctacacaatggaagaaaacactcggagagttcttcaacccaacgggttgactcgc

SEQ ID NO: 15350 - DNA, 584 bp, Zea mays
  unsure (1)..(584): unsure at all n locations; Clone ID: LIB3279-224-Q6-N6-A11
gaatcaaggtaaccaaaaaaaaaaactactgcagttacagacatggaacacaaatctcatttctccactacaacagcaacatgtacacactctatttcactgaataatgccctgatgcagccgaagggcgtgctcctgatcctatatgtcaacgctaacgctatcctcctcttgcgcgtaaagcctctccggcagtccttcctccagtgcgtgcgtccgccttcgaattctctgcagcacgccgtccacagcgaggtcgacggcgtcgttcacggcctgcctcagctcgggcgtgctcccgtgccgccggtacaccaccctcggcgccatctccagcgcgcgctgccgcatccgccgcacctcctcctccggcacggcctcgagcgtctcgacgatccggacgccgccgaacaccgcggcctccttgggcatgtgcaccgagaactcgccgtaccgcaccgggggcaggtgccacccgtactgcctccgcgccgcaggtcctcgaagaacacgggcacgcagccggcgaggatggcgtcnaacgtggagcgccgcgtcggcgtcccccccggcggctgcaggcc

SEQ ID NO: 15351 - DNA, 570 bp, Zea mays
  Clone ID: LIB3279-224-Q6-N6-A12
gcacacaaagcagttttctcacatgtaccttgaaccttttgactcaacaatgatgttgcgcctacaaacgaagcaattaaatccatctgtgcctgcctagcctacactacacatgccttccacacctccaaccaactcaggtcactaccagcctgacctgtcttcgacgaagggatcatggatcactcgcgatccgacaccccggtgaacgccatggaggcctgcgtggactcgttcgacagcaagggcgaggagtgcgccatgagggaggacaggaacgtcgaggaggacgtaggcggcgtggccacgttgtcgctcgctttcctcgtgctcctgaccttaaggtccatgaagtcgctgattatggcgggcttgctgaccgtctccggctcgacgtcccactcgcccgtcagcatggcgacgaccctcggcatgtcgggccggtgcctcgtcacgtcctgcgtgcacagcagcccgaccttcaggaacctgcaggcctgcgccacgtccaggtcgccgccgcccaaggacctgtctatgatcctctccagaaaccctgctcgtagtgca

SEQ ID NO: 15352 - DNA, 529 bp, Zea mays
  Clone ID: LIB3279-224-Q6-N6-A2
ttgggctttgtggcgggcttgggcttcgcgggggacttggccttcggtttggcagcggccttgggcttcttcacgccggtcttggtcttcttcggggcggcctttggcttggtggcggacgacagcttgtacgagttcttcaccttggtcagcttgccgccggcgacgagcttcttgagctgaacgttcagaagtttgcggaagttgggcgggagcttgtccttgtgcttgtcttccaagaacttggcaatagcaaagctgctggaccccgtcctctccttgagcgacgcgatcgcctccgataccatctcggcgtacggcggatgggtcgggctggcgcgcttcttcggcgctgtggccttcttggccttggccggcttcgcatcagcagcaggcgccgccggggtgtccgcgggcgcctcaggggccgcatccaccaacggcgcgggagtctcagccacgtcggtcgtcatcacagcaggacttgggcctcgatgaggaaggagagggcgagctcgggtgtggcgat

SEQ ID NO: 15353 - DNA, 574 bp, Zea mays
  Clone ID: LIB3279-224-Q6-N6-A3
ctaaattcttgcattggttgattggttcgattccatggtatggtacaagtggaagtacatgcataacaatataatgagtacattactgcattactacaacgagtgatgacatatatagggaccatgctcgatcactcgtgagcttgcacaaactaatcgaagtctggtccatccttattcagctccagtccagcaaatacagtgtaatccaacacgcacgcctagctcttacaattaatcaaggaacaaagcaaaacactagtataataataatatagcaagcaggaacgtacacaatacttactactaaaataaagcatgatcaacgaactggatgggtgtggacagtggacactgacacgacgatcgacgactcgggcttaggctgccgcctggcgcaggaagaagtcgtcgtccttctccagcctctgcatgggctccggctgcagcgccagctcgacgtcgatgccgccgtcgccgccgcggccggggtacaggtacaccatgccgtcgaacttgttgttcccgccgctgcggacgcgctcgggccgtccgaagccgaagtcgacgtcgt

SEQ ID NO: 15354 - DNA, 522 bp, Zea mays
  Clone ID: LIB3279-224-Q6-N6-A4
caccaaaaatgctccaacataatcttattttcctcgtagctggcacagtatgttatcagttggatagtccttaatttacaccgggggaaaatacacaatcacacccttccgtaaccaggttaggttagtttcgacttgaacatggacaatgccaaggcgatggctgaaagcttattgcatgaaagttaagcatccttcatccgtagctctactagatctacctttggttattatttgggcgaaattttaacccaaacattccttgggcgagcgcccttttttacccgctcatagcattttcctgaaaacttgtattccaatcctgaagctgggttaggggttatattcaaagggcaattctcgttgcactgatctgcaccagcactgacaaatgattgctcatgaatgcccgttgttaaatcaacttgaggatctggcggacaagttggagcatcaatgaaacaaataccctttttatctttgttttcccgacttaccggtaccatttttggccccactgcc

SEQ ID NO: 15355 - DNA, 585 bp, Zea mays
  Clone ID: LIB3279-224-Q6-N6-A5
caacaataaattaaattatatatataaatcctggtttcctaatctcatgtggcgacagtgcagtccattccttcctagacctagaagtcaattgtacaatctttctaaacattggcacaaaggtatatcaatttgagaatcaagcggaacccatcattctaaggtacgtgagcacccacaaagctaaaacccagagtccacagcagaccccgcagcatccaccgccacaagaggcgactgcagagctcttgctatcatcaacaccaacaagaaagcggcattcgcccatagatgggtcaaggtatgttatcatcccaagcccaccaaaatcacaactctttgggtcctgcttctgctgctgatagtagctgttgaaagcatatgaaacattgcctttctccccgatgccatagcatgaacctccgtagtacagagtcgtacaatccgccatgctacacgcaagcttcatgtgatctgaaacactgtcaagatcccgagcagggtttgcgacacaccaacgtgatggaaggtacggaacctctttggcattcttcagtactgaatttcccagcccaagattcaggg

SEQ ID NO: 15356 - DNA, 607 bp, Zea mays
  unsure (1)..(607): unsure at all n locations; Clone ID: LIB3279-224-Q6-N6-A6
tcgcgatctanacagactaaagagctgctgatgctgccatttcaaaaacaattctggtttggttgttggtggaaggcccctgtactgcagcaaagggttacttgaggttccaaaaccttcagcgaatcttgttgggcacctctcctcatatgttaagattggtcaaaagcagcgcgacgagcagaagaaggctgtagcaacctcgcattgttcccagcccaacacgatcgagtacgacttggccttggactggatgcttcttcgggaaaagcaagaccagagcttcagagtacttcacaagaagcacagagaagccaggaaagggttcgcaagcctggtcggcaaaggatccaaggcagagtagcaggccggttccaacctttcagagcttggcgcggtatgactgccgactggcaggaagagagggtcgtgcgcgcagaaggttctctttttgcagtagccatcgagtagttcgttgggtcaattcgtgttaatttctgttaggaaaggaaaaggtgttaataagtgttatgataggaaagaaaagcacgtcagctttgacaggtcagagcagcctaggtaggcatcaatatgttgctgcgactgc

SEQ ID NO: 15357 - DNA, 583 bp, Zea mays
  Clone ID: LIB3279-224-Q6-N6-A7
gcaatgctgaaattgtaaattactaccgggcaaaagtgtatgctcagcgatcaagttctgcagtacacaaaatgctcgtacacgactacgacacgtacatcaccattcaccagagaagagttaatggtacacaaactcgcaacagcagcagcaggtttcaaaaccgggaacgcagatgtcaggacgccgacggctcacacgtccgaagggacacgcctgtacagctcctccttgtccaggcgcggcgtggcgacggcctgcagcggcgtggccatgaaggtgacgagcccgggcgactccatcatgctcacgtcctcgggacaggtcccgctcggcagcgtccacgtgaagtggtgcagcatgtggccgatcatggacgccacgaggttgatcccgagctgcgcgccggggcacacccggcggccggcgccgaacggcagcacgcggaagtcggcgcccttgatgtcgatgttctccccgaggaaccgctccggccggaactcgagcgggctgtcccacacctcggggtcgcgcgccaccgcccacacgttgacgacgacgttggcgcccttggggatgtcgt

SEQ ID NO: 15358 - DNA, 569 bp, Zea mays
  Clone ID: LIB3279-224-Q6-N6-A8
gtccgcacatccttttcttcccatttgggcttgcattggtgtccagcatgattcttttgattaaagcaatacatgtatcttcccaacactaatactatcctttgacaactggttcgatgaggacgataaaacaactcatctgatttcagagagggcaccacgtacggcagatgtcgcgggcaaacaacctgcctgatttcccacacgtcacacatgacactaagatacaccatatgtgccgtatgggctttaggatacagctagcatgtttcttggcagatgccaccttcaagcatatccgtatattcgtgttgtcagtttgcctggttcataaaagaccagctcgaagtcgaagggcacaagtcatgtgccgtgttcccgtcctcgtccttgatccgaagatcagcatgatacttgacaagcaactctgcaatgtcttctctttcacaaacagcagcatagtggagtgccgtttgcccttcattgtccttagcattcagatctgcatttgcatttgcaagaacctcgacagcactaagatggccacgatcaacagcccagtgcaacgg

SEQ ID NO: 15359 - DNA, 593 bp, Zea mays
  Clone ID: LIB3279-224-Q6-N6-A9
gcaaaagacattgtcttcttgctcaaccagtaaccagtagaacaaggcacgaaaatccttaaatatctttcaaaatccaagccaaggcaacaaaatgtgctactactcggtaggaagtgattactatgctgatggcccacaactttcttaaaccttgaacccacggctgttcctcctgccacgagccttctcgaacttccttcccttggagcgcacatatggcttggtgtggctgtgcggcactccaggagccttgccgaagtgcctcaccgcctcacgggcattcttggggcccctcaagaggactgtgttctcgccaagtggagcacggagagcaagctggtcaaatgtgaggcactccccaccagcattgacaatcctggcccttgccgtctcggtgaacctcagggcagtaaccttcattgctggaacctcttggatcctcttgtcatctgtgactgtgccaacaatcacagcaatgttcttctcctttccttccatgaacttgacaaggcggcgcatggagattggtgggcgattggttttgctcatgaagagcctcttgagaatgacagcattgaagttgctcttgg

SEQ ID NO: 15360 - DNA, 541 bp, Zea mays
  Clone ID: LIB3279-224-Q6-N6-B1
gagcccttaaaacctcctttttttttattaacattgcacaggctttggggatttcacgtccctgtgagaaaaacatcttaccagttttcttatatgtgtatacatgcatcttatcatggtttctattctatcaaatcactcaaggcgatattgattacatgtaaataagccaataaaacatggcaatgaaaccaagggtatcaataaccaagagtgaagagccaaagtggccatagagccctactgcaatgcctgtgccatggttgcccgatgagagagttgttgctcatacagggatctgaatatctgatatttcgcatcggggtatttcttcaccttagggtctgaaaacggatttacgaccttccccgctgcattaaaagccttcattgcatcacaaacacccgggaactttttgccagcaacagcgccaaaaacagcggcacccaaaagcactgactcgctctctctaggaagtattataggacatcctgtaatatctgcatgctcttggatatacaaagaattctttgcaagtccc

SEQ ID NO: 15361 - DNA, 351 bp, Zea mays
  Clone ID: LIB3279-224-Q6-N6-B10
gaaaaaaacttttagttattaaaaaactaacattttgtacgtgcatactatatttttctcgttaagcagccaaacaatcattatccaacagaaactgaaatcagtgctgctacctcaaaaaaaatgagcgtccactaaaactctgatccaacgttccatttcatatctgcatatgatatgatctccagccaggatgaggtgagctggggatgtctgctaaagtggcacaattgagcaaggcacgagttttcacaaaacaggcgtgatgttacagttttattcaagctgagctacgctatgatctgaagacgcaaaacgagcattgtgcggacgcgtgggcggacgcgtggg

SEQ ID NO: 15362 - DNA, 580 bp, Zea mays
  Clone ID: LIB3279-224-Q6-N6-B11
acctcacctcatggtaatataacatcttgaacaaccataatacaaaatgaaatgcagttctgtcacgacaacatcgcattcataagcaataccacccatctagtacctagcaagcatcaccacacgaacctcaaactgacgagtactaacagcgatacaaggaatatcatatctgtaccaagcactgcggagaatgacttaggtctcttcctcttcttcctcctcctcctcgtactcctcatcctcggcagtggcgtcctggtactgctgatactcggccaccaggtcgttcatgttactctctgcctcggtgaactccatctcatccataccctcgcctgtgtaccagtgcaagaaagccttcctcctgaacatggccgtgaactgctcgctgacgcggcggaacatctcttggatggaggttgagttgccaacgaatgtggaggacatcttcaggccaattggtggaatgtcacacacactcgacttcacgttgttggggatccactctacgaagtaggaagagttcttgttctgcacgttcagcatctgttcatccacttccttggtgctcatcttc

SEQ ID NO: 15363 - DNA, 495 bp, Zea mays
  Clone ID: LIB3279-224-Q6-N6-B12
aaggggcaaatcaaataataataatgggtaaaccccgagacatgataatctggaacaattccatatcaaacaataacttggaagacagccccttccactgggcacaggcgcaaagctgataatttgttattatctccttgcaagttcaacatcaggcctgcacatttcgcagccaacacaacagtttatctgactgctagttcatcaggtttaaactagtaaccacccctcaaagcaaggacaagatggaggacaaatccaccctcgatgttgtagtcctttgcgggcttgtcatcaacaagctgcttaccaacataaatgaacctttgctgcacgggaggaatgcctttttttttttcaacaccctccttgatcctgtcaatcgagtcagggggttcaatgtcgatctcgatctttttcccagggagagttttgaccttgatcatggttccacccctaagcctgaggaccaaatgaaaagttgactccttttgg

SEQ ID NO: 15364 - DNA, 586 bp, Zea mays
  Clone ID: LIB3279-224-Q6-N6-B2
aagcaactagctggattcaataagcattgttactgttccatcagataacagttgctaccggaggagaccagacacagcagcacctaactacagcaagacacgcgaacatacgagggaagcctgcaagcggaggccacgcagcctaggacgaggtgaacttggtgacggccttggtgccctcggagacggcgtgcttggcgagctccccggggaggacgaggcgcacggaggtctggatctcacgggaggtgatggtgggcttcttgttgtaccgcgcgagcttggcggcctcggcggcgagcttctcgaagatgtcgttgatgaaggagttcatgatggacatggccttagaggagatgccgatgtccgggtgcacctgcttcagcaccttgaagatgtagatcttgtaggtctccacgctcttcttgcccttcttccggcccctctttccctcgccgccctccttgccggcggacttgcctgctgggacacgcttctccgccttgggcttcttcccggccggcgccttctcggcagcgggctcctcctccgccggcttcttcgccgcgggcttcttctcggcctt

SEQ ID NO: 15365 - DNA, 590 bp, Zea mays
  unsure (1)..(590): unsure at all n locations; Clone ID: LIB3279-224-Q6-N6-B3
aatcaagataatttctacttcccttagcttgttaaagaacaaaaggagaggggaagcgtttgtcaatgaacttctggcatcaatgatgccataatcttgctgaatttacctttttttctcgtttgaataagttagagagcatcggaaattctgaggaaacactcgaggcttccaacacaaccgggatcacgccatgaagctcatctcgaactcatcctcgccgaccatcacgaagtgcgagccctgatcgatcaccttcctgccatcctccgtcgcccggctgaagtgcttgcaggggctcacctcgaactccacgtgcgccgtctgcgtcgccctcaggtgcaggctctggaacccgatcagctggctggccggccggccgctgccgtccgtcgcgttgggccagcgcatgaacaccagcaccgagtgcttcccgtccatgggcccgtggttctgcacccgcaccaccgcggggaacttgagccggtcgcacgtctcggacccgatcgcctccacgtngtagctcgccacgccgcccgccgttgcctccaccgccttcaggccggcgacgttgctcgtgggaggcggct

SEQ ID NO: 15366 - DNA, 470 bp, Zea mays
  Clone ID: LIB3279-224-Q6-N6-B4
ctaaaaaaacaaattacacaaaacccaggaagcatcaaacaccccccattggcgccgctgaatgaaaaaaacccaacccacgccccggaaaaacagggccttttaaaacggaaaagggatttggggcaaccaaaaagcctcccctattaaaaccactctggcgtgctttacggggacctgtcaaaaacaaaaagcaaactgaggaggtagcccccggctttaaaagcaaaaccctaacaatttcacacaaaaaaccatccggaaaaacgggcccccaagtcattttcccgaattagggggaaaaatcaaaccaacggcattggggggactaaccaatatccaaacccaacccttgggacggggggtaaaaccatcaattccacctggcccagaatacaggacaaattcagtaaaggggggacggcccctaaggttttcactccaacaccgggctatgaactccccaaggc

SEQ ID NO: 15367 - DNA, 473 bp, Zea mays
  Clone ID: LIB3279-224-Q6-N6-B5
agtaacaactgacagacttcattcagggtgccatgaaaagaaagaacccagctaacgctgaatgatgaaacgcgagaaagaagctgaggaggaggagctccagttcagagcggtgtgcggaagagtatccagcaggctgtagctactcgttttcctgcagcttcagttcagagcggaatgcagaacactatccagcagggtgtagctacttgtcttcctgcaggttggggtggttgggctgtacccgggaaggtgaacggaatctgggaaatgaaatccctgtcgtgctggacctgatggtatacggtcttcaggttccttatgccgtcgctgagattaacagcctgttggtgcattctaaaatcagtattttatggtcggcctacagatatattgccatttgtgggtgcatgcttcagtagttcatctggttctagcgcatgttgggttgtccattatgaagggcattttta

SEQ ID NO: 15368 - DNA, 537 bp, Zea mays
  Clone ID: LIB3279-224-Q6-N6-B6
aaaacaatattatttaccaattggaccaaataacaatgggaggttctgacagtactagtcacgtttgccgctaaagctgggggggtttattccgtagttaccaacaggaattatggatacaagcgggcatattattcctcaccactctcacttttgacaaaaataaatagatcgacggtacaagtctgcgagcatagttcgggaacagcactcctcagtttttgacgggggggacatgccgcaaaagcatttgaatgacatccggggagatgcttgcggcctgctgggggagttgctcgatcttcgccgccgttttttcctcgaaacgcttgacgtttgcaccggagtcgccgctgttttttgcaacctttctttgaaactcagcctccatttgggcacggtattcggctatttcccgctcagcctccttttttgcttgcctgagcctcgctgacttggcagctttagcggcattcacaatttggtgagcctcctgctccgcagccagaaactggtggatcccactttggcgcctgt

SEQ ID NO: 15369 - DNA, 507 bp, Zea mays
  Clone ID: LIB3279-224-Q6-N6-B7
accgtaaaacaaaaataccgtatcacttatggtttgccagtagccgtgataacatggaaccgaccgactatcacgaggtccaaaaaaaaaaccaccacaaagttccagcccaccacatataaagtttaggcggacacacctgaccgaccgaatgacaataactcgtggcagctactggaccaaccagcaactgcagcactctcaagtactgacaacaaaccgcttagaccacctcctcaatcttggggccagggccgcactctgtcagctggggcgacctcatccatgccaacaaagacctccatgtattaacccgctccctgttacatattgtcgatcatggggtagcaacaggctcttcagatacttcatcttggcctggaactccaacaactccttgagctggatggtgtccagccagcttatgggctggtttaaggtgatcttaatattctttttgttataggccggctgtttgaacccaatcttatacttcttgagtcggaa

SEQ ID NO: 15370 - DNA, 353 bp, Zea mays
  Clone ID: LIB3279-224-Q6-N6-B8
tttttttttttttttttttttttttttttttttttttttttttttttttttttttttttttttttttttttttttgggggaaccggttcattcagcaattataacaaattctacattggtgcaaaagcaacccaacccaggcccaaatttgaaaattaaacaggatcgtagcaaccggcgggggccccctaagagggtgtaaacttgggaacccccttggccccttcggataccgcgtgcttggcgagccccccggggaggaccaggcccacccaggtctggatctccccggaggggaaggggggctttttgttgtaacgggcgaacttggcggccccggcggcgaacttctc

SEQ ID NO: 15371 - DNA, 574 bp, Zea mays
  Clone ID: LIB3279-224-Q6-N6-B9
gcaagaacaagtccattgataaatttcagaaatgagcaaacacagtccattgcactgaagccaagacatctagaacattactcctacaggataaggaagccacgaaacgaaagccaccatctacttctagtaacactacaacgacgagcagcacgacgggcgctcaagccctctcgcccctgatgcgccgcgcgagctggatgtccttgggcatgatagtgacgcgcttggcgtggatggcgcaaaggttggtgtcctcgaagagacccaccaggtacgcctcggcggcctcctgcagcgccgcgacggcggaggactggaacctcagatcagtcttgaagtcctgcgcgatctcgcggacgaggcgctggaaggggagcttgcggatgagcagctcagtgctcttctggtacttgcggatctcgcggagcgcgacggtgccggggcggaagcggtggggcttcttcacgccgccggtggccggggccgacttgcgcgcagccttagtggccagctgcttccggggggccttgccgccggtcgacttccttgctgtttgcttcgtgcgggccat

SEQ ID NO: 15372 - DNA, 570 bp, Zea mays
  Clone ID: LIB3279-224-Q6-N6-C10
aaaaaaaaaattttttttagattacgcataaaatttgagtcaacagcactaggttagcacatcggccgtctagcaataggatacaagcatgacaaaattaatgtgactacagagtacagactattggctacacaatacgcttgtttttttttttacatacatgcctagaaacatcctgggttagcagcagggccctggaactgagatgtggcaggcaggaaatcatacaccagcaggggatttcagtgacgaggcatcgtcggctgctacagccacatggacatggccgccagatgactcgcggaaaagtagcagagctatagaccgatcgatcgggtttgtctgcgtctcgatgctccgagggtccatgaacttgcacgaagtttctgcgttctccagttcctttccgtcctcgctaccaccattgctgttcatcgtatttggaaaaacttgtctatgttgcgcacttcgtgccaatcggtataaaccatccctgatgcacaatttggtttgcacatccagctgactaacagcatcctgcagttgttgaaagctgctttcttcgactga

SEQ ID NO: 15373 - DNA, 214 bp, Zea mays
  Clone ID: LIB3279-224-Q6-N6-C11
gcctatacatgtagtcttggtttatgtgataattgtattgcctaccaggggcagttgctagtatcaaatatgcgctactgttaacctgcacacagtttacagttttgtttgtcatccgagcgaaactttctgcagatccgggacttgcatttccttgttccttgaagggatgcccagggtcataccaacagaaacaagggtctccagggacctt

SEQ ID NO: 15374 - DNA, 575 bp, Zea mays
  Clone ID: LIB3279-224-Q6-N6-C12
aaaataaaacagctcatctgatttcccaatcgtcatagcgggcgccacgcacggcacttcacacagggcacaccatatgtcccccataaataaaaaacacattgaccaagtgcggtaccagcttagagtacagctaatgtaaggtagcatgttggttgtcagttcgcccggttcataaaagaccagctcggagggcacaggtcctgtgccgtgttcccatcctcatccttgatctgaaggtcggcatgatgcttcacgagcaattctgcgatgtcttctctttcacaaacagcagcgtagtggagtgccgtttgcccttcgttgtccttggcattcaggtccgcatttgcttttgcaagaacctcaacagcactaagatggccacggtcaacagcccagtgcagcggagttctaccttcagtatctctcatgttgacttccacacccgctgccagaaacttcactatatcctcagttgctccttccctcgctaaaacatggatgtcagcaagttctgaatcatttccttcgtcttcctcgtacatcaaactgctaaacacaggtcccatgggccc

SEQ ID NO: 15375 - DNA, 525 bp, Zea mays
  Clone ID: LIB3279-224-Q6-N6-C3
gcagcctaggccgaggtgaacttggtgacggccttggtgccctcggagacggcgtgcttggcgagctccccgggaaggacgaggcgcacggaggtctggatctcacgggaggtgatggtaggcttcttgttatagcgcgcgagcttggcggcctcagcagcgagcttctcgaagatatcgttaatgaaggagttcatgatggacatggccttggaggagatgccaatgtccgggtgcacctgcttcagcaccttgaagatgtagatcttgtaggtctccacgctcttcttgcccttcttcttgcccctcttgccctcgccgccttccttggcagcggacttgccagcggggacccgcttctccgccttcggcttcttcccggcgggcgccttctcggccgcgggctcctcctccgccggcttcttcgccgcgggtttcttctcggccttgggcgccatcgatgcggggcgagttggggttttggttgcgaaggggggatcggatgggaagaaatgcgaggagatg

SEQ ID NO: 15376 - DNA, 573 bp, Zea mays
  Clone ID: LIB3279-224-Q6-N6-C4
cacacaaaaaaaatgtggatttattcaagcacacggagctgctggcgatcccacgagcgtccgagcccgagccagcagaccttgatagcaagcatacagcagttcgttcaaaactccgagttccatccagagttcgttcaaaaatcgaaaccccgcgctccaccagaagccccaagggagaagaaggatcagcgcatcaggtcgtagcgggacgaggagccaccatcgtacggggacggcggacgcgggagctggagaagctcctgacccgctgcaacggcggcggcgccggcgccgcccagcgcgtcgatagcctggaaccgtgcctgcgcgtgggcatagtcgtggtggctcagggttgcgccgccgccgccgtcctgccacagccctgctggcgaggcctgcgccacggagacggagctggcggcgaggctgctgctcagggcagcgtggtggcgcagctgggccgtcgggtgctggtcggtaccggcaccagcccagctgtttgacagaagagagagagcacgatgaaggtccggttgtggggctccgttctggttggaggcgaccgca

SEQ ID NO: 15377 - DNA, 388 bp, Zea mays
  Clone ID: LIB3279-224-Q6-N6-C5
cgagtagagcatatttgttttcacagatgaaccgtgtgctataattgtgagcagtaacattttacttgctcaaattagccagtacatgcgtatcaactactatacatcgatgtggttcctacaagctgggctctccattgctttgtgattgctcgctctgacacaaaacaccgaaaagcatacgcaccgcaagccttgtgacatctcaagcgacaaacagctgggcctggcacgcaatgaacaagctcatgaattcctccccgtccacggtctccttctcgatcaggagctggtcgagcttgtggaggatgtcgatgtagcgtggtgattatctgccttggtctatagtaggccttctccaccagttccctcacctgggagtccacaa

SEQ ID NO: 15378 - DNA, 569 bp, Zea mays
  Clone ID: LIB3279-224-Q6-N6-C6
aagaacgagcgagagccggtcactgcactcacttgcacttgcacagcaaacaagcgccacatgtggttcgcgagtgctcatgcaagagctcacactcggcgggaattacgcgaacatgttgcgtccaggtgaactggaaggcatcgatgtgtatgtattcttgatgcaagttgtacatgcaatcaagaaatagcaactgtctagagccaaagccaaggattgaaggtttttcttgacctgcccaacgggccatggctcaggcccgtgcaggggccggggccgggacggcggcttctgctggaggcagtgacaccgagcgcagcagctccagggagctcgccaccccaaggaaatgcgacaggatggtgttcgctgaagcctgaactaggaaaacatctaaagccaagacagggctttggccagcagcctgataatagggtactgcagaggttgtgagagcttttgctaccaaagcaccaacagtagcttgcatgccgagaacagcagcgcccatcccaagaatattaaccacgatgccatttttaaggctcttaacaacatcagcacgt

SEQ ID NO: 15379 - DNA, 506 bp, Zea mays
  Clone ID: LIB3279-224-Q6-N6-C7
aaaagctgcaacagccgggcaaacggcagctgcatttctgggctgaatcaaaaacagggaggaaaaactagactatgtccaacggggcgaaaagctgccatgaaacaaggccaccctaaagctcttaacaggggaaaattattttggggcccaaagggctgcagggtttttagcagcaccatatagcactcggggggggttaaagtaactaattcacctggggcccaacctccgggggcactacaggctttggcaatttcctaagccccaacctttgcaggggcttaaggggcttttttgcagctgcctaatatgcagcttctcgtttttgcccccttttcgcccgccttccagcgacatccttggatacaaaccccgatcctgaccccaaaccaaacactgacaccgaccccaaaaacaaggcggttttttttttttttttcggagtcctggatggaccagcagccacatcagtattcactggcctcgcctttttcctgcctccc

SEQ ID NO: 15380 - DNA, 581 bp, Zea mays
  Clone ID: LIB3279-224-Q6-N6-C9
acacgaaaccagcaaattgcatttgaggtcaacaccaaaacattttacaacacttccatttgagcgacgggtacaccggaggagatgagcagacagacggaggcaggcgtgcatcctacagcagatgctcctcagcgatactgaaaagggatactaattacacgagtaaaccaatcagggaggctccaactacctaaatcccagacaaaataatcattagcaaacggaagggggtttctgcttagcgggcccgagaggcagactacaatgcgtggaggagaagagcatcggcagcaagctacaacctcactcgctacccagttttacagacccatcttttataagctttatgctaaggctattgaagcgccctcttgaataatgccgcgacgccttcctccaatctgttccagtcttcatcatcgctacaaattcttcgtagctaattttaccatccttatctgtgtcaacttcttgcaatatgtcattgaccacgtccatggtatcagctcccccgtcctccatcagggcttcctgaagctcctcgggctcaatgaaaccattgccatccttgtcgaaaa

SEQ ID NO: 15381 - DNA, 574 bp, Zea mays
  Clone ID: LIB3279-224-Q6-N6-D1
agatctgcatagacaaaatcggctgtgcatcatacagaatgcgtggcccactatttcttttccttttattaccgggaagaactgaatctacacgcaacattacaatgaccatttctgatacatcactacgagcttgggtacagggcatatgttgccttcaggtagtctatgatttcagcgctttcaaacatctggactcccgtgttaggatcttcgatgtacggcgcctggaaaaacccctttttcttgaaaaattcttgtcgtttggggctgcctcgtgcgcagctgtgtagcagatgtggcaattccaactcgacaagtgtctctcgtactaatttacagaagggagatccctcacatgcccatatctctatgggctgcggtgggacttttgaagcaatgtaggaatttccctttccaatacgaccaagagtagcaagccctgctgtaattgctgtcaacagaccaagtgatagcataattggaacagttccatcgccatatgtatcagctaggaattttatgatgtcatcggattcatacatggcgacccctgtgtttggatctaccatgt

SEQ ID NO: 15382 - DNA, 588 bp, Zea mays
  Clone ID: LIB3279-224-Q6-N6-D11
gctgcgtaaatatattctgaagctccgaagaatcattcatcaaaaatatccacatcacattgcacacctgcaaatagttggcatgcaacagcaggaccccaagcactcgtacacaaccgtaaggagacgcaccacaagcaactccagctgtgatcacttcgctaccgatttctagttacaagagagagaatattattgacagaacttatgaatctacccaaatctctttttcacgggaccctcttttttcccattcaactctttccacagtgcaacctaccggaaataaatggagataagagggatgtcgacatctttcccgttgtcatcctcacaagcaacgacgacatccagatgcttcctgtattctggaatgtctacctttgccacctccttggctacgtctctgatcttcttgctcagtcgatccttgtgccttgtgaacattatgttgtagagcaacgatgtgccgcaggagacactgtacgcactcaggcccttgtcgcttaaccacttcaggagctctgcaactgtgatgtctccctcgatagaccaccgatcccatacggtccacgtcatatctccatg

SEQ ID NO: 15383 - DNA, 290 bp, Zea mays
  Clone ID: LIB3279-224-Q6-N6-D12
ggacagaaactatgaaactagattcggaaaaccacatacgagttcatcagttcttccccgtcaaactacagggcagacacagcagtagacaatctaggtcatccgctgcgcagcctccttggcgagcagcttttcccgggccttggtcttggcctgcgacttggatcccatgatgccacctacccacttattcctggcctaatggaacttgggcggggagttagccttaatggcctccaagatcttgctgaactagagattatgctcgttgcttgccagtgggaaagaca

SEQ ID NO: 15384 - DNA, 581 bp, Zea mays
  Clone ID: LIB3279-224-Q6-N6-D2
aaaaacctaatctcttttcaatacataatcagtgaatcagttgctctttccaataattgttttggcatttttcaatacacgatttttgaaatagacgaatcgaaaagaaacgcatagtgaatccgtgttagttttgtgacggactattcattcgatatacaacaagtcagttatgggctcatggcatccgaactgtccacacttggggcaattacatgtacatacagtgaatgacgcgtatccaaacttgtaaccgtatgaaacaccgaagtgctgattctctgtagaaacgggcgagaattctttaacccaactaggtcgtaaaactaacctgatcctagtctttgaattgcaaccaccgccccgtcacaacgtgtgcatctgtaagaagtcgtagccgaacaacgtgtgcgtaggcaatagtagcaatacctgtgttgacatggaagagcaataaatggaatgctaggactggaccgacatataggacaatctgcttcatcaccagaagaacctcctgacttatctttggagaaggggagaaggaacttctttaccgaagacgagtttaggaggggaag

SEQ ID NO: 15385 - DNA, 580 bp, Zea mays
  Clone ID: LIB3279-224-Q6-N6-D5
gactagaaaatgccttcagtaagcgtgatatagttatacatgcactgaacaaacacaatggttcatcgtgcttcatctagccttaagttccagaaatctaatgcggtcggcagacagtgttctaagagattgttcaagcacacatactttgcagcagcaacttgtactggtgcccaaaggcctccatcgtctagccgctaaaagggagcttcacctctcccattcggaatccgggtgtggacgctctaccgtgggcctgctgctagctggaggagctggagctggatggtgattggttaaagcctggtcccaacccataatatgtggcaatgcaaaactcagagttgtgcggatcacagcaaactcagcttttgtgatagggactgaaagacgatcattagtcctctctgcactgttcacaacggttatattaacaaagtatccactgtcactgccaagtggagtgatcgacagcgattttttcaccgttccttcattacttgatttcatggatgggtcatggaaaaatcacaggattcagcaggcccaagacttatcaggcttccaacttcagtaggtg

SEQ ID NO: 15386 - DNA, 188 bp, Zea mays
  Clone ID: LIB3279-224-Q6-N6-D6
ggggaaaaaaaaaaaattggcaatttttttttaagggcaccacttaaaaaaattttaaaaaaagcgtaaaaagatttcttgtttgtttaaaaaaaaagaaacactgtaaaaaaaaaaaaaaggttttaaaccctaaactttcaagacaaaaggcggacaaacccgaatcttaaaaaacaaatttgggg

SEQ ID NO: 15387 - DNA, 502 bp, Zea mays
  Clone ID: LIB3279-224-Q6-N6-D7
gaccaaacacagcaatgtatatgtatagtgatagcaaaatacagccttatttgaatgattgatgaattgcagggttcagcgtcacatgctcatggatcggagggtggtgtcaacgtccaagacttcctcgtccatggtgctggagggagtggccaccttcctggtggcggaggagggagtggccaaaactcccacagcccgccggagtgatcagtgaggagtgagtagtgagtagtgagtagcttatggacttatggacagagacttatggactagagttttgtgaattgtgtatttgaatggacaatagacttttggactctagacttatttgaatggactatggactatttatgtatatgtgaatgtgttttgtgaattatgtattaagcttgtgaatctgtatatgtgaattgtgatattgtgtatattgctgtgaattattaataggtgcagaaaaatctgttttggggggaaccatcaattttcgtcggcctcggtg

SEQ ID NO: 15388 - DNA, 588 bp, Zea mays
  Clone ID: LIB3279-224-Q6-N6-D8
aatcaaatatagccatctagtacgtgttttatctaaatttgctgtcctatagctacagtatacaaagagatatcagtataccgtgattcgtgtgcccatatatattgatctatacatttcccctaggaacaaccaagcaactagccctggagctcgttccatcctatgaacaaacagctcaagcttcagcagtttgcatttcaaaaactgcagccacagccgcaaccgaagctgcagccaacagggccaatgccagtggaactatgctcttcccgttccacagcttccaccacggcttcataaagctttgtccatgagcaaccatcgcctgtcacaaccgcattccaaaacgtcaaattggggctcggcgtggcgactaccatgtcagcgatgctgcccactctggctactgatcgtgggaagtccagcgccaagttgtcgactctgtgctcgtagattttcccgttcctgtcgaccttgtacctcgacgtcccgctgaagcagccgtatgactcccatgggacacggggagtgccccacagctcccaccggacaacgatcgagttctctgtcagctgccaaatgcgt

SEQ ID NO: 15389 - DNA, 317 bp, Zea mays
  Clone ID: LIB3279-224-Q6-N6-D9
aataactacgataaaacgtcattatctagctctacttcattagttcagcaacaggtaacagggtgacaggttccttacagaatgagctgttaagggttacattggagttgagggatcagatcagggtgttgtaactcagcatcagttctgtactgtaacacacgaccagttaaggctacatgctaaataaaacactaagggtttttttttttacagcagaaacgaagctaacacgacggtatgcgcctctgccacaacgctggggtggtgtggagggagcggggagtgagttccattccatgcctgctgctctctag

SEQ ID NO: 15390 - DNA, 548 bp, Zea mays
  Clone ID: LIB3279-224-Q6-N6-E1
acagtaaccttaaacattatgtcattatgtagaaccataaacacttcggaaatccagcagtttatagcacgccattcatagaacaaaagaggataaggcagactaaaagatgggaggtttcaagagcaaaaaggatacatggatgcacatcttaggacctcaagattcaagacattaaccagggggaatggtaagcttaaatgaaggccaaaaacccattgttgaagatatcccacgggtagaattgtataccttcaagaaactccagggttagaacttcagaccaggagaagagatgccaaaatctcccccattggcttctctggtacatcggtactattgtccaactctgctccagaatgaagaattgcagcgtctagtactagcttccgccttgcaatctcatagatgttttcatcaactgaatcctttgtcactagcctatagatagtgacaggtttctgttgtccaatgcgatggcaacggtcctcagcttgccgatccatctgggggttaaaatcatatcatgtataatgactgtgtcagct

SEQ ID NO: 15391 - DNA, 551 bp, Zea mays
  Clone ID: LIB3279-224-Q6-N6-E10
cacaaaccatggttgcattggaataggagcaagatcccataaactggttcgatacataaaccctggatgcattggaaggagcaaaatcccatgagctggttcgatacataatactttgacatgtctattaggttctacatgtatggaaaatcagacactggaacataatctctggcaggctccatgaacttgaaatgctctctatttcttcttgtcagtgtgcgtaccagccgacctcatcttcctgaggacgcccgccatctcctctctcttcttctttgccctcttgggagttccaagctttctcttagcaagcttcagggcacgcttgtccttgccaaccttcagaagctcagtgatacgcttctcataaggagcaaacccagcaacctttctgatcaggcccctgaccatagacaccctcttcgttgatttccccttgcggtggcacgggcggggaggcagctcgcgcttggtgacgacatgacccttgttgatgccaacgaagaggcccgactttggctgcggcggcgccatgagtacaaaccctt

SEQ ID NO: 15392 - DNA, 561 bp, Zea mays
  Clone ID: LIB3279-224-Q6-N6-E11
tttttttttttttttttttttttttttttttttttttttttttttttttttttttttttttttttttttttttttttttttttttttttttttttttttttttttttttttttatttataattttttttttttttttttaagaaacggggggggaaaaaaaaaaaaaccccggggggggcccccgggaaagggaaaaagggccgaaaagggggaaaaaaaaaaattaaaaagggggaaaaaaaaaattgggggaaaggggggaaagcccttaaaaaggggggcccaaaaagaaaaaaaaaaaaatttgcccaaaaaaaaaggggggggggaaaaaaaaaaaaaaaaaggggaaaaaaccaccgggggagggttttaaccccaaaaaaaaacctaacccgggggggtttccgggttcccaaaaagaacccaaacccgggtttttggcccacgggaaggggcccttaaaatggggaacctttaaaaaggggaaaaaaaaaaaagaaaaagaacgggctagtgggggccaaaatttaaaaaaaaaattttcaaaggggggggag

SEQ ID NO: 15393 - DNA, 477 bp, Zea mays
  Clone ID: LIB3279-224-Q6-N6-E12
gggaaaaaacgagggccccctcactttacaaaaacaagctgaccggccaacgcaaaaacaggcccatgggaaatcaccattccgggggatctgccagcgtatcacactttggtggggagataaaacaacacaacttatctccctccccaaatacccaatttacgggccatgtccaaaggggaaaccccaaagaattaccaggcttactgacctatctatgctctgaacaaatctgaactggatgcccccccaactcaaacctgtttgaactgagaaaaaaaatcccaaaagacagggagctagccttgcatcaaccccgactcgggggcttttctcaacttgaaactatgcatgaactggctctttaaacttgccttgcagaaacatccagttgtcacatctggtggggaaccactgggaagggcaaatcgggaggccgcaaggcactctgaactagggcttgcactgttttgtttc

SEQ ID NO: 15394 - DNA, 580 bp, Zea mays
  Clone ID: LIB3279-224-Q6-N6-E2
ggaaacaagcaagcaaagccccatcatctttcacactaaacacatgtccacacgtggtactgcattccgttactactagacgatccatgtaacgaagtcagacagacgagaccaccggcgtcacggcgtgatgtacaacagacacagttcggtgtgcggagtaaaggaatccacttcagcataaacctagcacgcgacagcacaaacgacggtaacagaggttccggtccacattattagtgcggttccacgctgccgccgccacataacataaggcaacaacagcgcgtccctgccccttcccacaacgtcagccttcaccgatgggactccgcggggacctttcaagttactgggccttgccctccgctgtcacctcaatcctcggtgactccatgccatcggacgacttggcggtgctgtatggagctttgctcacgaccctgtcacggcgtttctcaaggaaacgctgaagagagtgcctcctggcaatggggagatcagcctgaagtttgcatatcgagctaggttcagcaacaacctgaggttgcccagttgctacagaagtgctctgcagtga

SEQ ID NO: 15395 - DNA, 605 bp, Zea mays
  Clone ID: LIB3279-224-Q6-N6-E3
tcgcgatctagaaggcacttctcatatcactttggtttagttgggagtgacacattttcagttgaggaagttattgataatctgcgctgagttatgaaagacctatttgtaggtcttgtagtgtctgtggttgatccacaacccggggaaacgattgttgattgctgtgctgcacctggtggaaagactcttttcatggcatcacggttgtcaggagaagggaagatatgggctctggacataaacaaaggtcgtttgagaatactcatggacgcagcaaagttacacggtctagatgatatgatcactgacatccatgctgatcttcgactatatgctaaggaaaccacagttaaatatgacaaagtattgttggacgctccatgctctggtctgggagtgctttccaagagggcggacttacgctggaatagacaatttgaaaatttggaagagttgatgtgtttacaagacgagcttcttgattcggcatcaatgttggtaaagccaggtggtatactaatttacagtacgtgttcgattgaccctgaagaaaatgaagagaggattactgcttttgttcagaggcatccggaatttgctct

SEQ ID NO: 15396 - DNA, 504 bp, Zea mays
  Clone ID: LIB3279-224-Q6-N6-E4
ggaacacagcaaatccgggtggcagtttcacggaatacgggggaaccagtttcagggcccatcaggcaaggcagaatgggccactggtcagggcccaacagaattacaagaaacacattccagggaaacatgtctacccacaaaaaacacgtttgggcaaaaacatactagggctcatctatgggaaaaggggagcaaactggcagcccaggaagaatcatatcgctggtatacagaaggatgggctgatggctggaggaaggacacacaccaggggaggccctgctggggtgcagctaaggtttgcctcacccacctccgggagggccagctgggggggggggacgtacccaaacaccaggggcacacatggcaccgggatctccatccttgaacctatgagcgagggcagggggaagggaaaattgtttcaaataggattggaagttgtcattctctgccacaggcatggattgaaacatctgggaccaggggtcttacctt

SEQ ID NO: 15397 - DNA, 576 bp, Zea mays
  Clone ID: LIB3279-224-Q6-N6-E5
agctcacataacgggaggatggaataaacatgataaacgagttccatattacgacattattatggtttgcatattgtcaaaactcaaaacacaagacaatggtaatcaggcaggttgcgatacacacaagtaacagcataatcaaagatttacaggctatgatctcctcagcagagtgagccgagattggccgttagctcaaccagttgggagcatacagcagtcgatgcagattgttccaagcaccgtgcttccaagaaataccagccaaggtcggcttggttcagaagagcaacagacgatttcatgagcccaggcatgacatcaatgacgtccttgacgttcagggtggatagagttgtagcaacagcgagctgcaagttgcaacaccgaagcagtctagacaagttcaagcacaaaaagagcaggtataaacatccgtacctccatgacaaatggtaaccaatcatgagaaagggaactgcatggctgggtccaagtagttggctggatcatctgttgcgaggactccattattgggaggaaaaacatcgaaaatgctagcattgttggctc

SEQ ID NO: 15398 - DNA, 544 bp, Zea mays
  Clone ID: LIB3279-224-Q6-N6-E6
aatagctgctggaagctgcaagtctggagccgcagaggcgaaccgttaactgttcaatcatgatcgttcaccagatactaagccttactacaaagttagaactaaacgtgtgtccctcaagtaacaccctactactgatgccatataaatcatggggacaggcacaactcataatgattgccgaatgaagattaggctatccacgaacaaaacctaacagaaagcacgttcatctactagggtccccaggcacaggatggtacagatacccagcaccaaaagccaccattcatcattcctagggagtccgtgccgaggtagccttaatcgctctcctttccctccgctccctcatcctcctcaggaaccacgtcagcgtcgtcgtcgtcctcctccgcggcagcctcctccggagtgacgaggtaccccccgggctgcgggggggcgcggcggcgggtccccaaggggaggatgttgctgaggtctacctcggccatcgggtcttcaacgagctcgtcgtcatcgctgctgctgccgccgccgc

SEQ ID NO: 15399 - DNA, 284 bp, Zea mays
  Clone ID: LIB3279-224-Q6-N6-E7
aactgaattgaacttgggcgaccagagaaaaagagcggtctattaatcttttgtacagttttctaatggcacacaatactccggctccagagcacaggcggcagccgctgcgcttttatacagagttctaacaatcgcaaagagaatgcaattggacagcaataccgtctagggcacgacaagccgaattgagatgcagttattagctccaactctgccagaaatacgcttactagtgataacagagagaccactgaataaccccatttctgcccccaggagct

SEQ ID NO: 15400 - DNA, 485 bp, Zea mays
  Clone ID: LIB3279-224-Q6-N6-E8
ggggcagggaacccaagggagaattccgttcaaagggggctgaaaaaaagacggccttttttgggggaaaaaaggaaggggtacatgattctaaaactaaattggggccaaactgatttaaccaccgccaggcccccaccaaaaagaattctgcattacagggcaattcaacccaaaggaatggagctatgtctttaaaagggaatccttgaaaaacttttccgggagccccttagggagccccattacactataaattggaccaaaaatggcttccacaaaaggggaaattaaggggggctccaaaaggaaaccaccagggaaaaaaaaaaaattgccctccttaataaaactttccaaaaatttgtaaggaattttggggaaaaaaacatttggtttaacccaaccttcccttttaactccaggcttaaaatttggaacaagcacaaatccaatcgtcgcaaaatgggtttaaaaagaccctt

SEQ ID NO: 15401 - DNA, 454 bp, Zea mays
  Clone ID: LIB3279-224-Q6-N6-E9
cccccaaaaaaaaaaaaaaaaaaaaaaccccccccaaaaccaaagggggggaagggggaaaaaaaattccaaaacccaaaaccaaaaaaaaagggggcctaaaaaaggggtaaaaggggggccccacacttaaagggggcaaaaggggaccggcccaaaaaaaaaaaccccgttgggaaaaaggagcggggaaaaaaaaataggttgggggggaaaacccaaaaagggacgcccggaacaacccagaaaaacccctaaaaaacccccttcccggggaaaggggggaacccaaaaaatttaaaggggggggtttggccaaaaattcaaaaaaaaaaaacctcgaaaatttatttgggtaaaaaaccccccggagggtttggttttttgaaaaaaaaaaaaaaaaaccccaaaagagtttttttttttaaaaaaaaggggggggtacaccggggaa

SEQ ID NO: 15402 - DNA, 586 bp, Zea mays
  unsure (1)..(586): unsure at all n locations; Clone ID: LIB3279-224-Q6-N6-F1
tcgcgatctagnactttttttttttttttttttttaccgtatcacttaaggtttgccagtagccgcgataacatggaaccgaccgactatcacgaggtccaaaaaaaaaaccaccacaaaagtaccagcccaccacaaataaagtttaagcggacacaccgcaccgaccgacgacgataactcgcggcagcgactgggccagccagcaactgcagcacgctcaagactgacaacaaaccgcttagtccacctcctcgatcttggggccagggccgccgctgccagcgggggcgtcctcgtccatgccgccagcgccgcccatgtcttcacccgcgccctggtacatcttggcgatgatggggttgcagaggctctccagctccttcatcttgtcctcgaactcgtccgcctcggcgagctggttggcgtccagccagctgatggccgcgtcgatggcgtcctcgatcttcttcttgtcatcggccggcagcttggacgcaatcttctcgtccttgatcgtgttgcgcatgttgtaggagtagttctccagcgagttcttggcctccaccttcttcttgtgctcctc

SEQ ID NO: 15403 - DNA, 584 bp, Zea mays
  Clone ID: LIB3279-224-Q6-N6-F10
gacaaatatcttaggtgccgtttggttcacatatttataacgtaatgggtaactgataacgttagatcatgtttgttttagtccaaccgtaatcaaataacacactaaaaattgatatcagcctattcaaatttgttaccgccagtaatcgagcgtaaaccattaccattaccatttgtgttacatttcttgaaccaaacagcaccttacatgaacaatcattaatataccatgttcgcaatcacgtcccaaacctcacaactcctcgaggaggttacgttacgtacagtacaggctctaccgctattgtttattttctgccaagtgacccaacggctactcatctcatacaacctgactgactgataaaagagcagatggtcttcgctctttgcctgtcacgctcgcgtcctgctgttctcagcggctctcacttgttggaagtacgggtgcgtcatagcttcaagtgcagtaagcctctcctgatgatcataacgcaaaagcttgtcaaggaaatctatggcctcaggagacactaggtgctggttatctgcgttcataaactttaaccagggtttcctgct

SEQ ID NO: 15404 - DNA, 582 bp, Zea mays
  Clone ID: LIB3279-224-Q6-N6-F11
aggaaagtccggacaaacataggacataaactgttgctatgcagcaagccagcaaaaacgaaacaatgttcaaatagccttgacagaaaagcaagcatgataaaattatctaagcaagcatgttgtccacagatatccgctcaagctgcatggcatacgatacatgcttaaaagaaaggggtggttgacaaaaataacactaagtagtcagctccataatggcggtgacgatgtctccattagaagctttgagggccttgaccgccctgggcctcgaaacagatgcctgagtcatcaccagctcgacatccttggcctcgacaccagtttcgtcaacctcctcctcctcgttgacctccaggcccaggccagatgtctcaggcttcgggatcatttggctcaggtcaggagccttgaactgctctgcagcttgggtctgcagctgggagctgaggtcctcgatcttcgcctcgccgaatatgacataggtgtccgagtttgggctcttgaacacatctggcttcgagatgacaaaaagcatattcttgcttttcttcacagtgacccggctgacaccagtga

SEQ ID NO: 15405 - DNA, 536 bp, Zea mays
  Clone ID: LIB3279-224-Q6-N6-F12
aattaagtccatatatttatatatggaatatatttggatattatcttacatcatatgagagagataggtatatacatttattttatagcgaaacaaatagaagggggggttataaattggccatcggaaaaaagcatggaaatctggataaacaattttcatctctcgccccatgaatttgagatagccttatatgaaaactttgaaaagggggggaatatcacattctaaaaaaatagcttattccattaggaagatttcaatttctcgaaataaaaggaaacaaacgggaccttatatgattatgcccacctgaaacatcattggactaacattatcatagcaagggggatacatctttgggggggggggccaatgtcgataaacagcagctccaaaaaaccctattgttaaatcaggctggccaaagaacataaaatgctggtttggggacatgccaggaaattgcacataaccaatgtcatactgcataaactggggcacaacaaagttaaaaaccctgggctcaagttgaa

SEQ ID NO: 15406 - DNA, 555 bp, Zea mays
  Clone ID: LIB3279-224-Q6-N6-F2
gctcaaccagccacgagtagcaaataaggcagacgacatcagaaatcttccaaaattcaaaccaggacaacaaattgtgctcactaatctcggtacagagtgatgactaattactggccactgatcaaacacaacggttgcactatgctgatggcaacacggagggccacaatttgttttaaaccttgaatccacggctggtcctcctgccacgagccttctcgaacttccttaccttggagcgcacatacggcttggtgtggctgtgcagcactccaggagccttgccaaagagcctcactgcctcacgggcattcttggggcccctcaagaggaccgggttctcgccaagtggagcacgaacagcaagctgggcaaatgtgaggcactcgccaccagcattgacaatcctggcccttgctgtctccgggaacctcagggacacaaccttcattgctggaacctcctggatccttttgtcatctgtgactgtgccaacaatgacagcaatgttcttctcctttccttccataaacttgacaaggcggcgcatgg

SEQ ID NO: 15407 - DNA, 612 bp, Zea mays
  unsure (1)..(612): unsure at all n locations; Clone ID: LIB3279-224-Q6-N6-F3
ggggnacgccggcatgttgccgcccaggaggtgcggcgggagcttcagccccttcatctgcaactgctgctgcagctgctggagctgctgcggcgtcggctgcggcatcaccatcttaggatccttggccccaccacccccgccaccggcaccaccggcacccttgtgaccgccgccacccgcaccgcccttctgggccttgccaccgccggcatccttggaatggcccttgccaccgccggcgtccttaggctggcccttgccgccgccatggccgttctgagggacgccgggcttggagccccacagctgggccggcttgccggccttgttgagcttcctgatgatggtgtccggatccagcaggccggacaccgtcaccttcccctgttccgcgtcgatgctgctctggtagacacctacagtggcaaggtcaacctccatcacgtttccgcatgcagagcaaaccaaacggtctgacgtacaaagaaaaaaaaaaagaggcatcggtggttcgtccttgtaccgtcgatcttgtggagggtcttcttgaccttcttctcgcacccgtcacagtgtatgttcactctcagcatcaaagtctgaaacaac

SEQ ID NO: 15408 - DNA, 580 bp, Zea mays
  Clone ID: LIB3279-224-Q6-N6-F4
gttacaatcttacccagttcattgattattcgagaattaagtggatagtttccatgttcatcacaaatgttacacacatacttgtcatgcaagaaccttgaagtacactccaagcacaacgtatagcacaggcagctgcatgcggccatgcttattaattcggaattgcgcagtagttcgatctcatggcaaccacgggggcaggaaggtggtcatgcatgagctagtcagtgcctctgaaggatacctgcaaacaaattgcacaaatggaggaacgaatcagcttttaaatttcattacaaagagctactctgtgataagaacttgtcatcagtagttcagtactacattggacttgttttgtagttaaagatttaacaatttacaatcacagtgaattctctagtttgtgacatgccatgcatgtgattttgccttttcttccatcaggaaaaaataggacaaggtgtcattttgatgatcgtgtacgttggtaggacgatcaaacgagcatagggtaaaattaatctagttaaaagaaaacaccatttatttgaagatcatttctatatgataaaaa

SEQ ID NO: 15409 - DNA, 573 bp, Zea mays
  Clone ID: LIB3279-224-Q6-N6-F5
gtcttcgcttaatgtttgcctcaaaccttttactgcatatgaaacacattacaagcgttcgtcttatttctatttaaaaggggatttgaagtacattccacaagaaaaagaacatagcatgcctcgatttacacaagtacatactccagaaacctaatacgtacacgtaccatttcaactcaaataaaaaccatggatttggccagctcaagggctctctcccgtccaaagagtttctccactatggcaagcgagaattccatagaagtcccaggaccttggctggtgattaggttaccatcaacaataactctgttgttgcattcgctttggtctgcaagtttgttccacatagcaggataggatgtaactttctttccctttagtaggccatgtggttcaagagcaatcgcaggggaggcacatatagctccatacaatctatttgcctcagcttgcttcttgatcagatccattagtttatcagattttgcatatgcttctgcaccacccagacctccaggtaacagaatgagatcatattgctccttaagagcatcatccaacagcaca

SEQ ID NO: 15410 - DNA, 252 bp, Zea mays
  Clone ID: LIB3279-224-Q6-N6-F6
agataaaaaagatggggtcctccttagccttatatacacaaccatgggcgtcttcccgcacaagtatcgatcgcagtcttcctacttatctcctaattagtagcaaacatcttttactatctcgagtagaatccggtgttttcatgtcgagctatccccgtcgttttagttaggatgtcgggcgcgggaacaaacagacccgacatatccacgtctatgtcgcggctagcttggacgtgggcctctttcgcc

SEQ ID NO: 15411 - DNA, 557 bp, Zea mays
  Clone ID: LIB3279-224-Q6-N6-F7
caccgggtgaatttttaattaatctaccaaaagggtcctcctgaatgttttaccaaacaatacgtagcgttacacaaaaagttagtccgacttttcaatgccgaaatgattagtccgactggatcacacatggtgctcggggtacatgatctgtagcccacaagcaaaatcacagagacacttggcagacaagaagaagagttatccagatctagctttgtttcagggtcttatctggcatatcgctccaactaatctgatcagtacaggcttcctgagcggcgctggttcggatctggcctgatgggctcccctgtgaagggatcaaacttgtaaggttcacccgtgaatggatcaaacctcatttgttggcgttgtgctgaatattcggcgggcgacctgaagcggaaatccgagccgcctgggttcggcatgtaccctgcagcaggcaaaaatctcctttccctaaaaaggagagcttcttcagctggtctttcaatatttgaactatgctcttgtatgtatcttcgatcgagatgcttttcggcgttgtgtct

SEQ ID NO: 15412 - DNA, 582 bp, Zea mays
  Clone ID: LIB3279-224-Q6-N6-F8
gaacattaacgtatctaggatgctcaacataaaattagaccacataatcgtcgaatattcaagttcacacaacagaagcacaaatgcttaaaccatgtctaagagcagtagtaggcatcacaagccacagcaaaacagagcattatgcctcgggtgttggctgtgtcaggccggactttgcaagcagcttccccagcgcttcaggagagcacacctggtactgtacctccccggagcccggctgcagaaacacctcggccagctccagcttctcggcagtcaggctggtggagtccatggtcttgctgaggaccttaagcgcgagggcgacggcctcctcgcgggtcaagccgtccttgtagtcctgcttgagcatggactgcgcggcctggctgttggccccaacagcggcggccttccacccgccgtagttcccggatgggtcgctcatgtagagctggaagccgtggtgcttgtcccacccagcgaataggaaggagaccccgaaggggcggaggcctccgaactgggtgtacccctgcttggtgtcgcagagggactggacgagctgctcgacggggc

SEQ ID NO: 15413 - DNA, 592 bp, Zea mays
  Clone ID: LIB3279-224-Q6-N6-F9
atccatcacatcggattacttgataataacattgttataaacattgcttcttcatgttccatgcagcaagtttggtggcactaacttcgggaaggcaacctcgtctctctagaggctttgtttcctcataggaggatgttaaaaccatcgataaaactaaaatcccatgttaaaatggaagcacgcagtaatcccaaaaaaaaaaagcgaatgcgacctgcttcgtgaaatgggaccaactcaagtcaaacgtatcatccagatcactactaggcacaaaaccaaaacaaaaggtagaacaaataagtctcggctaggtggcgacaaaaatctaagtcggtttcctcatgttgcggcctgccctgatcacttcatccacaagcagcaactgggatgcaatgatgggtccagaattgatgatctggcgcttcacagagtagttgtcgaagatgccttccatctggggatcaatcggatccccagagtgatggttcaaccccacaactaatccacggtcatgctcattctggagagaaacaatcacatcttgagtatctaaaccagagttctcagccaaagtcttgggtataac

SEQ ID NO: 15414 - DNA, 581 bp, Zea mays
  Clone ID: LIB3279-224-Q6-N6-G10
cgactaaacatcaatttgataagtacaacagtaaacaagacaaacagctgacagcagtatcacattgaacagaggattcaagggccaaatagatcaaaacctccggtgcgaaacaatcggtcctgataggtcctcagtgtcgtcttattcagagcaccacccggagtataccagatgttgtaaatctgcaacacagatcagaagtaattgcttgtgtagaatttcttcaggaagtcagagttccctagatccttcgaccccagctcatgcaccaggccctcttggccgatcacatactgcccaatcacatgatggcgctgctttgcatgttcgactatgttgttcagctcctccgtcgcgttgaacagaagcatatcaaccaccttggggttggtgacgttctggtttttacggatctccttagcgatggtcgagcggagctgagagggcgtgacaacgtcgtcgaggttgtagatctccatgacggtggggatagagcggcatgcctgcttgaagaaatcgaagacgcggtgccgggcctcctccagcgaggccgagttcggaggcaccttcactgcccg

SEQ ID NO: 15415 - DNA, 585 bp, Zea mays
  Clone ID: LIB3279-224-Q6-N6-G11
cagtaaaaggctatttgtattcattagtgcagttacagtactatccgtaagattagtccgtctgaatcttaaatcacacgactgctttagcacgcttcagtttctgtcaagaagctcagtgagcagctctacaacagctataccaataccacaccgctaagcccccccaggcttcaaacaccacctgggggtttctacatagttgtacctctgtagcatctagcacgaagagggaagaaagacaacacagcacagcagcacaactggaagaagaatctctttagttgtcgtcctatcaggttaccaccaaattatatcagcagtcagaaagagagaagtttcagcctttaatccttgtaccaatttccatttgatttctcatcctcaagcgctttaagcttctcatgtagagatgtattttctgaggtcaagccatcacacttctcctgaagttgtttcaattcttctttaagtgaactattttcctgctttagcaaatctgcacgattggctacttcctcccattcagcctgcttgcgcaatcttgagcgtcgagctgattccctatttgattgcttccgtttt

SEQ ID NO: 15416 - DNA, 428 bp, Zea mays
  Clone ID: LIB3279-224-Q6-N6-G12
gaaggaagcctacaatttagcaatactataaatttcaaaactacaaagtttgttgcgtccaaacacatcaagacactctaaaaccaaattgtttcacaaaaccaaagtatttttctaaaactcccccgaatacttcgcatcctcggcagcgcacaggaaactggtgccaccgttttcctgcaagctatccttcttcctccgtaaccggcaactccatgacccacacagccaaggagaacgcttacagagcatgacacatttctccactgtattacctggtagatcacaaattcacaggataacatgaaagcaaccgagaatggcaagggagaggcccagtgaacagcaactaaacaacacacgcaccataccatacaagctactggttagaacgaacgcacaaacacaatggtaaagagaaatcctac

SEQ ID NO: 15417 - DNA, 548 bp, Zea mays
  Clone ID: LIB3279-224-Q6-N6-G2
caaacggacgaggatttttcattctttccaaaacagtcgagaatgcacatatacattatcatcattggaaataaatacgaatccaaacatcagatttttcattaacaccatacgaagatttgaaatgttcaattggcagggaataaatgagtacttctactacatctttagaaagccaaactttttcataggggttgagcgaacgacaaggcccttagtccaggtcccgagttgatgacctccgaacagacagcagcgagcatgcatagaactgatgcatcatgtacgcaatttaatcgcagtccaccaatcatattctaggatggtttggacggtcgaacaacctgtataagtgcaagtcttcgtgtgtagctcggaaataagatactgttatacgttgtagtagcacattacttgcgcctgaagaaaaaggaatccttatattttctgccactcccgatgtggacaccatttttaatccaatcttctctatgaatccacgcatccttaccaatatcaaggacgcccaaaatcactccacctttcca

SEQ ID NO: 15418 - DNA, 399 bp, Zea mays
  Clone ID: LIB3279-224-Q6-N6-G3
gggtggggtggggaggggggggaggggggggttttttgggaaaaaagaaaatggggggggggggaaattgggggtttttgggggacccaattggggaaacccccccttttggggggggggggggggcccccccgagggggttttttttttggggggggaaaggggggggggggttttttttttttaagggggccctctcggtggaaaaggggaaaagggggtttctaggggggggcccccttttttaaagagtgcggaaaaaaaaagggtgggaggaaggaggggaaaaagttttttttttttttccgggggggggggggggggcgggggatttttggggggggtttttgggggttaccctttgttcctttgtgggggggggggttggagggggggggg

SEQ ID NO: 15419 - DNA, 578 bp, Zea mays
  Clone ID: LIB3279-224-Q6-N6-G5
aaacgtctattgtgatctgagatttaaaacaggcaccatagatgcttggggcaagtacagactgcaggctaaacatcccaatccaacaacggtcgagtgccgatgaagcgaagaaactacaaactaaactgcctcactccagggacgggacgacacttgcaaggaaactactcagaagacggcactaatctactgcatctagaaagtccttcgagaaaacccggttaggccgacaacgacgagattttttccctgactgcaaacacttggacagagtttcatccgtcatacatcactcgtcaccctcctcgtcctcgtcgttcacctcggacttggacttgtcggaatcaccagacgccgtggggtctccagactgcttgttgttgtaagcgtcgatcttcttggtgtactcagccttgagcttctctgccttagacacgtagggagccttctcggcatcagacagggacttccacttgtcaccaccagccttgccaatcagggagacttgcttcacattggggtgcttctccttgtagtccttcctgaactcctccatgaagacgaagaacgcgctc

SEQ ID NO: 15420 - DNA, 563 bp, Zea mays
  Clone ID: LIB3279-224-Q6-N6-G6
aaaataataataattctgtacaaaagcacaagagtcaaatactagcagaatccattacatcacagaactgtagtgcgcccatatatatagggtactagtactgatacaataacagtacgtagcctctattcggctcatgttcattggcatggcttattctagtcccacgatagcgaaacacacggtctactcgctccctcgcaacatactagtatactactataggtccataggaacagggagaagcattattataataatagaaacaataataagattagctcgacacgtaattgacggagaacatcgtcgtggtcgcttcggcccacccgtgtccgtatggtttcagggggcgcggggcaccgggttgaaggaggcgagctggcgggtgcgggtccagacctgctcgtacacgacggcgacgtagggcacggtgcggccggcggggtcggcggcgtcgacgtagaggcggtagttcatcccggacacgacctgctgctcgccgcgcaccacgcggcggaaccgcagcccgtcggcggccagcttctggtgcttcgcctgcc

SEQ ID NO: 15421 - DNA, 564 bp, Zea mays
  unsure (1)..(564): unsure at all n locations; Clone ID: LIB3279-224-Q6-N6-G8
aacatgtctccttgttaacccttgttaacgaagaacgtgatcggccgcgaagaaaaaaaacaagtgacatttaggtaacaggagagatttattctatggagaaagaaagctcaggacgttctgctttgcatcacaaagctccaaacccagcatggttcaaacgaaaccccagacgacacatcaggtaggatgattgccggtaacaagggaaacaaacacacacaatgttcagaagcacagctactgctttctaccatttgctcttcctcaccagagtcccgcaggttgccacccagctcactggcactgctccgacaacggtctcccctcaggcgaccttaatctcgatggtcttgggcttcttgggctccggcgggggcagcttctcgacggtcaccgtgagcacgccgtccctgcacacgggggcgaccttgtccacgtcggcgttgtccggcagcacgaacttgcgcatgaacttgcccatccgccgctccatgcgcaggtacttggcgtcctcgcgctcctcccggngccgctcgccgctgatcaccagcacccgctcgt

SEQ ID NO: 15422 - DNA, 514 bp, Zea mays
  Clone ID: LIB3279-224-Q6-N6-H1
caaataagcacataaaagatagtccaggattcttgaattacatgagcactgtcagatccatatagcaaggattaacacagggtcccaagacaatagttggacggaccagtgggcaagtctacctggtcacagattacaatatggtcatggctgaccttatgagctcaaaactgtaaaaacatcaacagcaccagtgcttggtaaagttggctccagcttcttgaccgagtcacggatcctgccggcgatctagtggtggttgtcgccggaggggcggtagaggcggttgtaggcggcctcgccgacgaggtagatcccgaaggcgacgatggcgatgccgagcccgggtgtggcgtggcgcagctggttccccgccatagggtgcctcctccactcgtccctccgccggaagaactccccagtcgcgttgagtcccttccctccgctcgccatcgcctccgccgcgctctcgatcccttcccctctctctcacaactgtccgcccacgcgtccg

SEQ ID NO: 15423 - DNA, 420 bp, Zea mays
  Clone ID: LIB3279-224-Q6-N6-H10
agctcaaaaaaaaaactgctaatttatattactccatatatgtttgtagcacacagcgagaatacagaatgctcattatgcccatggtgcacaacaaactactgggattagccatgacatggtcaaaaaatagcatatcggagcagatacaaatgggacgattcaccaccatcaacaaaatctcactatggatctacactagcaaaacagcattgatacagccatcgttctccgggttgtttgtaacttgagcatatttcccccaaacaacttttccagcgggagttaccagaccaagctcactgacatttacctcaatgatcgttccccttgtcataacaccaagagaagtgtacattggaccatttgggtttttcttcacagaaattatgtcaaggttgaaagtgcacttcagctctg

SEQ ID NO: 15424 - DNA, 580 bp, Zea mays
  Clone ID: LIB3279-224-Q6-N6-H11
actccaacataacaggttcgtttaaatatttatgatcaagagacaaaaagtctgttccaacaccataggataacaaaataaattaatcccaggaagtttggtttcaagctgtggagatggtcgaagtttcacggtgccttattaatgagatacccccatccggaaagaaaatccatgaataatcccagaggcagcttagacagacacaccaccacggcggcactcgttcagcatgtctaggtagaactggcacttgctgatctcgctgccatagttgttgagacaatcttggaaagccttagaatggaagctgcaagcatcagcattcatcgctggagcagcaggggcagcagcaggagcttctgtggcaagagtctcatgctggatggtccggggacctaatacagagtcaacagccctgtgtgccatggcactacccgtgccaaacgccataccttgagcaatggtggacccaattcctccaaacatggagccaccaccatctcgaacaggagctggaggaggagcctggcgtgctggctgtggcgggttcctcagtgaagcagcacggggagctggc

SEQ ID NO: 15425 - DNA, 541 bp, Zea mays
  Clone ID: LIB3279-224-Q6-N6-H12
caagaaaacatcctttttttccccaagcttattcatctgccggcgtaacactggagaagccatgtatctgcatatagctgtgggggtgaacaaacaatggaaaacaaacagtagcacgagcttcaacgcagaagtctacaattcagaaaccacggataaaccacgaacatatcagagggttatgttgggctactgataattcgactatagcttgcaatacatcttttagcaaaggcaaactctgacccacatctgctggccccccagttacacgtaactgtctatcagagacttcctcatgtcctccacaatcgcagggggctgcccttctctcagcttgaaaacgctttcaatgactgaaagctcggtggctgtcgtgtccgagccacaaaaggcagtccagtcgttcactgtcatgcctgcagcaatgacctcgcttcctctgttcacagttcctgcgacaagaggaacttggaggagcgtggagagctcgtcaaggtcttcaacggatgtatggggatgaaccaaaccacccctgtta

SEQ ID NO: 15426 - DNA, 491 bp, Zea mays
  Clone ID: LIB3279-224-Q6-N6-H2
gcatgccttcccgacacaaaagccctaaacaagcaagccaaggacaaagggtggtacaggggcaaactttctcaaaccccgacatttgaaatggcagggggccccaagcaaacatgggcacaaaccaccaacaaacgggacggcaaacccccgggcaaaagggggcctggaccacgggcttaaaaaacggccccggccaaatttgatgccaaagccaaactcacaaagcccaacccatggcttgggaggggaaaaccggaaaaaaaaggcccaacttggccattgacaacttttgcagcttggtgaacaaaaaaggcgtctcaacaacaaccaaaaaaaggctgagtttgctattaaaaagccccacccaaacatgtaaaagggggagccaaaaaccttgagggggggagggggttttcaaaaaccggattaaaaaaacccaatttgggaagcagcccaaccacaccttttgtctaaaacttgttgcaaaa

SEQ ID NO: 15427 - DNA, 539 bp, Zea mays
  Clone ID: LIB3279-224-Q6-N6-H4
gaaacaagatctttcactaagtcataaaatgtaggagccaaactgatagttgtctacagcttatctactgataagaactccttttcacagcacagtaaacaaagcaaaatgaaatactagaactatcctcttcactcgatacagtcaatagaaatatatataagcaacggataaactgctgttgagcttgtttttattgagcccattgtccgagtcccttggaaccgatctgccaaggttagttgcaccaccttttgaagcccatcttggttagactcatgccacgaaaaatctaccagttccatcttctcaatcatctttcaggttgatcagaacttgaagctccattaggaggcggtgcggacaagttgctagcagacccattttctaccggtggaggatttccccattttctatctgattccaaaggttccaacacaaaaacaccaccatcagtcagccctagagcaaactgactcgcttccgaagggtgtgccgcaaccacaacaggatgaacactcggactgatatttgggggg

SEQ ID NO: 15428 - DNA, 84 bp, Zea mays
  Clone ID: LIB3279-224-Q6-N6-H5
gaccaatatattcacattattattgggaaaccaacaggaaaaatacaaggatccctggtaataagtggttaccgccagcaccag

SEQ ID NO: 15429 - DNA, 574 bp, Zea mays
  Clone ID: LIB3279-224-Q6-N6-H6
gactgtcaaatacaacatccatcttacgtatctcatttgtctacagtatgcgctcaggagggtttcaaatgtaagaaccacatgtcgctggagcaaatcagtttacagagtgataaaaccaagacatgtcgctggagcaaatcagtttacagagtgataaaaccaagacaagcttcaggctggctgctcataagtgatgctgctattcttgtttgaaacagtaaatcatcaacagacaacttactccacctcttccaaaaaatccttgatctctgatgggcttagaactttgaactcacggtcagctcgaataattccgatttcaatgttgttggaggaaatttgcccctcatatccttctttcaaagtcaaaattgcagtgtggatggcatcatcaagctccatatcctctgtgtatctcttttcaagaaatgtctttgcatttgacacattttttcccatggctgatgccttccaggagaagtatgatcctgagggatcaacctgatacaactgtgggccattgtcatcatacccagcaatcaacagcgatactccaaatggtcttacacca

SEQ ID NO: 15430 - DNA, 602 bp, Zea mays
  unsure (1)..(602): unsure at all n locations; Clone ID: LIB3279-224-Q6-N6-H7
gcnaactgaaacacaaatcttgtagccgaacaagaacaaccgggatggacatacagtattttttcctgggcgggttgtctctctaggaaacaagcgcccatcggaaaagcaactaagtttctctaagccataattctaactgcctgacgaatgccgcccaattcttcagaaagctaggactgacacaaatgccacgaaaccaagagtgacagagaagccgtcagctatcatcttggacccccggctgtatcgcggcggcgtctgactgctcaccgatggtgacggtatcatacgtggtgtcgtcggcgttggcgtcgctggcgtggtgagggtcgctggagcactggagttggcgcttgcgtgtggagtgaccgccggtggcggcggcggcggtggcagcggcggtgatggtccatggggaagaagaccggcaactgcgcaggcgccggtggcgggcgggaggtcgaggcggcagagccgaggcatggccatcacgcgcgtcatgttgacggcgacgggggccgtgctggggttgctgagagcctggcagaggcactgcggctcgtcgtgcaccatgctgcccaggttggcgcaacaggtgt

SEQ ID NO: 15431 - DNA, 534 bp, Zea mays
  Clone ID: LIB3279-224-Q6-N6-H8
agctcatcgctacgttttcagagcgctagctcactgatcaggaaagaccgaaagagggcttcggagatagaagactgcctaaaatctcaagccggcgcagatgctcagcaagtaagaccccaactacgtcgatgataagcctactctggcacgtcaacgggaacttgttacatcaaccctactcccttcaccgaagcagccagatcacttgccccttagcttttcaagggcggggagataaagcatcccatcatcatcatcactttcatctccttcatttgcctcatcaaagccaccatttgaatccccagagaactcaaacttttcatcctcatcgcaccatttgttccagtcaactttgatggatggatgcttttcctctgactttagcaagcgcttccaccaacctttcttttctttctggattgagcaaattatgtttcgcaggcccatctttggcttcgttttacttccctctgacaggattgaatcaaaaagctccaaagtgaagctaaaagggtccccatgggcaac

SEQ ID NO: 15432 - DNA, 515 bp, Zea mays
  Clone ID: LIB3279-224-Q6-N6-H9
aatctcagggcccatattagcgagcggatctgtcacagatgggagcaggaagggaaacaaaaggcaaaacatgtccagactcaacatgaacctggcgacccaaaggcaccccccatccacatttattctcgggatacacaagcagcaaccatccatgagaagcaggggggaaaaacccctactgggtcttgaacatgtggcggatcaggtcgaccacccggttgctgtacccccactcgttgtcgtaccacaagacgagcttgacaaagtggtcgttcaaagcgatcccggccttggcgtcaaaaatgctcgacctgctgtcaccaaggaagtcggtaaaaaccaaatccttttccacataacccatgatacccttgaggggaccctcggaagcagccttaatagctttcttgatatcctcataggaggcccccttttcgattctgacggggagggcaacaaccgagacatccacagtaggaacacggaaggacataccagtgagcttgccattc

SEQ ID NO: 15433 - DNA, 657 bp, Zea mays
  Clone ID: LIB3279-225-Q6-K6-A1
cggacgcgtggggcctcggcggcatgccctcgtttgccttcgtctccgctcggtacgccgcggatgcggaggcggacttcctccgcatctccgcctcgcaggaagaccttctcgcccgcgcccccttcatcaccttcaacccggaggaggaggaggaggaggaggccgaggtgtccagcacgccgcctctcacacaccaggccccgcagaggcagggggaagagggcatcgccatgtgctccatgcccttcacccagcctccctccccttctccggctccctcccctcccttggggagtccgagtcgggagcgtttcccctccctcggagactccgattcggaagcgggtcacttgaaagccgcggaagggggtctgcacgaggaaggtgagaggagccaagctcaggactccgacgccgagctccagcagcccagccccagccccagccccgaagtcgaccctctggccagggccgtgctcgtgacccccaccactccttctgcattcaccagtgatgaggatatcctcgagctcgctcgcagccgcgacatctagagttgcctatgtcacggtgactaagcagccccttctgttctgccaatcaatccatccatccatatgctaataaatatggtgtggttggatttttatgcgt

SEQ ID NO: 15434 - DNA, 629 bp, Zea mays
  Clone ID: LIB3279-225-Q6-K6-A10
tattacactaggtgataagaggatcggcatccgaactagtctactagaggagaaagctacagcatgtaacatgctgtgttgctacgctgatgagctcaaggaaggatttttcccatggattgatcaggtcacgactacgcttgtacctctcattaagttctattttcatgaggaagttaggaaggcagctatttcagcaatgcctgagcttctacgttcagcaaaattggctatagaaaagggccaagctcaaggtcgtgataaatcctatcttaagcaactgtctgattacatagttccagcccttgttgaggccatgcataaagaacctgagccacaaatttgtgcaagcatactggaatcattgaatgaatctatacagctatcaggaacacttcttgatcaaaatcaagtaagatctgcagtggaaggtgtcaaagaagttatagttgcaagcactaacaggaggatagaacgaacagaaagggcaagggctgaggactttgattctgaagaagaggagctactcagagaagaaaacgaacaggaagatgaaatctttgaccaaattggtgattgtctaggcactctcgttaaaaccttcaagacttcttttattccgttcttcg

SEQ ID NO: 15435 - DNA, 338 bp, Zea mays
  Clone ID: LIB3279-225-Q6-K6-A11
ggtccggaaccccgtcgccccgcgtccgggccgccctttttttttttttttacacaaatatgaaaaagacttaacaaggctatagaattttttaaattagagaataacagccgttgttcatacagactcttatttctgggcgtcactaagctcctgtctggggggtggtgccatgcagtcctgctggctgtgccatgttcaaacagtgcggttattactgtgagaattaactggtctttgtcgctggccattgttgggtccctggttcttctgttgctgctgcctttgaggattgcctcttttgcacggtgggatcagtttgctttgcccgtctgtcc

SEQ ID NO: 15436 - DNA, 616 bp, Zea mays
  unsure (1)..(616): unsure at all n locations; Clone ID: LIB3279-225-Q6-K6-A2
atcgtcgccctcaaattcttccgtccaggcaagggaagaaatcgagcagccaaggagaggagaagatggctcgtacgaagcagaccgcccgcaagtccaccggaggcaaggccccgcgcaagcagctcgccaccaaggcggcgaggaagtcggcgccgacgaccggcggcgtgaagaagccccacaggtacaggcccggcaccgtggcgctgcgcgagatccgcaagtaccagaagagcacggagctgctcatccggaagttgcccttccagcgcctggtccgtgagatcgctcaggacttcaagacggatctgcggttccagagccacgccgtcctggccctccaggaagccgccgaggcctacctcgtcggtctgttcgaggacaccaacctctgcgccatccacgccaagcgcgtcaccatcatgcccaaagacatccagctcgcccgccgcatccgcggcgagcgcgcgtaggcgtatctcgcgcccggccccagtggcggcggagggatggaggagtgcaatttgtaactttatgctgtttgttcgcttttagacggcgtggcgaagtagtgtaaaaacggctttacaagtctattntgtgtggtagttcg

SEQ ID NO: 15437 - DNA, 359 bp, Zea mays
  unsure (1)..(359): unsure at all n locations; Clone ID: LIB3279-225-Q6-K6-A3
acccagcgtccttgtaataacacttgtgctccatggctggtgtgatgactttatcccatctgaaccttggggaagagacaacttttgcaatgaccacattgatgaaggacatgtgtgtagtgatgtagaagagccagtaaatcttatcaattaaccgggacaggtctacatgattgatattcagtttggcggggggtcaaaacaagtggttgttcatgctttaaaagaagtggtttggggtcacattcatgcatctggtgtgactgggcagggtagagaggaacctggtccaccggtgggcgtttcnttggtgtttcatgttctttcttgcgggtgtcctgatgctgtggcttctgttt

SEQ ID NO: 15438 - DNA, 654 bp, Zea mays
  Clone ID: LIB3279-225-Q6-K6-A4
gcgcctctcatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaaaagtgtatcaccaaaggattgctaccgagacattcacctggcttgagctggc

SEQ ID NO: 15439 - DNA, 644 bp, Zea mays
  unsure (1)..(644): unsure at all n locations; Clone ID: LIB3279-225-Q6-K6-A5
gtgcttctgtggttatcgtattagcaaatttttggcangatggaaagcatattgtgcctaggctctctcatgatttacccttcatggagggcctctttgacattcttgcactggtctctgatgataaccaagcccggaacgctctctggtgtatcttaccatgtttgctggcacaagcacaacagatcgatatgaactcttcatctctcgagcagtttgtatctctattgcttggcaggttcacacacattaaagatgatcttgaaagccacagagttgacaaaaaagaggagttgacagctgaggacgcttacttgaagcatggggtatccgcatctctcagggcgatctgctgtgtcatggagaggtggatcgtgnagaagtcctccctgggcgaagacgaagacgacgccccaccgactgaaagcaccgttgaagatgctagacatcttctgaactactgccagaattatgacctgtagcttgcttactgcaactttagtggacatagctgacctgtgagtgtgcggttgcaacccgcggctgccttaaccgtagaagtcgtttaaatactaatgttgctgtagaggacaacactgctacngagtactcagttgccatagaggacatatgtcaatttgcaa

SEQ ID NO: 15440 - DNA, 568 bp, Zea mays
  unsure (1)..(568): unsure at all n locations; Clone ID: LIB3279-225-Q6-K6-A6
cccagcgtccggcttgccaagnataggattcctccctcagattcacatggtgcgcaagnaaacccaagcaccacaagaagaaacataggtcccttagaatctcgtggcgcagactttgatgccgagcggcgcctgtactctcatgcgttcaagaagtcctcatcacttctgagccgcttaatgaagcacaagtttgggtgggtgttcaacaagcctgttgatccagtcacacttggtttgcatgattattttactattatcaagcacccaatggatcttggcacaataagggggcggctgagccgtgggcagtacaggaaccctaaggagtttgctgaggatgtccgtcttactttccataatgcgatgacatataatcccaagggtcaggatgtgcatttcatggcggagcagttgttaggaatctttgaggcacagtggcctgagattgaggctgaggttaactacctcgcatcatgtcctccattgccngaaaaagtttcccccgccaccaattgacctgcgcttcctanagaggtcagattcaatgagacaccatgtggcattg

SEQ ID NO: 15441 - DNA, 647 bp, Zea mays
  Clone ID: LIB3279-225-Q6-K6-A7
ggaccagctagctagctcctcccactgctatcacccgggccccggccagccatctcgctgaaagagaaaagcgcagccatgaagactactagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaatccatacgacgggatggtgatgttcagtgccctgctagcagtaggctgcatctgcactgagtgactagaataaaggatttggtgatgtttgtgctgattggtgtgttcgcctgtaatcgtgtgatgccgtcgttggcttcttatatccgtgtctaatctcgcaagtgctcgtgtttgcaactata

SEQ ID NO: 15442 - DNA, 560 bp, Zea mays
  unsure (1)..(560): unsure at all n locations; Clone ID: LIB3279-225-Q6-K6-A9
ccccgcgtccgcngaactgcgccgcttngaagaggctttgcggcgatggaccgggtcggcggcggcggaaaagcaactggaggattgcacagtagccaatgctctaggaacttggttcttctcagttgcgggtgctcttgttgctattcctgtgggcataaagaagaaatccttagccccactcgtcttcttcggcactactggaaccatgctggacattatcatgggcattacccagtgtgagcgagagcatgctgagcgggaaatgaagattttggaagcccagaaattttcggtcgatgcttcagctcagaacgaaagctctgattcctttggcagtgctgacaagtgaaacacttctcctgttttccctcacttgtgacctggcttcacctctgttaattagagttgttgctcagatgccaatttgacacctttaaatttctgaatacactattcctactccctcaataacgtgcaattgtgcatttgatcaaccattagtttttatatatattggngaattgaaaacaaaattaaaagtttcagtcttgctcctc

SEQ ID NO: 15443 - DNA, 652 bp, Zea mays
  Clone ID: LIB3279-225-Q6-K6-B1
cggacgcgtgggggccgccctttttttttttttttataaaacatgccacacacatggtacgcagcccgtgtgctgataagccatgcaatatatatatttgttacaatcccacattacaggttccacttatacttttttttactcgttgctgttttacatcagaatcagacaacactcacgtggcaaacgaggacagaaaatgtaaaaaaaaaactcaccggccatgttcatcccaatcattgccatacaaggcgtcaaaaccaaagttcttcaggacgcagtccccacgaatcacaatggcaacaacctgctgtgctacatatgccagctcgggatggtatcgatatccaaaatcatcagctcaccctgcacatgcgcattcctgggcgactatacggaaagataggtttttgcatcgctggagaagcgctgcaaagtcgcattccagatctcccctgcctccgctgtataaatagaccctcaagctccccctttttttttgtcaactctgcttggcttgcggacatgcagctggatgtcatcactgtcgacaacacgttcgagaaggaggacgagacgagggcgcagctgaagaactgacggaggcgggcgccgacggggtcatgatcgacgtctggtgggggctggtgga

SEQ ID NO: 15444 - DNA, 667 bp, Zea mays
  Clone ID: LIB3279-225-Q6-K6-B10
atttcctggaaaatatcgtgtagaggtgaagaattctttacccgagggcttagctaaggatgattggtgctgggaccagagtatcttgaatatagatgttggtactgatgatgtgagagacattgtgtttgtacaaaaaggctattggattgagctagtttcaactcatgatactaatgcttatattcagcagccagattcttctagacttgatttgttgataaagaaaggatcacaaagaatttgtgttgaaacttcagggcaacatgagattcatttaactaatccttgtatttcctttgggacctcgtctgttttgtttgatacagctaatttaatgccgatccatatcaatgcaaagaagtatcttgtaaaaggtgaaatccatgtggacatgagctccattcaggaaaacattgattccaaggacatagtcgtggatatcttgaagagtgatggcagtttcatagaaaagatatccacatcacttgttcttggaaaggacaatcaaaatgacttcactgcctttgagtactctatttgggctgaccttggggaggacttcatctttgtcccccatgattctagcattggaaaggaacaagtcctattttatccagcaagacagcagtattcagtttctatgaatggatgccaagaactgttc

SEQ ID NO: 15445 - DNA, 418 bp, Zea mays
  Clone ID: LIB3279-225-Q6-K6-B11
gtccattctatagaccttccgtcaaagctagcgaaagacttgtctgagatattcagtactttgggttttcacatagcaaggataacttggactgctgcaggtgcatgtccgctgagtgcttctctgggtggcgcagtcgcgcaggagtccaggcatgactactgctgctaattgtgttgattcttttgccactgatgtccttacatgcgcacataactgtacacagaaatgacaccggtttctaatcttttgcctgttcataagcctgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaggggggccctttgggggggc

SEQ ID NO: 15446 - DNA, 604 bp, Zea mays
  Clone ID: LIB3279-225-Q6-K6-B2
gtccccgcctctcccctcctataccctcgcctccgcaaccgccgcagccgattcttcgcggcctcctcctcctcctcctcgcctcagatggcggcgcctgccgacgccgccggtggctcctctgacgcgttcgaggtgatccgcgttcaccaggcaaaagctgttcgtctttctccagttgaagaaatacggaccattatggaccgaagtgtcagatgtgttcttgctacccattctcaggatcatgctggttatccatctggttcaatggttgattttgcatgtgatcaggatggttaccccatattagcagtgagtagtttagcagtccattcaaagaatctctctggaaatcctaaatgctcacttcttgttgccaaagatcctgaggacagaactgatactgtaatcactgtatatggcgacgctgttcctgtttctgacgaagaaaaagattcagtgagaagtgcttacctacgcaggcaccctgatgctttctgggttgactttggtgacttcagtttcctgcacatcaaacctaaagctgtgcgctatgtatctgggcgtgcaactgctctccttggttctggggaattcaatgttg

SEQ ID NO: 15447 - DNA, 540 bp, Zea mays
  unsure (1)..(540): unsure at all n locations; Clone ID: LIB3279-225-Q6-K6-B3
ngataccattgaaaaactgtctatgactactatgcaaagaaaggaacgatctaaagtattctggtgatttcccctgtataaatacaggggaaggcaaagcgcccaacatattttccaatcgagctatgctcgcttgttccgcttcaaagtacaccaaagctttgtctacgctacaaaggtcatcccttgtggagaagtctagacagaagcctgaagaaaggatgaccgttctaaatgatgcactgcaacgcagtaactacgattctgaccccatgttgagggcatgtggtgtttcagttgctccaaaatttacccaagttgaaggaaggatccttcaagccccaaagctgaaagccggcaatggtgatgatatcttttcacgaaatggacggtggaatttcactaataggaagttttatgaaacctgctctgtgaataagtgggcggtcgttaatttctctgcacgttgtgatgttcggaatcttatccgtgacctgatgaggaatgcatctgcaaagggnaattcaaatggnaggaacc

SEQ ID NO: 15448 - DNA, 660 bp, Zea mays
  Clone ID: LIB3279-225-Q6-K6-B4
gccgccggggcccctccggcttctcctggagttccaccgccgaccaagtcacgcagggcatctccgccgccggcctcaccgccatcgtcactggggcgtccagcggcatcggcgcggagacggcgcgaacgctggcgctgcgcggggcccacgtcatcatggccgtcaggagccttcccgctgcccaggccgtcaaggacgccgtcctcgcccaggcgccgggggccaagctcgacgtcatggagctcgacctctcgtccatggcctctgtccgcgctttcgcgtcccaattcatcgacaggggtctccccctcaacatccttatcaacaatgcaggagtaatggcaataccttttgcgctttcaaaggatggaattgagatgcagtttgcaactaatcatgttgggcatttcctgctcacacaccttctattggataccatgaagaggacctctcatgaatcaaatttggaaggaagaattgtcaacgtgtcatcagaggggcacagacttgcatatcgggaaggaatccgttttgacaagatcaacgatgaatcagtgtatagtagcattggtgcatatgggcaatcaaagcttgcaaacatattgcatgctaatgaacttgccaggcgatttgaggaagaaatgtcaacataactgc

SEQ ID NO: 15449 - DNA, 638 bp, Zea mays
  unsure (1)..(638): unsure at all n locations; Clone ID: LIB3279-225-Q6-K6-B5
ccccgcgtccgcngagcacanatccatcggagtgacagcgagcgagagcgagagagacagagagattgtccgcgcgtcagcgactcccggcgaagacgatggggaaggggttcgcatcctacctggcgatgaagacggggccggagggcggcgacgcggcggcggcgcagcaggctctgatcgacgcggacctgcgggagctcggcgtcgccgcgcggaagctcgccaaccacgcattcgtcctcggcggcgggctggggttcggcacctccttcctcaaatggctggccttcctcgccgcagtgtatctcttgatattggatcgcacaaattggaagaccaacatgctgacagctctcttggttccttacattttcttcaccctgcctaatgtgctgttttctctgatcagaggagaggtggggaaatggattgcgattattgctgttattctgcgtctattctttccacgacacttcccagattggttagagcttcctggttccatcatcctgctcacagtggtcgcccctagcctgttcgcggacagcttcaggggagacctcgttggtgtcttcatatgccttgtgatcggatgctacctgctccaaaacacatcaaggcgtcaggtggattca

SEQ ID NO: 15450 - DNA, 532 bp, Zea mays
  Clone ID: LIB3279-225-Q6-K6-B6
gaaaaacctgcaacatcagcattcacagtgcaatcacaagggagacggctggcagtggcagagtcataaggatgccacttacgccaacatacacgctactgccagtcttccttctcctcgttgcggtggcagtgtgcatcgtggtccggaggtggcgcaaccaggacggcgaccctgcgtatcagaagctagacatgtcagacttgccggtttcggttggaggcaagaaagaacatgacgatcggtctgacaagtgggacgacaactggggagatgactgggacgacgaggaagctccggtgacgccatccaagcctctgcccaacccttcgtccaaaggtctcgccccgaggcgatcggcgaaagatggttggaaagattagttagccacatgacgccacttaaaaggagcattgcggaaatagttccagtgcatgcagtatatttttaccttcatctttgttgttaaatatttctggaggatgctaatgtcagagagtgcaatacattgataccaagcagaaaatttgtg

SEQ ID NO: 15451 - DNA, 665 bp, Zea mays
  Clone ID: LIB3279-225-Q6-K6-B7
gcggaacagtaacgtgcccatctgcgctatccaagagcgttggatacctggtggatctttccgcctcgggccgccgcgcgatgggcccatccatggcggcaagcgcagcaaggccgtgacatcgtggggtgggggtcgggctcgagaggaggtagggggatcgtgcattcgtgctcgtgcgtggtgcgtcacgctgtgccgtacagtagcaaccaaaccagtgccacgcgcggcgggcccacggacggcaccatgggcagggccgcaggggtgcagtacagctactgtacagcagtactgcactgtgcacacacagccccgccgtcgtgcaggtgaggtcaccccgccctttgtgggacacgtttcgacctccgagcggctttggcaaggggtagaggagagggcccacgcgccgtgccggatggtacgtcggcgacgactgtccttgtcccgcgcttaggttcacgtgtcatttgacgcggtccggtccgcactccgcaggctggccgagccatgccaatgacagtagggaactaggatgtacttagatattacgaatattatctgtatgtatttaaatttgatttttcgaagagtcgatttgtcgaagtggactgatatttgatacttattcgagtctaaatattcagtatctagtgcataaa

SEQ ID NO: 15452 - DNA, 541 bp, Zea mays; identical to SEQ ID NO: 13199
  Clone ID: LIB3279-225-Q6-K6-B8

SEQ ID NO: 15453 - DNA, 536 bp, Zea mays
  Clone ID: LIB3279-225-Q6-K6-B9
aaatagggagttttcttctcccgtccaccttgcgtgctcgcgcgcgagctctcgtggcgcagccacaactaggcgaccgccgccgcccctacgccacgtgctcgagtctagcctcgtcgattgcttccccagtttaattgatctacaagcttcagaacatgttcaagaatacatttcagtctgggttcctgtccattctttatagcctcgggaccaagccattgcagatatgggataaggaagttgtgaatgggcacattaaacgaccccaagatgaagatatccaatctaatgtacttgaaattgttggaacaaatgtacagtcaacttacatcacatgcccagctgatccttctgctactcttgggattaagcttccatttctggctattattgtgaaaaatcttaagaaatacttcacgtttgagatccaagttctggatgacaagaatgtccgacgtcgatttcgagcatcaaattttcaatctgtcacaaggggtgaagccatatatctgcacgatgccgttgaaactcga

SEQ ID NO: 15454 - DNA, 646 bp, Zea mays
  Clone ID: LIB3279-225-Q6-K6-C1
ggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtgtccgttctacctttggattaggtgttggtacccctgttgttccctttggttgctcccgct

SEQ ID NO: 15455 - DNA, 587 bp, Zea mays
  unsure (1)..(587): unsure at all n locations; Clone ID: LIB3279-225-Q6-K6-C10
gggtagtatattaaggttttttttaaccccgctctgaaatgattattggacatcattgtttggcagcttagaatgctgcaaaaggaagaaccataaatagcatttccattcctttttgtgattctatcttagtaatccaaacatagttgtgctagcaaaacgaggctttagaaaccttcgttttttcacctatgctgcagcgtcggttcgtttgtaggcttcattacttgtcatcgttcttatcggttcctagaatctctcatcgtcaccgagcttcaagcacagagtcgttttccccgcatctgcttgtatttagctgggggggggggggggnnggnnnnnnttgctgccagaaccgccttatcttttgttgcnnatggcncaggggtttncgctcgttgcgtctgggccaatggtccggtcttcgtacaaggcaggtgaattctacatcaaggctatgatcgaagcggagcgagccaagggaaccgctgcagactcaagtgcataaccgagatagcaccttncggccccacccaccccttgacttggttgggcctgcaaaaagctttttactgcttttgtagtca

SEQ ID NO: 15456 - DNA, 649 bp, Zea mays
  unsure (1)..(649): unsure at all n locations; Clone ID: LIB3279-225-Q6-K6-C11
ccccgcgtccgcccagcgtccgcccacgcgtccggcatattccaggcagcagcaagctgatggcttcccagcacctcgccaagttgatgaaagtatggtattttatgatgccccatctgattacaacttggtggatggaaaagatgacttcgtatatctgaacgacattctgaatgagccacttggaaatgaatcgctctttgatggagatgatatgatggcttactttgatgccacagagaatgatttcaagtatgacattttgggctctggtcagggtttggattatccacttgcagacatgccgttgaactttgcccaaaagagtgacaaggaagacaagtttacattcgaagggatctctgaggttccggaagcaaatcctcagtacggtgcatcctcatctggttcacatgaagatctgtatactgatactgaatttctaggtgtgccaacagatgacactgctgataaaacttacggaaatcgcctggccagcatgttaggctctatcccagctccacctgcaatggcctcagaattcccgccgtcaacagggaaatctgctgggatgctttcggctgtcagctcgagctcaattcgttntacttgctggtatcatccaacttgatggcctcactttcagcag

SEQ ID NO: 15457 - DNA, 394 bp, Zea mays
  unsure (1)..(394): unsure at all n locations; Clone ID: LIB3279-225-Q6-K6-C12
ccgcgttcgttttttcgttcgcggncgcgtggggccgggccttttcgctgctgcgccgccgnngcgtggtggcggtcgtggcgggctgggcgccgngcccctttcgtcgggggctcgngccccngnggcgtngcgcnnnntgttctcgttcctcgtggtggtggtcgggggttccgggtcgggtctctgggtgttggcccttctccgttggtgagcccttcgcctcggcttggggctcctgggttctcctccgcggttccttcccggctgctgggtctcctgtgtccgttttttctctttcttggcgcccccccttcgnccgcccctttggtgttggtcgctttggtgcttgttcgttgcgttctgtgggttctcctcttcttttttctttttt

SEQ ID NO: 15458 - DNA, 464 bp, Zea mays
  Clone ID: LIB3279-225-Q6-K6-C3
gtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctaccgcggtcggcgcgagggtggtggcggcggc

SEQ ID NO: 15459 - DNA, 649 bp, Zea mays
  Clone ID: LIB3279-225-Q6-K6-C4
ctcatcttttcgcgtttagaactctaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtagggacttcatttgcactgtgtgctgtagcatgctcgtgtctagatctgtggatgggatgtgtcctgctctagtttcgtccttgtgtcttattgtatgttcgtct

SEQ ID NO: 15460 - DNA, 652 bp, Zea mays
  Clone ID: LIB3279-225-Q6-K6-C5
cgcagggcaagtgctgcctacggcggcacccgaggaggggctccgccgctgccgccgttggcggcggcgccacgctcggccgcgccgcggtgcccggggccgggctggtactggagtacgccgcgctggctgtggcggggctgtacccggactccacagcccgggagtcccaggacgcgcaccttgtcgccacgcgcttcgcgggggacccggacctccacctcttcgctgtcttcgacggtcatggcactgccggcaccgcctgcgctgggttcgcgcgggacgcgctcccgcgcctcctcgcgtcgctctccctcgccagcgccgccgaccccaccgcggcgttccgcgaggccatgctgggcgccaacgccgagatgcacgcggctcccgaggtcgacgactccatgagcgggaccaccgccgtggccgccctcgtctccggcggcgctctccacgtcgccaacgtcggcgactcgcgcgccgtcgccggggtctggcgcgccggccgcgtcgtcgccgaggacctctcctgggaccagactccgttccgcgccgacgagcgcgagcgcgtcagggcctgcggtgcccgggtcatgtccgtcgaacaggtggagggcatgcgcgatcccggagccgagcgctgggcgcc

SEQ ID NO: 15461 - DNA, 578 bp, Zea mays
  unsure (1)..(578): unsure at all n locations; Clone ID: LIB3279-225-Q6-K6-C6
aaaaacttggattgagtagggtgggttggtcggaagtccgacggacgggacgggacgcgagacggtgccgcaccgcccgcccgttttcttcctcagcgccggcacggcggcacatccactccaccgcaactgagccatctcttctccttcctcctccgcgcttctgaatgatccatccgagaacaagcagccacttctccgatgccgtcctcaatggccaaatccctcctcctccctccccagttcgtctccgtctcaccccgccacccccaccgcgccggattccccgtcctcaagccccgccgcgcctcgctgctggcagccaccggtggagacgtcacgcccgcgccggacgccgacaacggctccaacaccaaccctctcgtcgaggtgccccgcgcgctctggcgccgcaccctgcagcctctcggcgactatggcttcggcaagcgcagcgtctggggagggcggcgtcgggtctcttcatggtctccggggccgnccttctcgccctcgccctcgcatggcttaggggattccagctccgctcccgctttcgcaagtacaacaccgtcttc

SEQ ID NO: 15462 - DNA, 639 bp, Zea mays
  unsure (1)..(639): unsure at all n locations; Clone ID: LIB3279-225-Q6-K6-C7
acgccctccctgccgctccgccgtttcgcgtgggagtcgtttcgaaaaattcgtttcgcgagcggtgaggactgaggagtgtggaggcctaaaaccatggcggcgagcatcgggatcatggacggcgcctacttcgtcggcaggggcgagatcctgcactggatcaatgcgaccctccagctctccctcgccaaggtcgaggaggcagcgtctggcgcagtgcagtgccagctcatggatatgtttcaccctggagtggtgcccatgcataaggtcaatttcgatgcgaagacagaatatgacatgatccagaactacaaggttcttcaggacgtgttcaacaagctgcggataggcaagaatattgaggtcaacaagcttgttaaaggacggccattggacaacttggagttccttcagtggttgaaaagatattgtgattctgtgaatggtggaattatgaacgaaaattacaaccctgtagaaaggaggtcaaagggatgcaaagaacgtgtctcaaagggttccaataagccatctaaatcattgcaagccaataggctttctggtgctgatccaacagatggaggccatggagttgggaaagtatgtaacactntttctgaagagcatacatag

SEQ ID NO: 15463 - DNA, 625 bp, Zea mays
  Clone ID: LIB3279-225-Q6-K6-D1
ttccacaaaacagaacttaatggctgaatcaagagctgacaaaaatctggccatttgtcaatgaggctgcatcagagttgatcaaaacttctgtggagcctatttttgagcagtacaagtcattcatcctggcctccctccatttctcaaagttgacacttggtactgttgctcctcagtttactggtgtttcaatcttggagagtgatgattctgccatcatcatggaacttgagttgcaatgggatggcaatcccaatatagtacttgacatccaaacaacacttggaatttctcttcctgtacaggtgaaaaatattggattcacaggagtacttcggctcatatttaaaccgctggtgtctgaattcccctgttttggagctgtttgctgttctttaagggagaagagcaaggtggaatttaccctcaaggttattggtggcgaaatgactgctattccaggaatttctgatgcaattgaggggacaatacgtgatactattgaggatacactgacatggccgaatcgcataattgttcccattgtacctggagactatagtgacttggagttgaaacctactggggtattagaagtaaaactggtggaagctagggacct

SEQ ID NO: 15464 - DNA, 668 bp, Zea mays
  Clone ID: LIB3279-225-Q6-K6-D10
ccgcttcctcccgttagactaggttaggctaggctagggtgtcgaccagctcgcggtaatggtggccttcaggttccatcagtaccaggtggtggggcgcgcgctgccgacgcccggcgacgagcaccccaagatctaccgcatgaagctctgggccaccaacgaagtccgcgccaagagcaagttctggtacttcctgaggaagttgaagaaggttaagaagagcaacggtcaggtcctggccatcaacgagatcttcgagcgtaacccgacgacgatcaagaactatggcatctggctgcgctaccagagcagaaccggctaccacaacatgtacaaggagtaccgcgacacaaccctgaacggcgctgtagagcagatgtacaatgagatggcttctcgccaccgcgtgaggtccccctgcatccagatcatcaagaccgccacagtacacttcaagctgtgcaagagggacaacaccaagcagtttcacaacagtgagatcaagttcccactcgtgtaccgcaaggtcaggccgccgaccaggaagctgaagaccacgttcaaggcttcgaggcccaacctgttcatgtgatttagctgtggtcagtgtatgtgatcgtaagaatctgtgttttaagttttgacgctaagacttgggtggtttg

SEQ ID NO: 15465 - DNA, 433 bp, Zea mays
  Clone ID: LIB3279-225-Q6-K6-D11
ccacaacggctcgcctgggatccaggaagtgggcgcctcgcttcgactacatcctgacgcagcaggcctttgtggcggtggacaaggacgccccgatcaaccaggacctcatcagcaacttcttgtcggaccctgtccatggtgccattgaggtctgcgccgagctgaggcccaccgtcgacatctctgtgcctgccaacgccgactttgtgcgcccggagctccggcagtcttcctagattgaggcagtgagcggagagggagagggagagagaaagagaggatttcgtgtcccgagttagaacagagtgctgtatgttttgtgcgactgtttgtaagtcaagtctgaactgtgaacctatgtttgcttctatcagaggacccggagaaagcctgggcatctgtttccggaataaaatgggtccttcggaat

SEQ ID NO: 15466 - DNA, 372 bp, Zea mays
  Clone ID: LIB3279-225-Q6-K6-D2
cgggttcgacccaacgcgtccgaagtatacaaaaggccacgtgtcagagtgaccggaagaacgagaaaggggtgtgtttcagtggtgtgtagtaggtaggtaattttgtgtgtatgcctccgggtaaaagccccgcggtacccagtttgtagatggtgcttctcctggtgctagtttcccgtcgtaagctggatttttttggggggtgtgtgccctgctctgtgtgctgacccgcctgggggtaagttgtagcagagcaggagaaagcaggcaagaaaccgctggtgcgcctgcttggccaatccttttccttgcggagcgctgtaaatagccttggatctgaagcgtagtaatgtattgtcatggtactcg

SEQ ID NO: 15467 - DNA, 323 bp, Zea mays
  Clone ID: LIB3279-225-Q6-K6-D3
gtgcaactcgttttcaagatccccctttggcagtagtagtagtatcatcaccagtggtagctagtgccactaggtcatcgtagttctgttgcatctcagtatagtaacgtgatggctggtctggcgttttttctgcttggtgtcgacccatagatcgatcacttgcctggacgaagtgagtcgatctaataagagaatggactgtggccgaggggaacactgctttttttggttggttaatcttgtctccgtagttgaactatggtttcggaattcggatggatggtgatggaataaatcttggatggttcgatctggacctt

SEQ ID NO: 15468 - DNA, 361 bp, Zea mays
  unsure (1)..(361): unsure at all n locations; Clone ID: LIB3279-225-Q6-K6-D4
accaaccagcaagcaaaaattccccaatcctctcgtctccgcggctaagatgtcggggcgcggcaagggcggcaagggcctgggcaagggcggcgcgaagcgtcaccggaaggtgctgcgcgacaacatccaggggatcacgaagccggcgatccggagggctggcgcggcggggcggcgtgaagcgcatctcggggctcatctacgaggagacccgcggcgtgctcaagatcttcctggagaacgtcatccgcgacgccgtcacctacaccgagcacgcgcgccgtaagaccgtcaccgccatggnacgtcgtctacgcccttaagcgccaagggccgcacccctctatgggcttcggcg

SEQ ID NO: 15469 - DNA, 680 bp, Zea mays
  unsure (1)..(680): unsure at all n locations; Clone ID: LIB3279-225-Q6-K6-D5
agcagtgtcccctctgtatattatgtataaaattttatggtcgcatggnagaaaccaaatttatttgcattctcttgcattatattgtttttctactatttacttcaaaagaaatagttgtgtatgttggtagtattgcagttagatacttggtaggcatgtctcccttgttcttatagaacaagatatcctgaatgaacaggaatatttgaaaagcgtcattttcttttgctgcttcttgtactatgttccaatataagacatgacaccgatgatctggttgttcagacttcagatccgtgtggcacatcatatagagaaaacatgcagggagagagttgttacaaataagggagactgaattggatgattgtattgagattcaatgtgactacatataagtacatgacaaaaccctagactaggagattacactactacccttggcttttataccttaacaagaattatgtctgtattgcattgagccatcatagttgcaagcggaagaaccatttacctgtaagctcgggttccaatctctcagtcgacacatcagtactttttactttaattcaaacacatacaatgtgtgtttctgctgcgttctatcaaatcaatcattaatcgaatatttgaatttatagcgccttatgtgcaaattaatgatcctgctttgt

SEQ ID NO: 15470 - DNA, 528 bp, Zea mays
  Clone ID: LIB3279-225-Q6-K6-D6
aaggatttattagagttgaaactgtaagctgtacataacgatgagaattgaatgacgaagtttcagatttcagtttacatgttatgatatttctcagatacaatggcaatacttcacctctacggaatttggatatactgttacctgcttttttatgtttgatatttactaatcgtacaatcattaataccatacctcaggtatcctacgatgattttgttgcagttggttctcttggagtagcaagggagaaaggactggaaaaatttcgaaaacatcgagtcgagaagttttggcagcactttcatttcatccttattgcagtgcctcgacagtagacagaattaagttctgtccatgagtgggatttggggctttggttggcttgcctgcgcactcggtaatcaccatgaagcagaggatggaccgtgtcatctggagcagcaacaacaacatatatccatttgttgtagatgaattatacgatttacatgcacaattctttgcataaatattgaaggtgtctcg

SEQ ID NO: 15471 - DNA, 630 bp, Zea mays
  Clone ID: LIB3279-225-Q6-K6-D8
ccccgcgtccgggccagccaacagaggccggtggaaaggagagaatcgagcagagccaccaggttgctcctcatttccactttccactgcgcctccgctgcccatcgccgtccccgaccgcagcgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagaaaactggactgattaaggttgatcgagtcctttactcatcagttgtataccctcacaattatggtttcattccaaggactctttgtgaagacaatgacccaatggatgtgttggtcctgatgcaggagcctgttgttcctggttcgttcctgagagctagagcaattggccttatgcccatgattgaccagggtgaaaaggatgacaagataatagcagtatgtgctgatgatcctgaataccgtcactaccacgacatcagcgagctgtctcctcaccgcctgca

SEQ ID NO: 15472 - DNA, 607 bp, Zea mays
  Clone ID: LIB3279-225-Q6-K6-D9
ctgccgcatgcgagcgacagcgcgggatccaccttttaagcagaaagttcttgatggatgtcaatgtcatgcatagtcttatgctaatggaagctcacactaattgtcaccagaaatgatagtactctggtacctcttcagaccacctgtgaaagtttgtatgccaaccacgacaaattttagtgttccacatactcctgtggaacagctaaaccagagcactaatatttatgcaaattctactttgattgaccactattcttcttatagtggtccacatgcaaacgaattcatgcgaaatacacggatgcgaataaaccctagtgattatgatcaatcactgcccagccttttacctgaagggagtttcaagtgcccagcttatcagcatacacagcagcagtcatcatttaggccagtgcaacctagacaagtgagctcttctggttctcatagtggacctcacttgcctgttgttactcaattttcgcataatcttcaccgttcttcagcaaatattagttttggatcaaggattgggagttcttccagatctggttctacagtactgatacctgcttgacaagatcccagtacaagctcgata

SEQ ID NO: 15473 - DNA, 657 bp, Zea mays
  unsure (1)..(657): unsure at all n locations; Clone ID: LIB3279-225-Q6-K6-E1
cctaactccaaaaaccctcgctctcctctcatggccgccgccgcagctgacgacgcagccgaggtggagcggctttacgagctcggcgagcgcctctcctccgccaatgacaagtccgagcatgcggcggactacgaggcgattattgcagcggtgaagggacagagtgccaaggcgaagcagctcgcagcgcagcttatccccaggttcttccggagcttccctgcactcggcacgcgcgccatgtcagccatgttcgatctcgtcgatatggaggagctcgcgatcagaatacaagctattcgtggctttccacttcttggcaaagatactgaatttgtgtcaaaaattgcagatgttttgggtcagctccttacaagcgaggaaaatgttgagcgtgatgctgttcataaagcgctcatgtcccttatacggcaagatgttaaaaattcattacaacctttatttaagcatgtggagcaaggatcagagattcgtgagaagattatttgttttcttcgagacaaggtctttcctcttaaagcagagctgctgaaacctcaagcagaaatggagagatttataacggatntgataaagaaaagtgtgcaagatgtaactggttcagaattcgaactattcatggggttcttgcga

SEQ ID NO: 15474 - DNA, 650 bp, Zea mays
  Clone ID: LIB3279-225-Q6-K6-E10
cacgacgttgctgctcgatcccaagcgttccgtgacaccatcgacctctttgtcgagcggtacaaggaccaagggatcaccgtggttgctggtgttgaagctagagggttcatttttggtcctcctatcgctttagccattggcgcaaaatttgtgcctttgaggaagccgaagaagttgccaggcgaggtgatctccgaagagtattctttggaatatggaactgacaagatagaaatgcatgtcggagctgtacaggccaacgaccgggctcttgtagtcgatgatcttattgctaccggtggaacactatgtgcagctgtcaaacttattgaacgtgttggagcaaaggttgttgagtgtgcttgtgtcattgaattgccagaactgaagggccgagacaagcttggggacaggccagtttttgtccttgtggaagcagacgcctgagcggaacttgggacttctcagagagtttggcgccgtcgatgctcagtttcccatgttaccatgttggctattttctggctgacgcgtaataaagttttattccaaattgtgatcccctgaatgatttgtcaatgtagacatgattgctgatctttgtaaactgtggcttatgttttgtcaaatggttcttattattcaca

SEQ ID NO: 15475 - DNA, 99 bp, Zea mays
  unsure (1)..(99): unsure at all n locations; Clone ID: LIB3279-225-Q6-K6-E11
agcgtccgccccgcgtccgcagcctcttccccttcccgnccagnacaagcacgccaccgcttccgtcgtcggcctcccgaccgtctcactcccgccccc

SEQ ID NO: 15476 - DNA, 474 bp, Zea mays
  Clone ID: LIB3279-225-Q6-K6-E12
gcgagctgctgccacccctgctgccgcggtcgaccgccggccccggaccgagaaggacgctcggtgggcggtgctgctcgcgctgctggtcgccagcggcggcgtccgtgtctgcgccgccgctggggccaagggcgccaactggctgggcgggctgagccgcgcgtcgttccccaaggggttcgtgttcgggacggcgacgtcggcgtaccaggtcgagggcgccgcgtccaccaacggccggggcccctccatctgggattcattcgcgcacgtcccaggaaatattgcagggaatcaaaatggagacgttgcagtggatcaataccatcgctacaaggaagacgtcgatctcatgaaaagtctgaacttcgatgcctaccagttctcaatctcatggtccaagatcttcccgtatggcgaagggaaagtcaatccagaaagtggagcgtattacaataatttgataaacta

SEQ ID NO: 15477 - DNA, 621 bp, Zea mays
  unsure (1)..(621): unsure at all n locations; Clone ID: LIB3279-225-Q6-K6-E2
cacgaattagnatagnaatattttattcattattaaagtttctaaagattatgcagacattgcaactggatgtgttttatatgctcgttattgctagttgaagaaaagaatagatatgtaaagaaaccctacatagttggtaactccaattgtgtacaagatagtggaaatggtgagaggcaagtaattttgcaatttcttaatttttgttaggttctgattcaatcagtgttttgggtctccttctctgccgaaggtcctaatgacgaagaaattgcctataagcaatgagactgaatgccgaagctataacaagcatgcctgaagcaccgaaggaaggcaacttcggctcaaggcggctacgatgtcaaacacgatgttgagtcgaagaggaaaagactcgtttatccctaatgtttgtattaggattatgtgtatatgtcagggtcataaatgtatttttgcccgggctgcgttccatgcctataaatagatgaacagtacctgacatacttctcatgatgaatagagattgcactctcactttcacctttgggcaaaccggaggtacaaatgtaatatatatcacgtattactttgtcaacacatgatataaactat

SEQ ID NO: 15478 - DNA, 523 bp, Zea mays
  unsure (1)..(523): unsure at all n locations; Clone ID: LIB3279-225-Q6-K6-E3
cccatccagnacgaatccagctaacccttcaattgagcttggacctgagttcaagaaggttgccaatttccttggtcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttatcatcaccagttttcccaaggacatgtcacaggaactgccaagcctaatcactcctactgagctctatattttgtaattttcatgtgcattccgattccgctgtgagggtcatgtgagcccgctagagaataattgtaatcttctttgctgcgtctgtacttctgtttttgtgcgccaggacgtatatttttactgaaatgatactccgaagagcacgtatggtgtcttaaaaacnnnncgnnnncgcagc

SEQ ID NO: 15479 - DNA, 491 bp, Zea mays
  unsure (1)..(491): unsure at all n locations; Clone ID: LIB3279-225-Q6-K6-E4
gcggnaagtaagaagcgatggggcactccaacgtgtgngaactcgcaccccaagaactacgggncccggnatcccgcgtcntgccnngggtctgtgcgaaccctcatnnggactgatcaggaagtacgggctttgatgtgctgcaggcagtgctttccgcagcaacgccaaggacattggcttcatcaagtaccgctgaagtcagctgggcgggctatctgaatgccatctcttggacagtgtagtagaggcgatgccacaattttaattactgtcatttagatgttcccttcagaactctgctatttaagtccgccatgtttgtgatggagaactgaagctttgtttgttatactgattatgagttacctgtgctttgcctaaaaaaaaaaaaaacaaaaaaaaaaaaaaaaaaaaaaaaaaaaaaaaaaaaaaaaaanaaaaaaaaaaaaaaaaaaaaaaaaaaaaaaaaaaaaaaaggggggcggccg

SEQ ID NO: 15480 - DNA, 643 bp, Zea mays
  unsure (1)..(643): unsure at all n locations; Clone ID: LIB3279-225-Q6-K6-E5
ccccgcgtccggggattctcattttggaaatcgtttcaataataacaaaagatcaaggtatgagcgtggaggttttcagtctaaaagatctaaggtatggaaccgtactcctcacgctgatcacgggatggtcaagagcagagaaccaaccctcctgcagaagcttcttagctctgatatcaagagggataaacgtagacttattcacgtgttcagattcatgaccttgaacaatttctttaaggactggcctgacaggcctttacagtttcctagtgttaagatgaatcagattgaaataggaagcaatattagcacagatgatttggagaatgctgggatgtccaaagacagcatccttggtgtaaacgaaaatggtgattggaaagagttgagctcgattgatgaagaggataccgatagcgccaaccacaatgatgaagacgtcgatgatgacagtgttgacagcagcattgaggatggggccgaggaggacgggtacgaagagcagtttaatgagcctgaagatgatacggcagtctgaaaatttgactgagccgggtatccacatcaaaaagacaaagcgcttctccttgagtagagttnttgcacaacacattctgtagctcttcgcatattccag

SEQ ID NO: 15481 - DNA, 588 bp, Zea mays
  Clone ID: LIB3279-225-Q6-K6-E6
ccccgcgtccggcttatattcctatatgactactagctagaaattaagagcgctaatactatattaattgtgtaccatattcatcatttgctcgttcgaggagaaatttaaagtcttactagtgtcactactgatattttatttattctaaaatattaagaataatagtaaaagtgtgtcttgtagaacacattataatatctattttttagatgcgtgttattagagtggtctaccgtgtgttgttattgccgttaaatcctgaccatattgaatcctaaagctaaaaaggtcgaacatcagcgatggagtggaagagcaacgacatcccctccggcgttgttagccccgtgacgtcggaaggtgcaagggagtcttcgacgtcgagcaagaagatgagcagcgaggagcaacaacaagagagcgaaggccgtcatcgcacggaaggcatgccaacgttcgtttgaatgggctcaagtgggccgtgtaatacttaagtgggccgctgggtcccgatgctgatataggtcagtctgtgagaacattaaggccatcgaataacaaaatagcaaatccatttttgccgct

SEQ ID NO: 15482 - DNA, 636 bp, Zea mays
  unsure (1)..(636): unsure at all n locations; Clone ID: LIB3279-225-Q6-K6-E7
ttagccctccgttcccgaccctcctcctccgctccagacttccagcatctccgctccggctgcgctctgccttgctttcctgctacctgctctagcgcgagcgagcgaggtacggcggccgatctggcggcgcaggcggagggctcggccggggccggcaagtcggcgccgaacatggggaggggccgggtcgagctcaagcggatcgagaacaagatcaaccgccaggtcaccttcgccaagcgccgcaacggcctgctcaagaaggcgtacgagctctcggtgctctgcgacgccgaggtcgcgctcatcatcttctccaaccgcggcaagctctacgagttctccagcacgcagagcatgccaaaaacacttgaaaagtaccaaaaatgcagttttgcagggcctgaaacagcactccagaatagagagaatgagcaactgaaaagtagccgcaatgagtacctcaaactgaaggcacgtgttgataatttacagcggactcaaaggaacttgcttggtgaagatcttgagtcattaggcataaaagagctggagcacctggagaagcagctcgattcgtccttgaagcacataagatctacaagngacacaacacatggttgatcaactgac

SEQ ID NO: 15483 - DNA, 650 bp, Zea mays
  unsure (1)..(650): unsure at all n locations; Clone ID: LIB3279-225-Q6-K6-E8
cgttgatagcagccctggttgtgaggacacatgcaatagatatgagccaaaggtcgaaggcgatgaaaattgtgttcttggagatgagagcattagcaacaattgtgatgaaaataataaagatgccataaaaactggaagcgtaagtgagagacatgaagagctgataattgaagaagaaaatgagaaattgcagcaggcatttattgaagatgccaattcccaagcggggagtggttcatcaattaatgagcggacgaattctgggttttctcgcggctcatcagaggctgggttagatgaagatcagtcctcaaccggtaagagtggggactcatcattttttgctggtttcttgaagaagggtttcaaggacctttctttattaaataagtccatggacagcgttaaggtttcaattaatggtcatccaatctctgaaagagcccttaagaaggcagagaagaaagctggtcctgttgacccaggttcatattggtacgactaccgtgctggtttttggggtgtcatgggacgagaatgtatcggcattgtccctccatttattagagaatntaattatccgatggccagaaattgtgccggtggggatttctgtgttttttgtcaatggcagagaactgcatcaa

SEQ ID NO: 15484 - DNA, 659 bp, Zea mays
  Clone ID: LIB3279-225-Q6-K6-E9
gcctttgacccacacccaccccccgccggccgccgctgcagaccatggagcacgcgtccgccttcctcgcgcgcgcgctcaccactccgctcccggcacccgccgccctcccgcggcgccgcccggctcgcgtggccgtcgccgccgcggcgccggagcgcaggccgccgggcgcggtggcgtccaccaccaactacgtcgtgccgctcgacgcggcgccgtccgggatcacgcgcccgctcgtcgagatcctccgcgacctcaacaagcgcgtcccggacgccatcgtgcggccctcctcccggcgcgcctccgcctccgaccccgtcatcccctggtaccatgccaataggatgctcagcttttatgctccaggttggtgtggggaagttcgtgatgttatttacactgacagtggaaaggtgacggtcatataccgcgtgactgtgcgcggaacagatggagaggttcacagggaggctgctggaacagcatcgctgagcgatgaccggttcgacgaccccgtgtctgcggcagaagaggcagcgttctgcaaagcctgcgcgaggttcggtttcggcctttacctgtaccatgaagacgagacaccatagaagaccaacaatttctccacatcgtctatgccggccctgttctgt

SEQ ID NO: 15485 - DNA, 662 bp, Zea mays
  unsure (1)..(662): unsure at all n locations; Clone ID: LIB3279-225-Q6-K6-F1
ctgcttaccgccgatgtgttccttccatccgggaagttatcgctaatggcattagcgtcaacgtcacgcttattttctctattgcgacatacgaggctgtgattgatgcttaccttgatgggctagaggcttcgggcttgagcgacttatctcgagttaccagtgtcgcatccttctttgtcagccgagtcgacacccttatcgacaaaatgcttgaaaagattggaacacctgaggcacttgccttgagagggaaggctgccgtcgcacaggccaaactagcaaatcggctctaccagaagaaattctctggcccgaggtgggaggcgttggccaagaaaggtgccaagaaacagaggttgttgtgggcatccaccggtgtcaagaacccagcttatcccgacactctttacatcgacagtctcattggacctgacacggtcaacacgatgcccgaccaagctttgcacgcattcatagaccacggcactgtctcgaggacagttgatgcgaatgtgtccgaggcggaaggtgtatacagcgccttggagaagcttggcattgactggggcgaggtcggaaagcagcttgagctggaaggtgtggactccttcaagaagagctttgacagcctactcgtgagcctacagnagaagggcaac

SEQ ID NO: 15486 - DNA, 611 bp, Zea mays
  unsure (1)..(611): unsure at all n locations; Clone ID: LIB3279-225-Q6-K6-F10
aaatagcggacgaaatctatcaactggttgtctcgaagaaagaaaagccaatgtttccatacagtctgcctccagaattgaaaacatgctttctggatgctttgagtacgacttcagaaccgtcccttgatgaaagatattttgcatgcatttgatagtaataaagatgcacatcatgacaacattggttggcacagtttagaaaatttaatggtagacaagccancccatggaaaatcacattaactggttgcggaagaacaagtttcaagtgggtgacaaggttcgttcaagaaagcttgaaatctcttgtagtcttgaaactatggaaatccctaatggaacagtagttggtgtcgacgatgacgaagggcgcgatgcgtacgttcttgtatgagtctatgggttgcacaatgttttaaaggtccgctgctcgatggtggagaggggtatcatatggtcttgttgctggaaactgggtcactgcagccagaaaaccattgtgcctcaatttgaggagcttttccatctatatttttaccagacatagtgcctatttatctcttgtattcgaacacttggcaattaagcaatagcagattacttcctcg

SEQ ID NO: 15487 - DNA, 449 bp, Zea mays
  Clone ID: LIB3279-225-Q6-K6-F11
ggctgctctaaagtggtgtatgctcttatgacatcgcttttcggtgacgttaaagtcgcagaggaagggaaatttgtcatatctgtagatgggaatgtggcccacttggatgggaggagtggcgatgtcgaatgtgaaaatgctacgctgaaggaacggatcaagaccgcgttccgtcgcatacagggcgccgtgagaccaatcccactctcagcctcttaacaacttgtttgacatttcccatttgaacaaagtagcattctctgtttacaccagagtaccgggtttttttccctctctatcgaaaggaaccccagatgccttgtacggcatgctactcaagaggatttgattgttgatctgggattgcctctgtaaaatcacctgtaacattgtcatcctaacttgaaccacctccatcgttttcagtaaatttctacttaattttc

SEQ ID NO: 15488 - DNA, 614 bp, Zea mays
  unsure (1)..(614): unsure at all n locations; Clone ID: LIB3279-225-Q6-K6-F2
cccacgcgtccgcaaaaaaccatcaactactcaaccccctcctccagcctctgctcgccgcgcgcggcgctgtagcattctgccgtccatcgtcgccccggctccccatccctgctcctggcgtcaacatcccaaccatccccggagcgcgccaggggtggcggcgacacgaggctgcttacgatcgtcggcgacagcgcctcctcccactccatgccgtcggcggtggcggagcctttgccggatggcaagtacgaaacggatcgtgccggggcggtaaccgtcgtcggggcaggcgcagatcacagcatcgacggagcggttaatggaagcaaagacgagtcgttcttcgaagcgaggccctggctagattccgacagcgaagacgatttctacagcgtcagaggagatttcactccgtcaagaggcagcacacccgttcatccgagattaacgccctcaagtgggcggatgctggcagacaggtcgggtccttctctggtaaaaaagaagcagagactcctcgagcttcttcaggaggagcagcattatgacgacgaggatgacagcgtcaccgatgctagcaatgatctggnaagtagcgcagttcatgc

SEQ ID NO: 15489 - DNA, 585 bp, Zea mays
  unsure (1)..(585): unsure at all n locations; Clone ID: LIB3279-225-Q6-K6-F3
cgtccgcggtacgcgtgnggcttcaaccttgntcccgttatctttaaaaaatcacatgtttnnttggtagatnnattgttgaaacaangcaggnggtnngtttgatttgtaatanttgagatattttagagtgaaccaaatatatagggntttcatttttntagataccaacattaccccaattctgcaacaaacatgcttcgttttcatggattagctctattttgccaattcataaagcaatggctacataattcatgtaaatgaattattggtaaatggattgcaaaaggatgagcaacaaagaacaggaatagacatgcaaatatgagggttagcctaaaccaaatcaagtaggtttttggaatcgtgcgttattacataaaacatcatcaaggttccatgtgttggcattaattcagaagggagtacagttcacacaatgtcaaattttaaaaacaaattcaactagttgcaaaaatttcagtgtgtatcgacagaagacttacttgngagaaaaaggtcgagagagctaatatttagtctaggtgaagaaacaaatattggactggtcttgccaccagg

SEQ ID NO: 15490 - DNA, 683 bp, Zea mays
  unsure (1)..(683): unsure at all n locations; Clone ID: LIB3279-225-Q6-K6-F4
gggnaaccataccacagcggcagagccttcccctccgctccccagtcccacccgcaccctagccctcagcaaaccctaaccgctcgtcgccatgaaggacacctcgttcaaggccaccggcgccaagcgcaagaaggtcggcggcgccaagcgcgggctcacccccttcttcgcgtttttggctgagtttaggccgcagtacctggagaagcaccctgagctcaagggcgtaaaggaggtgagcaaggcggctggggagaagtggcgctctatgtcggatgaggagaaggcgaagtatggcagtagcaagaagcaggatggcaaagcaagcaagaaggagaacactagctccaagaaggccaaagctgatgttcgggagggagatgaagcagaaggttctaacaagtcaaaatctgaggttgaggatgatgagcaggatggtaatgaggacgaggatgagtaaatagtacgatggggaacagcagctttgcaattgagtgtttgctgctttacttatttttctatatgctgttccttttgatgttatatgctgtaaggaaaatctgtacatgatggtaccttagggtatggcatgctggagttcccctttaacccgaagagccgatacttttgccagcctcgtcagcatgtgtaaacagttgttttcttgttttatcgactaa

SEQ ID NO: 15491 - DNA, 651 bp, Zea mays
  unsure (1)..(651): unsure at all n locations; Clone ID: LIB3279-225-Q6-K6-F5
actcggctggctcgggaggaggaagatcaagctgttgctgaggaagcccaccatggngaaagaagacggacatggnagaacaacagcgataaggagatgatgctgccgccgatcgaggacgacgccttccagcagctcgacgacatcgagtcgtccgcgctgctcccgcgacggttcggcagctcggcaacgttcgtggcgtccatccccgtggcagagtaccaggggcggctcctgcaggacacgcccggcgcgcaccagggccgccccgccggcgccctggccgtgcctcgcgagccgcttgacgcggacaccgtcgcggaggccatcagcgtcatttcgtgcttctacgaggacaagacggagtgggggcggcgcatcgggtggatctacgggtcggtgacggaggacgtggtgacggggtaccggatgcacaaccgcgggtggcggtccgtgtactgcgtgacgcggcgcgacgcgttccgcggcacggcgcccatcaacctcaccgaccggttgcaccaggtgctccggtgggcgacggggtccgtggagatcttcttctcccgcaacaacgccctgttcgcgtccccgcggatgaagttcctccagcgcgtggcctacttcaacgtgggcatgtacccgttcacc

SEQ ID NO: 15492 - DNA, 558 bp, Zea mays
  Clone ID: LIB3279-225-Q6-K6-F6
caaaatcgaaagacaggaaggcatttctctgacagcataaagtggtcttctttgctatgttcttaatgataacaaacataaattttgcttctacaggccattggcagttctcttggtcttctcttttgtggaaaggacattgaaccagcatggggccgcaaggaattcttgaagttcattattttgatcaactccatctgtggcattcttgcattttgctttgctattggactctactacgtcactggaaaggagagcttccttgtcacaccactttctggtttccacggttgccttgctggctttcttgtggccctgaagcaactcttaccaaaccttgagcttcctatgtgctttttctggaaaataaaggcaaagtggatgccattctttgttgtatgtttctcaagtatcatggccttcatcgtgcctgattccattaacttcctgccaactttggtgtccgggatgtacgttagctggctttacctgagatacttccaaaggaacccactgactggacttaagggtgatcccagtgatgacttctccttcccc

SEQ ID NO: 15493 - DNA, 449 bp, Zea mays
  Clone ID: LIB3279-225-Q6-K6-F8
atttgataatgctggcgcaatgatgagtgttgacgaaactttgatgtgttccttccaaattctgaaacctgctgagagaaaacaaatttatggggccaaacaaaatgtgagatagtgaacccattttgcttccagcagctctgaggctctcctgtggatgtatcaagacaacatcatgatggcgccaaacttgaggtcagcattgggcaagggcaaccaccagagcagagaaaccaaataatataccatacctaactgttcgcctggaagttactcttcatggcaagtgcttgaattttctcttgttactgcgtgtcgaacaatcatgtagctgtagatatagtgattgtggaaggatgaagttgccaaattgacccgtggcgatttccttctccagacaggaaaaattctgaacatcaaggagtttctgtttgcaagtttcactattt

SEQ ID NO: 15494 - DNA, 497 bp, Zea mays
  Clone ID: LIB3279-225-Q6-K6-F9
ccccgcgtccgccccgcgtccggtccgtcgccgccgccttgggccgcgccgatgagctccgcgcgctggacgacaccctcgccggcgtccgcggccttgtagcgtctggtgcgaagcaagttcctcgcatctttcgcgtcccctacccggaggagctactccaccatgaacaaccgccagcggcggcgaccgtcccggtgatcgatctcagcggcgaccgcgcagccgtgatcgacgccgtccgtggggcggcggcggggtgggggttcttccaggtcacgggccacgcggtgcccgagcaggtgatgtcagcagccgtggcggcgatgcgggcgttccacgaagccgacggcggggagggcagcgacaaggcgcggctctactcgcgagagcccgggagggcggtcaagtaccactgcaacttcgacctgtaccagtctcccgtggccaactggcgcgacacggtctacctgcgggtggcacctgacccttccgcc

SEQ ID NO: 15495 - DNA, 654 bp, Zea mays
  unsure (1)..(654): unsure at all n locations; Clone ID: LIB3279-225-Q6-K6-G1
tttgcagntgtgaaggacataaagtgtgtgataaattatgattttccaacaactcttgaagattatattcacaggataggtcgaactggccgtgctggtgctagcggaactgcatttacttttttcacacacgcaaatgcaaagttctcaaggaatctagtgaagattctgcgagaagctggccaagttgtgaatcctgccttagaatccatgtccaggtcttcgaactcaacgggaggaggcaattttcggtcgagaggcagaggtgggtttggtaaccggggccatatgtctggatcaaatacctttcctttaggaggaagaaggccatattgatgtgtgcaaaagaactgtgggagtatgggactatttgtatactactcggcattaagtgcattctttgggaaatttctgagaaatttcccctactaccaggattgataacaccatcgattttcgctacagtacctggagcttcttatatgaaagaacaacacatcaactatctagcaacagcatatgcattccattcagatatttcttttggaaggaccctgtcttgttttagtggagtccctgtgatcgtttaaagtcgtctgtatacttgtactgaacttcttgtggtgttactgttaggatttatggttgctctct

SEQ ID NO: 15496 - DNA, 522 bp, Zea mays
  unsure (1)..(522): unsure at all n locations; Clone ID: LIB3279-225-Q6-K6-G10
ggcggagggcgatcggagagcgggatcatggcggggccagttgcggcggtgacggaggcgtgggacaagctcaccgtgttcctgtactcccagctctacgacgagaggaactgggccaaaaacaagaagttggcgaaggctcttggtgtgttcgctggatccatcctgttcatgcgcacctgtggtgatatggtggccatctagggagccttcaaaagttgcctaccgtgaactagagacacccccttttttgttggcattggatgtgttcttacttcggtcagggacagttgaagcgtatctagactctagagactgtttgtcttgctagaatcgcaaccaaaagtattggtccaagattagtgcaacggtgaaattatttcacccaagcgcacgagttgcagttttttttttcctggaaccatttgaattctggacagtggaatggtactcccttctttggcttccttaanaaaaaaaaaaaaaaaaaaaaaaaaaaaaaaaaanaaaaaaaaaaaaana

SEQ ID NO: 15497 - DNA, 569 bp, Zea mays
  Clone ID: LIB3279-225-Q6-K6-G11
gctgcgctggcgtgccgtcctccccccactcccactccctccgccgcctggcttgcttcgccgcctgcctccgcaccggcgcgccctctcgtcctcttccggcactatcccgcttccaccgccggtgatggaggcttcctacaagtttgggccctacaaaatcgacgccagggaggtcttgcacgccacgcccctctcctacgccatggtgaatctccgcccgctgctcccgggtcatgttcttgtgtgccccaagcgtgaagtgaaaagattcgccgatctaagttctgatgagattagtgacttatgggttactgcaaaggaagttggtgcacgtcttgagcagtaccacaaagcatcgtcacttacctttgctatccaggatggtcctcaagctggccaaacagttgcacatgtccacatccacctcatcccaaggaagaaaggggattttgggaaaaagatgaaatatatgatgcgattgatgtgaaggagaaagaattgaaggagaagcttgacctggacattgagaggaaagaaggaacatggaagagaggctaatgaggcca

SEQ ID NO: 15498 - DNA, 395 bp, Zea mays
  unsure (1)..(395): unsure at all n locations; Clone ID: LIB3279-225-Q6-K6-G2
actatacgaattatccccaatcaacacagcaagtcagcaacaagcaaagcagcgacccgagagatggacgcgaggatgttcgggctggagaccccccgggtggcggcgctgcatcacctgctggacgtgcccgacggcgacaaggcgggcggcggtgccacgcgcacctacgtccgcgacgcgcgcgccatggcgggcaccccggccgtcgtctaggagctcgcgggagcgtacgcgttcgtggtggacatgccggggctgtgctcgggcgacatttgggtgcaggtggaggacgagcgggtgctggtgatctgcggtgagcggcgccgggtggtgcgcgnggtcgccttgttcctgcgcttggggcggcggttgggctagtttttgcgcttgtt

SEQ ID NO: 15499 - DNA, 615 bp, Zea mays
  Clone ID: LIB3279-225-Q6-K6-G3
cggtcgcgtgggcggacgcgtgggcggcggccggcctcctcttctcttcacccacacgctggtcatagagatgtcggctgcagaggcgaaggcggcggcggtcccggagtctgtgctgcggaagcgcaagcgggaggagcaatgggcagcggacaagaaggagaaggcgctcgcggacaggaagaaggcgctcgagagccgcaagatcatcttcgcccgcgccaagcagtacgccgaggagtaccacgcccaggagaaggagcttgtgcagctcaagcgtgaggcccggttgaagggtgggttctatgtgagcccagaggccaagcttctgtttgtggttcgcatccgtggtatcaatgccatgcaccccaagacccgcaagatcttgcagctcctgcgattgaggcagatcttcaacggtgtcttcctcaaggttaacaaggcaaccattaacatgctgcgcagggtggagccatatgttgcgtacggataccccaacctgaagagcgttagggagttgatctacaagagaggttacgggaagctgaacaagcagaggattccacttagcaacaacagtgtcaatctagaaggcctcgggaagcacaatatcat

SEQ ID NO: 15500 - DNA, 651 bp, Zea mays
  Clone ID: LIB3279-225-Q6-K6-G4
ccccgcgtccgcccacgcgtccgcccacgcgtccgcggacgcgtgggcgtgcgtgggatttagctcaggaacccacgcctgacatcccctcttcctccccggccggcgatgtcgtcttcgtcttccgcgctggccaaaggcaagtcggcaatcggatccgcagccggatctgccaaattcgaggccaaggggaaattctcctcctcctcctccccagctgcggcagctaccaagcgtggaaccaccaccaccagcagcagaggtagaggtagagggaaggccgacaagaaggtctactccttgcccggccagaagttcgatcctccggaggagagggagcctctcaggattttctacgagtcactgtccaagcagatcccctccagtgagatggctgaattctggttgatggagcatggtatgttgtctcctgagagagcaaggaaggcatatgaaaggaagcaaaagcggcagcagcaagtgaggatgggtaccccaatcaagtcttgtgcagtgagaaaagaaataaacctgaaagttccaagaagccaggcattatggattccaaggcaaagagaagagttgattacagtgaggacgacgacgatgacttcattgtgataatgaagagatccaggggatgacatttac

SEQ ID NO: 15501 - DNA, 541 bp, Zea mays
  Clone ID: LIB3279-225-Q6-K6-G5
gtcccgtcctgctccgggcggacggagacggtgatcatcaccgacatgaactactacccggtgtccaagtaccacttcgacctcagcggcactgcgttcggcaggctggccaagcccggcctcaacgacaagctccgccactccggcatcatcgacatcgagttcaccagggtgccgtgcgagttcccgggcctgaagatcgggttccacgtggaggagtactcgaaccccgtctacttcgcggtgctggtggagtacgaggacggcgacggcgacgtggtgcaggtggacctgatggagtccaagatggcgcgcggcccgccgacggggcggtggacgccgatgcgcgagtcctggggctccgtctggcgcatggacaccaaccaccgcatgcagccgcccttctccatccgcatccgcaacgagtccggcaagacgctcgtcgccaacaacgttattccgggcaactggtgccccaacaccttctaccgctccttcgtccagtatagctagctgatcgggatccctgccctgccctgcc

SEQ ID NO: 15502 - DNA, 605 bp, Zea mays
  Clone ID: LIB3279-225-Q6-K6-G6
tgcttttctatgttcggtcaatgatgtctccgtctctagtacagttgagccaaggccacggaatattgagattggtgcagagatgatccttaaacaaaaacttaggggccaggggatggcttttcttgttggtggtggatcagtcatgcagaaaatccttgctcctagagaggtgattactgttgatgctgcttgtattgtggctatgtcggccaccattaacttccagttgaagagccctaaccagcttagaagagcagtttttgggggtgataaccagctaacagcatctttcacgggaccaggtgttgttttcattcaaagtctgccattccatcgactctcacagagaatcaccagtagatcagtggcaggcccaagcttgagggacaacccaaagttcttcatccagattgtcatgttcttcttcctggcctatgttatgattgtatcatccataattcttacagatgtttaggcgattcagtgagcttttggtgtattcctagacaagttatcgaagagttaaagctaccttcccaatgttaatgtagatgtaagagaacgaatttacaagctgttgttagaaaccttaaccgaagttc

SEQ ID NO: 15503 - DNA, 655 bp, Zea mays
  Clone ID: LIB3279-225-Q6-K6-G7
aaatcgaccctgatgttctggacccggcgctcctgcgtcctggacgtttagataggaagattgaaattccgctacccaacgagcaatcaagaatggaagttctaaaaatccatgcagccggtatcgccaagcatggggagattgattatgaagcagtcgtgaaactagctgaaggtttcaatggggctgatcttcggaacgtgtgcaccgaagctggcatggctgcaattcgtgcagagagagattacgtagtccacgaagacttcatgaaggctgtgaggaaactaaatgatgcaaaaaagctggaatcgagtgcgcattacagtgcagattttggcaaagagtaatgatgctgatgccgatgcaacggacaaatgcatttggcatgtatcatcaggggagcccagtcagatgcgatgcaaaagcgagaaaggaaccagctatttatgttcaggctacaggcagcttctcttttttctttctttctcgtgttcacaattttagtgaggaggattgtcgagctgaccggtgggagaaaccagtcgagcatttagtagctttgcaccagatgccatttgcttctgtaaaccacacattatctgcttccgtgtgtcttagaatggtaataactcgtccaatctgttttgttccatgt

SEQ ID NO: 15504 - DNA, 566 bp, Zea mays
  Clone ID: LIB3279-225-Q6-K6-G8
cggtcgcgtgggttgagaagtattcgttgcttctttgtatcggcatcgtgtgggcctttgcagctatccttactgctgcgggtgcatatgaccatgcttcacctaagacacaacagcactgccgcactgataagtctttcctcatgtcatcggcaccatggattaaaattccattaccattcgaatggggtcctccaatcttcactgctggtcattcatttggaatgatgggtgctgtacttgttgcagccttcgagtcaactggagcacactttgctactgctcgtctagcgggtgctacaccacctccagcttatgtccttagtcggagcgttggcttgcagggtattggaatgttcttggaggggatctttagtgttccagcagtgaaaacattggcctccttgggctgacaaaagttggaagtaggagggtgatccagatatcaactgggtttatgatattcttctccatatttggggaaatttggggccttctttgcatcgatcccactgccgatctttgcagcaatttactgcatcttgttcggcattgtagctgctgtg

SEQ ID NO: 15505 - DNA, 592 bp, Zea mays
  unsure (1)..(592): unsure at all n locations; Clone ID: LIB3279-225-Q6-K6-G9
gnaaaattgtatgtaaagttctaacctgagatgtgggaacgggagatatcatggcatatgctggtcctgctgcggttcggtcctgtacaccttagcgtctttccagctgcatggaactacagcttaccaccatttgtagtcttcttgtacaatgcgcactagacaaagcattgaaaccagctgaaaccaatagttgcatgaaattgtagaagcaatggtacgtgtctcatgcacatccaatgctttggcgaggttttagttggctacaatgcacatcgctaaaatacatagcattttcctctcttcctagactccaaacgaccaagattaccaaatagtcgaatccacctacggtcttgttcgattattctctatcccatgtggatttgatgagattagaaaaacttataaaggattttgacttgtttgcgatttaaacacatccaatccacatggatttagagcaaaacaaaccaagcctagctttgtaacccgtttgcgtgaatcgacaccgagagaggatcaagtatttgtgccagggaaggcatgttcgctcctcggatgtgcaaagcagtgaatgcaggttctgcat

SEQ ID NO: 15506 - DNA, 580 bp, Zea mays
  Clone ID: LIB3279-225-Q6-K6-H10
gttcagaatttcttcaattcatcagttcctgtttctgtgcaagcaaccttcccctacaagttcgttgtgagcaagttcttgcagcctggagcatatgatctggttggttacatagtgtatgagatcgaccagcacccttaccagaatgtattctacaatggcactatcgaggttgttgaggctggaggcttactcagtgttgagtctgtgttcctcatcacccttggatttgcacttcttggtctgtttggattgtgggcatatggccaggttcagcagctctcgaagaaaacaaagaaggcacccaaggtggagctcggaactggaacaactgatgccaacatcgatgagtggctggagggcacttcgtttgtgcagagaagcaaatccaagaagaagcagacctgaggctctccaggctagttaaatccttttgaggatctagaatgagacatttgagggtagcccttcacaagtgacttttgcagaaagatagatgcgtaaggaggtgctgaaaaccgtaaacatcttcgttgacattttcgaccttgtgtactttacatggaacaaaatttgttaa

SEQ ID NO: 15507 - DNA, 503 bp, Zea mays
  Clone ID: LIB3279-225-Q6-K6-H11
cccagcgtccgcggacgcgtgggcggacgcgtgggctggcccaaccgccccggggatacctacgagcgcctcgagtacctgggcgacggcgtcctcacctgcctcatgtcgcgcgaggtcttccgaacctaccgcacgctccagcccggcccgctcacaaggctccgcgccgctaacgtcgacactgagaagctcgcgcgcgtcgccgtccaccgcgggctctaccgttttttgagacacaaggcacctaaacttcaagatcagaagaaatgcgcaaatatccagttcactcaaatggactattggatcctcctaaagttctgtgtgacattgtggaatctcttattggtgccatatacttggactccaacttcgaccaagaggaggtttggcgggtctttcgaacattggctgatccacttattggcttagagacattagggcagcaccctgtaagcgagctttttgagttttgccaaaagactcaccgagggggtgaaatt

SEQ ID NO: 15508 - DNA, 562 bp, Zea mays
  Clone ID: LIB3279-225-Q6-K6-H3
ctaaatctaccacacccgcctcctctcgagttcgatctgtttgctcccccagacatgtcgggccgcggcaagggaggcaagggcctgggtaagggcggcgcggaacgccaccgcaaggtgctccgcgacaacatccagggcatcacgaagccggccatccggaggctggcgcgcaggggcggcgtgaagcgcatttccgggctcatctacgaggagacccgcggcgtgctcaagatctttctcgagaacgtcatccgcgacgccgtcacctacacggagcacgcccggcgcaagaccgtcacagccatggacgtcgtctacgcgctcaagcgccagggccgcaccctttacggcttcggcggctagggcgctaggctaggccatgctcgacccgccccccactctccgctctggcgtcgtcactggttccttgacccctgtgcgggtcggtcggtggtgctagggtcagcagttgtctggtgtctgtagcctctctggctatccgctctttggtgtgaaatggaatttccaaatccgtgtaatgggaatgggatctctgttg

SEQ ID NO: 15509 - DNA, 591 bp, Zea mays
  Clone ID: LIB3279-225-Q6-K6-H4
cggctatcgggcatcggctgggtccctgagagatgaacaccgtgctcactgctcacggcggccggcggctccctagcggcggccggcggcagaccggcagtgtgctagtgcggcagaccggcagcggcagtgcaggcggctgaccctctccctcaggccttcactcccttggcggcgcgccggcgcggcaagctggcaagctcttggccgtcggagacagtggcagtggtttgcatcaccctcactcccttcatcccttgcttgttgctttgcttgatctactagttcatgaacttgttaatctatttcaggttttttatttctatttgtaatgtcaactccgggagacagtggcagtggtgctggacctactagtggtggtggtcgacgcgattctagagctccaactccatcatctacgccacgagatcctactcctacaccatctgatggaatagcgcctactcctactgatggtcaaggtactggaaccaccaacactgatgctgttgaaatagatgaggatgttagggttggtagtaaaaggaagcttaaatctgatgtatggcaagactttgaaagagtctgtgt

SEQ ID NO: 15510 - DNA, 293 bp, Zea mays
  unsure (1)..(293): unsure at all n locations; Clone ID: LIB3279-225-Q6-K6-H5
accccgcgtccttgtctctcgtccctctccctcttctctgtggtgtgcctgcccngttgcgcgagccggtgagcccttgctggccgccgccgtggcgtccttggttcttcgtgccggtgtcgccgctcgtgtttccttccttcgtcctcgccgctgcggcggcggtttgttttccggcttgcggtttgggtggggggggtgcggcgtgcggctcgcgcttttttcgtccgcggcgggttgtccctgcgcgttcggggccgtttgccttcctgtcgttggtcgctgcccgggcc

SEQ ID NO: 15511 - DNA, 547 bp, Zea mays
  Clone ID: LIB3279-225-Q6-K6-H6
gtttaatcgcgcaggtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgatttctaccagcttgccggagttgtggccgtcgaggtcaccggtgggcctgagatccccttccaccccggcagggaggacaagcctcagccgccacctgagggccgtcttcctgatgccaccaagggttctgaccacctgaggcaagtctttggcaagcagatgggtttgagtgatcaggacattgttgccctctctggtggccacaccttgggaaggtgccacaaagagcggtctggttttgagggggcctggactacgaaccctttggtctttgacaactcttacttcaaggaacttctgagtggcgacaaggagggccttcttcagctcccaagtgacaaagccctgctgagcgaccctgtcttcc

SEQ ID NO: 15512 - DNA, 581 bp, Zea mays
  Clone ID: LIB3279-225-Q6-K6-H8
tgtcgacggactatcgccagtggcgatcaccctccctgtcccctgaccgcggcgtcccctgctcgcgccgcaccggtggcgacaaggcaccccttgcctgctcccctagacgcgagcgagcgagccaacacctgtcggcacaagaatggatgggaatgctgagacgatccaattctcatggggcaagcgtcgagggaaaggtggtgctaagatggatacacagttctttgggtccttcacattggacaatgtgaagtattcactgtttgactgtgtctatctatttaagcatggtgatcctgaaccgtacattggaaaaatagtgaagatctggaagaaaggctaccaatatatatgtagcgtcagtcgtaggatcctggtagacatatttgtgcgttgttggtctgtcaagtcggtgcgcgtcacattgtaccgggtggtttctgtccgagtatgtcttgaacagcaaaacttgggtcatttatcttggtattttttcccagaaaaaaaaatcataaaaaattaaaaaaaaaaagccggtccatccgtaccgcctttccctcggccctccccgtagaatt

SEQ ID NO: 15513 - DNA, 603 bp, Zea mays
  unsure (1)..(603): unsure at all n locations; Clone ID: LIB3279-225-Q6-K6-H9
cggttccagatgagnaaaaacaaacatttagnaagcaattggnagcagtntgagaatggcaaaaaatgcatttacacaccgagaccttattccaagcacccaggcttgagaatgctaagggctggtggatgccccttttatcaacagggcaaaagttgcagggcggtacttcgaaacatggaaatatgagctcgnccactgtattaccttttctgatgcacaagaagattggtgagggtnggctatgtggaatgtatacagggtgttccctctgaccacaccgcaagtagctgttaaagttgttgaacaagattcgatcaacaagattgatgagttcttgagagaggtggagattctcggccaacttcaccatcccaacttggttttactgcttggcttttgtcctgaaattggatgccttgtgtntgaatacatggagaacgggagtttagaagatctacttatcaacgataaagggcagccactccattggtttcttcggttccaaattatctttgatgtggcttgtgggcttgctttcttgcatgggacgaaaccagaacccattgtccatcgtgacctaaagcctgggaacatcttgct

SEQ ID NO: 15514 - DNA, 589 bp, Zea mays
  Clone ID: LIB3279-225-Q6-N6-A1
cttgtgccaaccaagcacggcatagttagcttccacatgcccaaaatacagtgagttttcttgtgccaatcaagcacggcatagttaacttccacatgcccaaaatactgcgacttgcaacatgaaccgaacaagacagtcatatgtagttgatggaaacgcataaaaatccaaccacaccatatttattagcatatggatggatggattgattggcagaacagaaggggctgcttagtcaccgtgacataggcaactctagatgtcgcggctgcgagcgagctcgaggatatcctcatcactggtgaatgcagaaggagtggtgggggtcacgagcacggccctggccagagggtcgacttcggggctggggctggggctgggctgctggagctcggcgtcggagtcctgagcttggctcctctcaccttcctcgtgcagacccccttccgcggctttcaagtgacccgcttccgaatcggagtctccgagggaggggaaacgctcccgactcggactccccaaggaggggagggagccggagaagggagggaggctgggtgaagggcatggagcacatggcgatgcc

SEQ ID NO: 15515 - DNA, 581 bp, Zea mays
  Clone ID: LIB3279-225-Q6-N6-A10
gaacacaaaatttcccatgctgatggtataagaaatacgacattaaaatcaactaccaaaattgttttaatttacaattctttcaacccaactaaaattactaagcgagcaagatatactgctttacaacttaatcgacgatgtggagagagcccagtctcgtacacatccgtgcagttctgcaactgcagccgatattacacaccggatgcaagcagtgccccttgtacaaaacctaagggcacatgaacgcgaaagcaaaccccaggaaccctggctctggctcaaaagcgcataaatagaacacgaaaggtcaagctgtgaagactcatatgctttacacagttgaggctattttaggttagctatgacgacaacacggactgtagagcgagctgttgctgtggttgtagagaagaccatgtcgaggctaatactgaaggaggcaatgttgcctgaagttgccttagtagattaaccatcctgctggcagtctgttctgttgctagatctttgcccgcacataatatctctgcaaaaacagacacaatctttggaagatactgattattatgacccaa

SEQ ID NO: 15516 - DNA, 412 bp, Zea mays
  Clone ID: LIB3279-225-Q6-N6-A11
accccaaaaacaagaaaaaaaggcccaacaaggccaaaaagaaattttcccaaaacccaaagaaaaaaacagcccggggattcaaacagagcaacttagtttcggggggggcaacaagaccagcaaggcccttaaaaggggcccaagacaaccggctgaaaaaagacaagagcaaggctagccctggattgacaggacgggacaaaagcaaaactgaaccccaccggggacaattagagggcaatccacccaaaaatgccttccgcccgaccgaaggaaacccggggaaccaccaaacaaaggcccacccaccaaagagcccagttatattcctcttcagggatataaacccccacctgccttgaacaatcggccagccgggaggagggaccgcgtgggcatcccccccccc

SEQ ID NO: 15517 - DNA, 310 bp, Zea mays
  unsure (1)..(310): unsure at all n locations; Clone ID: LIB3279-225-Q6-N6-A12
gcgggtgttttttttttgttcttttgggccccttgcgtnggccagctgggaggagcgtggaaccagtcaactgggggacctcgcgcgcccctgggcggggggcgggggtctggccgacgcaaacataccatgggtgggccgcccctgccccgggggggggggggggcgcgcctcgtctggtccgggaccctgggctggggcccgtccccgcactgaacgtgggccgccaggacgggcgtgggcgcgtccggcgtccgggggcgcgccccccccgcgggggggagggggggccgcgccgcgccctggtccc

SEQ ID NO: 15518 - DNA, 512 bp, Zea mays
  Clone ID: LIB3279-225-Q6-N6-A2
gggcaacacaaaacaaaaggcttttaccaaaaacgcttggggacgaagggggccccgaaccaccacacaaaaaagactgggaaagccggttttacactacttcgccaccccggctaaaagcgaacaaacagcataaaggtacaaaagggcctcctccatccccccgccgccactggggccgggcgcgaaaaacccctaccccccctcgccggggatgcggggggcgaactggatgtttttgggcaagaaggggacccccttggcggggaaggcccaaagggtggggtccccaaacaaacccacgagggaggccccggggggttcctggagggccaaaacgggggggctttggaaccccaaaacccccttgaaggcctgagcgaacccacggaccaggggctgggaagggcaacttccgggagagcaggtccgggcccttttgggacttggggatctcgggcaacgccacggggccgggcctggacctgggggggtttttcacccccccgggc

SEQ ID NO: 15519 - DNA, 520 bp, Zea mays
  Clone ID: LIB3279-225-Q6-N6-A3
ccgagcatcactactttaaaaaaatatgaagtttcatttttcaagttacatcagggagctgagcatgtcacgacgggcaccttagcaacaatcagagatcactacccaataagcagggggtgggtttaggccggccaacaataaacaaaataaaaaagactagcatctccggtccagcatggttcacttcacaagcggggaagtcggcggcatgtatatgtctatttcatccaacagggggcgatcacagagcttcaagttgggctcatttgccagatgcagaaggcagatgaaatacaggggtggcgaaatatcagttgctacagcatctgggctgctgcttggaaggtcatgtaacacctgagataggcgcagcggtggtccaggttcctctttttcctgaccagtctcagcagatgcatggatgtgattccaaagcacttcttttaaagcatgaacatccactggtttggataccttgtcatactgggtatcaatcttgttgacctgtctcggttat

SEQ ID NO: 15520 - DNA, 591 bp, Zea mays
  Clone ID: LIB3279-225-Q6-N6-A4
ccaaaccaacttattgataattaatactagaaagtagagagacatgaaagcatagaaaatacagggtccagaatgtaaccacagataatgataagtcaggtaggtacgacacccagcaaccccttgcacgctatagcaaaagccagctcaagccaggtgaatgtctcggtagcaatcctttggtgatacacttcttttccgatttaagttgagatacagtagggttccgtctccaaagccaaggaagttacttggggccaacatccttcaacgcgcagatctgctcctcccccatcgcagactggacagtcacaacaagatccttcccgctttcgaacccttccttaatctgggccacaagagtctcatcagttgggagtctaagatcatccttagtgttgccatctgaagtaagaaggctcacaaatccatcctcagaaatatcaatcagctgatactcagtacggttcacatgcggaatgtcacagttgtgtgatgaaggaacaatatcttcaagctttttcccattgaatatgtctatggcgacaaagtggcatttggcgtggccatgcttaccagtcttggaggtag

SEQ ID NO: 15521 - DNA, 597 bp, Zea mays
  Clone ID: LIB3279-225-Q6-N6-A5
gcaaattgacatatgtcctctatggcaactgagtactccgtagcagtgttgtcctctacagcaacattagtatttaaacgactttctacggttaggcagccgcgggttgcaaccgcacactcacaggtcagctatgtccactaaagttgcagtaagcaagctacaggtcataattctggcagtagttcagaagatgtctagcatcttcaacggtgctttcagtcggtggggcgtcgtcttcgtcttcgcccagggaggacttctccacgatccacctctccatgacacagcagatcgccctgagagatgcggataccccatgcttcaagtaagcgtcctcagctgtcaactcctcttttttgtcaactctgtggctttcaagatcatctttaatgtgtgtgaacctgccaagcaatagagatacaaactgctcgagagatgaagagttcatatcgatctgttgtgcttgtgccagcaaacatggtaagatacaccagagagcgttccgggctttggttatcatcagaaaccagtgcaagaatgtcaaagaggccctccatgaagggtaaatcatgagaaagcctaggcacaatatgc

SEQ ID NO: 15522 - DNA, 578 bp, Zea mays
  Clone ID: LIB3279-225-Q6-N6-A6
catccgccacgttaaacaaaagtaagaaaaaatgcttacagcagtcgccttcctacatactgcaatcaacacagctaaacaaaatcagcgttcaagctgccgctaatgtacatgctagtactgtctgggccagccagagggctcctagcaaaagggcggggtaccaagggacggggtcagcaacaagcctagtcttattaggggggtccaccacgaaacctacaagttactgccttcatcagggggggaatcgacatacaaaacctacttaaactacaggggttccctaagccagacaaggtaagcatgtacaatcttatggggctattgtcgcgtcaaatagacagttattgcctactcgacagaacttctgaacctatatctcaagatgaattgccagcatcagatccatctgaagaggagctatcactgtctgagccactagaagatgatcctgagccactgctggagctgcttgaaatgcttgaactactcgcattctgtctattctcaccattttgttctggtgcaaatgctggcagttgctcgccttccagcgaatctttcacaacttgttt

SEQ ID NO: 15523 - DNA, 487 bp, Zea mays
  Clone ID: LIB3279-225-Q6-N6-A7
gacaagcatgataagttgacattataaaggggatagttgcaaacacgagcccttgcgaaattagacacggttttaaaaagccaacgacgggatcacacgattacaggcgaacacaccaatcagcacaaacatcaccaaatcctttattttagtcactcagggcaaatgcagcctactggtagcagggcactgaacatcaccatcccgtcgtatggattctgggaagggaacagtatcccttcattcaatcttgtcccaatcaatgtcgggggtgatgttgtaggacaacaaaaggccccaatccccgggcaattcctgcgccggggaaagcacaacgtggacctgaacgtaggccgccttgaggcaccggcacgtggcctgcctgtcgggcctggggtcccccgccgcgtacagggtcctcaccccgtcgaaacactggttgttgctctcgctgggtttggctgccttgccctgcaggaagggcagg

SEQ ID NO: 15524 - DNA, 332 bp, Zea mays
  Clone ID: LIB3279-225-Q6-N6-A8
actaaatcttcagatttaaggtaccagctgtaaacacaacattgcatatagtgacatgaattcaaaacatagctaaggcggggtccaattcttggtaaactagatgtaaaatctactggttgatatcagccttcttcttttgccacagcctgtccaaggagctgtctgcgtcaccctgagcacggacaaacccagagagagcaaacgttgtgaagtgaccatcatacaggccattcgcatccaagtggccaatgttgatctggacagaggcatggtccttggcagtgatgatcctgtttgtggccgagcacttcctggggacatagaggtcc

SEQ ID NO: 15525 - DNA, 541 bp, Zea mays
  Clone ID: LIB3279-225-Q6-N6-A9
caccatgtggcaatcttgcttgaggagcaagactgaaccttttatattttgttttcaattcacaatatatataaaaactaatggttgatcaaatgcacaattgcacgttattgagggagtaggaatagtgtattcagaaatttaaaggtgtcaaattggcatctgagcaacaactctaattaacagaggtgaagccaggtcacaagtgagggaaaacaggagaagtgtttcacttgtcagcactgccaaaggaatcagagctttcgttctgagctgaagcatcgaccgaaaatttctgggcttccaaaatcttcatttcccgctcagcatgctctcgctcacactgggtaatgcccatgataatgtccagcatggttccagtagtgccgaagaagacgagtggggctaaggatttcttctttatgcccacaggaatagcaacaagagcacccgcaactgagaagaaccaagttcctagagcattggctactgtgcaatcctccagttgcttttcgccgccgccgacccggtccatcgccgc

SEQ ID NO: 15526 - DNA, 578 bp, Zea mays
  Clone ID: LIB3279-225-Q6-N6-B1
gggcctcttgtaattgtgctgctatgttgtatgccatgtcaagaatgagtattggtaagcattcaagagttcactcaaaacttcaatcgatacaaaacctaataactcagtatattagatgcagacagacttgaactgctacatctgacagggcaccacgtcaggactcgaaattacagcctccttccttttctaccaccctttctgcgtgtgctgtctgtggggactggagtaacatcctcaatacggcctatcttcatgccagatcgagcaagagctctaagagcagactgagcaccagggccaggggttttggtcttgtttccaccagtagcacggagcttaatgtgcaatgcagtaattccaagctccttgcatctttgcgcgacatcctgtgaggcaagcatagcagcataaggcgaggactcatcacgatcagctttaaccttcatgccaccagtgatgcggacgagcgtctcccttccagacagatccgtcacatggatgaaagtgtcgttgaaggaggcgaagatgtgcgcaacgccaaagacgtgttctccctcgcggacagcggggcc

SEQ ID NO: 15527 - DNA, 602 bp, Zea mays
  Clone ID: LIB3279-225-Q6-N6-B10
acaacaaaactggcattccttttcgtcggcaaaattacccgagggggaaaccagaagctattccactgttgaaattgctcaatttgtcatgtctcatttctcgacccctaaggctaagctaatatgccatttacactctctttcttaatatattcttgcgtggctcctttttggtcggtgccatccctgaacccagagaagtcatccctacagcgctctggtataagtcatttaaccttggcatactgatcaccagtgcaaccacagaaactccaacaataagcggaaaaactggtgctggggtcagttcctgcttttgatgacgctcctcagttttatatttgaggggaccaacatggatttggggatccttttccagatctacttcgactaactccgattcaaacctatgtgtatgtgatggaaggccagatcgaagctgaacaagatgcttgcccttgggcaaatctcggacttcaaagtagtatgaaagaggaagaggaagtacagcttctactctagaagagtctgttgctgatctgatttcaacagagagatgcggatgtaacgtatcaatgccatctccttccacatggccactc

SEQ ID NO: 15528 - DNA, 479 bp, Zea mays
  Clone ID: LIB3279-225-Q6-N6-B11
aaaaaggggaaaaaataaaaagggggggtttttttggggggggggttgggggggagggagggcccccaggggaaaaaaaatagaacaattgggagatttgaaaattcggggaccccggggggggggcccccccaaaaaaagccctcgggggaaaaaaacgggggaagccaaagttttccttgtttgggaaaaacccaagggggggaaaaaccaaaaaaaaatttttcttttgtttgggggggccttttaaaaaagggcccggccccgggggccaccccgggaattcgggccgggatccggggggggacccagttttcccaaaaggggggccaaaaaaggggggggaaaaaaaggggaaaaattggggccgggggaaaaatgtttggggataaaattcccccaaaaaaaccccccgaaaaaaaaaggggaaaacccgggggggccaaagggggggccaaacacaaaaaaaaggggcgggc

SEQ ID NO: 15529 - DNA, 616 bp, Zea mays
  Clone ID: LIB3279-225-Q6-N6-B3
gatcgatcagtgctctggtagatatagtagtggttttgattgtttggttctgcccttggctcgtttcattcctgagctactttagcatgcaaacattaaacattctttctacagccttactaactaggccttactaacacaaaacatggagctcgatcctgatgcgcacgcacatcagctagcagaagaacatggagctcctgactttgtcatgcaggcgaggcagctccggcacaggagcactgccagccgaggtatgccctcctccctggctggaggacgcgtctgacatctcctccaatctcaggaacgtgctcacctgggctgcagcgaggtgggcgtagcacactggagcaaccactgagatggctgtcgtgctcctctggtacacgtaagagagcgaatgaacaaactcctgcatctcgtcggcattaaaacctatctcgtcgtgcagaacatgatagtgggtgggccttgttgttccaatcatcccagcatgtgcacacatgtagaagtcgaagttcttaggatggcaaactttactatccaccacagttccaggaagaacattgtctggtgatgccgtctgaaagaattggtgtgatggttcttttga

SEQ ID NO: 15530 - DNA, 606 bp, Zea mays
  Clone ID: LIB3279-225-Q6-N6-B4
ggagtgtaaattaatttaatttaccccctaatccaccttaatacacgtagatagattgaggtgaatgagtttaccacacaggagctcctcgagggcctacagaatttaccatctgtcaagggatttacattacatccatgtctgaaaacaagtcgctaacaacaagaagcatgagctaggtgatgagctcgacgccgaagtcccagagcctcttggccaactccatgtccttggcgttcgcgcttggctcgtacaggttacagtcgcagaagtacttcccggacacgcccttcacatgcgggtggagtgccaaatagcatgtagttgccgcaccctgctcagcatttttcagcaccaatttacccagcgtccgatggagaacatctaggatactgtggtagcgaagaaggttcgtgataatggaaccaggatgaagagaatttgcagttatgttgacattatcttcctcaaatcgcctggcaagttcattagcatgcaatatgtttgcaagctttgattgcccatatgcaccaatgctactatacactgattcatcgttgatcttgtcaaaacgattccttcccgatatgcaagtctgtgccccta

SEQ ID NO: 15531 - DNA, 610 bp, Zea mays
  Clone ID: LIB3279-225-Q6-N6-B5
acatcaagccacggctactgattttattgggcgtttatgtactcgaacgaaccaaatgctgacatcgaactacaacaaatgagataaacaaaactgtccaccaacatggcaacatgcccaaccgatcaactcaagcacacataaaaacatcacctactcgtgacacaggatcacggatcaccatagagggaacatttgcacgggcacgaacgggaacggagctggaccgcacaggggaaacactgaggcaatggtgcctacaggacttgcagcacaccggcccagacagggtagatgaagagcagaaggatgccgatggagttggacacaccattgcccttcctgaaggcgttcctgaatccacctgacgccttgatgtgttcttggagcaggtagcatccgatcacaaggcatatgaagacaccaacgaggtctcccctgaagctgtccgcgaacaggctaggggcgaccactgtgagcaggatgatggaaccaggaagctctaaccaatctgggaagtgtcgtggaaagaatagacgcagaataacagcaataatcgcaatccatttccccacctctcctctgatcagagaaaacagcacattaggca

SEQ ID NO: 15532 - DNA, 604 bp, Zea mays
  unsure (1)..(604): unsure at all n locations; Clone ID: LIB3279-225-Q6-N6-B6
gaagtccaataactatattcaatagctgccagttactcagtttggcagaggaagatcacaaaattttctgcttggtatcaatgtattgcactctctgacattagcatcctccagaaatatttaacaacaaagatgaaggtaaaaatatactgcatgcactggaactatttccgcaatgctccttttaagtggcgtcatgtggctaactaatctttccaaccatctttcgccgatcgcctcggggcgagacctttggacgaagggttgggcagaggcttggatggcgtcaccggagcttcctcgtcgtcccagtcatctccccagttgtcgtcccacttgtcagaccgatcgtcatgttctttcttgcctccaaccgaaaccggcaagtctgacatgtctagcttctgatacgcagggtcgccgtcctggttgcgccacctccggaccacgatgcacactgccaccgcaacgaggagaaggaagactggcagtagcgtgtatgttggcgtaagtggcatccttatgactctgccactgccagccgtctcccttgtgattgcactgtgaatgctgatgttgcaggatttttccgnacgcgtgggtc

SEQ ID NO: 15533 - DNA, 588 bp, Zea mays
  Clone ID: LIB3279-225-Q6-N6-B7
atgcactagatactgaatatttagactcgaataagtatcaaatatcagtccacttcgacaaatcgacctcttcgaaaaacaaatttaaatacatacagataatattcgtaatatctaagtacatcctagttccctactgtcattggcatggctcggccagcctgcggagtgcggaccggaccgcgtcaaatgacacgtgaacctaagcgcgggacaaggacagtcgtcgccgacgtaccatccggcacggcgcgtgggccctctcctctaccccttgccaaagccgctcggaggtcgaaacgtgtcccacaaagggcggggtgacctcacctgcacgacggcggggctgtgtgtgcacagtgcagtactgctgtacagtagctgtactgcacccctgcggccctgcccatggtgccgtccgtgggcccgccgcgcgtggcactggtttggttgctactgtacggcacagcgtgacgcaccacgcacgagcacgaatgcacgatccccctacctcctctcgagcccgacccccaccccacgatgtcacggccttgctgcgcttgccgccatggatgggcccatcgcgcg

SEQ ID NO: 15534 - DNA, 540 bp, Zea mays
  Clone ID: LIB3279-225-Q6-N6-B8
acgaaaactgtcaaatatctcaatatctctttttataattgattagttctgcgaatagatcttaaacaggttgagtcaggtcgaccaagaacacacacatcgaccaactacttgttcttcccggacctcttcttaccccctgccgcgggggcggcgctgacctggggccgcgggtggcgctcggcctcggcagcgtcgagccacttgagcgggttacggttgtagaaaggccagttggggacggtgaccagagccgtgagcacgacgccgccggcgtagacgagcagcatgagctggaagtccgcgcgcacgtagcccaccaggaacgccaccaccgcagacgccaccagcagcacctgcatcagcatctccgcgcgtttctgccccagccaatccataatcctctggcgggtgctcgtcgctggagaagggcccgaaaatggagaattgggcacctgacgtagggcggcaacggagagaagaaaacagagcgcacgagagtggaacggtagaagtgtagaatcacgagatgggaaacgc

SEQ ID NO: 15535 - DNA, 597 bp, Zea mays
  Clone ID: LIB3279-225-Q6-N6-B9
gagcagtaacggtacgttttgctttggaccagaaggaccagtagccaaagggtccggactaataacattgactactcgttcacacaaaggggtcactgggtaacagccccaactaaggctactcgcccttgctatgaaaacagaacagcctaatcattcatcgcacaacaatcagaaaactaacagaaacattctggtacattttttttctgtatctcaggaaggcgcagatgtgcagctaggttatcctcacaatggtacgatataagtctcccggtcaccagagtctctccacgccctcgggatcctatgatttctggattggaaggtagagcttgaactcaggcggcagctcctcctccgagtagaggcggtcagagaagtagattctgcggagccggcagttcgcatgaacttgcacccgcagcgtctcgacgtaatttgtgccgtacgccctttttgtcagatcagcaaggttcaactggatgttgttccagccatcgtcgagtttcaacggcatcgtgcagatatatggcttcacccttgtgacagattgaaaatttgatgctcgaaatcgacgtcggacattcttgtcat

SEQ ID NO: 15536 - DNA, 559 bp, Zea mays
  Clone ID: LIB3279-225-Q6-N6-C1
agctgcgaacaaaaccttgctcattcttctctcgtctcgtttcatagcgggagcaaccaaagggaacaacaggggtaccaacacctaatccaaaggtagaacggacactaacacggtgacagaagcgaacggtaacacgatactatagatagataagataactcggccgaagccaggatgggcccacacatcagtccctccagccgccgccgccgccgccgtagccgccaccaccaccctcgcgccgaccgccgtagccgccaccgcctccgtagccgccgccaccaccctcgcgccgaccgccgtagccgccaccgccgccataaccgccgtcacggcgcccgccaccatagccgccgccgccgcgaccgccgccgtagccaccgccgccaccgccaccgccacgggactgggcctggttaacggtgatgttacggccgtcgagctccttgccgttcatgttctcgatagcgtcgagcatggagttctcggaggagaaggtaacgaagccgaagccgcgagacctccccgtctcccggtcggtgatgaccttggagtc

SEQ ID NO: 15537 - DNA, 346 bp, Zea mays
  unsure (1)..(346): unsure at all n locations; Clone ID: LIB3279-225-Q6-N6-C10
gaaggcgccgnngaactgttcaatnntgacaaaaaaaaagaagtgaatgtgtggttacaattatgacgtaaaaaatcgacatgtctctctgactacaaaagcagtgaagagcttatttgcagcacaaccaagtcaaggggtgggtggggccggaaggtgctatctcggttatgcacttgagtctgcagcggttcccttggctcgctccgcttcgatcatagccttgatgtagaattcacctgccttgtacgaagaccggaccattggcccagacgcaacgtagcgaaacccctgtgccatttgcaacaaaagataaggcggttctgtcagcnaacccccccccccc

SEQ ID NO: 15538 - DNA, 589 bp, Zea mays
  Clone ID: LIB3279-225-Q6-N6-C11
acaggacagaatataacatattgcagttaattttggttacaataataagagcagagcaccaaattcacagtgcactgctttccctgacgagaacatggtcccggcatgatcaccaccaccagttcgaaagtttattgctgtatgttttgacaggtcaaaatggtaaatgtgtaaaaaaggtgtcgaacgactgctatacccccatcactgagggaatgatccacgtgttgaactaaaataaacagcccacaggtctggccggacaagaggcgccatcaacttcaacttacctgctgtagatacacgaccctactttgtagctaaacaagagaatcatggccgacataaagaaaaggtaaaaaccactgcgcagcaccatgggaacggtgctaatccgagtagcacgcccaagaccaacagggagcttggatgccacgtcgccctccacagcaaaagagacaagcaaactcaagtctccattcttctgcaagggccactgaccggagccgctgctgaaagtgaggccatcaagttggatgataccagcagtaaaacgaattgagctcgagctgacagccgaaagcatccc

SEQ ID NO: 15539 - DNA, 327 bp, Zea mays
  unsure (1)..(327): unsure at all n locations; Clone ID: LIB3279-225-Q6-N6-C12
tttgtaaaatgggtgtggataattttttatggttaaagaagtatgtggaagattaagnagggagggaaaaaggaaaattggttttttttatgattgggtgatagagtggggggggggggggatgttttntatntttgagggnagttttgggtgggtggttttttggtgggtggtagtggagaggtaaggtntgggtttggttgttggtggaggtgttggttggggnttgtggtggttagtattgggtaaggtgggttggagggttgngggtgattttggaggtggtgttattgaaggggggaggtgttgntggtgattgtgtgatgg

SEQ ID NO: 15540 - DNA, 529 bp, Zea mays
  unsure (1)..(529): unsure at all n locations; Clone ID: LIB3279-225-Q6-N6-C3
gacaggggaacaacatatcaatatcattggacaaaaatagctgcgaacaaaaaccttgctcattcttctctcgtctcgtttcatagcgggagcaaccaaagggaacaacaggggtaccaacacctaatccaaaggtagaacggacactaacacggtgacagaagcgaacggtaacacgatactatagatagataagataactcggccgaagccaggatgggcccacacatcagtccctccagccgccgccgccgccgccgtagccgccaccaccaccctcgcgccgaccgccgtagccgccaccgcctccgtagccgccgccaccaccctcgcgccgaccgccgtagccgccaccgccgccataaccgccgtcacggcgcccgccaccatagccgccgccgccgcgaccgccgccgtagccaccgccgccaccgccaccgncacgggactgggcctggttaacggtgatgttacggccgtcgagctccttgccgttcatgttctcgatagcgtcgagcatggagttctc

SEQ ID NO: 15541 - DNA, 585 bp, Zea mays
  Clone ID: LIB3279-225-Q6-N6-C4
agtacacaacgagctctgattgctgaagatcttctcgatgaagacgaacatacaataagacacaaggacgaaactagagcaggacacatcccatccacagatctagacacgagcatgctacagcacacagtgcaaatgaagtccctactttctaagccttcttgggggacttggcgcccttcttgggggacttgggctccttgctgccggcgctggccgccttctccgccgccttcttgggcaggagcacggagtggatgttggggaggacgccgccgtgcgcgatggtgacgcctgccagcagcttcccgagctcctcgtcgttgcggatcgccaggagcacgtggcgcgggatgatgcgcgtcttcttgttgtctttcgccgcgttccctgccaactccagaacctcggcggcgaggtactccaggacggcggcgaggtagacgggggcgccagtgcccacgcgctgcgcgtaccggcccttcttcaggtagcgcccgatccggccgacggggaactgcagcccggccttgacggaccgcgtcaccgacttcttcctggggccgcctgccttgcgcccggccg

SEQ ID NO: 15542 - DNA, 547 bp, Zea mays
  Clone ID: LIB3279-225-Q6-N6-C5
aacactgccaagttaaagcgttcttgtttggcaggaatgaaatatagaagcgtcatttttcttctcgaatcatgtcattggcagtaaagtacctaaagcacgatttgggtcaaaccagcacggggggccacgagcaagatctaaacacgttctgtcagtataatcgggccaggcagacccaagacatttaaattacaaaaataaactaaaatgatcgcagatatgggtttagctccaaacatacattgacacccacctaactacactccattccacggaaaccttgctcatggctagatcccacacaggatcaaaaaccttgcattgtcggcagcagcagatgctctaccaaaacaagagcagcaacacgagatttgctgctggcaaacatcacatccattgtacggttagtagctctggaggatggcggggggttattgcgaggcctccttttgtcattcaacttccattctccactttcatcaggaggttggaggggggatgctttgctgcatagaccaatccagtacccccgtccatttgatgc

SEQ ID NO: 15543 - DNA, 594 bp, Zea mays
  Clone ID: LIB3279-225-Q6-N6-C6
aaaaaaaaacttgttaccagaataaccaaaaccttgtggaacattaattagctgctactcttcctacacctctgtgccaccaagacacacacagtcaccctactctaccagcatcaattcctgtctcaaacaaagcaaagcaaagcaaagcaatccatcattctgttctgcacattgaaaaacaatcataatagcctgctgagagacttgatcagaagcttgatgttctgccttgtcgtctcatcacccgtgaacccagagatgtccgagctgatactctcaatgttcttcagggtaaatataagggtgaaaatagactgcttaataagatccgtgttctctggggtgagcatggacgacttcagccttcttaggtcaacagacgcgtcggccaggcctttagctatagtctccacatccttcagcagatcactatcacggacttcagagagcaaaggttgcatttcttcagctaaatcctcaatccgtgtaagaagaggttgtgcctcttccattatagatgcaaccttttcagccaacttatagcttttgctaacgccaatctcctccatgtctctacctagtcgggtaaat

SEQ ID NO: 15544 - DNA, 563 bp, Zea mays
  Clone ID: LIB3279-225-Q6-N6-C7
gagacaaaaacaatgtaaaagtagtagaagccggtacagattagtcaagtgaacagaccctatattctccagaggaaccatacagggacagtcacatcaagcatgaatgcgtaataactacttaaccccactcaagttcttacaggaaaactgtttttgacagcaaaaagacttgtgtcaaatgttattttacgcatttacagactcagaactaagacgatcaatcatggaaaattagctcatgtagccgcacatctcactcggtttcatttgagaacaagcttggtgactttgtgattatatcattcgcctcaggtagcggggaatcctttgcatcagctgcataaagtattttccggaccgccttagtcatcggtagatgctctaactcaggccgttgacacagtatctcaatatcacgcaacttcgagaagtagaagtctctttctttttcagtactatcgacagaaactttcaggtctgcaatcttttcagacaacttctgaatctgttctatgtaatgctcttcaaaaaagtgttacatactttcccaactccatggc

SEQ ID NO: 15545 - DNA, 583 bp, Zea mays
  Clone ID: LIB3279-225-Q6-N6-C8
gatcaacaaataccacgttgttggctgaattattctgattttgaataactagtttgggagctccatgcaacacaggatttcttttttaactaggagtacaatttattatcttgtgaagccaatagcgcaatcgtacagtttagtctagcgatctgacaacctgacgtgcaccattaccaccatagtgataaaattcacaagaacgcggagatggaagacgtcttggctcctcttcacagctccagcttgctggccaggtaccaggagtgcatggccaagctaccaaacgacatgatgttggccagtgatgacagcccgtggatcatcccaaacttcttgttcattgcagcaagggtggggttggatttagccacctgctgattctttgaccatcccacttcctcaccgatactcaggtcccgctcaatcttgtgcctcttcttcatcatctcaattgtcatgggggtgaagactagcaggttggagagattgcaaccgagcgctgataggaggaatccaagctggtagcgctccacggtggacgccgtcttccacgggtggaggtgcgaagaggcggcgaccg

SEQ ID NO: 15546 - DNA, 519 bp, Zea mays
  Clone ID: LIB3279-225-Q6-N6-D1
ggaagcaaccaccaccacggcaccactaagcatatatgtgcttgcagcatagtaacagcatttcctattcattaacgactcaaatatacagggccatgcacttgctgacttgcatcacaaaggagaaaaacagggcgggggggtgatctctttttggtcacggggctataaaaaccgggggattttgtaaatacagaacgactaatatacatagcaccgttggggataagggtttatcggcctttttcgtttacaagtctcactgatccctgtcacgaacacaataaattggctggggcgtccacttgaaaagcaagtttagttttcccgatttggcaccttgcaagacaaaggtatcttggaattcaccttcgagtataactctcgtcagggtcaagaagcacctccctatgtaatcctttccaaaagtatcatgggcccatacttccaccatgagcaaatcatgcagtgcattttctaccatgaaatcaaatggctggttccatattggatttagcg

SEQ ID NO: 15547 - DNA, 568 bp, Zea mays
  Clone ID: LIB3279-225-Q6-N6-D10
caaaacgagttgaatcttcaaaccacccaagtcttagcgtcaaaacttaaaacacagattcttacgatcacatacactgaccacagctaaatcacatgaacaggttgggcctcgaagccttgaacgtggtcttcagcttcctggtcgggggcctgaccttgcggtacacgagtgggaacttgatctcactgttgtgaaactgcttggggttgtccctcttgcacagcttgaagtgtactggggcggtcttgatgatctggatgcagggggacctcacgcggtggcgagaagccatctcattgtacatctgctctacagcgccgttcagggttgtgtcgcggtactccttgtacatgttgtggtagccggttctgctctggtagcgcagccagatgccatagttcttgatcgtcgtcgggttacgctcgaagatctcgttgatggccaggacctgaccgttgctttttttaacctttttcaacttcctcaggaagtaccagaacttgctcttggcgcggacttcgttggtggcccagagcttaatgcggtaaatcttggggtgcttgtc

SEQ ID NO: 15548 - DNA, 433 bp, Zea mays
  Clone ID: LIB3279-225-Q6-N6-D11
attccgaaggacccattttattccggaaacagatgcccaggctttctccgggtcctctgatagaagcaaacataggttcacagttcagacttgacttacaaacagtcgcacaaaacatacagcactctgttctaactcgggacacgaaatcctctctttctctctccctctccctctccgctcactgcctcaatctaggaagactgccggagctccgggcgcacaaagtcggcgttggcaggcacagagatgtcgacggtgggcctcagctcggcgcagacctcaatggcaccatggacagggtccgacaagaagttgctgatgaggtcctggttgatcggggcgtccttgtccaccgccacaaaggcctgctgcgtcaggatgtagtcgaagcgaggcgcccacttcctggatcccaggcgagccgttgtgg

SEQ ID NO: 15549 - DNA, 350 bp, Zea mays
  Clone ID: LIB3279-225-Q6-N6-D2
cgagtaccatgacaatacattactacgcttcagatccaaggctatttacagcgctccgcaaggaaaaggattggccaagcaggcgcaccagcggtttcttgcctgctttctcctgctctgctacaacttacccccaggcgggtcagcacacagagcagggcacacaccccccaaaaaaatccagcttacgacgggaaactagcaccaggagaagcaccatctacaaactgggtaccgcggggcttttacccggaggcatacacacaaaattacctacctactacacaccactgaaacacacccctttctcgttcttccggtcactctgacacgtggccttttgtctgctt

SEQ ID NO: 15550 - DNA, 322 bp, Zea mays; identical to SEQ ID NO: 14754
  Clone ID: LIB3279-225-Q6-N6-D3

SEQ ID NO: 15551 - DNA, 368 bp, Zea mays
  Clone ID: LIB3279-225-Q6-N6-D4
ggcagacctagccgccgaagccatagagggtgcggccctggcgcttaagggcgtagacgacgtccatggcggtgacggtcttacggcgcgcgtgctcggtgtaggtgacggcgtcgcggatgacgttctccaggaagatcttgagcacgccgcgggtctcctcgtagatgagccccgagatgcgcttcacgccgccccgccgcgccagcctccggatcgccggcttcgtgatcccctggatgttgtcgcgcagcaccttccggtgacgcttcgcgccgcccttgcccaggcccttgccgcccttgccgcgccccgacatcttagccgcggagacgagaggattggggaatttttgcttgctggttggt

SEQ ID NO: 15552 - DNA, 613 bp, Zea mays
  Clone ID: LIB3279-225-Q6-N6-D5
aagaagcttgacagtcaattcagtggtcaaaagttcagccctttacaacaggtatagattttcaactaattttacaaccttaagcctccggatcatgtaaagaccgaaatccccacgagacgattcagactccagggtagaagcattgtctactcaaacttgtatgttttctggtggttcaaccatccacgaggaaagtcacaactattcagatgttactaggaagcttgcccccgttaatcaatggcaattatgaggaaaccaactgagatatacatgaggaagacaggatatagggccagagcttttctccttgggttaacagcagcactcatgaatggataggcagcccaggagctccatgccaatgtgattgtcaccacgacaatcttaagtatcacgttgtccttcagcatgcaaagtagagcaccaacgtccagtggaaacaggcaataaccaagaagactaaggctttggaagaagatgatgtgtccacccagaagcagaacattcaaggtcagaattatagccccagctgccaggacagcaaatgcaacagcaaatacttcagactacattgacaaacaaagcaggatcattaatttgcacacta

SEQ ID NO: 15553 - DNA, 529 bp, Zea mays
  Clone ID: LIB3279-225-Q6-N6-D6
cgagacaccttcaatatttatgcaaagaattgtgcatgtaaatcgtataattcatctacaacaaatggatatatgttgttgttgctgctccagatgacacggtccatcctctgcttcatggtgattaccgagtgcgcaggcaagccaaccaaagccccaaatcccactcatggacagaacttaattctgtctactgtcgaggcactgcaataaggatgaaatgaaagtgctgccaaaacttctcgactcgatgttttcgaaatttttccagtcctttctcccttgctactccaagagaaccaactgcaacaaaatcatcgtaggatacctgaggtatggtattaatgattgtacgattagtaaatatcaaacataaaaaagcaggtaacagtatatccaaattccgtagaggtgaagtattgccattgtatctgagaaatatcataacatgtaaactgaaatctgaaacttcgtcattcaattctcatcgttatgtacagcttacagtttcaactctaataaatccttt

SEQ ID NO: 15554 - DNA, 635 bp, Zea mays
  Clone ID: LIB3279-225-Q6-N6-D7
aacatcatcctcgccatctagagctcgtcgtgctgcttctcatcatcagaatccttgctatcctcggcatcagagtcggccttgtcctcgtctgccttctcatcgtcttcctcatcctctaggtcatcatcctcatcatccccacccttggcggcatcctcttcttccttctttttctcggcctcatcaaaagcagccttttctgcctccttgtgcttgccccaagtctcctctgcaaaagtcttggccaacgcagggtcatcagtgatgatgatgttgtcaaacagagtgcccgatttaacctgccacagctcaatgccaatgtacttcaagctgtcgaaggcgtaaatgtatggatcatccttaaaatctgggttgtcaatcataggtgccttccatttaccctggtagttcgggttcttgattttcttttgtttccatggtcccttgtattctgggttgggaatggtaggggcagtccattcaccatcttcctcatcgtcccagtcctcaggcttcttagcatcagggtcaggaatttccttgggaatatcatcatagccctctggcttcttgtcctcagggtcaggaatgtactccttgtcatcccagtcctcaggcttcttagcctctgg

SEQ ID NO: 15555 - DNA, 485 bp, Zea mays
  Clone ID: LIB3279-225-Q6-N6-D8
aaaaaaaaaaaaattttatttaagggaaaacaaaggaacgggcccagggggccggcccggaaacccacgggggccatctaaaagaaacgctggacatccccccaggcaggtgggtcctgggggggacaaaaacgggcagagcgccccacgggaaacggaggggccgggcctattcaaaggaaaattaaacgggaagggggcgaatcacaggtgggggcccgggtctaaattccaagggccccaaaaaaggaagggattgggcttaaaaaaaaaacccccccatccaaaacccaggaaaaaaaaatggggggtggaaaactacggcccaaagctttgaaaaaaaaacggggcaaacagggccagggggaaccgaaggggtttttgagctggtggcgggggcaaaaatgcaaaaacggggacttctttggtctcggttttcttggaaactaaaaaaaagcgctggatctcttgcagggggggaggaa

SEQ ID NO: 15556 - DNA, 587 bp, Zea mays
  Clone ID: LIB3279-225-Q6-N6-D9
gattgcccaagtaaatcgaatgtcattcaataaattataaatcccaaatctaggtttaaacaaaacaaggatgaaactccggggtctacagccattggcttcaggtaagtgccatgtaccacctatagtataaattcccacatgtgtgttgataatgggaaggtgtaacatgcttgtaaccagttgctagtctttgggtgcatggtgtggttagatgacaaccacttgcccttagtgccggctaccggattttccctagggagggaaaatgcagccatgtcttaggcgtccagtgctgttttcttgcagattgggcacacattttttataaccagccattgtttgatgcatgcggtgtggaagtcgtgaccacagtccagtctgcccaagtcctcgccttccgcgtagtcttcctggcaaatacaacatggttcaacacctgttggaggatcttccaatgatattaagacatatttccgttgttttaagttacttaggattttttcctcactaagtcctgtgtttacgtacccaatgcgttcacctagtgcgagcaattcctcataggacatattatccacatcaag

SEQ ID NO: 15557 - DNA, 612 bp, Zea mays
  Clone ID: LIB3279-225-Q6-N6-E1
agcttattaaatgcttaacttatattacagctaatcaatcgttacataaaagttaaacatcactaatacatctgtgtcagtacaaggacgaaacataaaacgaactcaaacaaagtcagcacaagcttggtcgtctcttcaaacactgtaaaataaaataaagaacaaagatatcgaactgcccagttcatcaaacagccagccaacgcaggtgacacgacggttagggtggcaaagaacacgatgagatggtaaatggataagaaagatgcacaaacttgcagatatttcttagcatcctttctctgtgtacgcatttctgctgttgtgtgccttgatccatttcaacgcgttgcagtaatgcacaccaataaaacatcgaccttggagtttactctctggtggaagcagaaagctcatcccttgtcaggtttgaacataatttccaggtcatctcagtggtacccactccatcctcttcctcttcctcggccacccctgccccgacctcttccactgcctcttccaacatgagacagtccttcaaaagctctgttcactagctggttttgcattcctcctctccccttcttgtttgcagggtcattccca

SEQ ID NO: 15558 - DNA, 468 bp, Zea mays
  Clone ID: LIB3279-225-Q6-N6-E10
agccccaaacaggatttatccttaattggggggaataattagaaccattttgacaaaacataagccacagtttacaaagatcagcaatcatgtttacattgacaaaacattcaggggatcacaatttggaaaaaaactttattacccgtcagccaaaaaatagccaacatgggaacatgggaaactgggcattgacggggccaaactttttgagaaggcccaagttccgctcaggcgtttgcttccacaaggacaaaaactggcctgtccccaagcttggtttggcccttcagttttggcaatttaatgacacaagcacacttaacaacctttggtccaacacgttcaataagtttgacagctgcacatagggttccaccgggagcaataaaaacattgactacaaaagcccgggcgttggcctgtacagctccaacatgcatttctattttggcaggtccatattcc

SEQ ID NO: 15559 - DNA, 597 bp, Zea mays
  Clone ID: LIB3279-225-Q6-N6-E11
aaagaaaaggagggagtaatatttagtcaaagtttacaatatttggcttctatgaagaaaaaatatcaactattttattttaggacggaggtagcagttttttttttataacggaggaaccataaccaatctctactgttccattccaggtaccaggtgaaagcaactcttccggaactacagtacatcagtagccgacatacactgcagcgttgactatgtagcagtcatcgttcttatcccccattgcttccaggcacacgccgcttgaacagatcatgccaccgtcaacgacctcaaagctgattatcttgccataggggaagacggccttgactctctcagcatccagcaagtgctgcgtcgacctaggcactccgagcttgatctgcagcttcatctggtccgtgttcactccgggaatggacccgccgcggaaggcggggatggagttggaggtgatggcgtccttgcaggcgcgcacggcggcggcggttatatcttggccgtgctgatcgtagccgacgcccatctccacgaacagtagcttcatggccggctccgcccctccctgggcgttgctcgcctggggctggg

SEQ ID NO: 15560 - DNA, 575 bp, Zea mays
  Clone ID: LIB3279-225-Q6-N6-E12
ggcacagccctgaattaagcatttcaaacacgatcaaccaacacgataaaataaccacagctcaaactccagagagaacatacccacaaacacacaacatcacaattgatcggggtagctgtcctttgttcccattttggtagccaggcactgagccggatttgaaccattgggccatcccaaacactaggcgaagctgaacaaaatggtaccttgcgtgctcaggctcggctctggagatctcaatgcttctgaagcatgtccctgaaccagtaggccgacgccttcgggtggcgttcgagcgtgttgaagtccacgtagacgatgccgaacttggacgagtaccctgccagccactcgaagttgtcgaggagagaccaggcgaagtagccagccacgttcgctccctggtctatggccttcttcagctggccgatgtagctcctgtagaaccgcaccctcttggcgccgcgcaggtactggtctcgggtcaagtttccaggctggtccatttcgttttccggtttgtagatcggtggattcccatacttttccttgggggagttcacgcaccc

SEQ ID NO: 15561 - DNA, 511 bp, Zea mays
  Clone ID: LIB3279-225-Q6-N6-E2
aaaaaaacattatagtttatatcagggggggccaaaggaatccgggatatatattacatttggcccctcggtttgcccaaaggggaaagggagagggcaatccctattcatcaggagaaggatggcagggcccggtcatctatttataggcaggggacccaccccgggcaaaaaacatttatgaccctgacatatacccataatcctaatacaaacattagggaaaaacgaggcttttcctcttcgactcaacatcgggtttgacatcggaccccccttgagccaaagttgccttccttcggggcttcaggcatgcttgttatagcttcggcattcaggctcattgcttaaaggcaatttcttcgccattaggaccctcggcggagaaggggacccaaaaccctgtttgaatcaaaacccaacaaaaattaaaaaattgcaaaaatacttgcccctcaccatttccactattttggccacaattggagttcccaaccatgggggggttttt

SEQ ID NO: 15562 - DNA, 501 bp, Zea mays
  Clone ID: LIB3279-225-Q6-N6-E3
aagacaccatacgtgctcttcggagtatcatttcagtaaaaatatacgtcctggcgcacaaaaacagaagtacagacgcagcaaagaagattacaattattctctagcgggctcacatgaccctcacagcggaatcggaatgcacatgaaaattacaaaatatagagctcagtaggagtgattaggcttggcagttcctgtgacatgtccttgggaaaactggggatgataaacattgcttaaagatcctcagggccattgacatccttgttctcaagtacgtctccatctggaatctccaacttcactccaggcttggcgataattgtcaccttgcccttgagtgtaattccagagccaaaccagacatcaccagaaaccttcaagctgtcaagctcaactatgctggggatggacttgaaccgaccaaggaaattggcaaccttcttgaactcaggtccaagctcaattgaagggttagctggattcgctctggatggg

SEQ ID NO: 15563 - DNA, 569 bp, Zea mays
  Clone ID: LIB3279-225-Q6-N6-E5
ccgcatattgtatactccctccgtttctttttatttgtcgctggatagggtaattttgctggatagggtaattttacactatccagcgacaaataaaaagaaacgtagggagtatatatattcccggcgataacataacaattcaactacaacaaagtacaaagtttctttaaacaccagaccctctcctataactggaatatgcgaagagctacagaatgtgttgtgcaaaaactctactcaaggagaagcgctttgtctttttgatggggatacccggctcagtcaaattttcagactgccgtatcatcttcaggctcattaaactgctcttcgtacccgtcctcctgggccccatcctaaatgctgctgtcaacactgtcatcatcgacgtcttcatcattggggttggcgctatcggtatcctcttcatcaatcgagctcaactctttccaatcaccattttcgtttacaccaaggatgctgtctttggacatcccagcattctccaaatcatctgggctaatattggttcctatttcaatctgattcatcttaacactaggaaa

SEQ ID NO: 15564 - DNA, 590 bp, Zea mays
  unsure (1)..(590): unsure at all n locations; Clone ID: LIB3279-225-Q6-N6-E6
agcggcaaaaatggatttgctattttgttattcgatggccttaatgttctcacagactgacctatatcagcatcgggacccagcggcccacttaagtattacacggcccacttgagcccattcaaacgaacgttggcatgccttccgtgcgatgacggccttcgctctcttgttgttgctcctcgctgctcatcttcttgctcgacgtcgaagactcccttgcaccttccgacgtcacggggctaacaacgccggaggggatgtcgttgctcttccactccatcgctgatgttcgacctttttagctttaggattcaatatggtcaggatttaacggcaataacaacacacggtagaccactctaataacacgcatctaaaaaatagatattataatgtgttctacaagacacacttttactattattcttaatattttagaataaataaaatatcagtagtgacactagtaagactttaaatttctcctcgaacgagcaaatgatgaatatggtacacaattaatatagtattagcgctcttaatttctagctagtagtcatataggaatataagccgnacgcgtgggc

SEQ ID NO: 15565 - DNA, 624 bp, Zea mays
  Clone ID: LIB3279-225-Q6-N6-E7
acaatcttacccagttcattgattattcgagaattaagtggatagtttccatgttcatcacaaatgttacacacatacttgtcatgcaagaaccttgaagtacactccaagcacaacgtatagcacaggcagctgcatgcggccatgcttattaattcggaattgcgcagtagttcgatctcatggcaaccacgggggcaggaaggtggtcatgcatgagctagtcagtgcctctgaaggataccctatctgaagggtgggttcaccagcaccatcgaggggatggaagaagttattgccattgagctgctgcggctgcacttcagaatgccgctcgctttgctcccacgcatgctgccatataacctggttgctctcctccagtcttcttcgaagacacttatttgcttcacaaaacatttgttcctttttctgaagttctgtcagttgatcaaccatgtgttgtgtccttgtagatcttatgtgcttcaaggacgaatcgagctgcttctccaggtgctccagctcttttatgcctaatgactcaagatcttcaccaagcaagttcctttgagtccgctgtaaattatcaacacgtgcctttcagttttgaggtactcattg

SEQ ID NO: 15566 - DNA, 598 bp, Zea mays
  Clone ID: LIB3279-225-Q6-N6-E8
tcgcttttttttttttttttttttttttttttttttttttttttttttttttttttttttttttcaagaaatcaagaaccacatatttatatatccatataaaggttgggggaagcatagctctcccaatatatattacaaaccgacaatggctcaggggacatcggacaacactgctatgcctgggagggggcaaggtcccgataaggataacacatttaaggaatagcccgtccaggcagagcagggaagttaaaagctgcctgatagtctagagtcactagcagcacacgtggtttccatggaagcaattgaaattagcaggggggatcctgggggtagccaagtcattagaccagattatctgggttttttgagggccaaataaccttcgccccacaccaaggatcttaagtactggtgtttccaaagctccagtccaaaaaatctgaaatttgataccaccgtcccgaaaaagccacacgtttgccaccccattgtcagctttgaagagggttttattagcaaaaccaaaatcctgtactaaaaccagctatctaaacttttaagggacgtgcatgccaaaaccagcttaaac

SEQ ID NO: 15567 - DNA, 497 bp, Zea mays
  Clone ID: LIB3279-225-Q6-N6-E9
aagcaacaaaaaaggtttggatatatactaaaaggtccataatccataccaatgggggctgacaacattttttgggaggacaaagctcccaaaacggggaaacaacatagtcccaggggacaacagctcaagggcctagcagcaaggggggggggttctgatagacttactggtcaacaacaggggagcacagcccctcaagcgcaaatttgaacaaaacagggccggcataaacgatggggaaaaaatggggggcttttatgggggctcgtcttcatgggacagggaaaggccgaaaccgaacctcgcgcaggctttgcaaaacgctgccttttttgccgcaaacacggggtcgtcaaaccgggcattgctcaaggatgctgttccagcagcctccctgggaacctttccatttgttccgcgcacaggcacgcggtatatgaccggcacctttccctggcagggtaaataacatcacgaacttccccacaccaacc

SEQ ID NO: 15568 - DNA, 549 bp, Zea mays
  Clone ID: LIB3279-225-Q6-N6-F1
gagccagcaagctagcattttatttagtaaaatcgttcacccgccggtacccaatcttttcagttttacacagttgccgtcttgaggctgttgcccttctcctgtaggctcacgagtaggctgtcaaagctcttcttgaaggagtccacaccttccagctcaagctgctttccgacctcgccccagtcaatgccaagcttctccaaggggctgtatacaccttccgcctcggacacattcgcatcaactgtcctcgagacagggccgtggtctatgaatgcgtgcaaagcttggtcgggcatcgtgttgaccgtgtcaggtccaatgagactgtcgatgtaaagagtgtcgggataagctgggttcttgacaccggtggatgcccacaacaacctctgtttcttggcacctttcttggccaacgcctcccaccttgggccagagaatttcttctggtagagccgatttgctagtttggcctgtgcgacggcagccttccctctcaaggcaagtgcctcaggtgttccaatcttttcaagcattttgtcg

SEQ ID NO: 15569 - DNA, 563 bp, Zea mays
  Clone ID: LIB3279-225-Q6-N6-F10
cgaggaagtaatctgctattgcttaattgccaagtgttcgaatacaagagataaataggcactatgtctggtaaaaatatagatggaaaagctcctcaaattgaggcacaatggttttctggctgcagtgacccagtttccagcaacaagaccatatgatacccctctccaccatcgagcagcggacctttaaaacattgtgcaacccatagactcatacaagaacgtacgcatcgcgcccttcgtcatcgtcgacaccaactactgttccattagggatttccatagtttcaagactacaagagatttcaagctttcttgaacgaaccttgtcacccacttgaaacttgttcttccgcaaccagttaatgtgattttccatgggtggcttgtctaccattaaattttctaaactgtgccaaccaatgttgtcatgatgtgcatctttattactatcaaatgcatgcaaaatatctttcatcaagggacggttctgaagtcgtactcaaagcatccagaaagcatgttttcaatatctggaggcagactgtatggaaacattg

SEQ ID NO: 15570 - DNA, 450 bp, Zea mays
  Clone ID: LIB3279-225-Q6-N6-F11
gaaaattaagtagaaatttactgaaaacgatggaggtggttcaagttaggatgacaatgttacaggtgattttacagaggcaatcccagatcaacaatcaaatcctcttgagtagcatgccgtacaaggcatctggggttcctttcgatagagagggaaaaaaacccggtactctggtgtaaacagagaatgctactttgttcaaatgggaaatgtcaaacaagttgttaagaggctgagagtgggattggtctcacggcgccctgtatgcgacggaacgcggtcttgatccgttccttcagcgtagcattttcacattcgacatcgccactcctcccatccaagtgggccacattcccatctacagatatgacaaatttcccttcctctgcgactttaacgtcaccgaaaagcgatgtcataagagcatacaccacctttagagcagcc

SEQ ID NO: 15571 - DNA, 483 bp, Zea mays
  Clone ID: LIB3279-225-Q6-N6-F2
accccaaaaaaattttccttaaaccttttttttttagcagaggacaccggtaaaaagggttagggacacccccccccggaggctaaaaaaaacgggtccccttttttttaaaaaaaaaaaactggggcccggaaggggggggcggttaaaccctcgggccctttttttttttttttcttccgggggggggggaagctacccttccaaaagaaggggggaagggagcctgaccccgaagactttttcgatttctaactttggggaagaggccccggggggtctttttttttttttaggggaagaaaggggctactttccaaaacattggtaggaagggggacgctggaaaccccggggaaaaaaggggggcccccctgaaaaaacccgggggggctttgtttttttttaaccaaaaaaggacccgacctggttgccaaaatccgcccacttggggggggaaaactcgggagaacgggggggccg

SEQ ID NO: 15572 - DNA, 615 bp, Zea mays
  Clone ID: LIB3279-225-Q6-N6-F3
aaaattcatttttttctttttcatcatgcaaaacttctccctaaaacaaaaataaggggagaagtatacaacacttgttctaagcttgtatctaggttccaccaaacaaaatattttctaattaatccaaagacattttgcaagttaatgtaatagcttgttgacgatgccaaattaaaccaatagaacatgaactatgaattaattacacttatagggtggaggaatccagttaaaatttcaagataaatgaaatgtactagttggtgctcgtcaccattagatctgcttgtggttattatataaggagttaaatgcatgagtgacctttgaacttgtagagtttgtcacataggtccacaaaatttgaaaatatatttttagggtcctgaacttgttaagtggcacaatacaatggttggtatggttttagaaatggacctgaatgcaccatggatgtgtggtacatctcttaacaagttcaaggacctataaatgcattttcaaggtttatgaacctaaccgacatctcttgacaagtgacatggtctttccttatttaagatggagatatttgtccaggtcagctctctctcccacatctaattctttttt

SEQ ID NO: 15573 - DNA, 618 bp, Zea mays
  Clone ID: LIB3279-225-Q6-N6-F4
gactacaaaccaactcttgggtagtcacccaattagtcgataaaacaagaaaacaactgtttacacatgctgacgaggctggcaaaagtatccggctcttcgggttaaaggggaactccagcatgccataccctaaggtaccatcatgtacagattttccttacagcatataacatcaaaaggaacagcatatagaaaaataagtaaagcagcaaacactcaattgcaaagctgctgttccccatcgtactatttactcatcctcgtcctcattaccatcctgctcatcatcctcaacctcagattttgacttgttagaaccttctgcttcatctccctcccgaacatcagctttggccttcttggagctagtgttctccttcttgcttgctttgccatcctgcttcttgctactgccatacttcgccttctcctcatccgacatagagcgccacttctccccagccgccttgctcacctcctttacgcccttgagctcagggtgcttctccaggtactgcggcctaaactcagccaaaaacgcgaagaagggggtgagcccgcgcttggcgccgccgaccttcttgcgcttggcgccggtggccttgaacgaggtgt

SEQ ID NO: 15574 - DNA, 613 bp, Zea mays
  Clone ID: LIB3279-225-Q6-N6-F5
gacatccaatctgtactgataggaacatgaatacagttagaaaaaaataaacaacttaagcaagttgcaattttgatacaatgacagtagctcgtcaggtactgaagaatcacagtccatcacagctattaaggaacagcaccccatgaagcaagaacaccttcatgtaggttctcttcggatacagttcagacaacacatgctaacataacaacattaccgctggtatccatctcgctactacgggaagctgaatccgccaccaccgatgagctccctggcacccgcaggagggctgatgtagacccacagcagcgagatggtcatggagatgagcccagaccagacgaacacgatggtcggcacacggccgcggcggcccaggaggcccttggcgaacgggtagaggtggcacagcacccagaagctgaagaaggcgccgccaagcagcttgctccactgcgggaactcgctgtacagcgtgcgtgccgacgccacggctaccgccaccgcgttcaccatcatgatcgtcacgggcggcaccatcaagaagctccaccgcacctcgtacagctccgcgaacgcgtcctcctcgccgtcgtcgccggtgccg

SEQ ID NO: 15575 - DNA, 612 bp, Zea mays
  Clone ID: LIB3279-225-Q6-N6-F6
gacgaagccattcttctttctatattttaagcagagtatatgactactacagaactttgaccagtaccaaacaatcggctgcaaatgcatggctacaacagaatctcaacacctcgctgcgaatgccatcatcctcttctctctttttcgctgtaccataacaattgactagtacacaatttaaccaataaatcctcgcagacaaagaagcggaaaaaaagagaaactaagaacatcgtattattcgttcgctgtgaactgaatagctccatctccagaagacaaaagtgcagagctataaacgctggagggagcaaagccatggctcctataagaggagctgatggtcacaagaaagttctcagtcttccgcggtgccatggccacgaggcgaggcctctgtgtcaccagcattgtcggccgccaacctttcctcaagaaccctctcgccacgctcccttcttcttgaagccttggtaggatctgatatcgggagggcgacttccaaaggcctggaccttgcacacaacagcctatcaaacaggttggccacagggtccgtaactggtctcatggcagctgggaataaactggggaagggagaatcatcac

SEQ ID NO: 15576 - DNA, 548 bp, Zea mays
  Clone ID: LIB3279-225-Q6-N6-F7
gcaaaacgttgcccaggaatcatttcaattatcgaacgataagattggattacattcgaaacaacttcaagaatactactaacaatagtccaacacgtcacagacaaggaactaaacgaaataaccctaacaacaaacaggcatccacgacagcaaggagaagaggcatccagcctagcctccgaagccgtagagggttcggccctggcgcttgagcgcgtagacgacgtccatggcggtaacagtcttgcggcgtgcgtgctcggtgtaggtgacggcgtcgcggatgacgttctcgaggaagatcttgaggacgccgcgggtctcctcgtagataagccccgaaatgcgcttcacgccgcccctccgagccagcctacggatcgcgggcttggtgatgccctggatgttgtcacggagcaccttacggtggcgctttgctccgcccttgcccagacctttgccgcccttgccgcgccccgacatcgtcgctgccggtgccctgtctttcacgctctcctcgcctcgaagaaaagggggattttttt

SEQ ID NO: 15577 - DNA, 449 bp, Zea mays
  Clone ID: LIB3279-225-Q6-N6-F8
aaatagtgaaacttgcaaacagaaactccttgatgttcagaatttttcctgtctggagaaggaaatcgccacgggtcaatttggcaacttcatccttccacaatcactatatctacagctacatgattgttcgacacgcagtaacaagagaaaattcaagcacttgccatgaagagtaacttccaggcgaacagttaggtatggtatattatttggtttctctgctctggtggttgcccttgcccaatgctgacctcaagtttggcgccatcatgatgttgtcttgatacatccacaggagagcctcagagctgctggaagcaaaatgggttcactatctcacattttgtttggccccataaatttgttttctctcagcaggtttcagaatttggaaggaacacatcaaagtttcgtcaacactcatcattgcgccagcattatcaaat

SEQ ID NO: 15578 - DNA, 612 bp, Zea mays
  Clone ID: LIB3279-225-Q6-N6-F9
ggcatagaagaaactcttattatgtgtttcagtaatatacgtccagagtccaaactccaaactcaattcaaattcaggctcatacaaacatgtgtacttctgttgtggcgatcgagcataaatttacattaattagggaatgttacaagcagctaatcttccccttggtattatcacacgatacataccgccccaacatttgcatcttgctgttaaataagatgtcgttcagaattcacaacctgaaatcagctagagcagtcttcttttttccatccaagccaacagagtagtaacgtgcaacatactctctcacgagtgtttccctatacaaaggagggttctcctcggacagcagctccttgattgggccatacgttcttgtcgaagcgggatggaaatgggtgctgaaaaagcacgcgatcgaaactcttggttcagcattcttggctaccaccctgtgctcgacgctgctgaacttgtcgttagagaccagctgcaagagatcgcctatgttgacgatgaatgctccaggcgtcggtgcaacgtcgacccactgaccatcatggaggatctggaggccgccaactttgtcctgcagtagtatggtca

SEQ ID NO: 15579 - DNA, 482 bp, Zea mays
  Clone ID: LIB3279-225-Q6-N6-G1
gggggagcaaccaaaaaacctaacagtaacaccaaaaggaaggtcagtccaaggttacagacgactttaaacgaacacaggggccccactaaaacaagaaaggggccttccaaaaaaaaaatctgaagggaaggcatatgccggggctagaaagtagaagggtggcccttttaaaaaaaaagctccagggaccggaacaaaaaacgaggggggtaaaaaacccgggaggaggggaaaattctaaaaaatttcccaaaaaatgcacttaaggccgaatagtatacaaaaagccccatacccccacagttttttagcacaaaaaaaaatggccttcttcctcctaaaggaaagggatttgaaccaaacataaggccccggtaacaaaaaccacctttggctttcgaccaaaaatagactcctcccgttgagttcaaaaacctggacatggattctaaggcaggatacacaacttggccagcttt

SEQ ID NO: 15580 - DNA, 470 bp, Zea mays
  Clone ID: LIB3279-225-Q6-N6-G10
aaggaagccaaagaagggagtaccattccactgtccaaaattcaaatggttccaggaaaaaaaaaactgcaactcgggcgcttgggtgaaataatttcaccgttgcactaatcttggaccaatacttttggttgcgattctagcaagacaaacagtctttagagtctaaatacccttcaactgtccctgaccgaagtaagaacacatccaatgccaacaaaaaagggggggtctttagttcacggtaggcaacttttgaaggctccctaaatggccaccatatcaccacaggtgcccatgaacaggatggatccagcgaacacaccaagagccttcgccaactttttgtttttggcccagttcctttcgtcgtaaagctgggagtacaggaacacggggagcttgtcccacgccttcgtcaccgccgaaactggccccgccatgatcccgctttccgatcgccctccgcc

SEQ ID NO: 15581 - DNA, 554 bp, Zea mays
  Clone ID: LIB3279-225-Q6-N6-G11
gtcactaaaaatgcattccttgcaacaaattattaattctccacggtacagaacgggacatcatcacaatgtcagtgcgcaaccataactgaactgcaacaatgaagaacaggtagcaaaccttatttctagcaaacagtcagctcagcttagaaactaactaaaaagagcacgggactcattggcctcattagccatctcttccatgctcctatctttcctctcaatgtccaggtcaagcttctccttcaattctttctccttcacatcaatcgcatcatatatttcatcatttttctcaaaatcccctttcttccttgggatgaggtggatgtggacatgtgcaactgtttggccagcttgaggaccatcctggatagcaaaggtaagtgacgatgctttgtggtactgctcaagacgtgcaccaacttcctttgcagtaacccataagtcactaatctcatcagaacttaaatcggcgaatcttttcacttcacgcttggggcacacaagaacatgacccgggagcagcgggcggagattcaccatggcgt

SEQ ID NO: 15582 - DNA, 564 bp, Zea mays
  Clone ID: LIB3279-225-Q6-N6-G2
aacatgtctccttgttaacccttgttaacgaagaacgtgatcggccgcgaaaaaaaaaaacaagtgacatttaggtaacaggagagatttattctatggagaaagaaagctcaggacgttctgctttgcatcacaaagctccaaacccagcatggttcaaacgaaaccccagacgacacatcaggtaggatgattgccggtaacaagggaaacaaacacacacaatgttcagaagcacagctactgctttctaccatttgctcttcctcaccagagtcccgcaggttgccacccagctcactggcactgctccgacaacggtctcccctcaggcgaccttaatctcgatggtcttgggcttcttgggctccggcgggggcagcttctcgacggtcaccgtgagcacgccgtccctgcacacgggggcgaccttgtccacgtcggcgttgtccggcagcacgaacttgcgcatgaacttgcccatccgccgctccatgcgcaggtacttggcgtcctcgcgctcctcccggcgccgttcgccgttgatcaccagcacccgctcgt

SEQ ID NO: 15583 - DNA, 509 bp, Zea mays
  Clone ID: LIB3279-225-Q6-N6-G3
agggaagtctggctgttttagagccaatgaacaccaaaaaaaatgcatatccatcattatccggcaacttactagagcaaaaacaaccacgctggcacagaaaagcattctcacaggatacaagagagaacctagttcatcctcttgatgagctcggtgatgtagttctcacgggttccggggtcaccgccctttacggagggggtcctcttttttttgaggccgccgaggggggccttcagcttgaacggccaaaggaagttgttggcctccttgaagggcgggcccaccgtcatgatctcgtggacaagggcctcaatgcaaatgatattgggcttcccgaggccctcctcgatgacactgttgttgctaaggggaatcctttggttgttcagcttcccgtaaccttttttggagaacaactccctaacgctcttcagggtggggtatccgtacgcaacatatggctccaccctgcgcagcatgttaatggttgccttgttaacctt

SEQ ID NO: 15584 - DNA, 603 bp, Zea mays
  Clone ID: LIB3279-225-Q6-N6-G4
gcaaacctcagtatatctattcaagatgcatgcgggtacagttgcagggtttaattaattaggaccctagcttatataaagcatgtctttttggtatctgtacttgatataattaataaaaaaaatacaagtaaagtaaatgtcatcccctggatctcttcattttcacaatgaagtcatcgtcgtcgtcctcactgtaatcaactcttctctttgccttggaatccataatgcctggcttcttggaactttcaggtttattatcttttctcactgcacaagacttgattggggtacccatcctcacttgctgctgccgcttttgcttcctttcatatgccttccttgctctctcaggagacaacataccatgctccatcaaccagaattcagccatctcactggaggggatctgcttggacagtgactcgtagaaaatcctgagaggctccctctcctccggaggatcgaacttctggccgggcaaggagtagaccttcttgtcggccttccctctacctctacctctgctgctggtggtggtggttccacgcttggtagctgccgcagctggggaggaggaggaggagaatttccccttgg

SEQ ID NO: 15585 - DNA, 579 bp, Zea mays
  Clone ID: LIB3279-225-Q6-N6-G5
gacgaaaggaaacatggcgtttatacattacaatatacttttcgattaatcaccgatcggaatgaagatgatgataaattataaaagcaacagtgggcgggagagcgtagcttgtacgcctgcctcctccattttcccacacggctttagtttttttttcttgcttgcttgccggctcgcaatcagggtcacgcacggcatgacatgccagcctgaccccacaaacatcgcacacgacgcctgacctaaaaagcgcgccccggatgcatgcaacaactcccaggaccatgatcacgatacaactgcaacggcacggtgaccggagacacctcccctcccaaggccgccgacgacgactagctgttccgttccgccgtacttggtggtagtagactagtagtaacagcagcagtctagtggtagtagagagcatagtatagtactgtagacgatggtgaccgagccgagtagcgccccagccagccagctccaattgcgggcagggcagggcagggatcccgatcagctagctatactggacgaaggagcggtagaaggtgttggggcgccagttggccg

SEQ ID NO: 15586 - DNA, 525 bp, Zea mays
  Clone ID: LIB3279-225-Q6-N6-G6
ggaaaaaaaatgaagaaccttcggctaagggttctaacaacagctggggaaattcgttcttttacatctacattaacatgggggggggggctttaacccttcgataactgggctgggaatcccccaaaagcccactggatcgcctaaacatttggcagaattttgggtgatcccatcataacctaggcccggaagaagaacctgacaatctgggtgaaaaactttggggtggccctcaagcttgggcctgcccctgatctactggggattctctgggagaggcgatggaatggcaaactttgaatgaaaacaacccctggccccgggagagatgctgttagctggttatcacccccaaaaactgcttttttaagctgggtagggctcttcaactggaagttaaggggggccgacatagccacaatacaagcagcatcaacagtaatcacctttttaggagcaaggattttctgcatgactggtccaccccaacaagaaaagccatcccctggcccctaagttttt

SEQ ID NO: 15587 - DNA, 586 bp, Zea mays
  unsure (1)..(586): unsure at all n locations; Clone ID: LIB3279-225-Q6-N6-G7
acatggnaaacaaaacagattggacgagttattaccattctaagacacacggaagcagataatgtgtggtttacagaagcaaatggcatctggtgcaaagctactaaatgctcgactggtttctcccaccggtcagctcgacaatcctcctcactaaaattgtgaacacgagaaagaaagaaaaaagagaagctgcctgtagcctgaacataaatagctggttcctttctcgcttttgcatcgcatctgactgggctcccctgatgatacatgccaaatgcatttgtccgttgcatcggcatcagcatcattactctttgccaaaatctgcactgtaatgcgcactcgattccagcttttttgcatcatttagtttcctcacagccttcatgaagtcttcgtggactacgtaatctctctctgcacgaattgcagccatgccagcttcggtgcacacgttccgaagatcagccccattgaaaccttcagctagtttcacgactgcttcataatcaatctccccatgcttggcgataccggctgcatggatttttagaacttccattcttgattgctcgttgggtag

SEQ ID NO: 15588 - DNA, 552 bp, Zea mays
  Clone ID: LIB3279-225-Q6-N6-G8
aacatgtaaggtgctagtattcttctgtaacccttcccaaaaccaatgtatccggcacagagctctacattatcatgtaacccgtttcttatcccgaaaagatcaaaccaagcaattgccctaagcattcttttacccatatccccctagaaccagccgctacaagtcacaggagtaagactaacaagactcacggggatttacatgcacagctgcggggtaacagcggtcatttggagtcagcgccgaaatcggtctgggatgacgtcatagacgctgattgggaagctgtagaactcctcgtttctggggtccgagtatcccttatggcggcgcaggaacggctggaaccacgagagcccccggtcggcctcgtagcccctgaactccagcgtgttgtccaggacagaagcgacaattagcgccaccgtcggcccggaagcaaacacggtgtttataatgtcgttgaaccatccagcatttgtccgggcaggtccgtggccgccagctgaagaatgtatccgttgaagtattgagggaccgagatgccaa

SEQ ID NO: 15589 - DNA, 483 bp, Zea mays
  Clone ID: LIB3279-225-Q6-N6-G9
atgcaaaacccgcattcactggtttgcacatccgaggggcgaacatgccttccctggcacaaaaacttgatcctctctcgggggcgattcacccaaacgggttacaaagctaggcttgggttggtttgctctaaaaccaagggggttgggtgggtttaaaacgcaaacaaggcaaaatcctttataaggttttctaatcccaacaaaaccacatgggatagaaaataatcgaacaagaccggggggggattccactatttgggaatcttgggcgtttggagtctaagaaaaaaggaaaatgctatgtattttaacgatgggcattggagccaactaaaaccccgccaaaacattggatgggcatgaaacacctaccattggttttacaatttcatgcaactattgggttcaactgggttcaaagctttggctagggcgcattggacaaaaagactacaaatggggggaagctgtaattccatg

SEQ ID NO: 15590 - DNA, 606 bp, Zea mays
  unsure (1)..(606): unsure at all n locations; Clone ID: LIB3279-225-Q6-N6-H10
cagaaaccacagcggcaacagcatatactttcttttaacaaaattttgttccatgtaaagtacacagaggtcgaaaatgtcaacgaagatgtttacggttttcagcacctccttacgcatctatctttctgcaaaagtcacttgtgaagggctaccctcaaatgtctcattctagatcctcaaaaggatttaactagcctggagagcctcaggtctgcttcttcttggatttgcttctctgcacaaacgaagtgccctccagccactcatcgatgttggcatcagttgttccagttccgagctccaccttgggtgccttctttgttttcttcgagagctgctgaacctggccatatgcccacaatccaaacagaccaagaagtgcaaatccaagggtgatgaggaacacagactcaacactgagtaagcctccagcctcaacaacctcgatagtgccattgtagaatacattctggtaagggtgctggtcgatctcatacactatgtaaccaaccagatcatatgctccaggctgcaagaacttgctcacaacgaacttgtnaggggaaggttgcttgcacagaaacaggaactgatgaattgaaa

SEQ ID NO: 15591 - DNA, 573 bp, Zea mays
  Clone ID: LIB3279-225-Q6-N6-H11
gaaccatgaaaactggtattttcatatagtagagataattacatagcaacacagaaattcaatgaaaatggaccaaccaagtgttgctatgattcaaaacttcattgccattaattgcacctattatgcatttctatatatgtcactcaatttagtgttccagctatgtctaattcgtccaatgcctcagaaacatctactgatgctgattcactttgggtgttgtctaattcgtccaatgcctcagaaacatctactgatgctgattcactttgggtgtgtccatgtgtgtcctttagcttatccagagcatccttcgcagcacggttctgagctatctccttctttggaccataaatagcacttccaactacctcaccatcaatcaacacctgaaccttcaaactcttatcccattcgtctttcagaaatttcacccctcggtgagtcttttggcaaaactcaaaaagctcgcttacagggtgcttgcctaatgtctctaagccaataagtggatcagccaatgttcgaaagacccgccaaacctcctcttggtcgaagttggagtccaag

SEQ ID NO: 15592 - DNA, 570 bp, Zea mays
  Clone ID: LIB3279-225-Q6-N6-H3
gaacaatccaacagagatccattcccattcacacgatttggaattccatttcacaccaaagaacggatagccagagaggctacagacaccagacaactgctgaccctagcaccaccgaccgacccgcacaggggtcaaggaaccagtgacgacgccagagcggagagtggggggcgggtcgagcatggcctagcctagcgccctagccgccgaagccgtaaagggtgcggccctggcgcttgagcgcgtagacgacgtccatggctgtgacggtcttgcgccgggcgtgctccgtgtaggtgacggcgtcgcggatgacgttctcgagaaagatcttgagcacgccgcgggtctcctcgtagatgagcccggagatgcgcttcacgccgcccctgcgcgccagcctccggatggccggcttcgtgatgccctggatgttgtcgcggagcaccttgcggtggcgtttcgcgccgcccttacccaggcccttgcctcccttgccgcggcccgacatgtctgggggagcaaacagatcgaactcgagaggaggcgggtggtggtagactttag

SEQ ID NO: 15593 - DNA, 602 bp, Zea mays
  Clone ID: LIB3279-225-Q6-N6-H4
acgtggctacgcaagtgacttgtaccatttctacatacagctgatagtgttttgtgacaccaattgcatttagctttccaagtaccacctacacagactctttcaaagtcttgccatacatcagatttaagcttccttttactaccaaccctaacatcctcatctatttcaacagcatcagtgttggtggttccagtaccttgaccatcagtaggagtaggcgctattccatcagatggtgtaggagtaggatctcgtggcgtagatgatggagttggagctctagaatcgcgtcgaccaccaccactagtaggtccagcaccactgccactgtctcccggagttgacattacaaatagaaataaaaaacctgaaatagattaacaagttcatgaactagtagatcaagcaaagcaacaagcaagggatgaagggagtgagggtgatgcaaaccactgccactgtctccgacggccaagagcttgccagcttgccgcgccggcgcgccgccaagggagtgaaggcctgagggagagggtcagccgcctgcactgccgctgccggtctgccgcactagcacactgccggtctgccgccggccg

SEQ ID NO: 15594 - DNA, 392 bp, Zea mays
  Clone ID: LIB3279-225-Q6-N6-H5
aaaaaaaaaattggctttatgagggattagggagatcctgagtacatttttagttctaaaagcagcgacccaattttcacatgccttatcaaaagtttggggggggcgaacaacagagggaaagggactcaaagctcgattttgggggcggccgatcacatcaaaacttgagttaggggagattctgtagaccattgggggcagccgatcacatcaaaacttgggttagggtagtaaaagcaggggagcagagatcctaatcacttggagatttgaggggggggactgaaaagctccatgtggggtggacccctaggtaacgatttctaagccgggaaagcgaaaaccatgtcatcgatgtccgacttgacattgctgtaaatgttgtcgaa

SEQ ID NO: 15595 - DNA, 605 bp, Zea mays
  Clone ID: LIB3279-225-Q6-N6-H6
gcatcagttatagaaccagcccaccaggtaatgcacgttaaaaccagcaatttacatcacttataaaatcagaaggcaacgcaagcgtattagcccgataatgcaccaataccagcaacttgcatcactaataaaatctcgacttgcaccctacagtttggtggactcgaattgcaggacttaagcacagccttttaaagcacacaacctgtgaaccgaaccaacggagaccagataaaagtgacaagaacatgctgcagccacaagatcatagatctactagtttcagctggatacagcaccagaaattaagaatctaggcaaacggaaaatgggttccgattcaaccatagacaaagtaccaagaacagataaatttattacaaagaagacactagacaatctgatggttcaccctgaatcgcacgagtccatacaggcagcagtttgtgtcccgctccaggatatggaccatttaagcatcagcataccccagttcggagagcttgaggtgggcctctttgtagtcatcaaagaatgccttctcatctgcagcatatttctccacaagagggcggaagacagggtcgctcagcagggctttg

SEQ ID NO: 15596 - DNA, 479 bp, Zea mays
  Clone ID: LIB3279-225-Q6-N6-H8
gaaaaaacccagataaatgaacccagttttggtggtcaaaacatactcgggcagaaaccacccgggacaatgggacgcgccccgacttggcagaccaacaacgcacaaatttgtttaccaggatcctacgactggcgctacatatatattgggaggcttttttccaaaactttactttttttccaaaggacgggtcaggatcaccatgcttaaatagatagaccccggcaaacagggaatacttcacattggccaatgggaaggacccaaaaaactggggttccattttaaaaccaccttttccttgacgcttgccccaagaaaaatggaacggttaaaaattcccatccatttttgggcccacagggggtggctccctccctcccctctaagggaacaagcaaggggggcctttttcccaccggggcggggccagacagggaccccccggtcaggggacaaggagggggaacccccct

SEQ ID NO: 15597 - DNA, 545 bp, Zea mays
  Clone ID: LIB3279-225-Q6-N6-H9
gcaattgcaaaacttaattccgttgtaacttaaattgtctgggtagcctaaaccagctctaacaaatctagactagtaatacaacttattcctacaatactatcttctttcactgctacattatagaactattgctctttatttacatcttaactcaaacagacagtaatgaatcaaactatttacaacgaataaaccagtcacctcatgctttattaggccttattcggttattctcattccatgttgataagatgagattggaagaaattagaaagaattttgactcgttatggatttaaacccactcaatcccgttcaatccatatggattaagattaaaacgaacgggccttaagatgctcgtaacttccattgctgtattgctgcatgcaaggaatggttgggaattatggatagatgtggaagcctctgatttgtcattggggatatcttgtgtttttcgagccaagctttgattgccctgtgttcataggtgtgcccatctgcagcaacgtaaggattttccattacctcctgcaata

SEQ ID NO: 15598 - DNA, 634 bp, Zea mays
  Clone ID: LIB3279-226-Q6-K6-A10
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcg

SEQ ID NO: 15599 - DNA, 644 bp, Zea mays
  Clone ID: LIB3279-226-Q6-K6-A11
ccccgcgtccgagtccctctctctcgctctcggcgacgactgggcgaccgccgccgccgctgccgctgccgctgcgccgcccttgtccaggtgcccaggtcttcgcaggcacttcgataaatatggcagggtcgcaaatgtaagaatcaaaaagaactttgcctttatccagtttgaggtacaggaggatgctacaagagcattggagggtactaatggaagccatttcatggacagggtgatctctgttgagtatgcacttcgtgatgacgatgaaaaaggtgaaagagggaacgggtacagcccagacaggagaggtcgtgaaagatccccaggtagaaggcgttctcctagtccctacggtagaggacgggagagaggtagcccagattacgggagaagcaaggagagggggagcccagactatggcaggggaggacgcagccctgataatggcaggggagtaagcccagctggtggtggcagaggcgatcatgccaggggtggagggcgcagtcctgactatgatcgccagcgccgggaagctagtcctccaggttatgacaggtcccccagccgctcacctgggagggaggccagagagtagaagcagcgttccatttccatgcctgtgttcaagcatc

SEQ ID NO: 15600 - DNA, 790 bp, Zea mays
  unsure (1)..(790): unsure at all n locations; Clone ID: LIB3279-226-Q6-K6-A2
cgtccgcggttacgcgtgnnggtgggcctggnagnaaaaccaggnagnaatgnannnagtacaagncttgcgnnnagttgagnaaatgtttnnaccagtccttacannatcgtctccagnagnnaagttgnngcccaccaggnatnnaccagcagggnagtgggtttattgagtncnnctaaaacnncatctcaaggagnaagnntctgtnncctccaggnnatttgnnggtctggnagnagnaacnncagggcnnaacgaccacttacatggntnnacaaacagnnagcgnncgtttaccaanggtcctttacaaccanntctcgnagnagnnaagtcnnggtccgccccagggtattgnngacaggnnaagaatcaggnngcaatgngnntggttcttttggaacccacgagttgnntgagcagggnanngtgtttacngnnagtcctanctagnnaggcanntctcaagaagnaanngtcggtnnccgccaggaataccggnngcccggggaaaaagtcaggngcaattaccacttttcgtggattttcgacncctgccagcagagaatgcnnttgcaggaatccangagaactggtnggctcaaggnagtattggacttttggaagcctttccaccgggatacccggacctggtggtgctttcagggagtgtcattaagcccccaagctcggtctgcagagaatgtagaattttcggacgaggctagaaaaaaagctatacagcgggagctgaggaggcggcaagagttcaggtgaaagcaatata

SEQ ID NO: 15601 - DNA, 628 bp, Zea mays
  unsure (1)..(628): unsure at all n locations; Clone ID: LIB3279-226-Q6-K6-A3
ggttcctacaaaacccagcagcacacaggcgcccagtctcattnncaggccaagggtctcanganagcccgctgctgttgcnnagcactttccaatgttttgactgcangagggatcgcacagcccccgccacagtaggtcgtccccaacagcagatgctgagaagactgaattagctcctgcttctcctcaccagttggaaacagggcctgcagaagatgtccggacagagcctgatgtctcacaggaacaaactgctaacgaaaacggaggccagaccacctttagctacgaccgcttggtatcaaagtctactgaccctgtcagtgggatagaccacaagcgcagagagacatatttggtggacaatgagttcgagaccgtgtttggcatgaccaaagaggagttctacgagcagccaaggtggaagcaagagttgcagaagaagaaagctgatcttttctgaactcacacacacggctagctacgaataaaagccctcccgttgcgcgtccacggctgtcgtccagcattctcaccatgctcgttccacgnatgcgtgatcaccagcagctttatccgtgagttgtatactctntatctgcacacgttttgggcgcgttatata

SEQ ID NO: 15602 - DNA, 284 bp, Zea mays
  Clone ID: LIB3279-226-Q6-K6-A4
cacaaccgtctcttcaaccagctcctccaacaccacgacgcagaccgaggcgccgagaccaaacacctccaaccgagccgtctcgccgctgtccgcctcccgcctgagtatcatctccagcaagacgtttccttcgatagtttcgcagggagggtacttgtcaagtgtcgaccagttcctgataacgcgccagatctcctcggccgccgagtcaccaccggaaccgttcttgcagttgcagtccaggcgtgatctgccgccgccccaggggtacgcggccagtt

SEQ ID NO: 15603 - DNA, 630 bp, Zea mays
  unsure (1)..(630): unsure at all n locations; Clone ID: LIB3279-226-Q6-K6-A5
ctccactcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtagggacttcatttgcactgtgtgctgtagatgctcgtgtctagatctgtggatnggaatgtgtcctgctctagtttcgt

SEQ ID NO: 15604 - DNA, 594 bp, Zea mays
  unsure (1)..(594): unsure at all n locations; Clone ID: LIB3279-226-Q6-K6-A6
atcgaggacgccaagcttctcttcctccagcaccacccctcggccgccaccgccatctcccttggcccgctagaggctgcaggtcccccaccggctgccttggaattggagtccgagatccaggcgtggcgaggagcgctggaggcctggctgttcgcgcagcgcgcctacgcgcgcgcgctggccgcgtgggcgcgacggtgcctcggcatcagcaccgcggcgcggccaagtagccacgcgctgccgccggcgttcctggcgtgcatggagtgggggcgcgcggtcgacgcggccactgaggcgcgggtgatggacggtctggacttcttcgtcgccggcgtcgggtcggtgtgctcgggcgcggctgccgggatggagggcatggctgggcgcgtgctgtgtgctggcatggcagcggtcaccggcgccttggcggagttcgcggcggcgtctggcgacagctatgacgccgctgtcgcagctgtcgtcgccgcggcgcgtgcgccggagcgcgggaaagagacggcgtgggacaagtgccggaacgctaggaaagtgctgcggcggntgctttgttggttgaccggcccc

SEQ ID NO: 15605 - DNA, 643 bp, Zea mays
  Clone ID: LIB3279-226-Q6-K6-A8
gcaaacactgcccgagacatagacagcgggacgtcgagatggccgacggggaggacgccgccgccgcgcgccgccgggccgccatcacagactaccgcaagaagctgctcaactgcagggagctagagtcgcgcgtcggcaccgtgagagaaagccttaaaactgcaaagaaggattttaccaagactgaggacgacttaaagtctctgcagagtgtggggcaaataattggagaagtactccgacctcttgataatgaacgctttatcgtgaaggccagcagtggtccccgatacgtggtcggttgccgaagtaaagtggacaaggagaagttgacatctggtactcgtgttgtacttgacatgacgaccttgacaataatgcgcactcttccacgggaggtggatcctgtggtatataacatgcttcatgaagatccaggaaatgtcagttactctgctgtaggtggtctgtctgatcagattagagagctcagggagtccattgagttaccacttatgaatcctgaactctttcttcgggtgggaattaagcctcctaagggtgttctactctacggtcctccaggaactgggaagaccctattggcaagggctatcgcaagtaacatcgatgccaactt

SEQ ID NO: 15606 - DNA, 507 bp, Zea mays
  unsure (1)..(507): unsure at all n locations; Clone ID: LIB3279-226-Q6-K6-A9
caagataagagaagtgcaattatcagggctcagggagaggctaagagtgcggagctgattggtcaagccatagcgaacaaccctgccttccttgccctgaggcagattgaagctgcaagggagatctcccacaccatttcggcctcagccaacaaggtgttcctggactccaacgacctgctgctcaacctccagcagctgaatgtatcgagcaagcagaagaaatgatgtcacaacgttatcccctttcttctgagtttgcagtcagtagtggatgcctttgtaccagacattgtgaggaacgctcggttttggatgtagtttcgccaatcttcctgtgatgtggaacttgcgagtatttgctcaaaggcaagcaagctgacaggttttgtttaaacgtgactacaggctgaggaagttttcantnnnnnnaaaaaaaaaaaaaaaaaaaaaaaaaaaaaaaaaaaaaaaaaaaaanaaaaaaaaaaaaaaaaaaaanaannanna

SEQ ID NO: 15607 - DNA, 566 bp, Zea mays
  Clone ID: LIB3279-226-Q6-K6-B1
gtcgttcgctttgccttgccccggcaaagcaatggcgctccgtctctctgctccgttcctcacctcgcgctttacgccgtcgcaagcgttggccccgcgcaggcgcacccgggcccgctctttctctccgtcagccgatgcgcgagccgcgtgcttcaagagaccctacacgtccgttctaattatccccacgggcgtcggcgcggccgtcgggggcttcgccggcgacgcccttccggttgcgcgagccatcgccggcgtcgctgactgtgtcatatcccacccaaacgtgctgaacgctgcgatgctatactggccgatgcccaatacactttacgtggaagggtacgcccttgacaggttcgcagaaggatcctgggctctccaacctgttcaccagaacaaggtttggtgctggattctggaatcgaggaagacctccggctgcgccacttgcagattgcagatgccactagggcttctcttggcttgcctgtagtggagtacattgttacagatgctcctctggagatcaagacatggtttgatcccaggtgtgggaagtc

SEQ ID NO: 15608 - DNA, 220 bp, Zea mays
  Clone ID: LIB3279-226-Q6-K6-B10
cttcgagccccgcctccacacgaacaccccttcggccgttgttgaccaacctcacgcgtcctcctccggtacgtggccaccagttacaatatgctcaactgttgcgagtggaagcaacccgactgttgctgatcaaactgagggcgtcagccattatgttgcttcaaagggtttcatggtttgcgtacgcacaggttgaagtactttgcttgccgctcgc

SEQ ID NO: 15609 - DNA, 659 bp, Zea mays
  unsure (1)..(659): unsure at all n locations; Clone ID: LIB3279-226-Q6-K6-B11
cggacgcgtggggtttttggtgatccgaactcttggatacatggataaggttgctttgatagcccatttcaataaatcaatgaatgagatgaaaaggcagcatgattcagttctgtaccagaggacggaagagatattcaaactgaagcgtgaaatcctgaagaaggatggatcaaacccttttcatttacgaaataacaaagaacttgagcaaacaaggaagaaaattgaggaagtcatctcaaagttggatgtgctcctcctggagaataaaagagcctctgttcgtatcaagtcaaatgcaattcctggtcaacaagataagaacaatgtattaggttctgaaatcgagcaactagaaagcggtgcaagtaataatgaagactaccattgctctattccaactcactcatcacattttgcatccagagaggcagatcatgaactgaatattgtaaggcctcaatttgacgttgaagatgccagaattgcagccacctttagagaagaaatagaaaggattatcataaaagagttcattagtgaaataaacatagaattgcatggttatgagattgagggtggtatgaagcanngaagttgctcaataattcacaatgaggctattgctagagcaatgtcaaacattgattctttgt

SEQ ID NO: 15610 - DNA, 652 bp, Zea mays
  unsure (1)..(652): unsure at all n locations; Clone ID: LIB3279-226-Q6-K6-B3
ccccgcgtccgcccacgcgtccgcccacgcgtccgttcaactacagcagngctgaaacagatagcttccagttagctgaaaaagaacagggtattttggtcaacagagttttgcaggcgccaaggtggatgtagcccagcctccagtagttcagcagaatgcaaagcaaactgttggtcaacaagcatcatctggtacccaggatacaaggaaaggaccatcgataccatttaatatgttaattccaatcctacaggcacatcttgacagagacaaagatatgcagcttcaaactgtttgggcaaaacttaggcgtaatgaagtcaacaaagatgatttcttaagagttatcaggaatattgttggggatcaaatgctcaagcaggcagctcataaagtttttgtacagatgcaagcacaggcgcaaagaaatagccaggcaaattcaagtcagcagtctttattctctcaactttctgcacagcagatggcttccagtggttcagcacagttacatngatcagaaaatcggccacctggaccacccaaccaaggccagaaaaaccaggtgtcatcttcacctcaggcttttgcaccaccatcaggcacccaaccgcagaatagtgtacactatcttgctcatgataaccct

SEQ ID NO: 15611 - DNA, 582 bp, Zea mays
  Clone ID: LIB3279-226-Q6-K6-B4
gctggactgtggtgaccagaaggattctacaagagtgaaaccaacagatcatgatgggagcaatgggggatcgggaaggtctttcaggcatggtcgttcaatgtctccagaagagcacaggcatcggggcaggcatgaatctcatccatcatcgagagtgtccagaagtgcagcacatatcgaggatattaactcgagaggaggtgaagcatcccggaatggagatcctgatgctttggcaacaatgaacgcaactgcagaagctcttgaagcaaaagaaaagcaaaagccatcgtttgaattgtctggaaagcttgctgaggagaccaacagagttgcaggtgtaaatctattatattcagaacccccagaggctcgaaagtcagagattagatggaggctctatgtatttaaagatggtgaaccactgaatgaaccactgtatgttcatcggatgacctgctacctttttggaagagaaggaaagttgcagatgtccccacagatcatccctcctgcagcaagcaacatgcagttcttcaatacagacttgtgggagaagagcaactagatggcatgatg

SEQ ID NO: 15612 - DNA, 662 bp, Zea mays
  Clone ID: LIB3279-226-Q6-K6-B5
ggcagcgccgccgcctcgccgccgccgtccgggaagctgacgcaggaagagctgaagcgcgtggcggcgcaccgcgctgtggagttcgtggagcccggcatgacgctgggcctgggcacgggctccacggcggcgcacgcgctggaccgcctgggcgacctcctccgcgcgggcgcgctgccgggggtggccggcgtgcccacctccctcaagacggaggcccacgcggcgcgcgccgggatcccgctgctcccgctcccgggcgccaggatcgccctctccatcgacggcgccgacgaggtcgacccggacctcaacctcgtcaagggccgcggcggctcgctgctccgcgagaagatgatcgagggcgccggcgcccgcttcgtcgtcatcgtcgacgagtccaagctcgtgccgcgcctcggctgcacgggcgccatccccgtcgaggtcatccccttcggcgcgctccacacgctgggcctcatccgcggcctcttcgacggattgcctggattccacgccaggctgaggactgtccccgccgctcccgccaagggggagaagactcggactcggagtcggagcagcccttcgtcaccgacaacggcactacatcgtcgagatgttcttcgaggacggcatccgcggcgacctgcgcg

SEQ ID NO: 15613 - DNA, 560 bp, Zea mays
  Clone ID: LIB3279-226-Q6-K6-B6
ctcgatctcgcacctagggtttcgtctcgccgctctcgtcctccgcgaagagccgaagaacaagggtaagggaggcaagaaccggaagcgaggaaagaacgaggctgacgacgacaagcgcgagctcgtcttcaaggaagacgggcaggagtacgcgcaggtgacccggatgctcggcaacgggcggtgcgaggccatctgcgtcgatggcacgcgccgcctctgccatatccggggtaagatgcacaagaaggtctggatcgcggctggggacatcgtcctcgtcggcctccgcgactaccaggacgacaaggccgacgttatcctcaagtacatgaacgacgaggcgcgcctgctcaaggcctacggggagcttcctgacacgctcaggctcaacgagggcgtcgacgtcgatgggcccgaggaaggcgaggagggcagcgactacatccagttcgaggacgaggacatcgacaagatctaagaaatctgttcctgcttacggctacctgtattgttacggaacgcgttcttctgcttctgcttgcggctacctttat

SEQ ID NO: 15614 - DNA, 589 bp, Zea mays
  unsure (1)..(589): unsure at all n locations; Clone ID: LIB3279-226-Q6-K6-B8
tgaggaggtgattcccctgacgcagtcgccgtggatgaggatggggatctcgttctggaccggaggagaagaaacaaatatgctagaggtgaccgccatctgttcactattcagcatggtgttaccagctcgcttaagagcgttgggcttcagccgtgcaggtttggaaagcggccttactattatctgactttattctgcacgaaagcttttcatcgccaaactttgatggtgttactgccattgagataggtgctggaacaggtttggtaggtttagcactagctcgagttgctagaaggatttttgttacaggttcgatgaagctaaagtctgtgtacgagaactggactggaaaatggcatggcctccacctgtgggtacatatgacccttctgatccaagtcggtatttatggtctgcaagtgaagttgaggaggctgagaaagcaacagtcctgtttgctgcagatgttatttacagtgatgatctcacaaatttgttcttcaacacggtgaagaaattgatgtcggntcggtgctaagaaggtgctatacttggccctggagaagagaacaacttcagtgta

SEQ ID NO: 15615 - DNA, 614 bp, Zea mays
  unsure (1)..(614): unsure at all n locations; Clone ID: LIB3279-226-Q6-K6-B9
gttcgtcccgagcgatccggcaaccatgaacatcttcaanaagaaggtcgaccccaaagaggctctcaggaccagcaaacgtgaaatggcggtcgccacgcggggagttgagagagagattggttccctgcaaatggaggagaaaggctggttgcagagataaagaagactgccaagactggaaatgaggctgcaaccaaaatattagctcggcaacttgtcaggctgaggcaacaaatcctcaatttgcaaggcacacgggcacagattcgtggagtagctactcacacacaggcaatgtatgctggcacttcaatctctgctggaatgaaaggtgcaagcaaagctatgtcagcaatgaacaagcaaatggaaccggcgaaacagataaaggtcatgaaagaattccagaaacaatcaacacagttggacatgacgcttgagatgatgtctgatgctattgatgaaacacttgacaaagatgaggcggaggaggaaacagaagagctcacaaaccaggtccttgacgagattggcgtcgatgtggcttctcagctctcttcggctcctaaagggcgcatcggagctactaacaagaaagtcgataacggtca

SEQ ID NO: 15616 - DNA, 646 bp, Zea mays
  unsure (1)..(646): unsure at all n locations; Clone ID: LIB3279-226-Q6-K6-C1
catanatgaaaaaaccagcttgttgctgttcaattgacagttgatctcaaacctaacattccaagcgaagcgcagagaatcaggcaacgcaggggcagaatatttgcgcttcccgaggagccggaggttgctcgcgtttggcttccaaagtacaactcgcctggactggccatggctagggcatttggagacttctgtctgaaggaccatggtgtaatttctacgcctgacgtctcctatcaccacatcacggagaaagacgaatttgtggtgctggctactgacggggtctgggacgtgctatcaaacgatgaggttgttagcactgtctgccgagccacatctcaggcctctgcagcccggtttctcgtcgagtcggctcaccgcgcttggcggactcggttccccacttctaagatcgatgactgcgccgttgtctgcctgttcctgaacacagacaaagcgagcgaatcgtcgagttctttggccaagaacttggcagatgctgtagaagttagcagtgccgggcgcgccacaactgtccaggtgagcgctggtgcatctacagatgttgccgccctggtaccagtaccagatgggaacgaggtgtctattgctgaaacctcacaaagctggtcacgctcat

SEQ ID NO: 15617 - DNA, 535 bp, Zea mays
  Clone ID: LIB3279-226-Q6-K6-C10
gcacaacggcacgattctcctcctccgtccgcgtagctctcggtttcggcgatgtcggggcgcggcaagggcggcaaggggctgggcaagggcggcgccaagcgccaccgcaaggtgctgcgcgacaacatccagggcatcacgaagccggcgatccgtaggctggccaggaggggcggcgtcaagcgcatttctgggctcatctacgaggagacccgcggcgtgctcaagatcttcctcgagaacgtcatccgcgacgccgtcacctacaccgagcacgcccgccgcaagaccgtcaccgccatggatgtcgtctacgcgctcaagcgccagggccgcacgctctacggcttcggcggctaggccgcctccccttctgatgctttgatgtgacggccgtggtcggttgtgtgtctagttggccggtctactgtagtttgttctgtatcttcgtttcgaggtgttccagtttctagcccatttggtgtaatattttcactgctattatcaatggaaagccctcggttctatcccc

SEQ ID NO: 15618 - DNA, 660 bp, Zea mays
  unsure (1)..(660): unsure at all n locations; Clone ID: LIB3279-226-Q6-K6-C11
ccggtacagccgcagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgctcaccaaagttatcctcccctgcctgctgcgtgctatgtctgaatcgtgaacaaccgttgtcatttcatgtgtgtaccccgtgcaatgctttgtgcgcatggttgatttctctgtggcaaacttcccgtcctgcatggggttgtaagctgtctctaaatttcacggcagtcgtgtgcctgaaccttcatcttaagttgttgtcgtatcccttcgtcttgtttcgttgcaccccgtgatggtatgnattggttgct

SEQ ID NO: 15619 - DNA, 255 bp, Zea mays
  Clone ID: LIB3279-226-Q6-K6-C2
ggtgagtaaggtataattttcgtcactattcttttacagtctatgttggatactgtacctactttactaaatagcaaaaagcaaacatatgaacaagggcggtgctacaactactgcgttgtgttggatgtaaagccttgatatattatcactttcccatgtagttgtggctataggcgggttcttttcagtgaacatattgtctgtttcagcgttcttgctggatggatagtaaatggctgtaccatttggttg

SEQ ID NO: 15620 - DNA, 582 bp, Zea mays
  Clone ID: LIB3279-226-Q6-K6-C3
cttccggccggtcttcgtttcgacatccaggaaatggctaccgcggcgcgcctcctcctcgtcgtggtgcttctctccgcggcgataccgatcccgtccttcgcgacaagcttcgtcgtcggcgacaagaggcatcgctgggctcccaacgtcaactatacagactgggcggaccgtcaccagttccacgtcggcgactggctcgaattcaggtacgagagggacaggttcgatgtggtgcaggtgaacgagacggcatacgcggcgtgcgacgccagcagccccatcctcagctacagccgcggccacaacttcgtcttccggctcaaccacacgggccggttctacttcatctgcagccgcggctactgctggagtggcatgaaggtctccgtgctcgtccagccgccgccgccgcccccgtcgctgccgccggcgtcccactcccacgcgtcaagcgccagtgcgcgtgtgcggccggcggccgggctttggtgtgcggctctctctaccttgctgggctgggcggtgctcacgcccccgctgtcgtttcgggtcttgggttcttgccgtcctggcgcg

SEQ ID NO: 15621 - DNA, 597 bp, Zea mays
  Clone ID: LIB3279-226-Q6-K6-C4
gggcgcggcccctggcgtcgcaactccgcgtgggcgcggcctccggcggctctgccaggcgtccatcgacaagggcgggcggccagggcgggcgcgggccccagcacgcgagccaggcggccctcggccagggcgggcggccatggcagcgcggcgaccctcgtccccggctccggcgcgcgcggagcgcggctccgaacatgtgccggcgtggcctcgccacggcctggcggctcgcaggcgcggcccctgcctcggccccatggcggacgcggctcccagccccggccccggcggcgacggcctctagccgcggccccggcggcccctggcagcgggactgcccggcgcgggcgcgtcccctagcagcgcgggcgcatcccccggttgcctaggcgcgaccctctacggcgagcggtaacggcggctgcggggcagtagccagtacgtgcgggcaccggcaacgcgggcacggtggcccggccacggctgcgcgggcgcgttcaccggcgcgcacgagcgcgggctcggctgcccgggcagtgcggcggttgtgcaggcgctccctttggcggtgggtagctcgggcgtgccccc

SEQ ID NO: 15622 - DNA, 646 bp, Zea mays
  unsure (1)..(646): unsure at all n locations; Clone ID: LIB3279-226-Q6-K6-C5
ggcgcctcccacgtctccagtccgacactccgactcactccccctcccccgccccaacccgtcgcaatggccgccgtctccgcagccccgaggccctcgatgcctccccgactcgccctccgtgcccacctcttctcctccgcctctccgctcccaatgcgcgcgctccccttactccgcagccgcttccgctccttgaccacggcctacgctgtcaagcaggacacggccctctggacccctgcacccgtctccgccatcagtgctgccaccgacgacggctccgtctccctcatcgccgtcgacctatctgacgccacggacctcgtggactcgtacacgaacccgggccaatacctcctgatccgcgtacccggcgaggagctcaagccggcgtacatggtcatctcctcgccgcctaaagcggggccccggttcgaattcctcgtcaaaagcgtgccgggagctaccgcggggcggctctgcgccctccgagacggngatgttgtggagctcggcgccgtcacggggaaggggttccccctcgacaggataaatccgcccgacgtcgcgcagaccgtgctcatcttcgcggcggngacggngatcagtgcgattcgatcacttatcgagttcggtttcgctg

SEQ ID NO: 15623 - DNA, 651 bp, Zea mays
  unsure (1)..(651): unsure at all n locations; Clone ID: LIB3279-226-Q6-K6-C7
ggtatcttcgctgaattcagcggcgaccgatttacaaacttcatggaggtcgcagagaagctgaggtctgactacgactttggccacactttgcatgccaaccacctcccacgtggtgatgcagcagtggaacggccattggtcaggctgctgaagccatttgatgagcttgttgttgacagcaaggattttgatgtcgctgcactgatgaagtttattgatgctagcaccatccctagagttgtcacttttgacaagaaccctgacaaccacccatacctcatgaaattcttccaaagctcagcccccaaggctatgctgtttttgaacttctccaccggaccttttgattctttcaagtctgcctactctgctgccgcggaggaattcaaggacaaggaaatcaagttccttattggtgacatcgaagccagccagggtgccttccagtactttggcctgaaagaggaccagacaccccttatcctcatccaggatggtgactccaagaagttcttgaaggttcacgttgaggctgaccagatcgtctcttggttgaaggagtactttgacggcaaattgactccgttcaggaagtctgagccttattcctgagtcaacaatgagcctgttaagggtnnggttgttgct

SEQ ID NO: 15624 - DNA, 661 bp, Zea mays
  Clone ID: LIB3279-226-Q6-K6-C8
cggagagttctttcgtggaggaggaagggggggacagcaggaggagggtagaggtagctcaatagatctactgctgtcgggggagttaatgcaaagctgagttgctgcacgttggctttcttcagagatggcttcagctggtgtagccccatctgggtacaaaaacagcagcagcactagcattggtgccgagaagttgcaagatcagatgaacgagctaaagattagagatgataaggaagttgaagcaaccataattaatgggaaagggactgaaactgggcacataattgtcaccactactggtggcaagaatggtcaaccaaaacagacagtgagctacatggctgagcgcattgtaggtcaaggttcttttgggattgtcttccaggctaagtgtttggagacgggtgagactgttgccataaagaaggttcttcaggataagcgttacaagaaccgtgagttgcagaccatgcgccttcttgaccaccctaatgttgttgctttgaagcattgcttcttttcaactactgagaaggatgagctttatctgaacttggtccttgagtatgtgccggagacagttcatcggagttgtgaagcatcacaacaagatgaaccaacgcatgccacttatttatgtgaagctgtatatgta

SEQ ID NO: 15625 - DNA, 619 bp, Zea mays
  Clone ID: LIB3279-226-Q6-K6-C9
cggccgcgtgggcggacgcgtgggcaactcccaagtcccttttttttctcgatctggaagcgccgcagtagcagccatggacgtgagcggagcaggcgggaaggcgaagaagggcgcggccgggcgcaaggccggcgggccgacgaagaagtcggtgtcgcggtcctccagggccgggctgcagttccccgtcagccgcgtcgggcggtacctcaaaaagggccggtacgcgcagcgtgtaggcacgggtgcccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgaggagctcggcaagctgctggccggcgtcaccatcgcccacggcggcgtcctccccaacatccacactgtgctcctccccaagaaggtggccgagaaggcggccaaggagcccaagaaggccgccaagtcccccaagaaggcgtagagtgatctcctgtcttacaacatattaccattagcggccgtgcagttagactagaacatgtttagtgtagatccagcatgttcttgttcc

SEQ ID NO: 15626 - DNA, 326 bp, Zea mays
  Clone ID: LIB3279-226-Q6-K6-D1
cgtagatacaccatacgttcagaattgagttgttatcgacttctgtaatgtttcaccatcacattgggataagtcgaaaaggagaatcacgagtctgagacaccgcgtgaatggagggaaggaggaagacattggaagtgcgcctaagttcagaacaagtggttcatgtcctacgcccccccccccccccccaaccggttgtatttggatggctgagtcctgctgcacattgcattctgaagaacattcgtagtctttttgttttgtaaatattttggatctataagataaaggaagcggtttggaacttacgcaaattctgatac

SEQ ID NO: 15627 - DNA, 467 bp, Zea mays
  Clone ID: LIB3279-226-Q6-K6-D10
ctttttagaaatgggctttgccggtgtcaatgtgcagccgctccctgggaaggacgggcagaggtcggtgcaagctaagttctccgccagcctcgatggtctgaacaacgcgtcacggctcgccgagttgttcgagcgccaaggccacgggcgagcagcctgggctcgcgtccggagcgccgtccccacaggcggtgggggcgataacaaccccatgctggtcaaggtggatggcaagggagagcggacatgggtcctctacggttaccttgccacggcatgggacttgaatgtcctggacccagagtcgaagcagaacgccactgtgaagagcaggaaggaactggatttagattaggaccacctgaatacctgatcctgctagagttgtgcatgttacctgacgagttatgaatccatggactgtgattcgagtgtttgtgttcacggcacagcatttaagttct

SEQ ID NO: 15628 - DNA, 520 bp, Zea mays
  unsure (1)..(520): unsure at all n locations; Clone ID: LIB3279-226-Q6-K6-D11
ctcgtcgccctcaattcttccgtccagcaggaaaaatggcaccaagagggagaagaggctcgtacgaagcagaccgcccgcaagtccaccggaggcaaggccccgcgcaagcagctcgccaccaaggcggcgaggaagtcggcgccgacgaccggcggcgtgaagaagccccacaggtacaggcccggcaccgtggcgctgcgcgagatccgcaagtaccagaagagcacggagctgctcatccggaagttgcccttccagcgcctggtccgtgagatcgctcaggacttcaagacggatctgcggttccagagccacgccgtcctggccctccaggaagccgccgaggcctacctcgtcggtctgttcgaggacaccaacctctgcgccatccacgccaagcgcgtcaccatcatgcccaaagacatccagctcgcccgccgcatccgcggcgagcgcgcgtaggcgtatctcgcgcccggccccagtggcggcggagggatggnaggagtgcaatttg

SEQ ID NO: 15629 - DNA, 524 bp, Zea mays
  unsure (1)..(524): unsure at all n locations; Clone ID: LIB3279-226-Q6-K6-D2
ccatctcgtcggcgcccttagcgcggnaagttgccgttcacggcgccgcccccgggatcttctccagataccgaggatggatcatgaagccagcgggctacgacccctgcacggcggagtactcggaggtctacttcaatcggcccgacgtccaggcggcgctgcacgcgaacgtgacaaagatcggctacaactggacacgctgcagcgatgcgatctacacttggaacgacgccgccttctccaccctccccgtcatccgcaagctggtcgccggcggcctcaggttgtgggtgttcagcggcgacactgacggaaggatccccgtgacgtcgacgaggctcaccctccacaagctcgggctcaagaccgtccaggagtggacgccgtggtacgaccatctgcaggttggtggatggacgatcgtgtacgagggcctgacattcgtcacgatccgcggcgctgggcatgaggtgcctttgtacgcgccgcggcaggcgcgtacgctcttcagcaacttcctg

SEQ ID NO: 15630 - DNA, 595 bp, Zea mays
  unsure (1)..(595): unsure at all n locations; Clone ID: LIB3279-226-Q6-K6-D4
accagccgccgccatgtcgaagcgaggcaggggaggttcggcggggaacaagttccgcatgtcgctgggtctgccggttgccgcgacggtgaactgcgcggacaacacgggcgccaagaacctctacatcatctccgtcaagggcatcaagggccgcctcaaccgcctcccgtccgcctgcgttggcgacatggtcatggccaccgtcaagaaggggaagcccgacctcaggaagaaggtgatgcccgccgtcatcgtccgccagcgcaagccgtggcgccgcaaggacggtgtctacatgtacttcgaagataatgctggagtgattgtgaatcccaagggtgagatgaaaggttccgctatcactggacctatcggcaaggagtgtgctgatctttggcctaggattgctagcgcagcaaacgccatcgtttgagagcttgttggaatatgttcagacttctatatgatcatcttattatcagttgctaagagtgctattgggcttaatgggccctntatgtttgttcactcaattttgtagtaaacagaatttggtataccaagggggatctatatatcaatgtatgccata

SEQ ID NO: 15631 - DNA, 535 bp, Zea mays
  unsure (1)..(535): unsure at all n locations; Clone ID: LIB3279-226-Q6-K6-D5
ccccgcgtccgccgnctacgagcagagcgaggccatcctctggggaatccaccggctccccgttgattcctctctcggaattctctgaccctatcatcgcgaagaaatatggagcaaaacccgacatgggaaaccttggacctcctgaacactacagctacccagaagaaattatggtggttgtgaaagtcctgtggggagatccgcgtgagaagctctgtcaagttatccatgacaccccgttgagctgcttggttataggaagcaggggccttggcaaactcaagagggtgctcttaggaagtgtcagcgattacgtcgtgaacaacgcaacctgccctgtcaccgttgtcaagtcatcaagcaccgaaggttgatctcatcaccgaaatgcctgaatattgctgttgttataataaaagatggttggcctcatgaagaacatgcactagtttctagctacctgaaacatgttgaaccgggcaatcctattgtaataatagacaaagtgccttatgaagggcatggnttatgt

SEQ ID NO: 15632 - DNA, 529 bp, Zea mays
  Clone ID: LIB3279-226-Q6-K6-D6
gcagaatctaaagctgtgtctgatgaacatgcaatatgtcaccgtatggtattggtatgtgggacatcaacctgcccatggctgtttcaaaggacagattgtttatacctggtgtctgggggccgttttggtctgcgatgatccctgagttttggctcacaaaagggggccaaagtgcaactggcgctctgctcgattacattattttaaaaccatgttgcttctcctcttctttctaaccatgctgcttctcaaagtatatccatatttgagctactgaacaagatgttgctttctatgtcacaagagcagaataatccgtttctttctgcattaactcaagacacccatgtgcttccggattttcatggaaataggtctcctgttcctgatccaaaatccaacagagtgatttatggctcgacactttttacaactggagaagcatttagctcttctattcctagcaacaatacagggtattgcttatggtactcgttcatattgtggcagcattgtaatgttcatg

SEQ ID NO: 15633 - DNA, 636 bp, Zea mays
  unsure (1)..(636): unsure at all n locations; Clone ID: LIB3279-226-Q6-K6-D7
cacgcctcctcggcaaggttgcgtacggcgtggccctaaggcataccagcgggatcaagctattttgctggccaaccgaacggtcaagccgacgatgacgctcggatcggcggcacacaagatcccgctggaggttgcgcacaccctcgtcgagatcgccgaggtcgcgcgctacgcctaccaccaccgccccggccgccctgcaacccacgagggggacccgactgcgccgcccgcaggggctgatagcagcgggggcaccaacgaggatgccgcgcggctgctggaggagaacgccatgctccgcgcccgactcgcagatgacctcgcgctcctgcgtgagctccacggcgcgccctgcgtctccaaggagtgccctcctgatctatacaaccgattgatggcggcggtcaacaatgttagcttccttgctcatctcgagaaatacaggatgagtcagcacgtcaacttaatgaactaacttctggcgacatgacagaggtggaagctgcagacattccggacaaagcgggtaacgggaagaaaggatngtgggtcttggtcccttgtgatacagctggagctaatttggaggaaatagtgggattgatgatgaaaattatgtcatagtaaatg

SEQ ID NO: 15634 - DNA, 524 bp, Zea mays
  Clone ID: LIB3279-226-Q6-K6-D8
aaaaaccccatcgttccccttctcgcctccacgagccttcacaaattgccctctcagctcttctcctaatctcactctagccctagccaaatcccagacccatcccagccctagcgacaccaaccagctcgccagcgaccatggggaacccggagaagctgatgaatcagatcttcgacctcaagttcacctccaagtcgctgcagcggcaggcgcgcaagtgcgagaaggaggagaaggagcagaagctcaaggtcaagaaggcgatcgagaagggcaacatggacggcgcccgcatctacgccgagaacgccatccgcaagcgcaccgagcacatgaactacctccgcctcgcctctcgcctcgacgccgtcgtggcccgcctcgacacgcaggccaagatgcaggtcatcggcaagtccatgcagtccatcgtcaagtcgctcgactcctcgctcgccaccgggaacctccagaagatgtccgagaccatggacaatttcgagcgccagttcgtcaacatg

SEQ ID NO: 15635 - DNA, 540 bp, Zea mays
  Clone ID: LIB3279-226-Q6-K6-D9
caacaccgcatctcaagcgcaaaacctcctcgcggctatggcgaagcgtctgatcccgtcgctgaaccgggttctggtggagaagctgctgaagcccagcaagagcgccggcggcatcctcctcccggggaccaccaaccagctgaacgccgctaaagtcgttgctgttggccctggtgatcgtgatagggatggcaagctgatccctgtatctctgagcgaaggcgacactgttctgcttccggagtacggtgggacagaagtgaagcttgcagaaaaagataccttcttttcagagagcacgacatactggggaagctggaggagtagctctggtcgctggaccgttaaaatggagttgtttgaaagtaggtatgcaagagttttgccacggcttatcttttgtttttgtgtgtgcggggggacaagcgagaaacccaacccttgtgagaattcaataacactgcctcattcttgacatcatcatttgggatgtcaccatgcttcatctgataaatgccttggaagtagttacattca

SEQ ID NO: 15636 - DNA, 620 bp, Zea mays
  unsure (1)..(620): unsure at all n locations; Clone ID: LIB3279-226-Q6-K6-E1
ngananaacactttagttacatcatgatcaacatgtcgcgttaggatatcttttatctttgaaagtataatgtgttacctaactacaaggtgatcttcgtctctattagctttnatgataaaaaactaatgttataattagagtcaaatgttatcattaaatgcatatagataggactgtacttgtgttggactctaggcttaacctatgtatatatatgctagcattaggatctcatattataataagtattattttaggatgaccatctgattggtgtggctacgtcgagcgcccgctacatgactgcaacattctagtggccgatgttgttgactttagtcaaatcacgattggagtagtttcccaatcggagcttgggacgatagggctcaaaaccctcacgcgcgaggtgatgggcatgctcatcgacacacccaagcatgtgacgcttggcaggtgggcaagacgtctgttagcctccacaagtctggtatgccgtcgttgatgtctatgggttatacaaggttggttgtctgttgttcacgatggagcgcacacaccgccgatagaaggatgttgtcatctattttcctgcggttgttgttagagcatctcaa

SEQ ID NO: 15637 - DNA, 611 bp, Zea mays
  unsure (1)..(611): unsure at all n locations; Clone ID: LIB3279-226-Q6-K6-E10
ccgctcccacacaanaagagagccgagagctagctacctagcgcgcgatggcgatgtccgcttccaagatgatggcggtcgccgccgctgccctgctagccctggtcctggccgcgtcgaccgcggaggcgaggaacatcaagacgacgacgacgacgacggagaagaaggacgatgcggtggtgcagccgcagaccttcccgcccttcgaccgcctcggcggcggcgcgtccccggcgtccggtggcctccccggcacctcgtcgggcggcagcagcattccagcgttcagcatgccgggcagcggcagcagcctccccggcgggtcgttcttgcccggcagcagcggcagcatcggcagcatgcccctcttcagcggcggctccccggccttcagcggcttcggcggcatgcccgggtcccccgccgccggctccgtctccgtcgtccccgtgcacggcagcaagccctgaaaatccgtccgtcgccggagcccggaagtctgtcgggccaacttgtgccctagtactcctttgcctgcattgtattggagagttggtatcgcgtttcgtttggtgtttgctttgttattataggccggctatctaccg

SEQ ID NO: 15638 - DNA, 590 bp, Zea mays
  Clone ID: LIB3279-226-Q6-K6-E11
tctagatcgcgagcggcgccctttttttttttttttggaacataagtgatcaacaacaaagtgttgatgattcacaaataaacaagtccttgctgggttacatgacgcagttcctacagaagcagagcagcgccgacagagaaaccagcaacatctaactacaacacaaggcgaacatcaacacaagagaagcctacaaagggcgagcgtgcaagcctaggaggaggtgaacttggtgacggccttggtgccctcagagacggcgtgcttggcgagctcgccggggagcacgaggcgcacggaggtctggatctcgcgggaggtgatggtgggcttcttgttgtagcgcgcgagcttggcggcctcgccggccagcttctcgaagatgtcgttgatgaaggagttcatgatggacatggccttggaggagatgccgatgtccgggtgcacctgcttcagcaccttgaagatgtagatcttgtacgtctccacgctcttcttgcccttcttcttgccacgcttgccctcgccgccctccttgccggcggacttgccagcggggacccgcttctccgccttgggcttcttcc

SEQ ID NO: 15639 - DNA, 330 bp, Zea mays
  unsure (1)..(330): unsure at all n locations; Clone ID: LIB3279-226-Q6-K6-E2
cggtcgcgtgggttaagcccagcgctgnctagnanacaaagtcagagatgcattattgagacttgtggagaatgatgaattcgtcgatttagtctaccgcgagatcatgaacagacagtaatggatttacaaggtacagtcatctccatcaggctagcttgtgtttggagtctgtcattatctgttgtttagcctattccaagttatcctgtaaattattattgataaaatccttcggttggtggtgtttgtacaattaatgtactttctacatctgtataaatggttataaaatctgtgctgtattcgtggcgcagaaaagttttgttc

SEQ ID NO: 15640 - DNA, 290 bp, Zea mays
  unsure (1)..(290): unsure at all n locations; Clone ID: LIB3279-226-Q6-K6-E3
aaccccatccttgnactagctccgntnnctggtaccgagaatggcccggcaagaatgaaaggggagttagnnacggcgccccagccctttgccaagnnatcttcatnntggcgnnggctctccaagggatacccaagcatgnnagtacattttcaaagnaacccattttgggnnaagtattggggtattttaatnntgatgggctgtctattaatggaaggggaccggtttcacacccataaagcccagnagggcctttggcgtttnnttgnacttttgcnntgatccca

SEQ ID NO: 15641 - DNA, 624 bp, Zea mays
  Clone ID: LIB3279-226-Q6-K6-E4
gtcctgacaatttctctttaaccaagtcaatcttcatttgattcaaaagtaaagaacgtatctcggttttcagctttcacggacaattttgtagccatgtaatgctcaacacttccttcaagtgcaccacattctttaaccaaattcatcgccttcttgattgactttatctttaattctccctctaggaccctttttgcagcatcactattagactgcaaagttccccacatgcccctcataagcttcaacatagggctttgtcctctctttaatggacttgttgcagtactagtgatgcatgtccgcttctttcttgctccactagctggactgacaatatcctcatccaagtcatcaccttcgtcaccttcattcatatgctctacaggaatacaagacgatgaaccaacaacaacattgtgctcatacatttgttgaagttgatcatgattttcaggtggtccatattgtaacttcttccattcagagtgatcctggcaaaatcagaatgattagtacctttgtgtgtcacaaaaaacacaaacagaaggcacgcttcatgagtacctttgtgttttcgctccagaaagcttcattagcaacaacagtaccatttgcccg

SEQ ID NO: 15642 - DNA, 493 bp, Zea mays
  Clone ID: LIB3279-226-Q6-K6-E6
ccctcttgtcacagcaccccccaccccacacacccaaggccccaactgcagtgcccatccggcagtcaggtcgatggcggcggaagcagcggcagcggggaaggagaagatgcggacgctagtcagcagcgacttcaagaagttcgatgtggaggagtctgtggcgagggaatcgctgattatcctgaacctgatggcggactgcgacgacagtgacatcccggtcttcaacgtcaacgccaagatcctcgacaaggtcatcgcgtactgcaggaagcacgcctcggcgccgcgcgccgatggcggtgatgcggagccaagtgctgcgagtaacaaggcctcagcggacgatctcaagtcctttgatgctgagttcgtcgatgttgacctggtcaccctcttggagctcattaaggctgcagactacctggagatcaatgggctgctagacctgacctgccaggccgtcgcggacatgatcaaggggaagact

SEQ ID NO: 15643 - DNA, 606 bp, Zea mays
  Clone ID: LIB3279-226-Q6-K6-E7
gctcctcacgccgccgccgccgccgccgccgccgtcgccgccaccacatccgtagcgcccagccgccggagaagaggagggagccagcaccagccaccatgggtcgcgtccgcaccaagaccgtgaagaagacctccaggcaggtgatcgagaagtactactcccgcatgaccctcgacttccacaccaacaagaaggtgctggaagaggtctcgatcctcccctcgaagcgcctccgtaacaaggttgccggcttcaccacccacctgatgcgccgcatccagcggggcccagtccgtggcatctcgctcaagctgcaggaggaggagcgggagcgccggatggacttcgtcccggagaagtcagcgctcgaggtcgaagagatccgcgtcgacaaggagaccatggagatgctcgcggcactcggcatggccgatctcccgggcgtagagcgccaggctgaggtctccagcgtccccgcctacggccgcccgcagtacggaggtccccgccgtgaccgcgtctaggtttaccgccgatcgcagtggttgcgtcgtggtcgcaccgttactcacagttgttatgttactatgttaaacttgtttt

SEQ ID NO: 15644 - DNA, 524 bp, Zea mays
  Clone ID: LIB3279-226-Q6-K6-E8
cggtccgaaaccccggtcgacccagcgtccgcggtcgcgtgggcggacgcgtgggcggacgcgtgggcttctgcaggtggtccggcagcgagagaggctgtaccacctgcaggacctggtgtgcgtgcgctgcaggcaggtgaaggccgcccatctgtcggagcagtgttcctgcgggggctccttccggtgcaaggaggagccttcgtatttcctcagcaaaatgcgggtgttcctgaaggtggcggtgagccaaaagttcccgctcctgcaggactgcgtgcagtggattcttgaagccagatgacgcgggctgctacttcaacatagttcattagttcacctgatcgctaggttgtacaacgtgcacaggctgtagctccgaagagtgtataaacgggtgtatagcgctgccacagttcattgtagctctgccctgcttgcaaaaggttgttgttgtattgtagatattcaaaggtggatggcgagaaacgatagtaaccttggtatcgaaacatctggat

SEQ ID NO: 15645 - DNA, 526 bp, Zea mays
  unsure (1)..(526): unsure at all n locations; Clone ID: LIB3279-226-Q6-K6-E9
ccccgcgtccgcgaccacacaaactgacggaactgctctcagctctcctcacgcggtcacgccctgcagaacgcagggctaaacccccgtctttagcccctgctgccgcttgccactactccgcttcgttctccgccgcctccccggacgtccggaaacttctagattgaaggggatagccattggcgtcaacgtgtgtgatggaggtcaggggactggggcagctcctggcggcgctggccgcggcgttcttcgtccgcgccatcgcgggacccggccccgccctccttccgccggcggaggacacggaggccgacgaggccgacgcggaggctggcgagggaggtggtgggtggtgtgccgcccgtgaccatccggtgggctcgcatcacctgtgcattgaagaacaagcgcgggngaagtggcaagggtttcttgttgtcaaatgtgtcagggggaggccgaaaccggggaggcctgcttggcacttaatgggggccattcgggctctgggcaaaaacaactt

SEQ ID NO: 15646 - DNA, 665 bp, Zea mays
  Clone ID: LIB3279-226-Q6-K6-F10
cggtccaggtaagcagcagcaggaaccctagcaccgccgcatccgcagccatgggtatcgacctcgttgccggtgggaggaacaagaagaccaagcgcacagcgccgaagtccgacgatgtttatctcaagctccttgtcaagctctaccgtttcttggtcaggaggaccaagagcaacttcaatgctgtcattctcaagaggctcttcatgagcaaaaccaatcgcccaccaatctccatgcgccgccttgtcaagttcatggaaggaaaggagaagaacattgctgtgattgttggcacagtcacagatgacaagaggatccaagaggttccagcaatgaaggttactgccctgaggttcaccgagacggcaagggccaggattgtcaatgctggtggggagtgcctcacatttgaccagcttgctctccgtgctccacttggcgagaacacagtcctcttgaggggccccaagaatgcccgtgaggcggtgaggcacttcggcaaggctcctggagtgccgcacagccacaccaagccatatgtgcgctccaagggaaggaagttcgagagggctcgtggcaggaggaacagccgtgggttcaagtttaaagaaaagtgtggccatcagcatagtaatcactttctaccgagtagtagcaca
